United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 12

SEQ ID NO: 46494 - DNA, 627 bp, Glycine max
  Peptide Sequence Number=SeqID_163272
atggctacctccaagttccatacccagaagccactctttgttgttctatctgtcgttgtggtgctactcaccatgaccaaggtaaactcaacaaaaccgtttctatcacctgggacaacgaggtctcttggtcgcgccctctactccacccctatccacatttgggacagcgaaatcggcagcgttgccagcttcgccgcttccttcaacttcactgtttatgcgtccgacatagcaaatctggcagatgggcttgccttcttcctcgcaccaattgacactcagcctcagacacgcggagggtatcttggtctatacaacaatccatcaaactcgtcgtggggtttagccaacgaccaagtaaccaatgttctcattacctatgatgcctccaccaacctcttggttgcttctttggttcatccttcgcagagaagcagctatatcctctccgatgtgctcgatttgaaggttgctcttcccgagtgggtgaggatagggttctctgctaccaccggactgaacgtagcttcggaaacgcatgacgtgcattcttggtctttttcttccaatttgccattcggtagcagtaacactaatccttcggattttgcaatctttatctag

SEQ ID NO: 46495 - DNA, 912 bp, Glycine max
  Peptide Sequence Number=SeqID_163273
atggctctctgttctccaagattcctcaccctcctcctactcctctctgccatacccatcggaatcatcgtcactttggagcgagcccaacccgccacccacgtctaccactaccacagttccggctggttccgagaatgcgccaagtgggattctcatcatcgccgcttcattgtttccttcttcgaaggtggtcttggtcaggttaagctgccggagaaggattccgagtcgtcctcgtcatcgccgccgttggaggaagtcacggtggtcagagatgcacacttggccggaaatgcgtcattgggcatcgccattgacccacccagaaatcgagtcctcgttgttaacgctgacgtcatcggtaatcgatacggtgcgcttgcagcatacgatctctccacctggaatcgcctctttttaacccaacttagctctccaagtgatgagaaatctttcgcggatgatgttgcagtggacgcagaaggcaatgcctatgtcacagatataaaaggcaacaaaatctggaaagttggggtggaagggaagcttatatcaatcattagaaacccgttgtttagtgcaaaagagtggtataagaacttggttgggctaaatgggatagtttaccacccagatgggttcttgattgtgattcacactttcagcggcaacttgttcaagattgatttaacaaaaggagaggaagtgaagataataaaggtaaagggagggactctatcttttggagatggtttggaactactgtctcctactaagcttgtagttgctgggaatccttctgggagattagtggagagctctgatgggtggaacacagcttctgttgtgggaacattctcagggccaaagcatcgcttggcctcagcagcaactgtgaaggaagggaag

SEQ ID NO: 46496 - DNA, 1206 bp, Glycine max
  Peptide Sequence Number=SeqID_163274
atgttctactttttctttgaatcacggaacaataaggatgatcctgtagtgatatggttgactggaggaccagggtgtggaagtgaattagctttgttttatgagaatggtccttttcatattgccaataacttgtctcttacatggaatgattacggctgggaccaggcatcaaatattttatttgttgaccaacctacgggtacaggtttcagttactcttctgaggaaagtgacattcgtcatgatgaaacaggaattagcaatgacttatatgacttcttgcaggagtttttcaaggcgcatcctgagtttgttaagaatgatttttatattactggagaatcatacgctgggcactatgttccggcacttgcatcccgggttaaccaaggaaataaacaaaatcaaggaatccatataaacctcaagggttttgctattggtaatggattaacaaatcctgcaattcaataccaagcttacccagattttgcattagacaatggaataattacaaatgctgagtacgataacatcagcaagttaatcccagggtgtgaacaagctgctaaaacttgcgaaaatcaaggtggacaaagttgcgcgactgcgttatatatttgtcaaaacatatttagtcttatcctggattatgctggcaacattaattttactaattgcactgtgctgatacacaaagtgcagtactatgacatcagaaagaagtgtgtgggagaattgtgctatgacttcggtaacgtggaggagtttttaaaccagaagaaagtgaagagtgctttaggtgtgagggatgacttgcagtatgttttatgcagtacaacagttcatgctgctatgcttcaagattggatgagaaacatggaagtggggattccttctcttcttgaggatggaatcaagttgcttgtgtatgcaggggaagaagatctcatatgcaattggcttgggaattcaaggtgggctcatgccatggagtggtcaggccaaaaggcctttggaacatcttctacagtgaaatttgtggttgatggtgtagaagcagggtctcttaatagctatggacctctctcttttctcaaggtgcatggggctgggcacatggtccctatggatcaaccaaaagttgcacttcaaatgttgaaaagctggatgggagggaaattgaatgcctccttctattag

SEQ ID NO: 46497 - DNA, 2255 bp, Glycine max
  Peptide Sequence Number=SeqID_163275
gatctgttggtaataaggacaaagtgaacaccgcagcaacagcacctaatttgcctaatgatcaaaatgggaatctaacgaacaattgggaaaagattattggtgatcaagccaacattggaactgataaaatatctgggatagcgggaaacataatttctgctatttcaggccaggctgaccaagggccatttaatcatttattacttcaatcagatgaaaatagacctagcatggaccaaaatccttctccagggagacattctgatggaggcgtaaatattggtctcaaaaaaaaggctgtagtaactgatgatgacttacatactgctgttaagcctataattgaatacaaaggctctggtgctcatgggactaatttagcatcctccagcaggaatcctttagaaaaactggaatatagtgcagagaatgatttacaaactttcaactgtgaagctggttgtgctggaacaagcgaagttaatgttaatgagtctgaaaacaaatttcaggacaatgaaatgatgctaccatgtgatagcagaattcatatggcaataaacaaaggcaaggaaaaatccttatcagatggggatgcaaatgtaatattatcgagggaggagaatgacagtcattcaagtgttgagagctgtaacagtgctggctttttttcaacaggtaagaagagacgtaactttcaacaacagttgataattgggagtaaaagagtcaaaaagcaaattgaagaatcttctggtttcaaatcctatgttaaacaggatagctcattcatgaactggatttcaaacatggtgaaaggactccaacaatcaattcaaaatgattcaaacactttggctcttacccttacaaatccagatcatcataatctactgcctgacgagaaacttttcacatgcaatatgaatcaagatcccgagccaaaaaatacaggattcaagtccttttttcagtccatatattgtccaagcttgaagaatggaggaacgagaatgtctcatcaagaagggaagagtagtgatgatttagagccaggtaacatggaacatggaatagatgctactccaataacctattgtgcagaaaacaatagcctttccaaactgcgtttgcaatcaaataagtttgaagtatctattgggggaaatgatgccggtccgtcctcgcagcctaaggtcaaacctctaaatttttttaactgtcaggaaagcagcaaaaataacccagtggagactaaaaattattccatcttgggccatagtaaggacaaggaagaagtggcatcacattcatcttcaaccaaacaaaatacagatgataatgataacatcgattccaatgcactacctgatagaaaggaagaagagaatatttgtcacagaagagataatctgggaagtctgtggataactcgtttttctccaaaattcactgctcccttgagagaacaacctgccaatgacacagaggcctctactgatcttaaggaagataagggaaataatgatcataaatcaatgtatatgttcaaacccctttcatcttccccagggctcagaaatttagagccaatggcttcaatgtttgcaaggagatttagtgccatcaaacatatcataccaacaaatgcaacagatactaccacacaggtaaatatgttgtgcttgttttgtggaacaaaaggacatcaactctctgattgctcggctattgcagaaaacaagctagaagatctccagaagaatatagattcatatggaggactggaagaacattcttgtctatgcatcaaatgctttcagcccaaccattgggcaatttcatgtcccacttcaatctcaactaggaaacatgaactgaaagctaatgccttggtcaatgattgtggaaaacaaaaacatttaatcccaagcaatgaagagagtgccaggctgttgactgatgaggatgaccgagttttatctggcggttctattaatgatgaaacagatcaacgaacaggccaaaatattaatttgaagctgaaatcaaatgaaattataacccataaggtagggtgcaatgcatcattccagaaatactgtggttcgagtttagaggaaaacaaattcagagaaaatcctatatcttctccatccaaattgactgaaaggcagatttcacatgtgccaaagaaaatatttgatgcagtaaaaaaacttcaattgtcccgcactgacatcctgaagtaa

SEQ ID NO: 46498 - DNA, 804 bp, Glycine max
  Peptide Sequence Number=SeqID_163276
atggagcctgacaggttaaattccccaaccacatttgagatgccattggaggttatgggccatgagttgcagttttctcaggatcccaattccaagcacttagggactacagtatgggatgcatcacttgtgtttgccaagtttcttgaacggaattgcagaaagggaaggttttccccagctaaacttaaaggaaaacgtgtaattgaactaggagctggttgtggtgtttctggtattgattcatttggttcgatcaaggtggctgagcttcagtggggagatgagagtcatattaaggcagttggtcctccatttgactacatcattggcactgatgttgtttatgtagagcatctattggagcctctattacagacaattcttgctttatctggaccaaggactacaactatgttggggtatgagatccgctccacgagtgtccatgagaagatgcttcagatgtggaaaagaaactttgacgtcaagactgttgcgaagtccaagatggatgaaacatttcaacatccaagtattcaactcttcattatgggatttaaacaatcagccgagtgcacagagaacccaggtcaggcaactgttgaaaaagttgatgtggaaactgttgtggaggatgaaagcagtgagggaaatgttgtagtagaaggatctggtctcgttgaagaaaatgtgggggatcacagtaagccaatctctcaaaatgcaaagcttagtgagtgggaagccagaaggtatggagcaatggctgctagggttttgaaagatgtaaaaatatcttga

SEQ ID NO: 46499 - DNA, 1113 bp, Glycine max
  Peptide Sequence Number=SeqID_163277
atggtgggagaagaagtagtaccaatggacgacaaagcgaagaggatgcgagatctgctatcgagtttctactcccctgacccttccatctccaacaacacctccaaacacgcttctctcgacgacatcaattctacttccttcgatcccgatcagtacatgaacatcctggcacacaagtccaatttggaaggcctgctccaacgccacgttgaaatggcagctgaaatcaagaatctcgacaccgacttgcaaatgctggtttacgagaattacaacaagttcatcagtgctacagacactataaagaggatgaaaagtaacatttccgggatggagacgaatatggagcagcttcttgagaagataatgtctgtgcagtcgagaagtgacagtgtcaacacttctctatttgacaaaagggagcatattgagaaactacatcggacttgtaatcttcttcgtaaagttcagttcatatatgacctacccgatagactaagcaagtgcatcaagtcggaggcctatgcagatgcagtcaggttttacattggagcaatgccaatttttaaggttgtggcatatggagattcttcattccgggattgtaaacaagcttctgaagaagcaatagctgttgtagtaaaaaacttgcaggggaagctattttcagattctgaatcaatacaagtgagagctgatgcagcagtgcttcttaagcagttggattttccggtgaacaatttgaaggcaaagttatttgaaaagttagaacaatctattacagacattcgactgaaccctgaagaaataaataatccttcaggggaccgttctactcatgaggcagctatacatgaatttgtggaggcagtttgtgcatttcgtgtaatatttcctgattctgaagaacaattggttaaagttgctgaagatttggttaccaagaactttgtaattgctgaggaatatgtaaagacacggatttccccagaagatctacttggtgttcttcccatatacttgacttctaaagctagatggatttttactttcagtaccacattagacatacgagctagtgaccttttgactcatatgcctgctatatga

SEQ ID NO: 46500 - DNA, 1725 bp, Glycine max
  Peptide Sequence Number=SeqID_163278
atggattcacggaagggcaaagcttctgttcacgcatcttcgcttagtgttgcacctttgagtgtttcaaataaggtggatcagatggtgtcgccccctaggcatttgagagctgttgagactgatgtggatatagaccttagggaaatttactttttaatcatgcactttttgtctgtcgggccatgccgtaggacttttctaaatttcaaggaggaacttttagagcatcagcttctacctagaagatatcatgcttggttttcaagaagtggtgaacccagagtggatgatgctgatgaagatgatggcatctctttacctttagattacagcaatttagtgggcaggtatcctcacataactaaggatcatttggtaaagcttttgaagcaattgatgctgagtacggtccatcctttgcatgggaaacttgaaggaagtagtcctaatgcagctgatgttcctactttacttggatatggttcattttcgcttcttgatattgatagaaaaacagctgacaagctggtgaagccccctctactttacatgcgttggccgcacatgaaggctaatcaggttcaggggctaagtttaagggagactggaggtggttttgcaaagcaccatcgtgctccttccattcgcagtgcatgttatgctattgccaaaccatctactatggtgcaaaagatgcaaaatattaaaaagctaagggggcaccgtgtagctgtctattgtgccatatttgatggatccgggagatatgttattagtggttcagatgatcgtcttgtcaagatttggtatatggaaactgcattttgcttagctagttgccgtggacatgaaggtgatattactgacttggctgtaagctcaaacaatgctttggtggcatctgcttcaaatgattttgtcattcgagtttggcgcttaccagatgggatgccaatatcggttttgcggggacatactggagcagttaatactattacatttagtcccagtgttatataccagctactatcgtcatcagatgatggaacttgtagaatatgggatgcaagaaattcacacaatccacgaatatatgtgcctcgacctctagatgctataaatgggaagagcaatgctccaccagctagtttgccatcatcctcaagcaatggtcaacaaagttatcaagtactttgttgtgcatataatgcaaatggaactgtttttgttactggtagctctgatacttatgccagggtgtggagtgctttgaaacccaacactgatgactcagaacaaccaatacacgagatggatttattatctggtcatgagaatgatgttaattatgtgcagtttagtggttgctccgtggcttcaaaaattttgacatctgacccctggaaagaagaaaatacgctgaagttccgaaatttctggtattgtcatgataacatagttacctgctctcgtgatggaagtgcaattatatgggttcccagatcacgtaaatctcatggaaaagtaggacgctggactcgtgcatatcatttaaaagtgccaccaccgcctctgcctccccaacctccacgaggtggtccaaggcagagatttctacctactcctcgtggtgtcaatatgattatatggagcctggacaatcgctttgtgcttgccgctattatgggtaatgtacttgctaaccctttgtttgtcatatga

SEQ ID NO: 46501 - DNA, 409 bp, Glycine max
  Peptide Sequence Number=SeqID_163279
atgagtgccgaaaacgagaaaataaaaccaaagactgatattgaactctttctcaataatgctaaccagtgcgtttggaaaaaattgaataatgactcaggtgcaggtgcaaatgcagcctccagggaggatatgacacttgctgccactgaccccctatctgaaatagtttggtctccagataaaggtttgagtcttaaatgtgccgattcaagctttgctcataaaaatagttctccttttcgggattttggaacaagctgtatggtttttgctccgccacaaaattttactggcagcagttctaccactgataaacctttagatgatgattttgtgaaacctatagcagttgtatgtgccaagagtgatattgctgaagcagatgctcctactatgcctcctacag

SEQ ID NO: 46502 - DNA, 393 bp, Glycine max
  Peptide Sequence Number=SeqID_163280
atgtcttttcatcttgaagattgcagaatatgtgtttggaatgcagttgatggcagcttagtgcactctttgactggtcatactgaatcctcttatgttttggatgttcaccctttcaaccctcgaatagctatgagtgctgggtatgatggacgaaccattgtgtgggatatatgggagggcatacctattcggacatatgaaattggacattttaagttggttgatgggaagttttctccatatttgacatttaaacaaatacaaaggaagaagcaaaattcatccccccctttagtggatttctggatctgcccctggttagaggcagctagaactgttccaatgctaaccgatagtgtaaatactaaacttcacactttcagtgggtaa

SEQ ID NO: 46503 - DNA, 603 bp, Glycine max
  Peptide Sequence Number=SeqID_163281
atgggtaaccaattagtctcactacgcccctcagaagccacgggcaaaattattacgtgggatggttcggtgcacgaaattgagcaatctttgacagtggcagagctgatgctggagcacccagagcaagtggtggttgagttgcattcagcggtgaataataaaaggccaacgccattgccagcggataacaagttagagacaaataaggtgtatctgatgcttccattgaagcgagggaagcccgttggattaagcggggaagaaactcgacgcattttattgattcttaattctgctctgcagcattccaagtgtcttgtgggttcttcttcttcttcttcaaagtttgttccctggctcacgcgtctgtgccagaacactactacaattgtggaacctcagagaaagattaacgaggaaataacggagaagagtgatgaagagagctgccagttgtttttgccggaaatgttggaagggaggcctgaatatttgaataggcaggtttcagggaaagggtggaagcctactcttgacaccattaaggagaagaatattgacagaaagctcactcactggttattcctcaagaccttttag

SEQ ID NO: 46504 - DNA, 3270 bp, Glycine max
  Peptide Sequence Number=SeqID_163282
atggggttgcaagcattaaacttaaacacttgtccaccactatgtcacagtggcatttgctttaaagtgaaatccaataggctctatacctaccttgctgatcatgagggttccatgtcacatgaattatgccatcttttatccatcttagatgaatcaggatctatgacgttttttcttggtgattatcgaccccttattcaggatactcaaggaaatgttcttgatcaggttgagagtagtcattgtgcccctgagactcaacttccaccacacagaagaaacattcaggaacccctatgtgattctagtatgatgccatatccagaaccttatcagagtcaatttcagcaacgtcgacttggtgcacttggcattgaatggcgtccttcattgataaaatatgctgttggtccagattttagtgttggtcaggactacccagtggtacctttggtagacttggaaggaatggttgagccacaaccagagttcttggatgccatgttctgggagccagaatatgacattattgtaagtgatgataatgactctgaatacaatgtgaatgaggatagttctagtgcagccgggcaagggagtgttatctcttctagtgatctagaatacagtgaagatgactctagtaatagggacggccttcgaagatcaagaaggaaaaaacataatgttggagttgaggtaatgacttcctctggaaggtgtgtaaggaaaaggaatttggatgagtgtaatggtaatacttctggaagtaacagactccgcaagaaatccaagggcagctcaaaaccctcaaaaaggaaatcttccaaagctaagacattgagaccccaacgaattgctgcacataatgctcgtagtatgttctctcaaattgatgaagcatctactgatggggaagataatgattctgatgaagaagcatcagacagtttccaagatcctgatgatcttagtgaacctgagatggaaatgaataataagcatgttgaacttaaaattccccttttagaaaagtttgcaactgtgtccaagcctcctgcattctgtgagtcccaggcaaatgttgaaactagaccgagactggttgttaagttttcacttcgtgattctaagaagaatgtgcccacagaggacacaagactagcttgtgagactcaggataatatggtatgccagtcttttagacctcaacctgaagaaagtgatcaaaaaacttttccagacacaaaatcgttggaccctgcattatcttctatggctgcacctaatgctaaacttccccaaagcctcgacagaaatgaaaatgatgataaagaacaaactgaaaatattacaaataatctggatgcatccagatatgttgaggcaaacacagatcagtgcagaaaaatgaagacacatacacacgaactttcaagatcaggggatgctttgctgactgatgctgaaattgatgaccatcttgaacaaaatgccaatgggtatgtaaagcctgagatgaatctcacaaaaaggagatcagaacaagtgattggcaagttagagactgtcgggagtatggttaatacagagctgactgattttgaagatgcacctaaattttcatcacttgaaccttcattgttttgcaatcctcagccaaatgctgaaggctccttgacatctggttatgataagttccatggtggtgataaaggccaatctggatctgagaaatgtgcagaggactcactagaaaacaatgaagttgttcaatcaagccactgccgtaacctcaaaatgaaagcgcctgtgaaatcaaccaagttagttattaaaaagaaacaaatttcaccagacactgaaggttcttgcaaactgaagattgttagttctaaggcagattcaactggtgctagaggtattgtaatatctggaagttcctcctttatggggcctaatctagtcacagaagtaccagaaggtgaagatgacagaaaatttagttctccacagctactgcattcatattctgacaagagaagttatgatcatgtccataaaagggacaagtcatataaaggtaaagtcaatcaagatggttttgaatcttttgattgtgatacggaagaacatacttctgttttcagcaatccacatggtttaggaattggtttgtttgatgttacaagtgatcctatgcgtcaaacacgatctataaggatgaagacaacttctgaggagccaagcacttcaaacagaagaattaaaattcgacagggtcaaagctccaggggcaaacctgaagagggtgtcaatgattctggtacttcaactcgaagggtgtcaaatcaccatgtcaaaaaattgtcatggctgatgttgtcagagcttgaagagggttaccgatatattcctcaacttggtgatgaagttgtgtactttagacagggccatcaagagtacatagagtcatattcattatctgaatcaggtccatggagactatttgtaggactaggtgcttctgaaatttgcaaggttgaagaacttgagtatgcggagctaccaggctctggggatagctgttgtaaacttaaacttagatttgtggatccttcttcgtgtgtgcatggcaaatcatttaaattaactctacctgaattgattaacttcactgactttgttattgagaaaacatggtatgatactgccatgaagagaaattggtcttcaagagataaatgcatggtctggtggagaaatgaagatgggaaaggtggaagttggtgggatggtcggattattcaagtgcaggccaagtctgatgacttccctaacagtccctgggaaaggtatcgggtccagtacaagactgatccaagcgagaatcatctgcatagtccgtgggaactatatgatcctgagatgctgtgggagcatccccacattgatcatgagatcagagataagctgctttcctatttcatcaaattagaccacaggcagaggtttgatatccaagcattgaaccaagtagctgagaggttagagtttgcaaacaggtttcctgccccattctatcctgaactaattcaatcaagattgaagaatgactactatcggagtgtggaaggtgtgaagcatgatataatggtaatgttatcaaatgctgaagaatactttaaaattacaaaaaatgctcagctggtgagcaagatcaggagaatatcagaatggtttagaaggaaacttgaaaggatatag

SEQ ID NO: 46505 - DNA, 153 bp, Glycine max
  Peptide Sequence Number=SeqID_163283
atggtgtgtggtgcaacggtggtgtgtggcaaattttctttgagagatgcagaatttaaaatgggaggtgcggtattcaaatgcccatttgcggaagaggaggcccaagtcttggtaaagatacctgtggtggaagaagcaaaagtgatatag

SEQ ID NO: 46506 - DNA, 609 bp, Glycine max
  Peptide Sequence Number=SeqID_163284
atggaacgttttgtgcgcctcctaactgttgtattagccatggctatggtgctggctgcaccagcccacgctcagatcagcacgccatgcagcacatcaatgataaacggctttttcaacccttgtatgaatttcctcacaaatagcagtggcaatggcaatggcacttcacctactgctgagtgctgcaattccatcaagtccctcacaagtggcggcatggactgtttgtgtctcattatgactggcaatgttccctttagaataccaatcaaccgaaccctggccatctctcttcctcgtacttgcaatttgcctcgtcttccacttcaatgcaaaagttcaccacttccagctccaggacctgcggcttttgggccatctctttctccatctgctccatctcttagtcctgaagcttcctctgtacttccttcaccttctttggcaccactgtctgacataacccctcctcttttgactccatcatctgcaaccacgggaagtggtcgttctgatctgactccatcttctgccatgccatcttaccgttttctaccttcagttgtgttgattgcgttaggatttgctgttcttaaacactattag

SEQ ID NO: 46507 - DNA, 324 bp, Glycine max
  Peptide Sequence Number=SeqID_163285
atggccagggttcggttgattggtattctaaagggaacattgccagtcataatgagacacaaacagtccatgccgccacttgtgagggacttgatggaattgcagcactcagcagtaggtgaagtgccattgccattgccactgctatttgtgaggaaattcatacaagggttgaaaaagccgtttatcattgatgcgcacaaaacgttccatgttgttgagtttggaagttttgataatgggaaagtgcagcaggacaaggaagtttgtaaagagagatcggaagtggaggggaaaaaagtagaggtgttgaagttggtttaa

SEQ ID NO: 46508 - DNA, 1794 bp, Glycine max
  Peptide Sequence Number=SeqID_163286
atgagagatgagaattccaagaaaagcaagctctcatggtcgaagagaatggtcagaaagttcttcaatgtcaaaagcaaagctgaggactcctaccagtcaaatggtgttgcttatggaggaggtgacgtagaatacagaagcaggaacagcagcttctctgagagggagatcaaaaagagcaaaacagacaagtttagcaggaacacggagcaggttaggcgaggaagagtgagtctcgaccatcctcgaattattgatgttcataactatagcatttttgttgcttcatggaatgtggctggaagatccccaccaagtaatttgagtatagatgattggcttcatgcctcgccaccggcagatatttatgttcttggatttcaagagatagttcccttgaatgctggtaatatcttgggcgcagaagacaacggacctgccaaaaaatggctagctctcattggaaagaccttaaacaaccttccgggtactagtggaggtggtgggtattatacaccatctccaatccctcagccagtggtagaaataaatgcagattttgagggatccgctaggcaaaaaaattcatcattcttccatcgccggtcgttccagacaacttctagcggctggggattggacaatgattcttcaactatgcagccgcgactagatcgaagattcagcgtctgtgatcgtgtgatttttggtcacaggaaaagtgactttgatcccagctatagatggggttataggcctagtgactattccagggcaagtgactactccagacccagtgactattcaagatggggttcatctgatgatgacaatggccttggagactcgccaagcacagtctcaccactgtcttatggtggacctgcctctgctgaagatggatatggaatgccagggcgttccaggtactgccttgttgcaagtaagcaaatggtaggaatatttctaaccatatgggtgagaagtgaattgaaagatcatgtgcgaaacatgaaagtatcctgtgttggcagaggattgatgggctatcttggaaataagggatccatctcaattagcatgtctctacatgaaacaagcttttgcttcatttgtagccacttaacctcaggacaaaaggagggtgatgaattaagaagaaattctgatgtgatggagattcttaagaagacaaggtttccacgtgtacatgatgctgacaatgagaagtctcccgagacaatactcgagcatgagtatgaatttacttgcatacatcttagtataactaatactcttaacatgtttattcgaattatatggcttggagacttgaattatcggattgccctctcctaccgttctgctaaggcacttgttgagatgcaaaactggagagcattgttggagaatgaccagttgagaatagagcagaagagaggccgtgcatttgtgggatggaatgaagggaagatttatttccctccaacatacaagtattcaactaattcagataggtatgcaggagatgatatgcacccaaaggagaaaaggcgaacacctgcttggtgtgaccgtattttgtggtatggagaaggtctccatcaattatcttacgtccgtggagaatcaaggttttcagaccacagaccggtttatggcatattttgggctgaggttgagtcaagtcatggaagactgaagaagagtatgagctgttctcggaacagaattgaggtggaggaactcttgccatattcccacggatatactgaactaagttttttctaa

SEQ ID NO: 46509 - DNA, 201 bp, Glycine max
  Peptide Sequence Number=SeqID_163287
atggccgggcaaagtggtgtagtttttggtaacaattttattagagtagttcaaccgcacttccccattgcgccaactgcaaaagcagtttgtgttgcctttaagtttcttgttcccagctcaaatgggtgtgagcttgatgcatccctaaaggcactgtttccaaaattcaaaggcaccaaggtcgttacgaagcggtaa

SEQ ID NO: 46510 - DNA, 1116 bp, Glycine max
  Peptide Sequence Number=SeqID_163288
atggatgctcctcttcttaccccatacaagatgggcaacttcaatctatcccatagagttgttttggcaccgctcaccagacagaggtctagttacaacaacgttcctgaaccacatctaattctctactactctcagagaacttccaacggaggcattctcatttctgaagctaatggcatttctgaaaccgctcaagggtatccacacacacctggcatatggacaaaacagcaagtccaagcgtggaaacccattgtggatgccgttcatgccaaaggtggtatcttcttttgtcagatttggcacgctggaagggtttcaaattcagtttatcaaccaaatgggcaagcaccgatatcttctacggacaagctactcgcaccacaaggtcgaggtgatggcattgatgaagtacattacacaccaccaaggcggctaaggacagatgaaattcctcatattgtcaatgacttcagacttgctgctaggaatgctatccaagctggttttgatggagttgagatccatggggctcatggttaccttattgatcaattcctgaaagataaggtgaatgaccgaacagaccaatatggtggatcccttgagaaccgttgtcgatttgctttggaaattgttgaagctcttgtagatgagataggggcggaaagagttggaattagattatcacctttttcagaatattgtgagtgtggagattcaaatcccgaacagttggggctgtacatagttaatgccctcaataagtatagtattctctactgtcacatggtggaaccaagaatgaagactgttgtagaaagagttgaatgtcctcaaagcctggtgcttatgagaaaggccttcaatggcacttttatagccgcaggaggttatgacaggcaagaggggatcgatgccatatctgagaacagggctgatcttgttgcttatggtcgtttgttcttggccaatccagacttgccaaagagatttgcactcaatgctcctctcaacaagtatcaccgggagacattctacactcatgatccagttgttggttatactgactacccttttcatgctgaagaatccaatgttgtagcatcttag

SEQ ID NO: 46511 - DNA, 969 bp, Glycine max
  Peptide Sequence Number=SeqID_163289
atggcttcctttcttcttcgccgtaaccgcaatctattctctcgctctctactcggtaaaaaggagccttttcgtctgtactttcagttcaagtctcaaagtttaggtggtgctgcaaacaaggtgcatccatatagcagccgtaatggtcccatcagaaatgattttactgacttgacttgccctcatacatggtatccacaggctcgaaagaaacatcgcaggattatcctgcatgttggtccaacaaatagtggtaaaacacatcatgctctgaagcaacttgagtcaagtgcttctggtgtatattgtggtcctttaagattgttggcatgggagatagcaaaacggttgaacaaggcacaagttccttgtgatctcattacaggtcaggaaagagatgaagttgatggtgccaatcataaggctgtcacagttgaaatggttgatgtttcagctgattatcagtgtgctgttattgatgaaattcaggcaagaattgctgctgatgaacttcacctttgtggtgatccagctgctgttccccttattcaggagataatgaaaattactggtgacgaaattgaggttcaattttatgagagactgtcacctttagtcccactgaaggttcctcttggatctttctctaatgtaagaaatggtgactgcattgtaaccttttcacgtcaggagatatacaaattgaagaaaagaattgagaaagaaggaaagcatctttgttcagtagtttatggatcactgccaccagagactcgaacaagacaggcaagcatgttcaatgatgcaagtagcgagtttgatgttcttgtggccagtgatgccattggaatgggtcttaatctaaacatctctaggatcatattttcaaccatgaagaagttcgacggtttcgaggtgcgagatctgactgtacctgagatcaaacagattgcaggtagcatgtaa

SEQ ID NO: 46512 - DNA, 1584 bp, Glycine max
  Peptide Sequence Number=SeqID_163290
atgctgcaaaagggaccacgaccggataaggtgaccatgttatctacgattgcagcctgtgcacagttaggtgatctttctgttgggaagtcatcccatgcttatgtcttacggaatggacttgaaggttgggataacatttccaacgccatcattgacatgtacatgaaatgtggcaaaagagaagcagcttgcaaagtttttgagcatatgccaaacaagacggtggtgacttggaattcgttaattgcaggtttggttagagatggtgacatggaattagcttggagaatctttgatgagatgcttgagagggatcttgtatcttggaacactatgatcggtgcattggttcaagtgagcatgtttgaggaagcaattgagctattcagagagatgcaaaaccaggggattccaggagatagagtgacaatggtgggcattgcttctgcctgtggatatttaggagctcttgatcttgccaagtgggtatgtacttacattgagaaaaatgacattcacgtggacttgcagcttggcacagctttggttgacatgttttcaagatgtggtgatccctcaagtgctatgcatgttttcaaaagaatggaaaaacgggatgtgtctgcctggactgctgccatcggagttatggcaatggagggaaatacagaaggggctattgagctttttaacgagatgcttgaacaaaaggtgaaaccagatgatgttgtttttgtggcactattgacagcatgtagccatggtggctctgtggaccaagggaggcaacttttttggtcaatggaaaaagcccacggaatacgtcctcatattgtccactatggatgtatggttgatttgcttggtcgagctgggctgctggaagaagctgttgatctcatacaaagtatgccaatagaacctaatgatgttgtgtggggatctctactagcagcttgtcggaaacacaaaaatgttgaactggcacattatgcagctgaaaagttaacacaattggcccctgaaagagttgggattcatgtgctgttatctaacatatatgcatcagctggaaaatggactgatgtagcaagagtgaggttgcaaatgaaggagaaaggggtccagaaagtgcctggatcaagctcaatagaagttcaaggattgattcacgagttcacctcaggtgatgaatcacacgcagagaacacccatattggattaatgctagaggaaataaactgcaggctaagtgaggcagggtatgttcctgatacaaccaatgtcttacttgatgttgatgagcaggagaaagagcatttgctcagcagacatagtgagaaactagccatggcttatggattaatcactactggtcaaggtttgccgatggatttcttcaatgagccagatggtggcctcagctttgtgtggatgaactatggtgtccaagggcttgtattcatcctcactgccaattctcaactgatcccattgcttgaggagaatatttgtgagtgcctcgatgatttgggattgggatctgcttcatgtaatcctgatacatttctgcccgtctga

SEQ ID NO: 46513 - DNA, 648 bp, Glycine max
  Peptide Sequence Number=SeqID_163291
atgacaagtatcaaggaaggtcaaccaagcttaatcctcacggccacagtttctctcaattgcacaggtgtttcagggaaggtggaatcaatgttaaaagatcacttggctagtgaaagggatcaagtttctttgtgcaaaaaggtgtcccccgatgttcgttatcaaatgaaacagaatattgaagaaaataataacaagaataagaagagaataattgatgaagaacatgatttgtatccacctagtgaagaaggtggcgaagtgccaataaaagtgaacaacaaacctagaaccactcctagagctcaacctaccttgaaaaatgtgatgcaaaataaacaagtgatacgaaggtgtgaccttgctattgctaaatggttcattgatgcatctattccatttaatgcagctaattcagcatattttcagcctatgatcgatgatctttgtagcatgagtccaagatacaaggctccaagtatgcattgttgtcgttgggatccacagcttcacaaaaatctccatgcttcaggttattggttaaagcctgcttgccggtttaatgaggaagaatttgaacaacatatgactacaacaactggtctgttggatgtcattgaaagatatgctcacagagatagttag

SEQ ID NO: 46514 - DNA, 250 bp, Glycine max
  Peptide Sequence Number=SeqID_163292
atgtcatacattctattaaatgttatgcatgtcgagaaaaatgtgtgtgatagtgtcatcgaaacattttttaagattcaaggcaagacaaatgatgatttgaatactcatcaagatctagctgagatgggtatacgagaccagtttcatccaaggtccgatgaagaagctattgagttttgttcagagtacatcgccaccgcaaaacctgttgggcttcccaagtctcgacatgacaaaagagtgagag

SEQ ID NO: 46515 - DNA, 2361 bp, Glycine max
  Peptide Sequence Number=SeqID_163293
atggacacgccagagaggaatcagatcaccgctactctctctatgtttgaggattcaccggttttcaactatatcaatagtttatctcctataaagcccgttaagtctgttcccatcagtcagactttcaattcactgagcttttcatcccctccatcggttttcacatcaccccatgtcagctgtctcaaggaatctagatttctccggagacataacccgttgggcacatcaaagcctaaggtttcttctgaagatgtaattaaagttcactcaagtgaagagactcttgctgatactacacgcgcacaccataactcaagtaaattacaggaggaaaacactggtaaagggatttcattaagagatgcttcgcttgagctatctagggagcacataagattttcagatgagctaccgaaagctttaaaatataattgtggtagccctggctatgatcatccaccttgtggtgatgaggccaactctcttttggaattgcctggtgaggcagcagaaaatgttggctatgttcaggaaggttgtaaaactgattcagttgagggcgaagtgcatcttcaggaaatatgtcagatggagccaaagagtgaaggtccagactgttattgggatagtttaattcctgatgcccctgatatgctaatttttaattccccaggtgaggcagaagcttttaagggtctaatgcacaaacccttggactcttctattcgactcagcaaatttatgtctatgcttccacattctaccatcaataatggtaggaaaatgcacattgttgattcagttgcttctggttctgcccatgaaattgaagataatcattctgagccgatgacagccacaggcacgagccaaactcaagataatcttgccgatgttgcattagtgactagcaattcaaatgagaaagcaaacgaccagcttgtttcagtcacacaccgtaccatacggaggcgctgtctagactttgagatggccaatgttcaaaggaagaactctgatgataattcaaacatcggttttagtacatctgagtctgatgagaggaatgtcgctaatgaaaagcaattgcttcctgcaaaacgcaatgggaatttacagaggggaattttgcaaggaattggtctacacttgaatgcacttgctgccttaaaagaatacaacggcacacaagttgaaaaattgtcttctggaagacaactcagtctgcccagctctacttctttgcaaatcactacaagccaagaacatcagcatctatcattggtacctgtatcatctgaaagagaattggatccatcagacattggggttcatcctgctgaagattgttcccagccatcagcttacatggctggtgaagacttcaatcagaacagccccagaatgaaaaggcaagtgaagttccttacaccgagttggatttgcaggcgtaagtcggagacaccaggagacaccgagggctgtaaacgctgcaattgcaagaaatcaaagtgtttgaagctttattgtgagtgctttgctgctggtgtctactgcatagaaccctgctcctgtcaggattgcttcaacaaacctattcatgaagacactgttcttcaaactcgcaagcagattgaatctcgtaaccctcttgcatttgctcctaaagtcatcagaaattctgattctgtacctgaaattggggatgacccaaataaaactccagcttcagcacgacacaaaagaggatgcaactgcaaaaaatcaagctgcctaaagaaatattgtgaatgttatcagggtggtgttggttgctccattagctgtagatgtgaaggatgcaagaatgcttttggtagaaaggatggttctgctcctgtaggcatagaaactgatccagaagaaacagaagcctctgacaagggtatggtagaaaaaactttacagaaaactgaaattcagaatactgagaatcatccagattctgctacagtgtcaacaccattacggctttccaggccattgcttccgttgcccttttcatcaaagggaaagccaccaagatcttttgttacaaccatctctggctctgcattatttgccaaccaaaagcttgggaaaccaaaccctctttggtctcaagctaagcattttcaaactgttccagatgaagaaatgccggatattctgcgaggtgatagctctcctatcacttgcatcaaaacctcttctccaaatggcaagaggatctcctctcctaactgcgacttgggattatctcctagtcgcagaggtggcaggaagttgatattacaatccattccttcatttccttctctcacccctcacccttag

SEQ ID NO: 46516 - DNA, 213 bp, Glycine max
  Peptide Sequence Number=SeqID_163294
atggttgagaatggagaattgcaggaagcaatcactttgcaaggctccaaacttgcgggtgggggacgcatgaaagaaaacccaaatcatgggcctcaaaaaagggttgagaatagagaattgccattagcaatcactacgcatggctcccaactcgtgggtggaggacccatgaacgaaaacgcaattcatggggctccgaaaaaaggttga

SEQ ID NO: 46517 - DNA, 463 bp, Glycine max
  Peptide Sequence Number=SeqID_163295
atgggaggatacgtaggagcaagagcctcgcttttgtcgaccacaccgccttttgttgccatgactcaagagctggtgatacgcggagataccttatggttattcgcacctttttgtcatccagaggcggcgggcccgatgacaagcagagaccaagtttggtcattctgcacccatgatacgcggagataccttacggttatccgcacctttttgtcatccagaggcggcgggcccgatgacaagcagagaccaaagaccaagtttggtcattctgcacccatgatacgcggagataccttatggttattcgcacccttttgtcatccagaggcggcgggcccgatgacaagcagagaccaagtttggtcattctgcacccatgatacgcggagataccttacggttatccgcacccttttgtcatccagaggcggcgggcccgatgacaagcagagaccaa

SEQ ID NO: 46518 - DNA, 358 bp, Glycine max
  Peptide Sequence Number=SeqID_163296
atgacccgtattgcgctggtcgccgcctcgctggcagcgtgcagttttacggcgcaggccgcgaacgttgaggctgccccgtctccctcgcaggatccgctggtacagcacctgaagctcagcaatgagcaggttaaaaagattgaagatctgcataagcagctggaacaaaatgtcagcaagatcccgatgacgggggtgaaggacggcgcgctgatcgacatgttccaggcgggtaaatgggacgaaagcacggtgaaaagccagcttgctgcctttagcaaaattgaagagcagacccgctattaccgcgtgaaatattacttcgacgtcagccaggtgttgacgccggaacagc

SEQ ID NO: 46519 - DNA, 540 bp, Glycine max
  Peptide Sequence Number=SeqID_163297
atgggttggcttagtcggttcataactgccgtggctttcttagccatcggagtgatattctcaccggagacactggggtcaaaatcaaccacactttccacctacctcaaactcgctcacctcctctgcttctccaccgccttcggcgccgctctgtgggtaacattcatcggcggcatcatcatgtttaaaaatctgccgcggcatcagtttgggaacctgcaaagcaagatgtttccggcgtatttctcgatggtgggtgtctgctgcgccgtatcggtggcttcctttggctaccttcacccgtggaaaacttcctccaccactgagagataccaacttgggtttttgctctcttcctttgcgttcaatcttaccaacttgtttgtctttacacccatgaccattgagccttacccttgcatatgcaaagaggctgtttccggattcaaacccatgaccaacaagtcaccaaggcacaactttaccgctgcaccagggctcaccctcaccaagtttagctgttcagtaaaagtctaa

SEQ ID NO: 46520 - DNA, 234 bp, Glycine max
  Peptide Sequence Number=SeqID_163298
atggcgaacaacgacgactctggttcttctgtttcttcggatagttcgctttcgagggaaggtgtcaagcttctcccttcctccgattccgatcagagtttcaagtgcttctctgtctctgacttgaataagaaggttatggcagggctgtgtaaaacttgcaacaacgaagggtattggagatcggagtcccaagtagtacttgttgtcatgtggggatggggttccgagtaa

SEQ ID NO: 46521 - DNA, 3951 bp, Glycine max
  Peptide Sequence Number=SeqID_163299
atggaagccacttacccatcgccaatgtttcgcggtgttcgtttcgttctccgtggcttcaatcccgtcgcccaaaaccagatccggttcaagcttgccaatggcggtggagtcgacgtaggacagtacggcgggagttgcacgcatgtcattgtcgataacgttgcttatgacgatcctgtgtgtgttgctgccagaaatgatcggaagacggttgtcactgcattgtgggttgaacacagtgctgatattggaatgcctgttgatgctacttcggttatgtacagacctcttaaagacttagatggaataccaggtgcgaaagatttgataatgtgcttgactggttatctacgccaggatcgggatgacattatgacaatggttggcctaatgggtgcacagttttctaagcctttggtggcaaacaaggttactcatctcatatgctacaaatttgaagagaagtatgagcttgccaagaaattgggcacaataaagttagttaatcatcgttggttggaagattgcttgaaggaatgggtgcttcttcccgaagacaaatataacaagagtggttttgaactagagatgatggaggaagaggctaaggattctgagcaagaggctgaagattctaagctgggacaatcagggggaagaaaaagaaaacaaagcccccttagttcgaaaattggtatcgctgctactcctggattgtccaaatcagcaacagaggcatcaaacgccttaccagattctactggtccacaggtcttgccaaatgtcaataatggtgaaaactctttaaccgttccaggaaataagagcagacctgatcaaggctcgagctttcataatgttgatgactcaaaggtaagctatcaggctgctgatatttctagacattctacatcatgccagttacctaacaaatatgtaaagaccagtgagtctaagaatgctgattctccaaaggcacctggctgccaggatcttggcaatatgggaaatacaaattcatctgatcagcagcctgatctgaatggcgacatctcagagtctaagaaggtggcaagtgatttgagagaaacttctgcaagtgctgctggagttgcacattcaaatgaaaagcttagaactgcaagttattctaggaagaaccaaaaaggatttactcttccaaggatcttagatgaaagctcaggtagagaaggcaacaactgtgataacagtaaggttcaaaaggccagtgagggtgtcaaatctaccagtgttgaagtttctgggaaaggaaatgattttgttaaagatgagccaattagtttattgcctcaaaagaggataaacaaagcttcttttactaaattaaaatcaagaaagaagacttcagtcccatcagctaatggtaaatctcaaggattaaaagtgacatctcaggttgatgagccacctgaagctgatgactacttttctataggtaaagatggtataaataactcaaacacttgcttagtttcgaaaccttcaggctctacctccaactcactggcatttgatgagcttctttcaagaaatgcaagcccagaatctgttcagtgtgataatgtctgtcagaattcatcaaaaatggctgttcagagcttaagtgagtctaaaattaatggcaaacctgatatcacaggttctggaatgcaacaagttggtggtaatgaagtagagcaacatactgtcactaaaaatcttgattgttcatctctgggaaacaaaaaatcatgtaatgtggaatctgctggttgtactaaattggatttaggcaccgaagaaagtaataaactggttagcaaatcaccccgaaagaagtcggttgccaagagaagtttgggttctaaacctaaagtaggtgccactgctaaacagaaaaaatcactttccctgactaaaactaccctgcaaggtgaaggtgaaactttttccagtggaagcaaagaggttgcaactggtgatgcgaggatgcatcagggatgcccccaaatctttgatgttaataaaacaacagagcaagaaacagttagtaaaaatgctggtgacagaactgagtttttggacgatgaaactgaggctccagatgacaaatgtgaatatgagttaggaatggcccttgacgaagacttggttcatctttcaaaaaagccagatacagcaaaagaagagaagtcagaagcaacttaccctgcaacaaaatgtgaagaggcaatgcctcctaagaatggcacaaataaaactgaaaaacagaaaacatcttcactggcagtaaagcatcaagctagaaaacttcctgctggtaaagtcaaggccacagttagtaaatatgcagaagatgatggtgacagaactgagcttgtgggggatgaaaccgaggctccagatggcaaatgtgaacccgagttacgaatggcactcgatgaagaatctcatctttcaaaaaaatcagatacagcaacagaagagaagtcggaagtaatttgccctgaaacaaaatgtgaagagccaatgcctcctaagaaaggcacaaaaaaaactgaaaaacagaagccatcttcactggtagtaaagaatcaagcaagaaaacgtcctgctggtaaaaccaaggccaaagttgccaaggaattaccaaaatctatggcagtatatggggagaagattcctaatgagaccgagcatgagccagagatagaaaccatggaagaaatgccccttcctgatgataaaagtgaccagccagccattcaaagaaataagtcagagaattttgctgaagagaaggagaataggccaattgatggagagcagggcaaaagcaatggcagttcaactattaaatctagtgtaaggacagcaaagatcaagtctaagaaatcggggctcaatccatctataacagaatctaacacgagagtgaaaactgaagccgcatgttttatattaagtgggcatcgtctacagagaaaagagtttcaacaagtaatcaagcgattaaaaggaagggtttgccgggattctcaccagtggtcatatcaggcgacacacttcatagctccagaccccatacgcaggactgagaaattttttgctgctgctgcatcaggaaggtggattctaaaaactgatttcctaactgccagtagccaggcaggaaaattgttggcagaggagccttatgagtggcaccagaatggtttcagtgaggatggcacaattaatatggaggctccaagaaagtggcggctgttgaaagaaagaacaggtcatggagccttctatggaatgcgtattgttgtatacggcgattgcattgccccacctttggatactctgaaacgtgtcattaaagctggagatggaacaatattagcaacttctcctccttatactcgcttccttagtacaggaatcgactatgctgtagttagccctggcatgccacgtgttgacatgtgggtgcaagagttcttaaaacatgagataccttgtgttgtagcggactacttggttgagtatgtttgcaagcccgggttctcccttgagagacatgtattatatggcactcatgcttgggcagagagatcatttgataaacttaaaagcaaggcagaagagattgttgaagaactcgttgctcctgaggattctggtgatgatcatgatcatgatataatttgcaaagtatgtggatcccgcgatagaggagatgtaatgctgatttgtggtgatgaaagtggttccgtcggatgtggaatcggtactcatatcgattgctgcgatcctcctctaacacatgtacctgaggaagattggttttgcccaaaatgcagtagcaaccgaaactgctcaaacaatcccagtaaaaggaaaaagactgttttatcttcatcagtgtatgtgaggtga

SEQ ID NO: 46522 - DNA, 309 bp, Glycine max
  Peptide Sequence Number=SeqID_163300
atgaaccaacctcttagagaggaagacaatttccaaaagaataagttaatcacaaacacaaacagattgagtgcatgtttggaaattcattcaaaatggagaggaatcgcatttggactaagaaatttgggttctggtgcgagcaaagaatgtgccgtcgcgtgcgaagattatgccatcatttgtgcagttgaaccacttggcaagctcggtgggacagagtcgaggtcgagaagggtgcgtcccgcgacggaggacggcggcggcgcgatcgagaagaaggggaagaaggagaacataattttttaa

SEQ ID NO: 46523 - DNA, 1086 bp, Glycine max
  Peptide Sequence Number=SeqID_163301
atggaagacgccatggtccttctccaaaccggcaaacgtctagccaccgccgccttccgccgagagagcgtttgctggtccgacgacagcttctccctctccaaccccctcttctccggcgacacccccaccaccccacccccggagtccgaagccgtcacccaactcctcgctcacattaagctcctcctccgccgccgcgccgccgccctcgccgccattgatgccggcctccactctgaagccatccgccacttctccaaaatcctcgagggccgccgcggcgcccctcagggcttcctcgcagagtgctacatgcacagagcctccgcaaaccgctccgccgggcgaatcgccgactcaatcgccgactgcaaccgaaccctcgccctggaccccaccagcatccaagccctcgaaacccgagcctcactcttcgaatccattcgctgcttcccagactccctccacgacctcgaacacctcaagctcctctacaacaccatcctccgcgaccgcaagctcgcgggccccacctggaagcagttgcgccaccacaacaacctgcgctacagagaaatcccaggaaagctctgcgccctcaccgtaaaaacacaagaactcaaacagaggatcgcttccggggacaccgggaacgtcgactactactcgctcatcggattgcggcgcggttgtgggcgttcggagctgcagagggctcatttgttgctgtgtctgaaacacaagcccgacaaggccacgtgtttcgtcgaacggtgcgagctggcggacgagctcgacctcgactcgattaaggaaagggggaaaatgtcggcgctgttgctctacaggctgctccagaagggagccgctgagaaacagaggaagaaggttctagaagctcaagtattgatgagtaatgagaatttggaagacaagaagtgcaacgtttcctcgccttcgacggcgaacccctctgtctatcagggagtgttttgccgcgatattgcggtggttgggaacttgctttcgcaatcggggttcaaccgctccattccggtgaagtacgaggcgttgagctgctga

SEQ ID NO: 46524 - DNA, 195 bp, Glycine max
  Peptide Sequence Number=SeqID_163302
atgtttctcacaaggactgagtatgaccgaggagtcaacaccttttctcccgaaggccgtttgtttcaggttgagtatgcaatcgaagccatcaagctgggatcaactgcgattgggttgaagaccaaagaaggagttgtccttgcagttgaaaagcgcatcacatcgccgctcctgtatgatggaatcaagtaa

SEQ ID NO: 46525 - DNA, 1674 bp, Glycine max
  Peptide Sequence Number=SeqID_163303
ccagggaaactcttgaaacatcatggtctgcgctttgtaatttcatcgatagagaagaaggaattggcagtggcagcaacagctgaaaaggatccccagaaagttggatcttcaatagagaagaaggaatttgcagcaattgctgaaaaggatccccagaaagttggatcttcaacagagaagaaggaatttgcagcaattgctgaaaaggatccccagaaagttgaaactgatgagaaggtagaagaaaaagaagaaacaaaggatccaaagaatgctggatacaagataagtgcaactgctgcttataatattgctgcctctgctgccacttatctgcattctcagactagtagcatatttccattcaaatcctcaaatgctgtgactggtgaaggttcacttgaaggaagcaatgaaagccttgacactgttaacatgctaaacacagaggtggcatctttgatggcaactactgattcagtgacagcagtggttgcagcaaaggaggaagtaaagcaggctgttgcagatgatctgaactctgcacattcaacaccctgtgaatggtttgtctgtgatgatgaccagagtgctacaaggtttttcgttattcagggttctgagacgttggcttcatggcaagcaaacctactctttgagccaattaaatttgagggtttagatgtacttgtgcacagaggtatatatgaggctgctaaagggatatatcaacagatgttgccagaagtacgtgctcacctaaaatctcgaggttctcgtgcaacttttcgtttcacaggccattctcttggtggaagcttggcattacttgtgaatctcatgctattgataaggaatgaagtgccggtctcctctctacttcctgtgataacatttggttccccatccatcatgtgtggaggtgatagtctgctaaaaaaattaggtttgcctaggagccatgttcaagcaatcacaatgcacagagacatagtaccacgagcattttcttgcaattaccctaatcatgttgcagaactattgaaggctgtcaatgggaacttccgtagtcatccttgtctcaataaacagaagctactatatgcaccaatgggtaatctgctgattctgcagccagatgagaaattttcaccaagccatcatctcctaccatctggcagtggtctatatcttttgtgttgtccattatcagaatccgatgacacagagaagcggctccgagctgctcagatggtcttcttaaactcacctcatccacttgagatattaagtgaccgatctgcttatggatctggaggaagtatacaacgagatcatgacatgaactcttacttaaagtctttgagaactgtgattcgcaaagaacttaaccagatccgtaaagctaagagggagcaacggcgtaaggtgtggtggcctcttctgttatctcgtggagctgataccagcattgttgctgggaggtccatgatatcaatcaatgtgggtcaacgccagtcacccttctccagcgtgatacaaacagggagagagtccctgaaaaggttcagtaggattgttacatcccaacatatgcatttgtttgtgttgcttttgttccctgctcggttgttgctcttgggaacatatagcgtaattaacctcaaatga

SEQ ID NO: 46526 - DNA, 222 bp, Glycine max
  Peptide Sequence Number=SeqID_163304
atgtcaagtatttggatgaaactgcaatttaaaaccttggcattggccacgattcaatgcaatttagattctagtgttaccattgagaagttttctgtccgcattggttggaacaagtttgctatttatgagcctgaagatagtaataagtgcgcactgtgcttattagatatcaatggaagcatatcagattgccacattgattgtgagttcttcgagtag

SEQ ID NO: 46527 - DNA, 285 bp, Glycine max
  Peptide Sequence Number=SeqID_163305
atgactttagaatcagaccagttcccactattgaatgaccctaacaaagcatgcatctacgtgatcaagtccggaaacctcctttacaacaaagagaagaacaagatgaaagacttcaaaaacacaagtggtgaggatgtctccttcacctctaggatctcacaatcactcacaaactcatctcaagctctcaaaacggcttccacttcgaactcgcttctctgcaaatcttcacatagcaaaatctctcagaactctttggaacttggacctttctctctctag

SEQ ID NO: 46528 - DNA, 543 bp, Glycine max
  Peptide Sequence Number=SeqID_163306
atggattccctgaaaacttggtcaaagtttctccaaaaaagctgtttacctccattttcagaaacgctgtgcttctcgttttctctttttcgtgcggcattgcctctggttcgtgggggtagcagcgttgagcgcagcggtgaaggtgaaggtaccaccgtcgagcgttgcggtggtcggtggcggcaaacgaggtacgtagatggtggtttgactatcgtggacatggacgaagatgagtggatgtatgaaataatgtctgaacgagcggatatggattatgaaaatgcaaaatcatgtggtgcgaatgaaccacatgttgattgttcggatgcggtcaagatttctcaggtgtttgagtgtcgagaggatgttttgcggtgggctcgatctgtggttgatgaaaatggatttgtggcggtgattttaaggtcagacacaaacacaggagtggcgagtataagtgtaggaaaaaagaatttatcagaagagacactgggactaggaaatgtgggtgtcccttcaagcttcgttgcaagctag

SEQ ID NO: 46529 - DNA, 1029 bp, Glycine max
  Peptide Sequence Number=SeqID_163307
atgggaagggctccttgttgtgagaaagtggggttgaagaaagggaggtggacagcagaggaggatgagaccttggcaaaatacattcagaccaacggggaaggttcttggaggtcattgcctaaaaatgcaggattattaaggtgcgggaagagttgcaggctgagatggattaactatttgagagctgaccttaaaagagggaacatttctgctgaagaggaaaatacaatcgttaagttgcacgcttcttttggtaacaggtggtctttgatagcaagtcatttaccaggaagaacggacaacgagataaaaaactactggaattctcacctcagcagaaaaatttacagtttcccaggtgcaagtgcagggatcatggatacacctaaagtagcgtctattcctcccaagctcaaaggtggtagaacaagccgttgggccatgaataagaacaaaacctacacccaaaatgtcaatgtcgcaatttaccagagacccaaacaaacgtttactcaaccaaatagtgatttcacggtcttggacgctgacgtggcagatgtgaatgagccaagaatagaggagctagaggcagaggtaaataaatgtgacaggagcgttgatgaaagtaacgatgaagacatcttgggactgtgccaaatggagggcattagtgacattttggaaagttggcttccggaaacaacatgtgtggtttgggacttgagtgaagagatagacaacaatgacatggtagtgagggtgagtgatgcgtgtcgcgacaaaatggcatcgagtggagaggggtattcatgctcttcttccatggcattggatcaacactgggattgggagagtgtcatagagtttaataacgttgtcgagtccgaagcttgtaataattgggagcaacaagaaaaaccgctcacttggccgtgggaggacgatgcttgggaaagccaaagcaaaaatttgggagagacagatactcagatgcaaaacgacatggttgattggttcctctcttga

SEQ ID NO: 46530 - DNA, 405 bp, Glycine max
  Peptide Sequence Number=SeqID_163308
atgaggggaaaagaccatcaaaaacatttttgtagctttctgatgactattagagcaagaacagtttgcttacaatatatatggtattttgagcagtttcgtatccgtacagcaccccatggcctcttcagaagggaaggcaatgacttgcacaccactgtcactataacactggttcaagcacttgtcggctatgagaagactgttaaacacctagatgagcatctggtggacataagcacgaagggaatcacaaatccaaagcaagtgaggaagttcaatggagagggcatgccactgcatatgagcaccaagaaaggatatctttacgtcacgtttaaggttctcttcccaacctcactaaccgaggagcggaaaacaaatataatagcaattcttgattag

SEQ ID NO: 46531 - DNA, 483 bp, Glycine max
  Peptide Sequence Number=SeqID_163309
atggcgcctcttctcctttgttttctgctgcatctccatggtgaaaaatcaccattaaaggacctcattgaaactcaaagatccaacctacatagaagtcccacaagcaagcttccatcacagatggttgcaactgaggctatacaagaggttgttgttgctgagagtttgctgcaatgtctaagactgcccattacgcggtttcgcaatctccgctttgtcttcctcttcactcttgattccatcaacgcttctctcgtcaccatttccaagaggctcaacaagacttgcgattggattgttgccatcaaagccctcttggagtatgagcattgtgttgttggattgatatttggtgcgtggaaggaacgcgcagcaaaggaagttgtggatgcagtttggtacgagaaagatgacttgtgtgaagcagggaagaggaaaactgagatgagacagatgcaacgattcttaactttgtggtga

SEQ ID NO: 46532 - DNA, 426 bp, Glycine max
  Peptide Sequence Number=SeqID_163310
atgtatgaaacagattggtctgcaacagtatctatagatgatttctatttgacgactgaaggtcagaataaactaagagaagctaatccaggaaatgctcttcttgagtttttggaagtcattaaattgggagttgctcattctcctggagactcaataatgcccagagaaatgtttcttttccaagacttcatcatattccctttgatgcatagcatggtgaacttcttggaatttggatatgacccctgtttcatggttctttgcattggatacttgcatgtacacagggaaaaaacttcaaaaatggagctttttataatttctggtgctgcttgcttgcctcatccctctaaggtaccttccatacttcaatatcatgactcattctgctcagttaataggaatgagaatgaagcatgttaa

SEQ ID NO: 46533 - DNA, 750 bp, Glycine max
  Peptide Sequence Number=SeqID_163311
atgtcgcgggagtcaggagaccttggggacatcaggtggggtgctattgtccaaaaccaagcttggctaatcccgacccaacccgggcatagtcagtccgtgagaacctgtgacgtacctaagcaggcgagctcctggcagtcaaccaataaaagaacaaagtccacgaagcaaggagacttgtgtggcggctggccagctatgtatcttgggtggtatctgaaaattaccctctgggcactggtaatcgattaccagttgtgtgtaatcgattacatagtgctacctgctactgattccaatgtgcaaaggttgagtaattcgtttttgggcactggtaatcgattacatactttgatcgcgatggcagcacagttgatccatgatcgtgttgtgatggagtgcctagagggtgtttgggagaccctcgaaggcaatgagaggtgccgattccgtggcacaattcgactcactgctacttcgctagtacatccggagcagcccgcgtgcacacttcagcagcctgtggaatggatactacctacacccactccatatcgactagttgagccgattcaagtgatagaggtgtcatcctctgaagaggatcttgaagaggacccagaggagttatctcctgaacctgctatggacgcccctgatctaccagaggatattatgtcagcgtctaaggcagactctacagaggagagtggccctggagggacagcgcgaaaaaaattaccgtga

SEQ ID NO: 46534 - DNA, 207 bp, Glycine max
  Peptide Sequence Number=SeqID_163312
atgtctccgctgcagcccaaccgcgtcgaccccaaaatctggcgggcatgtgccggtgccactgtccacatggagcatgcctctccctcgcatcacctcagccctctcatccgtggcgcgatggggagagtgaccgcggaggccgtggctagagcttctacagtacagactagcttgagctcagtgattggagttctctttcgctag

SEQ ID NO: 46535 - DNA, 444 bp, Glycine max
  Peptide Sequence Number=SeqID_163313
atggatctatgctcttcttgtaggttcactagctctcccaagtggtggaatctcttggacttcatcatcttcatgagtggtaggaggggcttgggaagtagcacctactctagttactcttcatttcttgttggaagtggtcagagtgttattttcttgagaggtgccatgttgaaaaataagaaaacaccattgcatttaacatatttgataaataccaatacaagaaaagaaaacatattggaattaaaaagagaaatatcaaacaaccacaagaagaaaggtgatgtgggaatatggaatattaaaagtaatggagaatgtatgtgcataagtatgatgggaaattgggttgaaaaagtggtttggaagagggagagtttcaatgagaggcaaaaaggagcaaatttgaagaagtgccaaagtggatgtcgcgctaagtga

SEQ ID NO: 46536 - DNA, 290 bp, Glycine max
  Peptide Sequence Number=SeqID_163314
atgggttctgattccaatttgggagggtcgccctcagcatcttcgcccagtgccaaacgcaccagagatcccgaagaggaagtttacctcgacaatcttcgctctcacaagcgttacctaagcgagttgtttttgtgcaatggcctgtcaggggatttccgtgttttggcttctataacctttttttttcctataatggcatccagtcttaacgggttgacagttggagactcacttcctgataatctcatggattctccagcaaggtctgaaagcatgttctctttcag

SEQ ID NO: 46537 - DNA, 444 bp, Glycine max
  Peptide Sequence Number=SeqID_163315
atgagatataatgttgccaccattaacaaatatttagagaacacatttcaagagcctgtaagccaagattgtgcctacttcatcatgtatgctagaagaagtggttttagcaacactgaccttagcaacaagctttgcctcccatggaggtcttatatggataacgatgctacaaaagtgcttagctctggttgcttggcttgggggccaactcattttcatgggggtgtcggtgtcgtaagtgttgctacaaatgctgaggctactagacttgtggctggagaaggagagcaagcagaagaagaaagacttagcaaggaagagatcgaggatgatgaaggacgtggctcgagtgatgaggatgaggaaggaagtgaagaagaaggaatttatgacgatgatgatggcttcgataattctgggagcaagtttgatgatgcttaa

SEQ ID NO: 46538 - DNA, 226 bp, Glycine max
  Peptide Sequence Number=SeqID_163316
ggagattcgccacttgagtgaatcccccaccgagggtcaggaggccagacaagaaagattcgcgcgcctcaagacggttcttgactcagtcgacagccggttggatcaagcccgagaaatagatcgggttcgtgacaacgaacgtgctcggctacgggcagaaatggatcacgactgtgatcggtggagggctctcgagagaaagaacgcccaaatgcgattgaaa

SEQ ID NO: 46539 - DNA, 183 bp, Glycine max
  Peptide Sequence Number=SeqID_163317
atggaagtgacgcgaaggccacaggctttgagcacgacgcctatgctgctggcggtgacgcctttgccgaggccactgaccactccgccgctgatgagcacgtatttcattctgctgcttcctactgtccaacttgctgcttttgcgcatagcagatatgatgttgctcgaaaatcattttag

SEQ ID NO: 46540 - DNA, 111 bp, Glycine max
  Peptide Sequence Number=SeqID_163318
atgctagcaaccaagaaaataagggaatacaataggaagactcatatgggtcccaccttcagcaggtattcgccttactcaaaaggaaacaattcacctacccttaactga

SEQ ID NO: 46541 - DNA, 554 bp, Glycine max
  Peptide Sequence Number=SeqID_163319
ctctgatggtccttcaccaaagcaagccagggttagaggccatctagtgaagatcgatgctggcagcctcaacgcattcctagagacacctgtggtgttggcagagggccgagggttcatcttgaacgcggagggccattctgggaggattcttaggaaagatttgactactttagcccaggctgatctttggcctagggttgtctccgacagcctcacttttgagagcctaagcacggcgattaacttggcctacatcaggaagaactgttggaatcttgatgatctgatagtttttatccgaggggctaggagggcgagggcgaggccagctgagcttcgttccacatctgcagctcctactccagcatccacatcagcaacgagatccattccttctgttaagcagtttctggaaagggtagcttggcctggtgcccaaccttctctttacagggaagatgaaggtcccacagcccaggtaccacaacatgtagaggatgcatcatctgaggccaccattccagagccatacatggtagaggaggaggcag

SEQ ID NO: 46542 - DNA, 305 bp, Glycine max
  Peptide Sequence Number=SeqID_163320
ctctggttacgggcctctgtagtcctacagggtgcccgttccccccgacaaggtcacgccatcatggcatagagatcgtgcccgcaagacacccagtggacccgaagaagtccaacatggtcttggagttgtcaaactctaattacgggcaggcacagggcgaaacaccacagcagcctggggatggccagcagcgggcaacagacgcaccgccatcacctctagagttcacctcatctcatccacaaaaagccatcaagcgtccagctcaagacgttaaagaagcgctactaggaggcaaccta

SEQ ID NO: 46543 - DNA, 234 bp, Glycine max
  Peptide Sequence Number=SeqID_163321
atgaagtacgaacgaagaacggttaagaacgttcacggaattggtcacggaaacgttaccaaaatagggggaggagcttaccgcccaactcgcccaggcgagctggtgacttactccaaaagcaacttgctcgcccagcgagctggttgcttctcccctaagtcatctagtgggtccaagtgggcccaagggctgaagaatgtccaaaaatggaccattttgcccctatcttga

SEQ ID NO: 46544 - DNA, 186 bp, Glycine max
  Peptide Sequence Number=SeqID_163322
atggcggaaaaattctgtcacggcatccaaatcaaactacctccttctaatgtggtcacgctccgatgtacccacaaatttctcggaatgaacgaagattattccgatgacgaccttatttccaagaagaaggagagcgtgtactctttaaatgtattccgaacaattattaatggaaggaagtga

SEQ ID NO: 46545 - DNA, 225 bp, Glycine max
  Peptide Sequence Number=SeqID_163323
atggattacgggtcgggtcagcgtcgggttgagatagtgagcgggaaaagctacggctgtagtcagagctacatggcggcgattccgagcgaggtgactcgggcgagtcacagcggagcagctacggcggcgaagccttggagttttggtggcccagagtcaaggcggagaaagaggattgccaagtataaggtttacgcggttgagggaaaggggcatccatga

SEQ ID NO: 46546 - DNA, 264 bp, Glycine max
  Peptide Sequence Number=SeqID_163324
atggatgatggagatctggtagaaatggttcatgttgatataagtccatttgaagttaaggctccttcattcgatgttcaagatccattgatagaattaaatctcgacacaagtgaggaacctcgaattatgaaagcaagtggtttgttgaatgaggaacaaggaaagaaattggtggaacttatcaagaaataccaagattgcatcacttgggattatcatcagatgcttgggttgtctaaagagttggtagagcattattaa

SEQ ID NO: 46547 - DNA, 780 bp, Glycine max
  Peptide Sequence Number=SeqID_163325
atggctgcaattacttgtttcatgggattgcaatatgggcacataattgtacatttgcagggccacaagcagagggtacttctttggtctgtgttttccttctctctattgctcataggatacattctggagatcttaggaatgcctttatcaaaagcactgtacacattaagctacacgtgtatcactgcaggggcatcaggcttagtcttgactgctatctattacatttgttacacccatcctcaatcattgattcttttgtcatctaacggtcctaataaaaacacattagtgaataatgagtcacgtgcaaagagatgtagggtgagagatgccaacaaaggaattaccattgtgtataacagaggtagtggaatcaaatgtctggcattcctctgccaaatatttagccatagtgccttgaaattgtctctgggcaatgatgtttgtgaggttttggcaatgatgtttgttgacatagaacatctcagaaagcctacagttttactgcaatggatgggaatgaatgctcttgttgtatatgcattggcagcttgtgacattttcccagcagttatccagggtttctattggcattctcctgaaaataatttggttgacgccagtgaagctttaatgcagatcatatttcattccaaaagcctgccaaagttgtctttctccactttagctttggaatgtctgaaaggcatttccactatttgtgtcttgaaaatcttgagggtagcagaattcagcatgggactgaatgcttaa

SEQ ID NO: 46548 - DNA, 810 bp, Glycine max
  Peptide Sequence Number=SeqID_163326
atggcactaagcaacaacgtcataggcgccattaacttcgttgcggtgctcctctcaatcccaatcatcggtgccggaatctggctaacaaccgaaccagccgattcatgtgtcaaaattctacaatggccaatcataatcttgggggttcttatatttgttgtggctctggctgggttcataggggccttttggagaatccccatgcttctcgtattttacctcattgccatgcttgtgcttattgtgttgctggtttccttggtggttttcacctatgccgtcacccttagaggccgtggcaacattgagcccaatcggtcttacttggaatatcgcatggatgatttctcaatttggcttcgtcgaagggtgaggagctccagcaagtgggatggcatcagaagctgtcttcgctcttcgaatatatgtgctgacttggatcaacagtaccgaacggctcaggaattctttaatgcacacctaaccccaattcagtcagggtgctgcaagccaccaacaaaatgtggttacacgtttgtgaatccaacgtattggattagccctatcaacacggcagtagacatggattgcatgaaatggagcaacgaccaagcacagctttgctacaactgtgactcgtgtaaagctggattgttggcaacccttagggtggagtggagaagggccaatgtgatattgatcgttactctagttgctttaattgcggtgtatttggtaggatgttttgcatttaggaatgccaagacagaggagctctttcgcaaatacaagcaaggctactcttga

SEQ ID NO: 46549 - DNA, 534 bp, Glycine max
  Peptide Sequence Number=SeqID_163327
atgtcaagtgaggtagaagaagaagaaagaagacctcttatcggccatgatttaggttcctcaattctcatcgttcatcaaaatgaagacactatctcaatctgtcctttgccacaatccaatcctacagatacatcctctctttctcttcctaatcaacgcctttcttctctcgatgtcttccgcggtctaactgttgcgttgatgatattagttgataatgtgggaagggcattcccgtccttgaatcattctccatggtttggagtgacactggccgattttgtaatgccgttttttctctttgtggttggcgtttcgatcggtctggtattcaagaaagtctctagcaaacccaacgccacaaagaaagtcatatcgaggacgcttaagcttttccttttgggactgttacttcaaggtgggtatttccatgggcacggcaaattaacgtatggagttgatttgagcaagatacgctggcttggcgtacttcaggtagctggaaccagtaaagttgttaacccttgctaa

SEQ ID NO: 46550 - DNA, 1041 bp, Glycine max
  Peptide Sequence Number=SeqID_163328
atggagaggcttacggtggacctaaatctatatttgcataagcgtagcagtggattaatcatctttgcaccgttgagatcgtcaagatctatcgttcctggtgggttcggagagcgcgatggtggcactaggtatccgccaggtccgtctggtgggatcgacaaagggggtaacactggtgatggtagatttggcggcagaggtgacggtggtagcagtggcggaggagatggccgtaagggtggcggaggtgctagggcaccgctgataatatcgtcaagatctatcgttcccggcgacgacggaagctgcggcggcggttgtaggtattggggttcctctggtgtctccggcaaagtggggagcaagcagtcagcacctccaccacacggtggttttggcggtggtggacattcaataaccacgggtggtggtggtggtagtggttttggcggcggcggacatttaataataaccggaggtggaggtgatgcaggcaacggtggtggaggtgatggtggtatcggcggtggaggtgacggtggcggtggacactcttttggttgtgggggtggaggtggaagctcgcactcattgcacattatgcgtggaacttggtcttttcccactgttgaagtagtagtttgggtggtggtggtggatgaagctgttgttaggagaaaaataatggagtacaagctcgctcagagatgcaacgccatcaacctcgccgagggcttccccgcccctcctcacctcaaaaacgccgccgtttctgccatcatttccgactccagccagtacaggcacttgcaaggtgtatgtgatctcttggccaagatagtgaagcaaatgcatggtttagacatcgaccctcttaaggacgtagctatttgctgcggtcaaagcgaggcatttgcagctgcaatctttgcaacacttgacccgggagacgaagtcatacttttcgacccttcctatgaaacgtatgaaggatgtgttgtcatgaccgggggagtcccaggaagcttgcaatcttga

SEQ ID NO: 46551 - DNA, 216 bp, Glycine max
  Peptide Sequence Number=SeqID_163329
atgttgtctagtgttgagagtgataacctcgactggtgtaagaattgcaggtctgccaagcttgtcaagccccccaacttggacaagtgttgtccgagctttttctgtctagttgtctggggtggacatacttttggctttgcaagcgtgtgcagcacacgcgcaatacttttgcgtacatgtcactcgtggagtaggcacgcactggagacgtga

SEQ ID NO: 46552 - DNA, 579 bp, Glycine max
  Peptide Sequence Number=SeqID_163330
atggtatacgagcatataacgtatgacaacctaaaacatatatccctggcctcatttcctggaatgcaagagcggacaattataacgtcttctttgccaaaatcattcagtgtcacaggttggagagttggatgggcaattgcaccagcttttcttgcgtctgctatcagaaatattgacggaagggttacagattatgctccagcaccttttcaggaagctgcattgactgctttgagaagtccccctgaatactttgaatcactcagaagggactatcaatcaaaaagagactatatcatcaagttgctaggtggagtaggttttaaaatagagtttatacctcaggattccttcttcttatttgctgagcttcctgataattgccctctttcagatgtagaatttgttaagaagctaatactagaagcaggggtagtggctgttccaggacaaggattttttcatacaaacttatcatcaaatgaagtttctaacttaaactatcagaagagatacgtcagaaagactgggcaagcttttggatgctgcaaggcgtcttgcgcttcactaaagtag

SEQ ID NO: 46553 - DNA, 405 bp, Glycine max
  Peptide Sequence Number=SeqID_163331
atgaaaaaatgtcaaaagaaaatgcgaagaacaaatctccctcgtcctttgttttttgtgatagccgatgcaatatcgtcgttgaaagaatgcaaggggtcgagccagccagcaatagccaagttcatcgaggacaagcacaccaaagtgctccctcccaatttccggaaacttctctccgttcagttgaagaaactcgtcaaatcggagaagctttacaaggtcaaaaacttctacaagctttcttccgccacggataaacagacccagaagagtaccgaaaccgagcccaaacagaaggtgggtgagaaggctaaaagattgagtcaagtgaagacacacgaagctctcaagaagaaagcaccgaccaagaaggacgcggcggcggcggtggatgcctcgtga

SEQ ID NO: 46554 - DNA, 519 bp, Glycine max
  Peptide Sequence Number=SeqID_163332
atggccgcaatcatcaccggtgagaccgccggccccagcagcagaaaggcgataatgccgccaagaatctccgccatgccggacaggcaggcccagaacagcgctttggctttcgagccggtggcggcgtacatcggtccggccaccgccagcccttccggaatattgtggatcgcgacggccagcgcgatgcccagccccagttccatatcgctgctggcggtgacaaaggtggcaatgccttcgggaaagttatgcaggctgataccgagcgtcagtaggatcgcggcgatccatggcgaaataacccagcagaccgagcatgaacatgccgtagccgagcaccggcgacatgccttccgcatgcagcgcggcgggcagcatctccatcagggaaatcagcagcatgatgccggcggcaaatccgagcgcaaaggccagtacgcggttcgacggcttttgaccgagcacgccaaaaatcgcgccgacgaaggtggcaccgccagccaggatggttag

SEQ ID NO: 46555 - DNA, 990 bp, Glycine max
  Peptide Sequence Number=SeqID_163333
atgacccgcatgcccgctctgtttctcggccacggcagcccgatgaacgtattagaagacaaccgctatacccgcgtatggcaacagctgggcgaaaccctgccgcgtccgcgcgctattctcgccatctcggcgcactggtacacgcgcggcacggcggtgacggcgatgagcaatccgcgcaccatccatgattttggtggcttcccgcaggcgctgttcgacgtgcgctatccggcgccgggttcgccagcgctggcacagcgcgttatcgatctgctggcgccggtggcggtgcaggccgatcagcagtggggctttgatcacggctcgtggggcgtgctggcgaagatgtatccacaagcggacattccgttgattcagctcagcatcgatggcacccagccggcggcgtggcattttgcgctgggacgtaaactggcggcgctgcgtgacgaaggtgtgatgctggtggccagcggcaacgtggtgcataacctgcgcatgattcgctggcagggtgcggaaagcgcttatccgtgggcggagagcttcaaccagtttgtgcgcgataatctggactatgaaggcgaggcggcgcagcatccgctggtgaattatcagcagcatgaaggcgcgcagctggctaacccgacgccggagcactatctgccgctgctgtatattctcggcgcgcgagctgaaggtgaggcggtgagcatcccggtggaaggcatggagatgggttcgatcagtatgctgtcagtgcagatcctgggtgatcagcgcacgatcttcgcgcagaccgataccggcaggctgatcgtcaatcagccagctgccaatcagcgtatagctgtcgccaaacttcggcagcggccagaactgctggacgatcatgccctcttcgccataagggccatcggcgcgcgcgatttcctgaccgttttccacgatggtgatattggcaccttcgcgggaaaaccagcg

SEQ ID NO: 46556 - DNA, 393 bp, Glycine max
  Peptide Sequence Number=SeqID_163334
atgaagcttgcttctacacttcgccattcttcattcgttcttcgtcgttcgtcgatcttcaaccgatccgctttttattggtttttccaacgttttcctcaaataaacgttggtggcgactccacgcattttccttccttggaagatgcaccatcgagtctcgcgtcgccctcccaccgaagggtgaaaaagaggctaagtcatgaagtgccaaaacgcgcatccaccactaagcgcagcttcagcgtgcttagagcgacagaagaatctggcagggcatcaatatcaaggccgcgcgctaagcgcgagatcagtgcactaagcgtagcagctgtcttcagtcaggctgagcgcatgactagcgctaagctcaaatccacttactcgtactaa

SEQ ID NO: 46557 - DNA, 561 bp, Glycine max
  Peptide Sequence Number=SeqID_163335
atgggtaaagtaggcgaggtgcaagagcggataaaggtcgacacagaggccctgaaagagcaaatgggcacaatgatggaggccatgatgagcatgaagaagatgatggaggtcaatgcggctacaattgccgctatcaacgccattgctgaggtggacccgactcccccacctagcctcaaccaaataaatcatcccatctcagatatggtagggcggagaggcaaagaattgggaagtatgggcgaccctcattttgtgcaagttcaaaacaagcatcccttctcactatatggcttgcctcccaactacacaccacccaatgtggtgcacactcccgatgagaatgtcaataactccaatcccatactcattgatagccaacaacctcaatctgatcatgcacatgtgtctcaacccatgggggagacacatgaaataccccaccataatctagtcgacttcgagcctcgcctcaaatatgccactaaggggcaagcagttggttgtgtgcccctgctaaacactttggagggccctcggttttgcccacaaccataa

SEQ ID NO: 46558 - DNA, 291 bp, Glycine max
  Peptide Sequence Number=SeqID_163336
atggcagagttgtatctagtgcctgacgttgtcatccctccgaagttcaaggtgccaaacttcgataggtacaaggggactacttgccccaagaatcaccttaagtgggctaagcacgcatccaccactaagcacagattcagcgtgcttagcgcgacagaagaatctggtagagcatcaatatctaggtcgcatgctaagcatgagattagtgcgctaagcgcaatagttgtcttcagccagactcagcgcacgactggcgctaagctcaaatccacttactcgcgttaa

SEQ ID NO: 46559 - DNA, 252 bp, Glycine max
  Peptide Sequence Number=SeqID_163337
atggtgcgtcttcaaaggaagaaaaacgtgtggagtcgccaccaatgtttattcgaggaaaacatcgaaaaaaccaaaatggaaaaaggtcgaaggtctgcgtattttgaaaacgagggttcgagagttgtttacgcacggggaagtgataagacgagattacggcatgaacgatcagtcaaaactcactttaaacaaagaaaaagatcatcgattatcaaagaaggagacgaagaggcacaaacaatatag

SEQ ID NO: 46560 - DNA, 222 bp, Glycine max
  Peptide Sequence Number=SeqID_163338
atggataagagcttgaaggtcggagaagatgagtggagggagagggagagaatgagcatgaaattttgtgcctcaaatgagtgtagtaatctagaagctacctcccaagttcaaagatccaggaagcgtcaccatcccatgctctatagggagtgtatccgtaggagaatagggaacctcaaaattgaccctacaaggtgttggaccttgtggcctcaataa

SEQ ID NO: 46561 - DNA, 264 bp, Glycine max
  Peptide Sequence Number=SeqID_163339
atggcttctatggatacctctgatatggtcaactctaagatctttccatgcaatttaagaatacgggggtccggggaatttgtcaccttcttagatacgacatctaggggtagcgaaatgccccaacgcacgtttttaagaaggcgacacggaccctccgttggtttgtttacagtagggatcaagacagaacccatatgcaatgcctatgcaaaagacacaatgcgggaatgtgcacagtatgacaatatttaccgaacataa

SEQ ID NO: 46562 - DNA, 1713 bp, Glycine max
  Peptide Sequence Number=SeqID_163340
atgtggtgcgcgggcacattgccggccgggaaggctggctgggttgccagagttaacattttacaggacccaagtatggaaacaccgatgcgcagccgcacccgcatagtgctgctgatagcgctttttgctctctattatctgatcccggtgccattccgtgatctctggcagccggatgaaacccgctatgccgaaatcagccgcgagatgctgctgagcggtaactgggtggtgccgcatttttttgatttgcgctacttcgagaagccgattgccggttactgggtcaataatcttggccagctgttatttgggcatgataattttggcgtgcgcgccggtgcgattatctgtaccacgctgagtgccctgctgatctactggctgggcaagcggatgttcgccagccgcaaaatagcgctcaccgccagcgtgatctttcttacctcgctgctggtttacggcatcggcacttacgccgtgctcgatccgattctgctgctgtggctggtggcggcgatgtgcagcttttggtttgctgcgcaggcgcacagtacctcacagcggctgacggggtatgtgctgcttggcgcggcctgtgccatggggttcatgaccaaaggttttctggcgctggcggtgccggtgctggcgattgtgccctgggtgctctggcagcgacgttttggcgaactgctgcgctggggcccgcttactgtgctggtggcggccgcgatcagcgcgccctgggcgctgtctattcagcatcaggaaggcgatttctggcactacttcttctgggtcgaacatattcagcgcttcgcggagagcgatgcgcagcataaagccccgttctggtattacctgccggtgttggtggcaggctgtctgccgtggctcggcctgctgccgggcgcgctgagcggcgcatggcgacagcgtcaacagcacgctgccgcgatctatttgcttagctgggttgtgctgccgctgctgttctttagcatcgccaaaggcaaactgccgacttatatcctgccgtgctttgcgccgctggcgttgttgatggcgcattatgcgcacggtaacaccgcgcgcctgaagcaggcgttggtggtaaatggctggatcaacctgctgtttggtctgggcgccacgctgctggtcgtggtggtgctggcaccatgggggctggcgcaccatccggtgtacgcgcgcgatgagttgctgcgggtagtgtgcgctgcgctggcatttgccggctgggcggtgatgggctggttaagcctgaaaacaggccgctggcaactggctgcgctttgcccgctggcattggcgctgctggtcgggttggctatcccgcaaaaggtgcgtgatagcaaacagccgcagagcttcgtcagcgccgttcggcctcagctggcgcagagccgctatctggtggtggacaattccggcatcgcttctgcggtcgcatgggaattgcgccgcagcgatatcactttcttcgatgaaaaaggtgagctggagtacggactgggttatcccgatgcaaaaacgcgctacgtcgacggggaagccttcgctgactggctgcgcctgcatcgccgacagggtccggtggcactggtgctgctgctgaattctgacgaaaagcaagcggatgcgcatctgccggtgccggatgatgtgtatcagcagggacggctg

SEQ ID NO: 46563 - DNA, 268 bp, Glycine max
  Peptide Sequence Number=SeqID_163341
ggatcgtgcccgcaagacacctagtggacccgatgaaggccaacagggtcttggagttgccagctctaaatacgggtctctatcagttcaagggagtgcctgttgcccccagcagggtcatcaggccccctaccaatcgagctttcatcaagaagcaacagacgcaccgccatcacctctagagttcacctctgctcatccacaaaaaggtttgagtattgcctacaccacatggctgaccaataggcgaccaagtccaaggccaaag

SEQ ID NO: 46564 - DNA, 264 bp, Glycine max
  Peptide Sequence Number=SeqID_163342
atgaggattcttttttacaggccaaggttcaaaaagtctaaggttgtgtttcaatggggtcttttatcgtgggaacccaatcttgatatctggggagaaacaaaatttgggagtcaagccaggtgggcactcaagcatcccatttatggcattgtgatactacggttgggaatttacacagacagacccaacgtttccaagttatgttctttcatcagttcaatgaattcatccattcttatctcggtttattccggaaaataa

SEQ ID NO: 46565 - DNA, 186 bp, Glycine max
  Peptide Sequence Number=SeqID_163343
atgaaaaacaaaatactaacagcaaacaaccaatacacgttcgagcatcgtcttaaaaataccacacaccatcaacctaagtacaaggataaaggtagcgaaagggaggtagcacacaccttcgacagcggggaaggcgacaacggggctcgtgcggcacaggcttctcgtttagggtttagctaa

SEQ ID NO: 46566 - DNA, 249 bp, Glycine max
  Peptide Sequence Number=SeqID_163344
atggatcaagctggtgaggaaagaaagttgcaactgagtgagttagatgagatccgcctagaagcctatgagaatgccaagttctataaagaaaagaccaagaagttccatgatagcatgataattaagaaggacttcatggttgggcaaaaagtgttattgtataattctaagcttggactcatgagtgctgagatcaaaagagactccacaaacaagagctttcaaggtcaatggacatctacttaa

SEQ ID NO: 46567 - DNA, 1320 bp, Glycine max
  Peptide Sequence Number=SeqID_163345
atggatgagaacaaatatttgtggagggagtataatgagattcttgtccatgaggaactattttggtatcgaaaggctagatgcgagtggttccgttttggggataggaatactcgattttttcatagttcggttgttattcgtaggaagaggaatcgaattgaagccttggaagattcatcgagagacctgattatgggcctggttttgttgaagggtatggctcaaaattactttcaagagttgtatcaaaaggaggaaggaggtgaattgtggaacttgtgcaataatttcgcaagaattgaggaggttcttatgttgaatgttcaaaaggtttttgaagaggaggagattaaggaagcaatgtttagtatggggccttttaaatccccggggactgatggtttgcaccttatattttttcaggctaattggagcacggtgggtgaatctgttgtggctatggttcgtaagtgctatgagcatcccttgaccatcaaagatattaatggtacatctttggtactcattcccaagtttgatgcccctactcatgtgaaccagttggctcacttgattgatagggagctagtgaggtttagatggacaccattaccagtaagggagcttagggagttgtcagggtttgctctaacaaggtatcttgagaggtactttggggttcctttgattcatgggctaagaagaaagagatgtgccagttcttgttggacaaaactcaacgccgtcttagaaattggtgtgctaatagtttgtcgtttgcaaggagatgtactttgtcaaaggcggtttgtgtggggcactttgaagggagaaaggaagtgtcattcagttgcagggagtacaatgtgtcaacctaagcaagtggttggggtggaaggtggattcttggtgaaggaactcaaatggcaaattctcaacaagttagcgtatgagtctttggctgatcctagtcctcttctggggcctgggagatggaagcaggctcagaatgatttggttttcaacgagactccttttgaaaggcataaagttatacatgaggcaaagagttgtctggttggaggagaaactttgataaataagagtagtcaacatgatcggtttgtggaatcccagctttgctatttatcatgggaaccttcgcaagaaggctgggtgaaagcgagtacatataggtatgtgcagttaggtggtttgaggcttatggatagggagtgggaggttcacctgcactatgtctatctcgagatgaatttgattgttgattatctttcgaatgaagcccataattatgag

SEQ ID NO: 46568 - DNA, 966 bp, Glycine max
  Peptide Sequence Number=SeqID_163346
atgtcaagtatggggtattcaaggtctttcttggcttcttttcttcttgctgtgttgctcaatgtgactaatgggcagcctctagtccctgcaattttcacatttggggactcaattgtagatgttggcaataataaccaccaattgactattgttaaagcaaacttccctccttatggaagggactttgagaatcactttccaacaggaaggttctgcaatggaaagcttgcaacagacttcattgctgatatccttggatttacctcttatcaaccagcctacctcaacttaaagaccaaaggaaagaacctattgaatggtgccaactttgcctcagcttcttctggttactttgaattgacatccaaactatatagttcaattccattgagcaagcagcttgaatactacaaggagtgccagaccaaattggtggaagcagcagggcaatcaagtgcttcatcaattatatctgatgctatatatcttattagtgctgggaccagtgattttagtttatatgcattgggagcaaggaggattggtgtgacatcattacctccaattggttgccttcctgcagtcatcactctcttcggtgctcatatcaacgaatgtgtgaccagtttaaacagtgatgcaattaacttcaatgaaaagctcaacaccacatctcagaacttaaaaaatatgcttccaggcctcaatttggtcgtctttgatatctaccaacccctctacgacttggccaccaagccttctgaaaacggattttttgaagcaaggaaggcttgttgtggaacggggttgatagaggtatctattttgtgcaataagaagtccataggaacatgtgctaatgcatctgaatatgtattctgggatggttttcatccctcagaggctgcaaacaaggttttggcggatgaattgattacttctggcatctctcttatatcctaa

SEQ ID NO: 46569 - DNA, 489 bp, Glycine max
  Peptide Sequence Number=SeqID_163347
atggatcagcctttcctcagtctcatacttgtgttccctacacacgctccgcctcacttcaccgcaaaagggctagggttcgcaattgcgagtcatcatcgctatcgtggagggtctcgcttgggacgtgctgacggcgatcacgtgagttggtttcgtgcgagtttgaagcatacgcgtttggctgaaggtttggatcaaggttctggtattgaaggttgtggttccaaaagtgaagtaggtggaccaaaacagatggcttttactgtggaggttaaccatgggggttattttactcctgaaccctttttgaagtattttggaggagacataactctgttatcagagatagacattgacaaatggagcttttttgaatttgttgggattctgaagcaggatgttaagattaagggagattttaagttatgctgggagggggctaatgctggatttaaagagttggtgttggatagccatgttgctgag

SEQ ID NO: 46570 - DNA, 708 bp, Glycine max
  Peptide Sequence Number=SeqID_163348
atggcattgatgattttgtcattacaagtaaatgagcagaatgctggaaaggtgcagaaaagaaaagcacctgccaagcctgcaaaaccagctcatgtcaagcctgcaaaaccaacacctgttagtgtcaagattgcaaaagcagctcctgtcaagactgcaaaaccagttccaaaaccagctcctatcaagaatgcaaaactagcaggatgttttgtatgttctaccattggatctgcacaactaaagaatactgctgctacaccagctgcaacaagtcctgttggccattatacaaaaatgtcttatggtattgcaaagtcagctaacacgggaaaacgtaaggatgctgtattgcacaacaacaatgataaagctaagaaaaagatgaagctatctgaaaggacaacaccctctgcaaacgcagccccatcaagcattcataagctgaaaaagttgtgtgaattgataaaaggattgataaaattgtgcatgagcttggcttatccaaacaaagcaaaatcaaatggacaagcaaatattcagaagggtgataaggaaaaatatgatgcgaaagtgcaaaagaaggcccaaggtttgaagccaccaagaccagtcacaaaaagctccgccacaacaacaaaggaatctttgtcacaagaagttaatagccctactctagggctgcaaaaaacacctaaaaaatag

SEQ ID NO: 46571 - DNA, 324 bp, Glycine max
  Peptide Sequence Number=SeqID_163349
atggtcgcacactggtggagctcggataaccagtcacaggcgaatgcatcactaatgctggaagaaggttgtgtgattccccttaagtcagatcgcttgctaaccattagtgaaaagaggccgcatgaaaagttttaccatggtctcatggtgaacgtcaaatgtacttaccaaaatctggagctgattaacgtcagggacgacgtggccaagatgagctctacgatcttgtgtgtcgggcttgtggtaccttttattaggagatcacgaagggggacctgcaaaacaaaggattctgacactcaaataattgctagcttgtag

SEQ ID NO: 46572 - DNA, 342 bp, Glycine max
  Peptide Sequence Number=SeqID_163350
atgttgatcgttttctacttcttcactccatcattttcccttttccctctacacccttttcccttcgtttctgcctcactcccacttcttgccctacaaattgcttttaccctctccactctaccagcaaaggctttgttgacaagaggtcgcattgacaatcacaaagatgataacaatgaaagaaagaacgatgctttattggtaatggcggatgtagggaggtcgttggagagcatatttatgaacctggtgaggatgataaaggacgacaacatttcggtttctcttgaatgggagaagtctttgttcctccattgggaaaacctcgaagctaggtag

SEQ ID NO: 46573 - DNA, 4848 bp, Glycine max
  Peptide Sequence Number=SeqID_163351
atggaaccgccggttgcacgatcgaggggccgcccgaggaagcggagaagagaggaggaggaaaagaagaacgagaatgaggcaaagcggcaagcgatggggacgcgagccgttgcattggtgggaaagtatgtgttgaaggattttgccggaaacggagtgtttctcgggaaagtcattttttacgagtgtggtctgtatagggtgagttatgaggatggcgatttcgaggacctagacagttcagaggtccgtgccattctcgtaaaggacgacgaattcggtaaagacatggcgcagcggagggtcgtgctggagaagttagtggcgaagaacagtgtgaaggctgaattggataaaggcggtgatgaagggaagaaggaggaatcggccgttgaagtgaccggatcgaaaggtgagtcaggggctgagaacaatggaggggaggaaaatgatgacgataatgaatcatcaagtgactcgggcttggagggaagcgagcctgggattgatgaggagtcactgccgccgctgccggagtttccgtcgtcttccggcaccattggtgtaccggaggagtctgtatcacttttgtttgctgtatacggattcctcagatcattcagcactcgcttgtttcttatgccattcactctggacgagtttgtgggtgctgtgaattgccgtgttccgaacagcgtgttcgatgccgttcacgtttcgttgatgaaagtgttgcggcggcatctggaatccctctcatcggagggctcggagattgcttccaaatgcctcgggtgcaatgattggagcttgctggattcattgacttggccagtctttgtaattcagtatttagtcgtcagtggacacacaactgctcatgaatggcgaggattttacaaagaggttgccactgatgaatattatttgttgcctgtgagtaggaagttgatgatattgcaaattctctgtgataatgctttggaatctgaggagattgtaacagaaatgaacattcggagggaatcagaggttggggtggattatgatggagaggatatccttccttcagaagttgggcttagaagagtccagccaagatacgccaatactttagcttgcgaggataaagaagctacaaagtttgtttcagcttcaaatgctgtgaaccaacctgggagctctgtttcatattccagagatacagaaggcactgaagatggtgatgttgatagaaatggagatgaatgtcgcctttgtggcatggatgggatcctgctttgttgtgatggatgtccctctgcttatcattcaaggtgtattggtgtgttgaaaaatcatataccagaagggccatggtattgtcccgagtgcaaaatcaatatgatggggccaaccattgcaaagggaacattacttcgaggggcagaaatatttggaaaggatttgtacgggcaactctttgtgggttcctgcgaacacttactagtgctgaatattgggaatgatgaattttgtcatagatattacaatctgaatgacattcccaaggttctcaaagtgctttatggatccacggagcacagggctatataccatgatatttgcatggctgtgcttcaatattgcaatgttccagagagtactttattatttcctcctttgggtgaaacccctctaagtcctgctactcgatgcaatggcaatggtagcagcaacgagtgccctccttccaaatgctctttggtaaatggtcaattttgtaattatgaccatgcaaatgattcagctcctataattctttcttcccaaaccaaagaaagcacccaagcaggttttgaaaagtgtgaacgcaatgtaatcaatgatcctgcatacatgggtttctcttataagcctttgttgtacaataattactatgcacatggctattttgctgcatcagcagctgctaaatttgcccttctttcctcagaggaatctagatcagatggccatgcatcagacaatcagaggaaaaatgcatctggaaacacttacttgcaagcaaaagcattctcactaacagcttcacgtttcttttggccaagttctgaaaagaagcctgtggaggttccaagagaaaggtgtggctggtgcttttcttgtaaagcccctgcttcaagcaagagaggatgcatgttaaatcatgctgctctaagtgccacaaaaaatgctgcaaaaatgcttgctggtttttcttctataagaagtggagagggagtactccctagtattgcaacttacattatatacatggaggaatgtctacatggtttagtagttgggcccttcctaagtgcaagctatagaagacaatggcgtaagcaagtggaacaggccacaacatttagtgctatcaagccacttttacttaaacttgaggagaacattcgaacgattgctttttgtggggactgggttaagctgatggatgattggttggttgaattttccatggtacaaagtgccacatctactcttggaacagcacagaaacgtgcaccaagtggtaggcgttacaagaagcggtcagcaaatgatgaagctacagctgagggttgccctgaaaactttgtgtggtggcgtggtggcaaattcaccaaatttatattccagaaagcagtcttgccaaaatccatggtcagaaaagcagcacgtcaaggtggttcacggaaaatttctggcattttttatgctgatagctctgaaattcccaagagaagcagacaacttgtttggagagttgcagttcaaatgagtaggaatgcatcacagctggcacttcaggtcagatatctagatttttatctcagatggagtgatctgattcgtcccgagcagaacatccaggatgggaaaggtcaagagactgaagcttctgctttcagaaatgcaaatatttgtgacaataaacttgtagaggggaaaagctgttatggaatagcttttgggagccaaaaacatcttccttctcgggtgatgaaaaatgtttttcaaatagagcaagatccagaaagaaaggaaaagtattggtttttcgaaacacgcattcctttatatttgataaaagagtatgaagaaggtaatggaaacatgccatgtaatgaggagcacttgaatactgcatctgagttgctgtacagaaggcggttgaaggctatctgcaaggacatatttttgtaccttacttgcaagagagataacttggatgtggtgtcgtgttctgtatgtcagatgggtcttttaattcgggatgctcacaagtgcaatgcatgccaaggttactgtcatgagggttgttccacaagatcaacagtctcggcaaatgaagttgtgtacttgaccacatgcaagcaatgttaccatgccagattacttgctcagaaagagaataataatgaatcgccaaccagtccattactcctacaaggacgagagaataactctgggacatttttgaagggttcaaggcctaaatctcatgatcaagtactgaaatcttccaggacaaaggctaataatcccagcatgaaacaagttactcctgtgacagctttgaaaggaacaaaggctaaatattatgaacaagaaccaacttctcccgggacaaaggataataatcattttgacatgcctcaagttgcttctgaggccacttcaacaggaaaaaaacctcgcaaaaattgttcttggggtcttatatggcaaaagaaaaataatgaagatacagacaatgatttctggctcagaaacatacttttaaaagggagttcaaacatgccacaattaaaacctgtttgtcacttgtgtcggaagccatatatgtctgatctgacgtatatttgctgtgagacatgccaaaattggtatcacgctgaagccgttgaacttgaagaatccaaaatttctagtgtgttaggcttcaaatgttccaagtgtcgaaggataaaatcacctgtttgtccttactctgatttgaagcctaagagacaagagggcaagaagtcacgcacaaagactaaaaagaaagagcattctggagcagattccaattctggagcaatctattatggtatgagagagtatgaagctgctactcctgcctttccagtagaggatggttctactcctgtctttaatgtagaggatgatcctactcacctctttcctgtagagggtgatcctactccggtctttcctgtggaggatgatcctcttcttttctctcttccgagtgttgagctgataacagaacccaagatggaaggggatgttgagtggaacagtgtctctgggccagggcttcggaaactgccagtgagaaggaatgttaagcatgaaggggacggtgatgtttcttttggaggtatgcctgcagaggtatctctacctttagaatatgcctctgctgttgactttgacaacaagctgctgaatgactctgataatgtaaactatgatgattacatggattttgaacccaatacctatttctctctaacggaactgctggagccagatgatggtagtcaatttgagggattaaatgtgtctggggacttgtcaggatatttggaaaattctagtaccctttttcctgaagaatgtggagatgaacctacactttccttgcaagacaccggctttagttccaatgttcgccttgggttgaagtaccatctaggcttggaagttggaggtgtgggaattgccgggattggtaatgctggttttgccagtgctgtagaattttgctatcgatcatgcaagctggttgcaattagctcaccatggatgaattga

SEQ ID NO: 46574 - DNA, 129 bp, Glycine max
  Peptide Sequence Number=SeqID_163352
atggatatattggctgaaatgcctaaattccccaagcggcaggctgaggatactgatgtcgatgctacagagcaaagtgccattaatggaactccacctgtcagccaacttagccttgtttgtaactga

SEQ ID NO: 46575 - DNA, 285 bp, Glycine max
  Peptide Sequence Number=SeqID_163353
atggctaacaacgatgaaggagaggagaatgatgatgatatggtggatgactcatcgagttactcaggcttgggggatcgtgagcctgggattgatttggaggcattatcgcctttgtcatcaccactagaattgttgccattgtttggaacccattgtgatcaaggtagtaacattggtgggtggagaggagagaaacgagacagtgaaggagttaggaataagaaaaagcatttcccaaatggttatggaatcggcggagagacgaaaaagaaaaggagatga

SEQ ID NO: 46576 - DNA, 348 bp, Glycine max
  Peptide Sequence Number=SeqID_163354
atggcgttgtccggaatgagaggtctctccgtcttcgtcagcgacatccgcaattgtcagaacaaggaacaggtgaggctccgcgtcgacaaggaacttggcaacatccgaaagcgcttcaaaaccgagaagttaattgacaaggctggagaatttattagtgatgacatttggttttgtgtggtgcaatttgttacaaacaatgaagacctacagccctacactgcagcaaaagctcgagagtatcttgacaaacctgctatacatgaaacaatgaatgttcatgggaggcatttactcatgttaaagaaagatgacttaaatgttcatgaggaggcaaaaatatga

SEQ ID NO: 46577 - DNA, 147 bp, Glycine max
  Peptide Sequence Number=SeqID_163355
atggatctggggatcccacggtcatgtggctccgcatgccactggactcttgggtcacgcacttcgtttctaaacgaccatttagaggaaacactgggtccaacaaagataggagaaaatcactcaaagtgtatcaatctcacacag

SEQ ID NO: 46578 - DNA, 414 bp, Glycine max
  Peptide Sequence Number=SeqID_163356
atgaatcaacttagaaaaccctcaagagaaggcttcaatttccctttgttcttggcaacaaacaactccaccaaccccacaaaatcccatcatcatcatcatcatcaagttcttctcaacgtggttaatgaagaggacacaatcccacgtgagtccttgcacgtgttccaacctccaagcccccccaagtcacgtgccatggatgatgatgcagctagtgatgcaagttctgatctttttgagattgaaagtttctccactcaaactactactacacttccataccccattattacaccctccattacccagtgccatgaatccaccgaccacgagttcttcttcgccactgacgccggcggcagcctgtggcggcggcggctgagggatacggaggtgctgccaccactttga

SEQ ID NO: 46579 - DNA, 423 bp, Glycine max
  Peptide Sequence Number=SeqID_163357
atggcctctggtaatcgattaccaaggggtgtaatcgagtacaaggcctggaaatggagtcaggatggtgaggtggcctttggtttccatgttctgaagctgtgtaactcgagtttggcctctgaggaacccgcacacatgcttcagcgaactgtggagtggatactacctacacctactccatatcgactagtggagccagtccaagtgatagaggtgttgtcatctgaagaagaccctgaggaggacccagaggagttacctcttgagcctgttgtggatgctcttgactttccagagggtgatgaggacccactccctgatatggattctccagaggacgtcatgttagcatctgaggcagactctacggaggatagcagccctggagggataacgactagtggagactcttcatcatag

SEQ ID NO: 46580 - DNA, 291 bp, Glycine max
  Peptide Sequence Number=SeqID_163358
atggtggctgtgggtgatggagaaagtgcttgggatgttagaaatggatttggaagaaagaaagaagaagaaattgtgtttttcctaagctacacgaaagcaaaggctgaacttcgagaaaactccagacattttctcaaagatcccaacggtctgatcgtggacacgtgtcttgtgaagctgcaaaccaaatttcgagaagctccaacggctaacgaaggctgggcagcgtttttaccgaggcagcttcatgtagcttcctcaagaagcttcattaagaggcttctttga

SEQ ID NO: 46581 - DNA, 237 bp, Glycine max
  Peptide Sequence Number=SeqID_163359
atgtcacaaagaaaggacaaggaacttaggggaagtagcaacgggcccatcgacggttactgtaggtggttgaaagcctacgcacaagatctggattggctcccgagtttgaggaccactaaggggatggagattgaaactccaaaagaagacgaagaggtacaggccctcaagacagaacttgagaaaacccaagcagtcaaagaaaagttcaagtcaacagctgttaggttctga

SEQ ID NO: 46582 - DNA, 588 bp, Glycine max
  Peptide Sequence Number=SeqID_163360
atggccaagttcgacccagacatagtcctcgagttttatgtcaatgcttggcctacagaggagggtgtgcgtgatatgcgatcttgggtgaggggtcagtggatccctttcaatgcggatgccctcaaccagttcctgggatatcctttagtgctggaggagggccaggaatgcgagtatggtcagaggaggaatcgggccgatgggtttgatgaggaggccatcgcccagttgctgtgtataccggggcaggattttgcccggaccgctgccgggaggcgggtgcgaatcatgcgcaccaatatgactaccctgactcagacatggatgacgttgctgcttagcaacatcctacccagcgatcataattctgacctccccctaccgaagtgtcatctggtgtatgccattctgacacggatgagcgttcatgtggctcagttgatcgctgatgccatttatctctttgcaggtatgccgcctaccaggcaccctctggacccgaataagtccaacaaggccctaggatttccggctttgatcacaggactctgccagtcgttcggagtccccgtcgcacctagtaag

SEQ ID NO: 46583 - DNA, 252 bp, Glycine max
  Peptide Sequence Number=SeqID_163361
atgaggaagaaaaactacgattgtgagacaagggttcaaatccaagaaccgcgagacggaaaggagaaggagggagaagctcagtaccaggcttttgatgctgtgatgaacaaagcaacctttgttgaggatgccatcacctacatcaaaagcatgcaagacatggtccagagtctcagccaagagcttcatgaaatggaagcaacatcagagaaaataaagcaagagaatttgttgcagcagaagagatga

SEQ ID NO: 46584 - DNA, 834 bp, Glycine max
  Peptide Sequence Number=SeqID_163362
atggagggtactccctttaacttgccccagattttcttctactactttgctactgaagtgatgaaggacaagagcatcaggaaagacatctatcatagtgtcgtcctcactaagaaagtctttagccaagaaaacatctccaatataagaatggtagatggtggctcattccaacaaactccccaggtggatgattccatacttgttgaacttcaacataagtttggactcaacactagatggaatgatcagagaaccaaggagaggatggacacaccttcatccaaggttgtacttgcacaacaatacccacctcccactctcgttgctcccatggcaacaggtgtcatggaaaaaactaagagtgacgatgaaaggcctcttgtcttcaggaagagaaaagttgcacccctttcggatgagacctttgtgcctcaagtaaagaagactattcgtcttaggaagaaaaaaagaatcgagaccactgcagctatggatgatgaatatcaacatgaagcacctccatctcctatccaccttgatcacttccatcatcaaggtccacccgtcactgaccccaacctcacagttgtagatattgcaagattgcattttcctataaactttctttttgagaatgcttacaacattaaaataagaatggaagcaaaattccaacctacaatagattggatgcaattccctttagatattgaaaaagaagaagttacatgcccttcatccatgcacagaggttttcaagttgcatccataactactgagctagatccatcaataggaatcgaaggtcttcctccaccaaagcgaaagtga

SEQ ID NO: 46585 - DNA, 1676 bp, Glycine max
  Peptide Sequence Number=SeqID_163363
aaatctaccttggggttcatgagaaccccaaggccttctttagcagctctagcccaatcctcttggagtcttctatccaatacccttggggggtaggattgcatcatctagttcgagccttgatcatctatgaagtgagcttggacaacgtatttgacgtagatccatgcgttgagactgttgacaaaggcccaaagcctatggaagaacttgtcaagctgcagcttggacccaaacctaggctaaaccattgtcacaaaagaagaggaagatgtgagaagagcgatgcaaggcagtcagagaggaagttgacaagctcctcaaagccaattttattagagaagtcaggtactcttctaggctcgccaacatcatcatggctagttgatggagcgcccgggttccaagtactaagcttcctagatgcctactcccaatacaatcaaatccaaatgcaagccccagacgaagagaaaacgaaattcattactgaaggtgccaacttttgctatagggtatatgttgatgacatggtcatcaactctcaaagcaccgcccagcacgtggcagacctagaggaggcacttcgaggcaagttcctaggattcatgatcaccaatcggggaatagaagccaaccctgacaaatgcacaaccatactagagatgcacagtcctaccaacattaaggaagcccaaaacctaaacggtagactagcatctctgtccaggttcctcccaaagctcgttgaaaaagcgaaaccattctacaagctactcaggaaaactgagcctttcctatgggacgaatcatgtaagcaagccttcttggcctctgtagaaacctacccttcggcggggacgcaaaaaggccaaaatagatgggccaaagtgtttgtctccaagggagaaaatgagtggagtcgccaccaatgtttacttgaggaaaacgttgttgccctcgctcctatgtatcctcagggtacatctacttgggttgttgtaactaagaacaagagagggtacatctcttgtggatcagttcaagtggaggttttttacaaggttgaaaagaaatctcaaggaccacaggttgcctggggactggatgtaggcacggatgaaggtcattgtcgccttttgaaagcatgcaatgacagaagacattgtcgtcttcgaaatgtagatgaaggtgcggatgaccatgtttggtctctgcgtgccatcggacttgattgtctctggatggcgaaaagggtgtggatgaccatgtttggtctctgcgtgccatcaaactcgattgtctctggatggcaaaggggagactgcaacagcctcggtcgaaagacattgagtcttcgacaaagggagcagatgaccatatttgtctctgcatgtgaggactttgagtcttatgaaggcaaggactttgagtcctttgaaggcgaggactttgagtcttctaaaggtgaggactttgagttctcagaaggcaaggactttgagtcctctgaaggtgaggactttgagccctctgaaggcgaggactttgagtcctctaaggcgaggactttgagtcctctaaaggcgaggactttgagtcctttgaagacgaggactttgagccctctaaaggcgaggactttgagtcctctgaaagaagccaataagtactag

SEQ ID NO: 46586 - DNA, 468 bp, Glycine max
  Peptide Sequence Number=SeqID_163364
atgttactcacaccaaaggaccctcagttttccatcacacgctttaaggtggtggagaccaaaccccaccccaaatacgacgtcactttggaagttcacaatctaaattccgacgtgggagtttcgtataaaaacaaaggccatgtctccctctctcttaggcgacaagaggttgcttcaggagcgtaccctagtttcaatcaagacgctcacgataggacaacgtttggcgtaactttaacatcctcaaaagtcggtctcccaaaggaggtggaggaaagcgtcacgaacgataagaagaaagtgaatgtgacattctctttggccattcacgccctagcacgcatgaaaatgggcttgttgcgtagtgggacaatgaaattcgatgttacgtgcaatgtgaagttggatacattggccaaaaccactcaagtactctctcaacaatgcgaaactaaacgacactag

SEQ ID NO: 46587 - DNA, 375 bp, Glycine max
  Peptide Sequence Number=SeqID_163365
atgggtagtatcatgatctcatacctcaaacagaggctcaggaggcttgctgaggagtgtctggagactatcaatgaaaatgaggccctagaggtccatcattttaactccatcacgtatttgttgaactattcacagtttattcaattaaagttcttagcaaacaagcaatacaccttcgagctaaaaattaaaaagaccacacaccatcaagctaggtacaaggttaaagcaaaaaattataaagagcacacaccttcaatagcggggaagggggtcaatgatgacacacagcgggatgacacaacagacgatctcagcttcgaggttctcagcttcgcttcgggttcagaacgtgtacgcttcaaatggtaa

SEQ ID NO: 46588 - DNA, 1017 bp, Glycine max
  Peptide Sequence Number=SeqID_163366
atggatgcacaagccaagaaaaaagcattgtttcgtgctaaattgaatgcccaaaagaagaaaaagcgcatagaatctccccttgtaaggttggtacttggtgctcatcattctgagtctttatgggatgcacaccaagtttctcgtaagcatcgtgaggcaataagtaatctgaaagctaatgcagctggattaactcagcataacattgcaaagcctgttgctgatactagctttttcaaggctaaacctgaacattctttggactcacaatccaaagcgccagaagcttcacaagtagtttctaaacctcaatcatcatcagtgcttccaccaggattttttgatgacagtaattcaggaaaaacaagatctggaagtggtaacatcatcctcgtctttcaccatttttactgggtatatccaattggtgctttacacacctttggacttcttgctgctacatgtagaaaagctggggtttctgctcaaagtcaggtgttaaacttggagaaggagaaaggtcattttcatgacaataatgctgcaaagtcaaatgttggtcaagccgcaatggagagtagacagacaccagtcaagtctactgatacagagatccagcaaataaaagggactctgcctgaaggattttttgacaataaggaggctgatttgcgtgctcgtggcataaagcttgtgaagccagatgtcaaagatgagtacaaggaatttgagaagttgattcaagaagacttgcgggaggtggacgaccggttggaagaagaagagattgatgcggccgaaatgatagaagaggaggaagttgtagagcaaaagatacttagcgagaaagtggaaatgttgaagaagaggagattggagctaaaagctgctaatgctgcaaagcgtagtaaatcatctgagattgtagccaaggagtctagacgagaagagccatccagtgatgatgaaagtgaagggaatttggccgtggactggagagcacaacacttgtga

SEQ ID NO: 46589 - DNA, 273 bp, Glycine max
  Peptide Sequence Number=SeqID_163367
atggcgattgcaattgccagccccatcagtagcatttgtatgcaactttccacaacatgtagaatcgtgacaaaactgcaactgggactacaatttaaaaccttcatggctatactagctagtcaggcaataagacaagctgtgagcagtcacttcctccatagcacatgttgcattcgcaaacaggcttgccatgaagaagtaaaccatccaaaaaagcctttccatggccggagcacgagatcgacgatacagcttcagcttctgtcatag

SEQ ID NO: 46590 - DNA, 1317 bp, Glycine max
  Peptide Sequence Number=SeqID_163368
atgacagaagctgaagctgtatcgtcgatctcgtgctccggccatggaaaggcttttttggatggtttacttcttcatggcaagcctgtttgcgaatgcaacatgtgctatggaggaagtgactgctcacagctccaacccgattgcatggttgatgcagatagtggagatcccacttttttggagcccttttgggtgaagaatgcagctagcagtgcaatagtgattgcagggtggcatcgcatgagctatgaatacagtgatggctctctcatctccgaagagttgaaggcacacattcgaaatgtccatgctagtgttggaaatgctataacagatgggaaatacataatatttggagcaggtgccactcatcttcttaatgctgcagtgcatgccctttcttcaaaggcttcatcttcacccacaaaagtggtggcttcaaccccatattacccggtttataaagagcaaactgaatttttcaattctgaggattataaattcaatggggacacgtcaatgtggaataatgatacttcaaactcgacctttattgagttggtgacttctccaaacaatccggacgggcatatgaagaaggctgtccttcaaggtcaatttgtgaagacaattcatgaccttgcctactactggccacatttcacacctatcgtagcacctgcagatgaagatttaatgatatttacactctctaagcttactggtcatgctggaagtcgatttgggtgggcaataataaatgatgaagctgtgtacaaaagaatgctaacatacatggacttgagtacctacggtgtttctagagagactcaactgagagtgatgaagcttttaaaggtagttctcagtggaaatggcagggaaatgtatgaattcggacacaacacaatgaagaaccgatggacttttgcgtggttgaagtgtgaaacatcaatattagaagatcgttcttgttatgaagtcctcaaagaagttaacattactggccgggaaggtagtttatttggtgctgataaccgctatgtgcgtcttagcttagttaggagcgaagatgactttgatttattgctaaggcagatcaacaagctagtttctgtggaaattaatgataaacatgtggctacaacttcaactattttaaggcaaagcaatgagactacactgttgttaacagctggtgtgaatgttgtgaacagaacattggatttgagaatggaattagagactttgaactccaatatatttcctagacaaaatggattgtacacaactattgatctttcttttaattag

SEQ ID NO: 46591 - DNA, 258 bp, Glycine max
  Peptide Sequence Number=SeqID_163369
atgatgatcgtggcacactcatcggccgtataccggcaacagaatcacctgagagaaagggctagggtgagagaaaggaataaccgggagaagaaacaagctctcaacaaagaagaagtagagaacaggggaagggaatcacctcaaaataatcctacaacgtgtaatcctccagccttatattctccctccccaaccttgtgctacgcctgtctccttcactttgcggatcgtgagccatgtgtccttcgattctaa

SEQ ID NO: 46592 - DNA, 591 bp, Glycine max
  Peptide Sequence Number=SeqID_163370
atgttacagatgcaccctctgtcttttacaaataatacatgtgtctcccctctgtcttacaaaaattacactcgatatccctcttctctctcagtcaccggaatgtataaagaaatcgaggacaaaggaaacgaggacaaagcccgtcatcgcaattggatcgagcaggagtgggccccatgggaggaaatcctcactccgaaggccgatttcgcgcgcaagtgcctcaacaaaggcaaagaggttcccctccgctccccggaagccattgaagcgtttaaaatgctaaaccctaactaccgtaagaagaaaagggaggaaatgggactcattgaggaagagttctatgcaaagcagttcgagatcaagggcgacattccggagcctctcatgatgacgtgggcgggaccgctggtagtgcgtctcgtgccgccacatgactggacgcctcgtgggtggcacgtggaccaggaggagctcgcgttcattcgcgaggagggtgatgctggagaaggtggagagctttggattggattgagaaaagggaagaggatagaaaaagaaagacctaagcgagcgagaagaagatga

SEQ ID NO: 46593 - DNA, 147 bp, Glycine max
  Peptide Sequence Number=SeqID_163371
atgcagaagatacaacaaggcaagatggcgatgagggagaggaggttacttatcaccattgcgaaggagaaaatgccttgcatcacgaccacaaaggagaaacatgctcacttacaatcttggaatcacgaaggtccatatgcctaa

SEQ ID NO: 46594 - DNA, 890 bp, Glycine max
  Peptide Sequence Number=SeqID_163372
cacttccgaaaacagaaaaaccggagtgtatgtctccgatgccagagcaggagggtatatcagggtccgttcggtagattttgaaaagggaacttcaggattttcagcttccgttgccgcaggaattgatggcggaattctggaagttcatctggatgatgttaaagggccaaaaatagccgagattgaaattccgagaaccggtggctgggaagagttcaaaaccctgacctcaaaaatttcagaatctgtttccggtgttcatgataaccctattattcagaccaattatactgcagacccggcaccaatggtgtacaatgacaggctgtatgtgtacacgacacatgatgaggatgattccacctggtttaccatgaacgactggaaagtgtattccaccaatgatatggtcaactggacagatcacggaacaattctctcgtataaagatttcgactgggcaaaacgtgatgcctgggccgcacaatgtgtagaaagaaacggaaagttttttttatacgttccgatgtggtctaaaaccaataacaaaggcgctataggggttgccgttggcgacagtccgtttggaccttttcatgatccgctgggaaaacctcttgttcagagcgaatggggagatattgatcccaccgtttttgtggatgatgacggacaggctcatatgtattggggaaatcctaaattaaaatacgtaaagctgaatgaagatatgatctcctattccggaaatattacagaagttccgatgaccgaagaatcatttggaataagggacggaaagcctaatccggaaagacccacaaaatacgaggaaggcccgtggctgtacaaaaggaaaaacctgtattatcttttctggccgggag

SEQ ID NO: 46595 - DNA, 387 bp, Glycine max
  Peptide Sequence Number=SeqID_163373
atgcggaagggaccactaaaagaaggaggaactgaagccattgatagtgttggaacacgcagaacttatacgaaaaatgaggttacattaagcaaaaatggcaacagaaatgaagagaaagaaggaattctgaagaaggcccagcccaacagtggagctaagcgcgagtcaggcgctaagcgagcaaccaaatcgcgcgatccgaacgcgctaagcgcgagggcgaggctcacgggtgcgcttcccaaaggaggaaagatgcgcggagtcgccaccaacgaaggtattagcacctcttacgtcgacaaaagcggggcttttgctcctacgtaccctcctttggagaggaaatcagacctacgtagttcttccttatgcgtgaatcaa

SEQ ID NO: 46596 - DNA, 495 bp, Glycine max
  Peptide Sequence Number=SeqID_163374
atgaccgagagcgggcacccgtcggcgcaatcagtgctagggtttttgtgggaaatggggctttttagagagcaaagaaaggggaaggtctttaccccactcggtgactcgcttgccaccttcgaccgccagacgctactccgctctggcgctgacccgcagcagcgtcaccgccttgtggcggcgatcgaggcgggtggacacggcgtggaggcgtgccccgctgcaaatgcgaaccactatagggagaggcactgccccaggccagaggactcgcccctatgcttgattctgccgccccacgggtaccgggtgccagtgccgtggtgggagagcttgcacaaggaaaggaccaaggagcttgtttttggggattctaagtttagaaagggattgtaccctgtgtttagtgttttcggatttgaatttttagaaaaaaacttccattttcagctgtttttggatcctaaaactcgttgccagtattggctctaa

SEQ ID NO: 46597 - DNA, 375 bp, Glycine max
  Peptide Sequence Number=SeqID_163375
atggatacttcaagtcaaccacccaggaagcttgtactggtacaatggaaggggatggcaccagaagactcaacatgggaaaattgggctgatatccgcgactcccttcaccttgaggacaaggtgactttcccaggggaggatactgttaggatcgttagaagcaatgacaccagtagcaacgaagcacgtccacgaagagctaccacgagacctcgatacttagaagaatacgaaatgaagttgaggatcccttgcttaagtgcggcttgttgtgtgcttaagcgagaagagacaaaagctgaaatttttgaagatcagcctagcttaagtgagacactattcacacttaagcgatgtactattcacgcttaa

SEQ ID NO: 46598 - DNA, 536 bp, Glycine max
  Peptide Sequence Number=SeqID_163376
acagcaaggcttttgttcgcaagtgcagcatatgccagcaggtaaagcatgaaacacgtaaaagtggaggcttacttcagcccattccgatacccacaggaatctgggaagatctttcaatggattttgttactcatcttcccagctctcatggattcatggtggttcttgtcgtggtttatagattctctaaggggatacacctcggtgccctacccactcaattcaccgcgtttaaagtggccaatctgttcatgggaatgaatgagtggcaccactctgcgaatgagtattgcctaccatccacaaacggatggtcaaacagaagtcctcaaccgcacactcgaaacgtatctacgcgccttcgttcattagcaacctacagcttggtatcagttcttactgatgcaagctccattggagcttgtaggcctaggatcttcttcatcaatggattcctttgcttcttggaagatgaatggcagcggaatggagaaggaagaaagagaggagacgccacttcaaggagaagatga

SEQ ID NO: 46599 - DNA, 210 bp, Glycine max
  Peptide Sequence Number=SeqID_163377
atgatatcgtattctttcaaatcctctcttagagatgagtacaaggaatttgagaagttgattcaagaagacttgcgggaggtggacgaccggttggaagaaaagattgatgaggccgaaatgatagaagaggaggaagttgtagatcaaaaatttttcacatcatcaatgaaacacgtactgtttcaattgatttgctctctgtcataa

SEQ ID NO: 46600 - DNA, 333 bp, Glycine max
  Peptide Sequence Number=SeqID_163378
atgtctacagaggaagagagtgcggtgaaggagcctttggatctcattaggctcagcctcgacgagcgtatctatgtcaaactccgttccgacagagagcttcgtggcaaacttcacgctaagaattttatggtggatgttaaagattggattaatgcttatgatcagcatcttaatatgattcttggcgatgttgaagaaatcattactacagtggaaatcgatgatgagacatacgaagaaattgtgaggactacaaagcggacagttcctttcctgtttgtcaggggagatggggtgatattggtttccccgccattgaggaccgcatga

SEQ ID NO: 46601 - DNA, 987 bp, Glycine max
  Peptide Sequence Number=SeqID_163379
atggaacatttggatttcagttctaattatgattcaagtgaaatgcaaatcccagaatacattggctccttcaaaaacttaagatatctcaacctatcatatataggtttgagtgggaggattccttatgaactcggaaatctcttaaagttggagtatcttgatcttcaagaaaattttcttgatggagcaatcccttcgcaactcgggaatcttacaagtttacgatatcttgatctaagttataattttgaaattgatggggaaatcccctgtcagtttcgaaatctctcacaactgcaatatcttgatcttgaaggaactcatctttctggagcaatcccttttcaaattgggaatcttcctatcttaaatactcttaagcttggtcagaatttggatgtcaaatctatggatacaatgtggttgtctagtctctactccttgacacatcttggcttggattctttacataatcttgactcctctcaccacttgctacaaacgatcagcaaactttttgcgaacctaagagagttgagcttaattcaacatttttcatggtgcaacaagactggcatgctacctaatcttacaaatttgccgtctttgaggaatttaaatctttcctacaatcgcttaacaagagaaatacctaaaagcattggattgctatatgagttgatgtctcttcacctggaggagaattacttggtaggtgacatcattgaatcacatctcacaaatttgaccaaattggaggagttagacttaacagacaactcattgtctctcaagtttggtactacttgggttccacctttccaattatatgttttgggactagcttcttgtaagttgggtcctagtttcccaagttggatccagactcaaagtcacttacagtttctagatgtctctgatgctgggattgatgactttgtaccagattggttatggaacaagttacaactatatatgccatga

SEQ ID NO: 46602 - DNA, 2295 bp, Glycine max
  Peptide Sequence Number=SeqID_163380
atgaagttggagatagaggacataaccgtgtacttcccctacgacaagatctacccggagcaatactcgtacatggtagagctcaagcgcgccctcgatgccaagggccactgcctcctggaaatgcccaccggcacagggaaaaccatcgcactcctctcattgatcactagctacgtcctttccaagccccattcccctctcaagctcctctactgcacccgcaccgtccacgagatggagaagacgctcgccgagctccgtcttctccatcattaccaactccgccacctcggccccgccgccaagatcctcgccctcggcctctcgtccaggaagaatctctgcgttaacccgcgggttctcgccgccgagaatcgcgactccgtggacgccggctgccggaagctgaccgcctcgtgggtccgggcggtggccgcggagaatcccagcgtgccgagttgtgagttctttgagcagtatgagagggccgggtcgtccgcggttctgcctcctggggtttatacattgcagcctctttgcatatgcaagggtaaggctgcgtacaacatccctcccccataccttcgcatagcgaagagcctctgggcaatggggtacgaagacttgagagcatatgggaaggagaaggggtggtgtccatactatttagcacgacatatggtgcagtttgccaacgtggtggtgtatagctatcagtatttgcttgatccgaaggtggctggaataatatctaaagaaatgcagaaagagtcagttgttgtgtttgatgaagctcataatattgataatgtctgtattgaagcacttagtgtgagtgtgaggagacagactattgaaggtgctagaagaaaccttagtaggatgcgtcaggaaattgacaagttcaaggccactgatgcaggtagactccgtgctgaatacaacaggcttgttgaaggtttggcactaagaggagacctgcctgctactgatgcctggcttgcaaatccagccttgcctgatgatatactaaaggaggctgtacctggaaatattcgccgggctgagcattttattcatgttttgcgtagattagttcaataccttgaagggcgcttagatactgagaatgtggagaaggagagccctgttagctttgttgtctctattcttaaccatgctggaattgaccaaaaatcactaaagttctgttatgatcgccttcattctttgatgatgacattggaaattacagacactgatgagttccttcatattcaaactatatgtgattttgccacccttgtaggaacgtatgcccgtggtttttctattataattgaaccttttgatgagcgaatgccacatattccagatcctgtattacagctttgttgccatgatgcttctcttgctatcaagccagtttttgagcgatttcagtctgttgtgattacatctggtacactaagcccaatagatttgtaccctcgtcttttgaatttcaatcctgttgtcagtcgaagttttaccatgtccttaacaagggattgcatatgtcctatggtgcttacccgtggcagtgatcagcttccagtcagtacgaaatttgatatgagaagtgatctgggtgtggtaaggaattatggaagactcttattggaaatggcttcagttgttccagatgggattgaaataatgcaacataaacttgtctttattgagactcaggatgtggtagagactacattggctcttgataactaccgcaaggcttgtgattgtggaagaggtgctatctttttttctgttgctaggggaaaggttgctgaaggtatagattttgatcgacattatggccgactagtaatcatgtttggtgttccttttcaatacacattaagcaagattttgcttgcacgtctggaatatctacgggatacttttcaaattaaggaaggagattttctgacttttgatgcattgagacaagctgctcagtgtgtgggtcgtgttatccgttcaaaggctgattatggaatgatgatttttgcagacaaaaggtatagtcgtcatgacaaacgttcaaaattgccgagttggatactctctcatttacatgacgcccacctgaacttgagcacagacatggctttgcatgtagcacgtgatttcctcaggaaaatggcccagccatatgataaaactggtggcactggcaggaaaactttgttgtcccaggaagacttggagaagatggctgtcagcggcatgggtgatgtgatgtattga

SEQ ID NO: 46603 - DNA, 653 bp, Glycine max
  Peptide Sequence Number=SeqID_163381
gggatagaaacaagaactcaccaagtgatgaaagttttgtggaggaaggtattcatggtcattatgaagtgggtaaagggaaaaaagggttgtcttggcagcgagtgaagtggactgataagatggtgaagcttctaataacggttgtgtcttacataggtgaggatgcaacttttgacaacggttgtggaagaggaaaatttacagtcctacagaagaatgggaaggggaagtggaaatatgtttccaaggtcatggctgaaagagatgatcacgacaatgatggtatcagaaagtcccatcacggtgatcatgacaaagatgttctagatgtggaaattgacgatcatgatgactctgaagagaattatacttcccctgcaaatagtaaaggttatagggcaacaggacaaccttttaagagtttaaaactagggcaagggcaagaagatgctgctacttttgggagtgctttaaacaataaagagtataacaaaagttcacatcctcatatgcaatgggatgaatctggttcacttcagttagaagagcaaaagctacaaaattttggccgagatgttgaagctagagaaacaaagattcaagtggcaatgagtttagttagaaaaaagaccgggaaatggaacaattga

SEQ ID NO: 46604 - DNA, 360 bp, Glycine max
  Peptide Sequence Number=SeqID_163382
atggtgtacatgcgttgttcaggagtatacagtgaagttggatcgttattcgtcaccgaagaaaaagagaaaaacaacaacaacgaaggagtagcaacacaatgcacaaaaaataagtatgataaggccaggagaatacttacctcaaaggagaatgaagaagacgaaaggaaaaagaagcagcaaaggatcaggagccaccaacaagaaaaaccacgaatggaggaccaacacccacgaaggaagaagaacaagcaccaacggagtgaaacgaggcaagaaagaggaagaagaacaaccacagcgacacaggaagtgaagaaagaagaaggaaagaagaagaacaaaaacgacgcatga

SEQ ID NO: 46605 - DNA, 1725 bp, Glycine max
  Peptide Sequence Number=SeqID_163383
atggaggatacttgtggtgtggtaaaaataattggagcaaaatactttaacatcgaaggtgactatgccaaagaagatagcatatcacctagagatgtacaaggtcacgggtcacacactgcatcaacaattgctggaaatttggttaagtcttcaagtctactagggtttgcctcagggacagcccgtggaggtgttccatcagcacgcattgctatatacaaagtatgttggatcaaaataggttgtcctcaagctgaaacccttgcagcatttgatgaagcaattgctgatggagttgatataatttccatttcaaccggacttactagtatagtgtacattccgtatttccaaagcgcatttgatataggaagtttccatgcaatgaagagaggtatattaacgtcaaaatcagccgataattcgggtccagggttatcctctatcacaacttattcgccatggatactctctgtggcagctagcactattggcagaaagttccttactaaggtgcaattgggcaacggcatggtttttgagggggtttcaattaacacttttgatctcaaaaacaaaatgtttccactggtttatgctggagatgtacctaacactgctgatggatataatagttccacatccaggttttgctacgttaactctgtggataaacatttggtgaaaggaaagatcgttctgtgtgacggaaacgcgagtcctaaaaaagttggggatttgtctggggcagctgggatgcttcttggagccactgatgtaaaagatgctccattcacttatgcactgcccacagctttcattagtttaaggaactttaaactaatacattcttacatggtttcattgagaaattcgacggccacaatatttaggagtgacgaagacaacgatgattcacaaacccctttcatagtttcattttcatctagaggtccaaatccacttacaccaaacactctcaagcctgatctcgcagccccgggagttaatattctagctgcatggtctccagtctatacaatttcagaatttaaaggtgacaaaagagcagttcaatacaacatagaatctggcacttcaatggcttgtcctcatgtatcagctgcagctgcatatgtcaaatcatttcatcccaattggtctcctgctatgatcaagtctgcactaatgaccactgccacaccaatgagtcctactcttaatcctgatgctgaattcgcatatggcgcgggtctaattaatcctcttaaggcggcaaatcctggtttagtgtatgatattagcgaagcggattatgtcaagttcttgtgtggagagggctatacagatgaaatgcttcgagttctcactaaagatcatagtagatgcagcaaacatgctaaaaaggaagctgtatatgaccttaatctcccatcattagctctttatgtaaacgtctcatctttcagtcgtattttccatagaacagttacaaatgtgggattggcaacgtctagttataaagccaaagtggtatctccatctttgatagatattcaagtgaaaccaaatgttctgtccttcacatcaattgggcagaagaagtcattctccgtcataattgaagggaatgtcaatccggatatactgtctgcttctctggtttgggatgatggaacttttcaagttagaagccccattgtagtgtatggtgatacataa

SEQ ID NO: 46606 - DNA, 378 bp, Glycine max
  Peptide Sequence Number=SeqID_163384
atgcatgatataaacatgcttaataattggaactcagaagacataggagctgacactgaaggatccaaaaaaattcaattatgggccgagttagagagaggtgaggcagcaagttcgattgtgtgttacatgcgtgaaagtggtgctagtgaagagggtgcttacaaacacatccgcagattacttaatgaaacgtggaagaagatgaacaaagataaagtgtcacagtctcctttcccaaaacctttcatagaaatagctatcaaccttggaagaatttctcagtgcacataccaatacggagatgggcatggagctccagatagcacagtcgagaatcgcatacgatccttgataattgaacccattgccatctag

SEQ ID NO: 46607 - DNA, 300 bp, Glycine max
  Peptide Sequence Number=SeqID_163385
atggcagtatggggtggacaaaagggggaggttgagtgtgaaaagaaggctagattagataggtgcgataaaaagggagttggggtagatagcccgacacagaacaagaaggataaccaagaagttgggtcagttgggcccactgtcagttttactctctcccagatcgagcatggtgggttaaatatggaacaaaaacatcatgagaaagggagtacactacttgggaacgatttgataggcctattgggtgatgagggagtgctgtcagaaataagaatatgggctctaaaattatga

SEQ ID NO: 46608 - DNA, 893 bp, Glycine max
  Peptide Sequence Number=SeqID_163386
atgacccttgtcaattccacgttgcttaattcctctttcatttcaaattttagttttggcaaacctcagaaaccagaagggactaataaccttctcctgcgtagaattatttgccctatccgatgcaacgcaacaaccaccaccacaaacgttaatgcttctgaaagaaaatcagccaattaccagccaaacctctggaattacgattttctgcagtctttgaagtgtgaccatgcggatataagatatgaggacaaggccaagaagctgctagaggaagtgaggagaatgataaaggatgaaaatacagatatatggatcaaacttgaactcattgacgatgtgaaacgcttgggaattggctacagttttgacatggagataggagaagcccttcataggtgcctctcttctgaaacatttattgatacaatcactcataatcacagaagcctgcatgaaactgctttaagcttcagggtcctccgagaatatggctatgatgtcacaacggatatatttgagaggtttaaggactataatggtaatttcaaggcaatccttagcagagatgtgaagggaatgttgagtctatacgaggcatcatttctaagttatgaaggagaacagattttggatgaggctaaggccttcactagcttccatctaaagggtgccctcaaagaaggtagaagcaatactatgatcttagaacaagtgaatcatgcaatggagcttccacttcatcacagaatccaaaggcttgaagcaaggtggtatattgaatcttatgctaaaagaaaagatgcaaatatggtgctgcttgaagcagcaaaactggatttcaatattgtgcagtcaactctgcaaacagatctccaagaaatgtcaag

SEQ ID NO: 46609 - DNA, 366 bp, Glycine max
  Peptide Sequence Number=SeqID_163387
atggctccggataggatgcagctacagagcatgtgtaaaaaagagcatgaatctttcaaagaatatgcccaaaggtggagggatctggcaactcaagtatcgcccctaatgacgaaaaaggagatgataacaatgatagtggacacgttaccagtgttccactatgagaagatggtgggttacacaccttcaagctttgccaatttagttttcaccgggaaaggatcgaagaagcctggggaaaatggagagaataagaaggagggaggaacccatgttgtgactgtcattcctacatggcaaaatttcccaccagctcaatactcagccaatatcagcccttctctttacccaccaccctattag

SEQ ID NO: 46610 - DNA, 258 bp, Glycine max
  Peptide Sequence Number=SeqID_163388
atggggttgaaccaagctcgtgcttttaggaaaaaggttcatcgagtcaagttgaagtatggaagcagagatttgggaagtacggacggcccccatgatgtgaaaattcaaaacgagcacgccttcccgccatatggcttgcctctcaactatacaccacccaatgtagcgtacactcccagtgagaatgtcaataactccactcctatacccattgagagccagcaaacccaaactgatcatgcccatgtctcttaa

SEQ ID NO: 46611 - DNA, 987 bp, Glycine max
  Peptide Sequence Number=SeqID_163389
atgttgggggactcagcagtgttgggaacaggaggaggaggctctggtgatgcagtggcagcaccaccggttgttggtggtggtgctgctgcatcaggaggagcacatgaaggcggtgccaacggcggcggcggatcaaattcaggggatgatagagttgaggaaggtgacaagagctttggtgggaacaggtggccaagacaagagactttggctttgttgaagatacggtcggatatggacgtggcttttagagacgcaagtgtaaagggtcccttgtgggaagaggtttctaggaaactggcagagcttggctaccacagaaatgccaagaagtgcaaagagaagtttgagaacgtttacaagtaccacaagagaaccaaagaaggtcgaagtgggaaatcagaaggcaaaacttatcgcttctttgatcaattacaagcccttgaaaacaacccttcaatccatgctatgcaatccccaacaccaacaccttcaaagccaccacaaacaacagcactacttgcaacaccagtgtcaatagtggtaacaacaactactacaccatcaacattagtgtctaataatgccactgttccatccacaaatacaccccctttgcctcaagccattctcaacataacaccaccatcaacactaaacatcacaaccccttcttttccatcatcaaaccctacaacatacttcccaacacaaacaccaaaccctacaaccaacaacaaccctccaaacaccatcaccccagcttccttccccaacttctccgcagatctcttgtcgaattcgagtttttcatcgacttcgtcggaggaaacaacgacgatggggggagggggaatgaggcgcaagaggaagaggaagtggaaggacttctttgagaggctgatgaaggaggtgatagagaagcaggaggggctgcaaaggaggttcttggaggccattgagaaaagagaacaagagcgtgtg

SEQ ID NO: 46612 - DNA, 339 bp, Glycine max
  Peptide Sequence Number=SeqID_163390
cctgacattgctgcacctggagttgaagttatagctgcacggtctccagttggcccaatttcaaatgttaaaggtgacaaaagaaaagtacaatacaacatagaatccacttcaatggcctctcctcatgctactgcagcagctgcatatgtcaaatcatttcaccctaattggtctcctgctatgatcaagtttgcattgatgaccactgctactccaatgagtcaaactcttaatcctgaagctgaatttgcatatggagcggggctaattaatcctggtttagtatatgatattagcgaagcagattatataaagttcttgtgtgaagagcggtaa

SEQ ID NO: 46613 - DNA, 249 bp, Glycine max
  Peptide Sequence Number=SeqID_163391
atggcctcaacaactcaagattttaatggctggagaagtgaaattctcgaacatatattcaatgaagaagatagcaaagagatacaacaaatgtctttagtcaacattgttggacaagataaaatcttttggaggcttggcagcaatggagattactcagtccgtagtgcttatcatcaccttatggagaatatgttggacaatgaacatttaaaggtggaagtgaccggatgcagatttggagattga

SEQ ID NO: 46614 - DNA, 1800 bp, Glycine max
  Peptide Sequence Number=SeqID_163392
atgcagctaggagactcaagtgtgttggagatctcctcccataccgagcccgagatggcggtggtgtcgccaccagaagaagcaccacatgaaggcggccacaacagtggtggtggtggtggtagtgatgagatgattgggatggatttggatgcaaattcaggtgaaggaaatgaaggtaacaagatgagctttggagggaaccggtggccccgtcaagaaactttggctctcttgaagataaggttggatatggatgcagtttttcgagattcaagtcttaaaggtccactttgggaagaagtttcaaggaaattggcagagcttggatatcaaaggagtgcaaagaagtgcaaggaaaaatttgagaacgtgtacaagtacaacaagagaaccaaagagaacaaaagtggcaaatcacatggaaaagcctataaattctttgatcaattacaagccctcgagaaccaattcacagtctcttacccgccaaaaccagaagctacttctactttgactacaacaaacacattgacaagtgatcatggtaacaaagttatctcttatgtcacaccttttccttccacaaaccctactctcattccaccttctccacaaaccaacaccaacaccactaccaccacaacaacaacatccactaccgaccctagagactcatcaccaccacaaaccaacaacaacaacaatagtgtcccacattctttgccaaacatgaacgctcctttcttaaccaccaccacctccacctcttcctccacagcatcagatgaagacttggaagagaggtataggaggaagagaaagtggaaggactacttcaggaggctcactaggaaggtcttgttgaagcaagaggagatgcaaaagaagttcttggaagccatggaccaaagggagagggaaagggtggcacaacaagacaattggaggatgcaagaaatggcaaggatcaatagggaacatgagattcttgttcaagagagatcaacagcatcagccaaagatgctgcagtcattgcattattgcaaaagatgtacggccagcaaaaccccacacaacatgttgaagtagagccaccacagcaacagaagcaaacaatgccacaatcacagcctccaatattaatgccaaacaataattttgaggtcaagaaaatgaataatggtcacagtgctacaagtactactactactactacttctccggtgagttcttcttcttcttctcggtggccaaaggccgaagttcatgatttgataaggttaaggacaagtcttgaaatcaagtatcaagagaatggaccaaaggctccattgtgggaagatatatcaattgcaatgcaaaggcttgggtacaaccggagtgcaaagagatgcaaggaaaaatgggagaacatcaacaagtacttcaagaaagttagggagagtagcaaagaaaggcgtgaagatagcaagacatgtccctatttccacgagcttgaagctctatacaaagaaaagggaaaatctcagaacccctttggcatgtttcagaatatgacgccaaatgagacgatgatgatggagccattgatggtgcaaccggagcaacaatggaggcctccacctcaatcattggaagagggtatagggaaggataatgcaagtgaagaatataatcaagaaaaagaagaagaagtagaagaaaatggtggtgatgatgatgataatattgaagaagatggagatagtgtggaagatgcaggaccaaacccgtgtgagattgcgacaaataattaa

SEQ ID NO: 46615 - DNA, 1347 bp, Glycine max
  Peptide Sequence Number=SeqID_163393
atggcaaaagtttgttggccatattttgatccggagtatgagaacttcagcaacaggatcaaccctccaagggtctctgtggacaatgatagttgccatgattgtacactgatcaagtttgatagtattaacaaacctggaattctgctggaagtggtacaaatcctgacagatcttgacttcataattaccaaagcttacatatcttctgatggtggatggtttatggatgtatttcatgtcacggatcagcaaggaaagaagataacagacagcaaaacgattgacttcattgaaaagactctaggaccaaaaggccagagcacagaaggggtgaattgttggcaaggcaaaagggttggagtgcactcaattggtgatcacacagctattgagctcatcggtagagaccgccctggtcttttgtctgagatatcagcagtccttgccagcctccaattcaatgttatcgcagctgaagtttggactcataacaggagaattgcttgtgtcctttatgtcaatgatgctacaaaccaagccatggatgactcaaaaagattgtctattatggaggagcagcttaaccacatcctacgcgggtgtgaggatgatgagaaagtggctaggaccagtttcacaatgggtttcacccacatggatcgtaggctccaccaaatgctgtttgctgatagggattatgagagtgttggattaacaaccacagatgttgattgtcctccttcttttaggccaaaaatcagaatagaacgtattgtggaaaaaggttactcagtggttagtgtgagatgcaaggatcgagcaaaattgatgtttgacattgtttgcactctcactgacatggaatatgttgttttccatgctacaatctcatccgaagggcaatatgcatctcaggagtactttatccggcacatggatggatgcacgcttgatactgaaggagagaaagaaagggtcatcaaatgcattgaagctgctatacaaagaagagttagcgagggtgtgagtcttgagctgtgtgcaaaggacagagtggggttgctgtctgaggtaacaaggattctaagagagaatggcttgagagttagtagggcaggtgtgtcaactgtaggggagaaaggcttgaatgtgttctacgtgagagatgcatctgggaacccagtggacatgaagatcattgaagcactacacaaggaaattggacagataatgatggttaatgtaaagagggtacctggctatgtcaaagcaccagctgaaacccgaggatgggctaaaacaagctttttctttgggaacttgttggaaagattcttgacctga

SEQ ID NO: 46616 - DNA, 195 bp, Glycine max
  Peptide Sequence Number=SeqID_163394
atgtactctatatcgagggtttatgagagtatgaactcaggactagatctgaattcttcggtaacacccaccccaccatgccaacgaccttcccttggccataatcaaccatgtcttccacccccgctgtccttgctccacctcacccgcatcaaaaccctcccaacctcatctgccatgcgaaatggagcataa

SEQ ID NO: 46617 - DNA, 210 bp, Glycine max
  Peptide Sequence Number=SeqID_163395
atgggattgaaccaagcaccctcttttaataaaaggttttatcatgtcaaaatcaaaagcctagaggtagctagtttacaagagctagggcagcggatggagcaactccaacgtcaagccttcctcaagacatatggaaaaatttgggatttggctgtgatagaagtgtctgttgaagccattgcatccctcgctcaatattacgactag

SEQ ID NO: 46618 - DNA, 300 bp, Glycine max
  Peptide Sequence Number=SeqID_163396
atggtttctagaggtatcatcctcgtcgaagaacatactgcagcagtagggactactagccacgataggttttcaaagaggaatactctagatgaagtggagtcgccaactgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtggaaggttcgggagttgtatttacgcacggggaaggtattag

SEQ ID NO: 46619 - DNA, 234 bp, Glycine max
  Peptide Sequence Number=SeqID_163397
atgagtctctttggctcctccaacgaccaccatcattgccacgttgaggaggatatgtcacctttgtgcccccggattaagatcaacaagatcatgattgaggagctcgaggcctacaacaacaccgatctcaagaagccttgctcatggccatcaaggatcaaatttgtgatgtctcccatagtaggcttactatctcacaaaacccaccccatggctcctctagatttttga

SEQ ID NO: 46620 - DNA, 429 bp, Glycine max
  Peptide Sequence Number=SeqID_163398
atgaaggttgacatggaggccatgaaagagcaaatgaccacaatgatggaagccatgataagtttgagaaggatgatggaggtcaatgcggctacagttgttgccgcaagtacttccatagaagtggacccaactcacccacctagcttcaatcaagtaaatcatccagccttggatatggtaggtcagagaggcaaagcgttggaaagtgcgggcggccccattttgtgtaggttcagaacaagcattcctttcaaccatatggcttgcctcccaactatacaccactcaatgttgcacacactcccgatgagaatgtcgacaactccacatccatacccattgagatccaacaaccccaatctgatcatgcacatgtctcttaacccatggggaagacacatgaagcaccccgagactacaatctag

SEQ ID NO: 46621 - DNA, 1431 bp, Glycine max
  Peptide Sequence Number=SeqID_163399
atgtcttccggaaccctagaaaacgagaaacctcaagtggaagaagaacaagcccaagctgaagacaaccacaccaagcaagaagataattcggagatgaaagacgacgatgacagaggcgaagaggaaagggatcaggtagaacaagagaaggatgtggagaaagaggaagaaaaagaagaagaagaagaagagaaggaggaggaccgtgacgaggtgaagtcaaaaaagtcaacgaaagaaagcggttacgctactccaggaagtgagagaccaactagggagaggaaaacggtggagaggtacactgtttcttcgcccgacaagtttcccagatcttcttccatcaaagctctgtcaattgaaaagggcaacggtacgcagctcaaggacattcctaatggtctgttttctggctatgtgtggactgagaatgaggaaaaacagagggtgaagataaaggagaagattgacaaatgtgtgaaagaaaagttggtggacttctgtaatgtgcttaatattccgataaataagaccagtaagaagaaggaggaactgtctgcaaagttgttgcaatttttggagtccccacatgctacaactgatgttctgcttgctgataaggaaaagcttgtttctatgttacagaaaggcaaaaagcgagccagaaagcaaaccccaagcaaatcttctggggaaggatccaaaacatctgccaagaagcaaaagcaaaattcacaagttgggaaaaaccaaaagcagtcttctgacattgaggacagtgatgcagctgaaccttcagatgcaaaagttgattctcaggaagatgatgattcaagtcaaaaaagtgaaagtgataatgaggaaagcatatcagagaaagaggaagataaagaaaaggctcacaaacgtacttcaaaaaagattctgaaggaggatcaaaccacacctgtaaagaagaccactgttgtaaagactgccaagagcaatgaaaaagctcctgaaaaatcttcttcaaaaagggctgttactgacagtacttctaagtccaagcaatctgcttccaagaaacagaaaacaatgaaggaaaaccagaactctatagggaaggatgcaaaccaaaaacaagctgacaagtcttcgaaggctttagtgaaggatcaaggcaaaggtaaaagtagtgagaaggcaaaagcagaacctagtaaggtggagatgcatcgagtggctgttgatattttgaaggaagtagatttcaataaggcaactttatctgatatcctcaggcaacttggtactcactttgatgtggatttaatgcatagaaaagcagaggtgaaggatataattacagatgtaattaataacatgtctgatgacgatggagaggaagcagaaaatgttggggatgatgatgaagatgatgcatga

SEQ ID NO: 46622 - DNA, 234 bp, Glycine max
  Peptide Sequence Number=SeqID_163400
atgggtcagcttgcaatgtatatccatgcatatttgcaattgcaggctacgggattgaagaagcatctcaagaggctcaatgctcctaagcattggatgcttgacaaactgggtggtgcatttgcgcccaaaccctcatctggatcacacaaatcgagggagtgccttcccctcatcctcatcctacgaaaccgactaaagtatgctctgacttacctcaagacgagtaggtga

SEQ ID NO: 46623 - DNA, 377 bp, Glycine max
  Peptide Sequence Number=SeqID_163401
aggccatcttgcagttgtccttatacaaggcaatagaaggacagaagtttcttaggacattgatgaagtcagaaaatgttccagccattgcacaatgtgcaaactctgactatgaaagtgtgattacagcgtataagagtgctctaagcaagttgaaagacgatcctaaaactgctaagcattatgccagagatgctgaatgtgctaactctgactatgaatatgtggttatggcgtttaggagtgctctgagtgatttgaaatacgaccctctaacggctatctatgctaacttgatgccaaacatgctgctgatggatctgaatactgctgctcatatttttaaccctgcaattcctgctcttatcgttgcttag

SEQ ID NO: 46624 - DNA, 771 bp, Glycine max
  Peptide Sequence Number=SeqID_163402
atgattgaaattaacaagctactgaactttgcattgcccccattatcactaattgtcatcttcatcttcacgccacctttgctcttagtgaagctgcttatgtgtgttaaaaagtttctatacaccgaaaacgtggcagggaaagtagtattaatcactggagcagcctcagggattggcgagcaagtagcatatgaatatgctaggcgcggagcaaagctgtctctggttgacattagaaaggacaaacttgtagcagtggctgataaggcacgatctttgggtagccctgatgttaccatcattggtgcagatgtatccaaggtccaagactgtaaccgctttgttgatgaaacggtgaaccactttggaagactggaccatctggtaaataacgctggaattagtcgtaagtctgtaggggtggaggattggcttgatgtttccgaattcactccgattatggacattaacttttggggagcagtttatggcactttatatgcaatcccacatctcaaaataaacaagggtaggatcatagtgattgcttcaggttgcggatggttcccactaccaaggataagtatctataatgcgagcaaggcagcggtaataaacttctttgagactctgagaatggaacttggttgggatattggcataactatcgccacacccggttttgtcaaaacggaccttacattgagggcaatggaatttgaggttggtcttgttcagagaacatgcagtggtaggagagtaggataa

SEQ ID NO: 46625 - DNA, 375 bp, Glycine max
  Peptide Sequence Number=SeqID_163403
atgaaccacttcttccggaaagttcccggaagaggtttttccgggagtcttccggaagaagtgttcttccggaagacgtttggttacttccggaagaacccttcttccggaaactttctggaaaatgttcttccggaacttccggaagaacccctaacgggtcttccggaagtctccgccgtcagcctcctttccccattttttccggcgtcctctcctctcgtcttctaccctaaggttactatcctaagcaaaggggagttagggagactaacctcgttcgcggagaagaagaagacgaggttcgcgcttgccttgccggagaagaagaagcagttcgcggagaagggagaagaagcttcgcggaaggaatga

SEQ ID NO: 46626 - DNA, 519 bp, Glycine max
  Peptide Sequence Number=SeqID_163404
atggatcttattcataagtacctaaacatagtagcttctataaccaccttctttttcctttgccttttcttgccaccgtattggaccttcaagttcttcctttacatcacaaattacatcttcagtgaaaatgttgcggtaaagttgttcacatcactgttgcttcctctgttattggcgagatgtttagagagggcgagccctggtgcagcgaaacagcatctttgcatatgcaaaggtaaggctgcctacaacatcccttccccataccttcgcatagcgaagagtctctgggcaatgggttacagcctctgggcaatgggttaccatttggcttacgagtatgctaagagaggtgcttgcttggcactttctgccaggagggagactgcagtactacgggaagtggctgatagaacacgtgattgtggatctcctgatgttattataatgcgtgcggatgtctctaaggttgaagattgcttccgattggtggacgaaactgtgaaccatttttga

SEQ ID NO: 46627 - DNA, 443 bp, Glycine max
  Peptide Sequence Number=SeqID_163405
acaatggaattcttccggaagaagcttcttccggaaacattccggatgacgttcttccggaaattgtctggggtgaatcaaagcctaagattaagccaaggagcatagtcaatggacaacaagtaaatattcttgtattaccctttgttaatctggagggatggatgaaggaagctagaagttattggttcaaggatgcaaggtgtggctattttttcaagaatttcttgactccagtggtgtctaatatcttcttgctaggggcttccctcgctgttgttcttgttgattcagtcatatacatcattctgaagctccactccaccagctctgggcacaacagtttgagtaaatacgtcactttgaaccacgcaggcactgtgaggtaccctatcaaccctcaacgtgccattaactatcgctttggcgcacccactcactaa

SEQ ID NO: 46628 - DNA, 330 bp, Glycine max
  Peptide Sequence Number=SeqID_163406
atgcctgcacccagaagaaacctgtataatgctagcaaagcagctttagtgagtatgtatgaaacattaagggtggaagttgggtccgatgtaggcataacaatcgtgacacccgggtacctcacagtgcctgcgtggttcaaagtgacgtatttactcaaactgttgtgcccagagctggtggagtggagcttcagaatgatgtatatgactgaatcaacaagaacaacagcgagggaagcccctagcaagaagatattagacaccactggagtcaagaaattcttctatccctcttcaatccaatctcctgatgtcaagactgagtga

SEQ ID NO: 46629 - DNA, 399 bp, Glycine max
  Peptide Sequence Number=SeqID_163407
atggatcctacacaaatgaagaagattcaagccatgaacagaatcctttcctcggattcctcttcaagtacttgtgttgtttactatgatgagtacattcagagctgtcaaactatgaaacctcagattccaagccctgaggtcaacgagagtaaaacattattggagaaacatgttggggaaaatgaggacgtgaacagtgtggactttaagggcaaatgggggattgagaaagctacagaagaatccaaagaggaggagaatctagatggaggatataaacaaagtttgattccttcttcttcttatgaattgaacaaaagggctgatgatttcgttgcaagagtcaataggcaaaggaggcttgaacttagccttctgcattatgatagttactaa

SEQ ID NO: 46630 - DNA, 241 bp, Glycine max
  Peptide Sequence Number=SeqID_163408
atggtgcctctcgttgccccagtgcagggctctgagggtcgtacaatgctcaatggaatgccccagaactcccccatgataagcacatattgcattcgagttgtatccttggaaaaatggaggttgaggaatctttgctgggggtggtgtttggtattggatgtgcagaaggcgggccttggggctgatttaggggtggcctttgtggatgattgggtgttcttggctgatagggtggtgg

SEQ ID NO: 46631 - DNA, 585 bp, Glycine max
  Peptide Sequence Number=SeqID_163409
atgaaaaggaaagaatgcgctttacggtgcccttaccgaacgcgtgccgaagctagagtaatgagtgaaataaaggaggtgcaagaatggatgaaggctgacatggaggccatgaaagagcaaatggccacaatgatggaggtcatgatgagcatgaagaagataatggaggtcaatgcggctgcagttgccgctaccagcgtcgttgctgaggtggacccgactcccacatctagcctcaaccaaataaaccatccaaccttggatatggtaggtcagggaggcaaagagttgggaagtacgggcggcccctattttgtctatacaccacccaatgtggcacacactcccgataagaatgtcaataactccactcccatacttatggagagccaacaacctcaatcttatcatgcacatgtctctttacccgtgggggagacacatgaagcaccccgaggccataatctagctgactttgagcctctcctcggatatgccactaaggggcaggcattttgtggcgtacccctgccaaatagtttgggggcccctcagtatcacccacaacccttgcatttagta

SEQ ID NO: 46632 - DNA, 717 bp, Glycine max
  Peptide Sequence Number=SeqID_163410
atgtggagcaaagagtcgcgtgaattagaaaagaatggtataaaagaggatgactcaaaggctaaaagtttagtgaatatgcaagaaggaaaaaaatctattcattcttcagagggtactacaacatcagaagtagttgcagatgaagcggctaaaccctcaaaattttcaagttcatcttccactcaaccatttgaagttgaaggcaaggataagatagatgctagtagtgacgaagaatctcaagtttccaacagggaccctgaaatagatggtcaagaatcaaccaaaagtgaaacagacgaagaagttgaacaaagagaaacacttcagccagagtcccctgaagatcaacaatgcataaacaaagatcaagaagaaagccatgaaacacatgaaattgaagaaaaggtttatgagcaagtagatgaattcgatcaagaacactctcaactgttagaggagcaaaaagaatgtgaggaggaagccactgaagggaagaagaacggccaaaaaggatcaaagaaactgtttgtttcgattatcatagccggatcaggccttcttgcttctggaatatttctctttattcgacatagaagagccagaaaaggtgtgtctgttttgcttgcagtggtaagtgatactcaaagtgagcagaaattcacattattgatcgcttttgaactcaaggaaattgaatggaaaagtgcatga

SEQ ID NO: 46633 - DNA, 4746 bp, Glycine max
  Peptide Sequence Number=SeqID_163411
atgccacataatattgaagatacaagtcatgataaagagttggaggttcaagaaatggaggacaatggaggttttgtagaggaggaaaaagtggtatctgaaaagatgcttgatgatgccaatggaaacaaaattggagaggtgatccagaaacaaatagaagaatccaagtcgggaattaaggatggagatggagaaagtgtgaaagaaaagatagggaaagcaggatacaaaggaatgaaaacatcagaaatagagcaaaatattggtgcacatgtcgcacaaaacattggagataccagccaagaagtatctaaagagtttgatattgaacaaatgggggaagctaaaaggactgctgggaagattgagagagaggagtctggagatatgcgtgttgaggtcaatgtgtctaccgagggagagacactggaagagtcaaaacaaaaacaatttggagaagaacctaagcctgaaactgaggatagactaaaagaaagtgttaaagaaagtagtatggaactaatgaaggcaccaaaacttgatcaaaatatagatgatcatattcctagcaacatttgtggtacaagccaagaattcaagaagtctaggattcaacaaaaggagaaaactaaaagcatagaagaaaatatggaaggaagggaaactggaaggatgtctgttgaagccagtaaggatagtcaaaaatgcatatttggagatagcatgaaaaaagatataaaaaagcctaagatcgaaactaaggatggagatcaagaacatgatggggaaaaggctggtaaggaagaatttgattcaatgacaataagggaagtgtttcctaagcagttaccagaagctactaatgaggaaaacaaagggttgagtgcttcaaaaatgcaagacactgaaaatgtcaaagaagcgatgatcaaaagaaaattgaaagagattgattcttttgtgtataagaatgaaggtgaaggacctagaaagatgcacatggaagccaaaaaagacttgacaaaagatgtcaaagaagcaatggtcaaaagagaaggaaaagagattaaatatgttgtggataacagtggagatgatgaacgcgaaagaatgcatatcgaagcaaagaaagacttaacaaaagagacaacacaagaaggtgaagatctcaaagaggaaatggtcaaaagagaagggaaagagattgattatttcttggatgtggatgaagataaaaaccctagaaggatgcatatggaagcaaacaaagacttcacaacagatacaatgcaagaaactaaagatgtcaaagaagtaatggtcaaaagaaaagacaaagagattcaaaattttgcagatgagggtgaaggtgaaaaacccaaaaggatgcatatgaaagcaaaggacttaacacaaggaaggatgcaagaaagtgaagaagtcaatgaagcaattgacaaaagaaaaggcaaagagattcaacattttgtggataagggtaatggtgaagaactcatcagcatgaagatagaagctaaacaagacttaacaaaagaggcaatgcaagaaagtgaagacgtcaaagaaacaatgttcaaaagagaaggcaaagagattgactattttttggatgagaatgaaggtgaagaacccagaaggatgcatatgagagcaaagaaggatttaataacagagacagtgcaagatagtgaagatgtcaaagaagaaatggtcaaaaggaatgacaaagagaatgaaaattttgcagaaaatggtgaaggtgaagaacccagaaggatgcatatggaagtaaagaaggacttaaaaaaagagacagtgcataaaagtgaacttgccaaagatataatggtcaaaagaaaagataaagagattgataattttgctgataaaggtgaaggtgaagaacccaaaaggatgtatatcgaagcaaataaggacttagcaaaagagattatgaaaaaaggtgatgtcaaagaattaacagtcaaaagaaaagataaagagtttgataattttgttgataagggtgaaggtgaagaacccaaaaggattcttatggaaacaaagaacttaaaaaaagagacaatgcaagaaagtgaagatgtcaaagaagaaattgccaaaaggaaagacaaagatattgagtattctgtgaataagggaaaaggtgaagaacccaaaaggatgatggatgtggaagcaaagaatgaccttaccatagaagcaatgaaagaagctaaagatgtcacagaagtaatggtcaaaagaaaagacaaagagattaagaattttgtagataaaagtgaaggtaaagaacccaaaagaatgcatatggaagcaaaggagcacttagcaaaagagacaatgcaagaaaataaagatgtcaaagaagcaatgttcaaagaaaaaggcaaagagactgaatattttgttattaagggtgaaggagaagaacccacaacgatgcatatgaaagcaaagaaggacttaacaacaaatacgatgcaagaaagtgaatatgttaaagaagcgatgggcaaaacaaaatgtgaagaagagattgactatttttttaatgagggtgaaggtgaggaacccaacaggatgcatatggaggcaaaggacataacaacagagataatgcaagaaagtgaagatatcaaagaagcaaccattaaaagaaaaggcaaagagactgaatattttgtgggtcagggtgaaggaaaagaaattgattattttgtgaataagagcgaaggtgaagaactcaaaaggacgcatatggaagcaaagaaagacatagcaaaagaaacaatgcaagaggaaattgaaaagattaagaatggaattaaggatagtgatcaacaaaatgtactggagaaaactggtaaaggaaaatttgaagtaccaactgaagagttgcccaagctaattgggaggccagatggaagtagaggactcaaggttgcaaatatggaagaacaaaaggagatgatcaaagaagaaatggttgaaaccaaaagttcaatggaaaaagtgaaaggagaaaagtccaacacaacaagcaaggttactgagaaaaacatggcaactgagatcatacagaaggaaactgaggagtccaacattgaaagaatgtctagagatggaccatatgtaccaaacaatatggtcaaagtagtatttgaagtgttggggactttccaggcaaagcttcccaagcaggtgattgaagcaatttcccaaaataaaaaagaaaaaaatgaatatgttattgtgaaattgaaaggagaaggatctataaagatgcatgttgaaccaaatgacgcttttgatgaggatgaaattgaggacataaatcagaaagaaatcggaaagccaaaactcaagtctagtgaccaaataagcgagacagatgatgttgatgttggggtatttgatggaagcaaaagaccaaagtttccaaagatgggggaaacaaaagatgtcaaagaagacagtgcaaaaattgaggagtcagtggagaaagtaaatgaagacaaatatgagaaaatacaagttgaagaaaaagggggtatgagaaaagacacaacaggggagtctactcagacagaaagagaaggttctaagatccaaacaatggaaaaagatcaacattgtttacaagaaacaattagtaaaggaatatttgaagcaagcacggctgcaaaagaagagtttcctgtgataacggtggattcactagctgataaaagaaagggactaaaaggaaaaaagatagatgaagcaaaagttgccaaagaagagttagtcaagcaaacaagtgaggaaaagaaaataattatcaaagaaaagggttctagaattgaacaatttgtgaagaaagtacaaggagagaaatatgaaatgatacaagctgaagcaaaagaaggtttgaggaaagatataactaagggaaaagatcaacaaggtttgcaagaagggacaagtagaggaagatatgaagcaaacacaacaagagaaaaaactttgaagccagaaattcctctagaaaaacaaataaagaaaggagaaccaatcacaagaaaagatgagtttgccaaaggacaaaaattcagggagacaatacaagaggaaattgaagggcataaggataaaattgatgtcagtgatcaacatgtgcaaagagatgtcgtcaaaggagttggaaaagtagacactataggaaaggagatgatcaaaaaagaatatgtagcacatcttggcccagtagctaaaaggatggaaacaaaaaaagacttgaaagcaactcctgaaaaagagaaatacacaatagctcaaaatgttaaagatgaaaagccaaggatatatgaagaaaatataaaagttgatgttgaaaaggtggataagaaaggatatcaaacaaaagttgtagaagaagggatgttaaaaggggaacacaaagcagaagtagttcttgagataaaaacggaaaggccaaaggttgcaaagagagaagaaactaaagaggcttccaaactaccattcaaaagagagatgggaaaaacaattcaaagtgcagaagataggaggcctaaaacaggagaaataacttcagagtttgaaaaggttattgaattcaaacaagctgtagaaaaaatgcatgaaagtcacaacggagaacatcaaagagactcaaaagaagtcacacctaaaaaggag

SEQ ID NO: 46634 - DNA, 372 bp, Glycine max
  Peptide Sequence Number=SeqID_163412
atgtcgcggaacttcacggattgcttaacgatgggtgtcaagttcctcaaagcggtcaagcgaaggttgcatgccatcaaacaatggtccccggacgaaattagggcaatcaattcgtggggctctggactcaatggtggaggaggcatgaatagcgctaggcaatcaattcatagggctccgaataagatgatggaggatgcacgaacagcgctagacaatcaattcgtggggctccggactcaatggtggaggatgcatgaatggcaatcaattcatgggctccgaataagatttgatggtggaggatgcacgaacagcgctaggcaatcaattcgtggggctccagactcgatggtggaggatgcatga

SEQ ID NO: 46635 - DNA, 1861 bp, Glycine max
  Peptide Sequence Number=SeqID_163413
atggacctggaattggggctcaaaatcactaaaactagagatgacattgcttccatctctgagtatcgattagcaaaggcaggacctatctttcaatctagagaaacaagcactatgttcatcctctctgctcatcttaaaggttataagaggaataaaattaacatcaagattagtgaagatggtagtaagatatcaattagtggagagaagcctgttcagaatattttgatgatgggatggttaatgcataggaaagaggttgatgttgtagggttcaacaaggttttcaaaattcctgatggggtgaaattggacgggatcaaagcaaagtatgatgaggaggaatggacattgaatattttcatgccaaaattggttaaaggaatttgtggggttaggattgaagagatcaaggaagaatcagaaaaagggagatcagaactagagaaaagtgaagctgatcaaattcttggtattgttggagaggcaagccaaaaaggatctaaagagtctaactctaaagttcaagcaatggaggacagtgaaagtttcatggagaaggatggaggagaatctgacaagatgcttgatgatgctaatagggaaataattaaggagaaaataaaaaaagatgtagaagagtctaagttgggtggaaatggagaaagttctggagagaagggtgaaattgaaggatgtgaagtaatgaagacatcagaactagagcaaaatattggtagaggcacctcacagaaaattggagacacaagccaaaaggtaatagaagaatctaagttgaggattgaggatgaaggggtaaaaggcatgagagaagaggttggaaagacagtttatgaagcagtgaaaacatcagaaaaggagaacaatgtaggtgaaggtatgccacataatattggagatacaagtcatgataaagagtttgaggttcaagaaatggaggacaatggaggttttgaggaggaggaaaaattggtatctgaaaagatgcttgatgatgccaatggaaacaaaattggagaggtgatccagaaacaaatagaagaatccaagataggaattaaggatggagatggagaaagtgtgaaagaaaagataaggaaagcaggatacaaaagaacgaagacatcagagttagagcaaaatattggtgcacatgtcacacaaaacattggagatacaagccaaggagaacctaaagactctggtattgaacaaacgggggaagctaaaaggactgttgggaagattgagagacaggagtctggagagatgtgtgttgaggtcaatgtgtctaccgaggaagagatacttgaaaagtcaaaacagaaacaatttggagaaactaagacagaaactgaggttagactaaaagaaagtaatatggaaccaatgaaggcaccaaaacttgaccaaaatatagatgttcatattcctagcaacatcggtggtacaagccaagaattcaggaaagctaggattcaacaaaaggacaaaactaaaagcatagaagaaaatatggatggaagggaaactggaaggatgcctgttgaaaccagtaagaatagtcaaaaatgcatatctggagatagcatgaaaaaggacatcaaaaagcctaagattgaaactgaggatggagatcaagaacattatggggaaaaggctggtaagcttgattcaacgacaatatgggaagagtttcctaagcagttaccaaaagctactgttgaggaaaacaaagggttgagtgcttcaaaaatgcaacaaactgaagatgtcaaagaagcgatgatcaaaagaaaatcaaaagagattgaatattttgtcgataaggatgaag

SEQ ID NO: 46636 - DNA, 141 bp, Glycine max
  Peptide Sequence Number=SeqID_163414
atgagtgtggaggagttccttgcactggtggcttggccaggaggccagcctcctccttctggaatggaggatgagcctgttcctcctgagccatttatctttgagactaatccatccgttcaggaggaagcagcagcttag

SEQ ID NO: 46637 - DNA, 267 bp, Glycine max
  Peptide Sequence Number=SeqID_163415
atggggttggattggaaccgggtcaggacgatccagcccaacccgcatttaggcaacagggttggaacaaccctagatgagacaaatcccaaaacgatgcaagacttggggaaccaccacggagggtggtgcgccttctctggccggcgatgcgagatcgtgataggggcagtggcgacagaggggctaccgaaggcaaggtggcgcaaccaaaacaagaagaaaggagagttgttagtgactgtggaacatgcgaacaaaaattaa

SEQ ID NO: 46638 - DNA, 380 bp, Glycine max
  Peptide Sequence Number=SeqID_163416
atggcgggaacggcgatgccgccattggcagcagcgggacgaggtctgactaggagagatgaagaagctcataccgccattcgtattagcgggacaaggctgaggagagagacccgtcattggcactggcgggacataccaacgtttgctcccttcaagtctatctgcttggaagctgttgtaggacttgatgacccattggcgggactgcccacgttggcatgtcccgccagtgccaatagcgggtctctctcctcagccttgtcccaccagtacgaatggcggtataggcttcttcatctctcccgttccgctgctgccaatggcggcatcgccgttggcgttacaagcttcatgccagtaacaatggcggcacccac

SEQ ID NO: 46639 - DNA, 546 bp, Glycine max
  Peptide Sequence Number=SeqID_163417
ggacctccagagcctgaggttggtccctcagctgctcgtgtcagcacaaaggagagttgtgttgatccctcaaggaatgatctagacacgggtgacttagacaaatgcaggttgtacatcgaacaaaaccctccccgcctgattgccctagaaagagattatgagggatccacaaccgttcacaacatccctttgttgcatgatcaagtgaaggtcggtattgaggaggttaaagatgcagatgctcccgttcctgtacccactagcgaggcacttaacaccttccttgcttggccgacacatcttgtaaagcgtttatcagaactgggagttgtgggaccaacaaaacctgcagataggccggatcatgagtccatccagagatctgcgcaatcgcaatttgaatcagaaagttacatgaagaactggatgcagaattcaaaatgggatgtctacctaggcgcctacctgaatggtgctttgaaaggacttgacgatactccacaacctaaattcaaggctggtgctaggtggattgttgttaaa

SEQ ID NO: 46640 - DNA, 328 bp, Glycine max
  Peptide Sequence Number=SeqID_163418
atggttttttataaagtgtatccttctgatctgcaacaccagaagggtagttatggagaagcattagctaagcatgaggaaagagatggatatgaatacgagtttattgagaggattgttaagtcagtcaccaggaagattaatcctgttagtttacatgttgcggattacccagttggactagggtcacaggtgcgattagtctggaagcttttggatgttggttctgatgagggtgtccacatgatagggatccatggaaagggtgggctaggaaaaacaacacttgccctagcaatttataacttgattgctgaccaatttgatg

SEQ ID NO: 46641 - DNA, 381 bp, Glycine max
  Peptide Sequence Number=SeqID_163419
atggcgaggaataaaggtataatcccatctggtccaactgaaatatctatccaaagaaagcagctgaaggctattattgattctcttcttccagcatgcatatcacctgatttggaaactggtgttccgtttagagctcaggctattatttccaatcctactgcatgtggacatacacacgttgctgaagctcttggggtgccccttcacatcttcttcacaatgccttggacgtttcttgtaagaactaaaagcaggagtaatggtgtttccaacattcagataaatgcaacagtttcctatcaaataattacccattatccaattgtcaaggaaagtgcattatctttcaaggaccgcaacacaaagtggatcccttga

SEQ ID NO: 46642 - DNA, 390 bp, Glycine max
  Peptide Sequence Number=SeqID_163420
atggtcgaggagaaagaaataaatgaccaagaaaaagaaatagaggtagaaaaagaaaaagaaaatgaagaaaaagaaaaagttgaaaaaaataaaggagggaaagaaaagagtagaagtgagaaagcaagaatgaagaagaaagaaaaagtttcaaatgaggatacggaagtaccatatcctgtggtaccttacaagaaggacaaggaccgccatctagcaagattccttgatattttcaggaaactggaaataactatgccttttggggaagttttgcaacaaatgccactttactcgaaatttctgaaagatatgttgacgaggaaaaatagatacatccaccaaaagaatattgttgtggaaggcaactgtagtgttgtaatatag

SEQ ID NO: 46643 - DNA, 654 bp, Glycine max
  Peptide Sequence Number=SeqID_163421
atggaggagtgtgtgaaagtgaggggcgcgcatgaagagaaacatagattgagaaagtggagaaggggaaaggattcaaaaagaggtttggaccatttcatcctagagcctactggaacagagaggaacctgcttgttgctgaccatgagattatattttctagatcaatgatggagaaatgtgattctccaaggcaagacttaatattggacaggctgtcagagtgtgaaaagcaaaagctgtttaacctagtgaagatacaaagtgacgggactgttaaagttgatctagaaaaagatgcacctcttgcatcagaattgttgaagttccaatcttttgaagagtcaacaatgagtggaactattatttctgaatcaaaaaaatcagctccctggttacaaattgtcatacttgtggttggaactagaggcgatgtacaacctttcctggccattgcaaaaaaacttcaggcatgtttgaacatttccatccaatttatcctggagtatggacattgtgttaggctggcaactcatgctgattttgacacatttgtaaagtctgctggtgtcaatttctatccgttgggtggcgatcctcgagctttggcagaatgtaagaggttcctttttaatactgccattaatatctaa

SEQ ID NO: 46644 - DNA, 216 bp, Glycine max
  Peptide Sequence Number=SeqID_163422
atggctattggaatcttgcctagttacctatcagtggaaacttggctcatcatcataatactcaaaacttccttgcgcgcgagtgcattaaagaagggatcgttgactgaggccattgggcttagtggttttgcagaatggacacttggaagttcaaactcatacatcaatattgctatttgcaaattactacgaaggcaagacagtactctttaa

SEQ ID NO: 46645 - DNA, 2016 bp, Glycine max
  Peptide Sequence Number=SeqID_163423
gtagctgtcacagaattaagtggtcaaatttgtcagatctgtggggatgagctggaggttactgtgaatggggagccatttgttgcttgcaatgaatgtgcgttccctgtgtgcagaccttgctatgagtatgaaagaagagagggtaaccaagtttgtcctcagtgtaaaaccagatataagcgcatcaaaggtagtcctagagttgagggtgatgaagaagaggatgatagtgatgatttggaaagtgagtttgatattgggagcgtgttctctgctcgccttaactatggttcacaggtgaatggttcggtgatccatgcaccatcggagtttgatgcagcttccgtggcttctgagatccctctcttgacatatggtcaagaggatgttggcatttctgctgataaacatgctcttattcttcctccattcacggccagagggaaacgagttcatcccatgccttttcctgattcatctgtacctgtgtccttatttaatgtgacaattaatgatggtgatgcagttcaaccaagacctatggatcctaaaaaggatattgcagtttatggatatggaagtgttgcatggaaggaacggatggaggattggaagaaaaaacaaagtgaaaaacttcaggttgttagacatgaagggggtaaagatagtgatgagctggatgatcctgacttaccaaaatatgaaaaagaaggaaagccatctctgttagctgatatagacgtgttcgttagtacagtggaccctatgaaggaacctccactcattactgcaaacacagttctgtctatccttgctgtggattatccagtggacaaggttgcatgctatgtttcagatgatggagctgccatgcttacatttgaagcactttccgagacttctgagtttgcaaggaaatgggttccattctgcaagaagttctgcattgaaccacgggctcctgaatggtattttgctcagaaggttgactacttgaaggataaagtggatgcaacatttataagagaacgtcgtgccattaagagggagtatgaagagttcaaagtgaggattaatgcattggtggctttggcacaaaaggttcctgaggatggttggacaatgcaggatggtactccatggcctgggaacaatgtcagagatcatcccggaatgatacaagttttccttggtcaaaatggtgttcgtgacatcgaaggaaatgaattacctcgtcttgtctatgtgtctcgtgagaaaagacctggatatgatcaccacaaaaaagctggagctatgaatgctttggtgagagtctcggcaataatcaccaatgctccttatgtactgaatgttgattgtgatcactacataaataacagtaaggcccttcgtgaagccatgtgcttcatgatggatcctacatcagggaaaaaaatatgctacgtacagtttcctcaaagatttgatgggattgatcgtcatgatagatactcgaatcgcaatgttgtattctttgatatcaatatgaaaggtttagatggcatccaaggaccaatatatgtgggaactgggtgtgtcttcaggagacaggcattctatggatatgatgcccctacatcgaagaaagcaccaagaaagacatgtaactgttggcctaaatggtgctgctgtctgtgttgtggatctaagaagaaaaagattaaagcaaagtcaagtgtgaaaaagaagataaagaataaggatgatataaagcaaatgcatgcactagaaaatattgaagagggaattgaaggaattgacaatgagaagtcatcactaatgtctcaatcgaagtttgagaagaagtttgggcaatcatctgttttcatagctttcgacactcttggaagatgggggtgttccaaaagcagcaagttctgctacactcttgaaagaggccatccatccttgaagctcttttcaagctctggtcttcctgtacttagacctctgctacattttgtctttcag

SEQ ID NO: 46646 - DNA, 783 bp, Glycine max
  Peptide Sequence Number=SeqID_163424
atggctgcttcaacaatggctctctcttcatcatcattggctggtcaagcaatgaagcttgccccctccacccctgagcttggtgttggaagagttagcatgaggaaaacagcccccaagactgtttcctcaggaagcccatggtatggcccagaccgtgtcaagtacttgggcccattttccggtgaagctccctcctaccttactgagacttttgccaaaaaccgagaactcgaagtcatccactccagatgggccatgttgggagccctgggctgtgttttccccgaactcttggcccgcaatggtgtcaagtttggagaggccgtatggttcaaggccgggtctcagatattcagtgagggtgggcttgactacttgggcaacccaagcctgatccatgcacaaagcattcttgccatctgggccacccaagttatcttgatgggtgccgttgagggttaccgtattgcaggtgggcctcttggtgaggtgactgacccaatctacccaggtggcagctttggcccattgggccttgctgatgacccagaggctttggccgagttaaaggtgaaagagctcaagaatggtaggttggctatgttttccatgtttggattctttgttcaggctattgtgactggaaagggacccttagagaacttggccgaccaccttgctgatccagtaaacaacaatgcctgggcctatgccacaaactttgtcctggaaagttcatacaaagaggagaaatcacttgcattaaaagaagatgaatga

SEQ ID NO: 46647 - DNA, 363 bp, Glycine max
  Peptide Sequence Number=SeqID_163425
atgggtggtcgcagtaaaagcgaatgcgagatctcaggaacagagtctgactctgatatcatgttagatctcatcttaaaatcttatatatttgttggacaacttcacttaagatcaattgattttaagataaaatataacatggtatcagagcaggctcacaatctgagacctcgtctctcttccgctaacaccactcacaatttgttattgacgcaccaagcccaagtgctatgcatgaggggatgtgttgaaaaacaccaaagtctcacgctgaaggacaatccaatgcaccaaagtgtacgtcctgttttctacaagaccatagccaaagccacggaaagaacagaaatcaatcaataa

SEQ ID NO: 46648 - DNA, 291 bp, Glycine max
  Peptide Sequence Number=SeqID_163426
atggctatcgaaatggatatagagccaaaatttcgtgaaaattgtaaaattcatagaaaatctcattttgatgaaaatattagtaatgggatcacacattcacctgaagaatcttttcgtattgaacccccaaaatgtctctacacggtcctgtccttcgaagacctcaaagttaaacaattcgaagagacacaggttgagatgcagtcgaggttcgccggagatgatcacttcagttctggtagctacgctcacgtccaggtttgggtgggtctcaacatttgggaatga

SEQ ID NO: 46649 - DNA, 1587 bp, Glycine max
  Peptide Sequence Number=SeqID_163427
atggagtttggttattgtgcagtgtttctgatactgcttcttccaatctcatgtgcagattctacctcagttgagaagcaattcagggaatgcttgttaacccaacttgatggaaattctgaatacattgaaaaaataaccttcacctcatcctcctcgctatatccccaagtctgggattcattggcacaaaatcctagatgggttagttccacaaggaagcctcttatcattctaacacctttccatgaatcagaaattcaagaagccattctatgcagcaaacaacttgaactgcagctcagagttagaagcggtggccatgattatgaagggctatcttaccttggtaaggtcccatttgtgatggttgacctcatcaacatccgttccatcgacattaaccttgatgatgaaacagcttgggttcaggctggggcatcaataggtgaactttactacaaaatttcaaaagcaagtaaagtgcacggatttccggcaggaacctgtccaagtgtagggatagggggacatatcagtggagggggacagggtctgatgttgaggaagcatggcctatcagcagaccatgttcttgatgcttacctcatagatgtaaatgggaagattcgtgatagaaaatcaatgggagaagatgttttctgggccatcagaggaggtgatgctgctagttttggagtcatccttgcatggaagatcaggttggtcagagttccacctattgttatcgggttcaacgttgggagaacactggaggaaggagtcaccaatctcattcacaggtggcaatatatagcacatgactcgcatgaggatcttgtcattagagtaattgctcgaattagtggtcatgacaaatcaaaaaaattccaagcaaccttcaactctattttccttggaggaatagacaggttgatcccactgatgaatgagagtttcccagaattgggattgcaggccaaagactgcattgaaatgagctggattcaatcagtgatgttcatagctggatatgacatagaggaccctctagaactcttgctcaacagaactaccatgtttaaaagatctttcaaggccaagtctgactttgtaaaggagccaataccaaaatctggtctagaaggagcttggaaactgcttctagaagaagaaatagcattcctgatattggaaccttatggtggtagaatgaatgaaatttcagaatctgaaatcccttttccccacagaaagggctacttgtacaacatacaatacctggtcaactgggaagtcaatagtgacgaagcatccaagaggcatctacaatgggctaaaatggtttataaatacatgactccttatgtctcaaaatctccaagagctgcctatttcaactataaggatcttgatttaggcaaaaacaagcatgacaacacaagctactcaaaagctagtgtttggggtgagaagtactttaagggaaactttaggagattggcacaaattaagacagagtttgacccccaagattttttcaagaatgaacagagtattcctctcctgaattcccaacattcttag

SEQ ID NO: 46650 - DNA, 141 bp, Glycine max
  Peptide Sequence Number=SeqID_163428
atgggaggaagaagttcatcatcggaaactactatcggtcatcatgcgcctcaatgtaggcaatgtgctgcatatgttgtgaccaatgtgagcaaatgggtggtaactctaggtctatcagccatatctatgacaacataa

SEQ ID NO: 46651 - DNA, 186 bp, Glycine max
  Peptide Sequence Number=SeqID_163429
atgaaatttggcggagttgttccgtttctcattcctatgacgaggggtgagggtcacaactcactctttgaggattcacctagtgagtgtggtggtggggccgccactgtgagatatgggttaatctctaagggacactcacgaaacaagatacaagcgcaaggccgtgtaacgtgctaccactga

SEQ ID NO: 46652 - DNA, 669 bp, Glycine max
  Peptide Sequence Number=SeqID_163430
atgcaaactgaccctaagaagaggaaaataagctctaagacttttgattgcttgtatatcggttatttagaacatagtgctgcctataggttgctagtgttgaaaagtgatgtgcttgttgtcaacacaatagttgagactaagaatgttgacttctttgaagacatattcccttttaaatctagacaatctatagaaatcaacagcgaaagtggaaggacgatccttggtcaaaccttagaaaactttagtgagttcgtggttgaggacctaagaaaaaatgcaccttctttggaacaagctattaagatagaaattgactctattaagaagaataatatatggaccctaccccaaggagtgaaaccaatagggtgtaactggatctttaagaagaaatacaaccctgacggatctatcaataagtataaagctagattagtagttaaacggtttacccagaaccaaaatgtggattactttgacactttttcccttgtgactaggatttcctctattcaaatgttgatagctttgtcttccatacataagttggtgattcatcagatggatgtaaagactgctttcttgaatggtgatctagaggaagaggtctatatgactcaacttgaagggtgtgttatacttggtcaagaggaaaaagtgtga

SEQ ID NO: 46653 - DNA, 603 bp, Glycine max
  Peptide Sequence Number=SeqID_163431
atgagatacttgagagttattatagaatatggaattgggtataatggatttcccaatgtactagaagggtacaataatgctaattggatccctgattcagatgagacaaaatccactagtggttatgtgtttacacttggtggtggtgtggttgcatggagaccatacaaacaatccataattgcaagatcaactatggaatcagggttcgtagctttggagttggctagtagtgaggctgagtggttgaaaaacttcttggcctacattcctttaggcatgaaaccaacctcgtcaatgccaatgcactgtgataaccaatcagcgatagtcatagcaataaacaaaacctttaatcgaaaaaatagacatatccaattgagacataacatggcaaagctactaaagcatggaacaatttccattgactgtcgttggttgtttgtgacgaaatttgggtggcatggtaacccaacctttgtgattggagatcccatgaagaaggtggtttacaatttgcagaatacacttgatgaaatcacctatatgagtgtcaagtggagtcatttgcatgagatcatggcaaaatctctagagcactaa

SEQ ID NO: 46654 - DNA, 789 bp, Glycine max
  Peptide Sequence Number=SeqID_163432
atgaagcaaggggaaactatagcggatgtgcagaaaagatttacacatattgtaaaccatcttaagggtcttggaaagatttttgaagaagaagagatcaatgtcaaggtgctgacatccctcaatagaacatggcagccaaaggtcacaattatttttgaatcaaaaaaccttatgacacatgctgaattgtttaggaagctaagggaatatgaaatagagttaacaataatggttgaagaagaagctatagataagaaaaatagaggtttagcattgatgactagcattccatcaagtgatgaaagtgaggatcacaatgcaaaagggtcggatactgaaaatctgaacttgcttgtgagaaggttcaacaaattccttaagaaaaagaagaacaatggaaacataacctttcaacctaagaagaatctcaaggaaggagaatcatcttcctccaatggatacacttggtttgagtgcaaagagacaggtcatattaaggtagattgtcccatctaccaaaagaagcaacaaggagataagaagaataagggttcattccaaaagaataaaaagacatatatctctttggatgacgatgaatcaacaacttccaacgacaatagtgaagatgatgaacaaaatttgtgcttgatggtaaacaatgaagctgaaagtgaggttaccgtttctgatttggaagatgatgataactatgatcaactactagatgctttcaaatcaaaaaatgtagtttccacctccagagttttgaacttttacatttag

SEQ ID NO: 46655 - DNA, 459 bp, Glycine max
  Peptide Sequence Number=SeqID_163433
atggaagttggactcttggctaggcaacttaagataggaatgcctctggtgtcatcaatggttgctgaagagataaccggtgaaggatctgtgccaagagatactagccatggtggagactttgcaacatggggaaaagctacaccagttgaaggtgtgggaggtaggagcgaggttgaagtaagaaagcacgctccaggtctgggcaagaatagttgggtccttccacagaatcttccacagagctccctcggcattcagaataaactaccttcctggcatacacagcttggccgcaatggcctactagacagggcgggtgagtcttctgtgccactgccacctctggagcttgccatagaattcatcatacatccctggtgtgagctccacattcctctcccgaagaatgttccggagataaacgttatcctagtagcggacctaggcaatctctga

SEQ ID NO: 46656 - DNA, 724 bp, Glycine max
  Peptide Sequence Number=SeqID_163434
atggagatgaaaaataggtcccttgaggaactagcaaggaccatgcttaacgagtataatttgcctaaatatttttgggccaatgctgttagcatagccttctatgtactcaattgggtgatgattagacccattatgaaattaacttcttatgagatatacaagggtacaaaaccaaatgcgtcacatatgaaagtttatggtagtaaatgttttattttgaataatggtaaggagttacttgggaagtttgattcaaaggctgatgaaggaagttctaaagaatcctctcctacaagtgaaaaggtagtgaacaataaccctcttaaaggacattcactacaacacaacagtcttcctaaggagtggaaaaaacctaaggatctttctgttgacaacatcataggtgatattgcaaagtattgcaaggaacttctcaagaagtttgatacggaaaaaagcaaggaggctacaactgctatggctacaaattgctacttaagtgtagatgaaaaaggggagctcattaaccaaacaaagtacaaagatgctgagatcactttagtgggatactcagattctgactttgttggatgcaaactagataggaagagtacaagtggtacttgtcacttattgggacatggcctagtatcttggaatagcaagaagcaagcatgtgttatcttatctacgactgaggctgagtacattgctgcaacga

SEQ ID NO: 46657 - DNA, 135 bp, Glycine max
  Peptide Sequence Number=SeqID_163435
atggagtttgattctacctcagatgagaagcaattcagggaatgcttgttaacccaacttgatggaaattctgaatacatcgaaaaaataaccttcacctcatccacctcactatatctcaaaacaagagtctag

SEQ ID NO: 46658 - DNA, 474 bp, Glycine max
  Peptide Sequence Number=SeqID_163436
atgacaggtcatcagcagcttgtgaaccatgtctatttttcacctgatgggcaatgggtggcaagtgcatcttttgataaatctgtgaagttatggaatggcaccacagggaaatttgttactgccttccgtggtcatgttgggcctgtttaccagatcagctggtctgcggacagtagacttcttttaagcggcagcaaagattcaacacttaaggtttgggatattcgaactcgtaagttgaagcaagatcttcctggtcatgctgatgaagttttttctgtcgattggagtccagatggagagaaggtagcctctggtgatctcttgcatagtagtgagcaagggctatggatgctcctcaaggagccaaggcaaccattctttcaccaaattgtagatgactggttggtagagcatcttgagaggatcaaagttgaggctacactagttcatcccttagatgaagagtaa

SEQ ID NO: 46659 - DNA, 3459 bp, Glycine max
  Peptide Sequence Number=SeqID_163437
atgggtatggattttcacggcatgaaaaggaagaggctgcaggctttgtgcaagaaacatgacatccctgcaaatttgaagaacaaggaaatggcagacagactctccctcatttttaagggaaaggaaatagaagatcctgtaggttctggtaatgttggaacaatgaaagacaccccccgttgtgttagtggcaaagacataaatgtggaaatgattgatttggtgactcctggcccgggtttagaggaaaggagtgttgtttctgtcaagaatttgaaaagttcagagattgaaaggttggagtttgaaacgaattcttcccgggaaataacaaggggagattttggaatttgtggagttgaggaagacatgaaaagtggactcaatgaggaacaagttgttaacagtcagggaggtttgcattcagcaccagttatagttgcagtagaggaatttaacaaacctttggtggagggagaaggcgagcatttgggtggtgaaaataatcttcttgaagatctttgtgaaaatggaaaggaaagagatgaagctgtagaacaaagcaaccacaatagccctcaagggtcaaacatgaaagatgtgaatgttttacatgtttctcaagaggaatctggttaccctatggtggaagaagatgaagctgcagaacaaggccaccacaataaccctcaagcaaacattaaagatgtgaatgttttacatgtttctcacgaggaatctggttaccctatggtggaagaagatgaagctgcagaacaaggccaccacaataaccctcaagcatcaaacattaaagatgtgaatgttttacatgtttctcacgaggaatctggttaccctatggtggataaagaagaagctgtagaacaaggtgacaacagtagccctcaaggatcatcaagcatgaaagatgtgaatgttttacatgtttctcaagaggagtctggttatcctatggtggaagaagttcagaaatctgatgacaatatttataatggtagtgtctacaatctcataaacaaaggatttgaagttgatgccaaggatactgatggaaagactaattttactgctgaatattgtgcacatgatgtttcttttagtttaaatataccaggtgggacactagatcaatttcagggaacttatccagaaaatgaatccaattctagttgtcttaatattcatcaagatacttgtgaagaggagttggaaacaccacagaagacaggtcccattgaagatccaggggaatgcattggattttctcccaataaccttgaaatttcagcggttaaaggctttctggctgaaacatattttgatccgagtacacttggagatgttgagggaacttgtaacatgaaagaaagaacacaaagtgtcaagatggaggaagttgaacattttatagatgagtttcactcatctacatttaaagattcatatgggacacctgttcagtttctgacaaatgatgcattaaatgaagtgaagtctgatcttaatattcatgaaatgattgcttcagtgatagttcataaaatttctcccatgatttcaaagaatgaggttataatctctccaaccttgacgttctatgtgattgaaaatgcagatatatctgatgctaagtttgtatcttctagaaaaagaagtttacgcccaacttcagagacaatgattggtttttctccgaagcagctaaataattcagagattaaagtgtttcagtctgaaataatttctttcccagaaccaccagcagttgacattggaatttgtgatgtagaggagaacatgcatattgatgtcaataaggagcaagttgatgacaatcagcaagttatatatgtagcatctagtgtgatggacttgaacaaagaggatcttgtacaggttgcttcagtggaagttggagaccattcgttggagggagaagttgagaagtcaggtctgattgctgattcggaggaaattgatattggattttgtgatgtggaggacaacttgcagaatgatgtcattgaggaacaagctgataatgaaatttgtaatgtggaagagaacatgcagaatgatgtcaatgaggagcaagttgatagtggaatttgtgatgcggaggagaacttgcagaatgatgtcaatgaggagcaagttgatgccagtcagcaagttatgcatgctgcatctagtgtaatggtgttgaaaactgaggatcatgtacaggttgcttcaggggaagttagagaccatttgttggaggttgaaaaggcaggtctgattgctgattcaaaggaagttgatattggaatttgtgatggggaggagaacatacagattgatgtcaataaggagcaagttatacatgcagctagtgtaatggtattgaacaatgaggatcttttacaggttgcttcagtggaagttagaaatcatttgctggagggagaagttgagaagtcaggtctgattaatgattcagaggaaattgatattggaatttgtgatttggaggagaacatgcagattaatgtcaataaggagcaagttatgcatgcagcatctagtgtaatggacttgaacaatgaggatcttgtacaggttgcttcagtggaagttggagataatttgttgaaggaagaagttgagaagtcaggtctgcttgctgattcagaggaatgcattggatatatgcccaataacctcgagccttcagcaactaaaggctttcaggctgcaacatattttgattcaagtacacttggagatgttgtgggaacctgcaacatagaagaaagcatagagagtgatcagatggaaaaagaatacagtcaggaagttttgaatatggcaaatgaattgcagagatctatggaggagagtgatccaatggaacgagaagttacaaggttgtttgacaactctgatgaccatgatgatgcagatggaactgaagcagaagacaaaagtcatcaacactatataaagagcgacatggatagcattgagaaatatttgctgaatgatttccagtctattgatgatactgatggacaaaattcagatgagtatgctccaactgtgccccattctgttgaaatgaagtcatgcacttttaaccttcaacaaatttctgcatcagacactgtttctggagatgaaggtacttttcaagagaaattggaaacaccaacaaagtgtacaccaattccaagttcagaggacagtgtcgttttttatactaatcttgaatcatcaatgaagaaagagttgattgtaaagagtctgcccatgaaacgtgcaagggatgtacttggggctagtgacatgaaagaaaacattaaaattgcaaagaaggaacaaggtggcaggatcatatcaaggagtgcatttcctaagaggaaacctctacaagatcttcaacagaactga

SEQ ID NO: 46660 - DNA, 324 bp, Glycine max
  Peptide Sequence Number=SeqID_163438
atggctgcttcaacaatggctctctcttcatcatcattggctgggcaagcaatgaagctttccccctattgccggtgggcctcttgcattgacccattgggtcttgctgatgacccagaggtttttgccgagttgaaggtgaaagagttcaagaatcgtaggttggctatgttctccatgtttggattttttgttcaggccattgtaaccggaaagggatctttagagaaccttactaatcaccttgctaatccagtaaacaacaatgcctgggcctatgccacaatgagaaactacgagtgtgaatttcacgttgttatttaa

SEQ ID NO: 46661 - DNA, 771 bp, Glycine max
  Peptide Sequence Number=SeqID_163439
atggaggacgagacagagactatggtggagaagagggagataatcaacaacgtaatgtgtcttttgacagaccctgatggaactcctttgggtgctcctatgtacctacctcagaatgctggtcctcaacacctcatccagattgttaataagcttctaaacaatgcattgcctatagtttgtcaacctcaagctattttccggattcgtcctgtgaatcgctgtacggcaactatttctggtcatgctgaagctgtactaagtgttgccttcagtcctgatgggcgacaactggcaagtggttctggtgatactgctgttcgattttgggacttgaccactcagacaccattgtacacttgcacaggacacaagaattgggtccttagtattgcatggtcaccagatggaaagtatcttgtaagtgggagcaagactggagaacttatttgttgggacccacaaactggaaagtcattaggcaatccactaatcggccacaagaaatggattactggtatctcttgggaacctgtccacctgaatgctccatgccgtcgctttgtaagtgccagcaaagatggggatgctcgtatatgggatgattgtacaattaaagtctgggaaaccacacaagggaagctaatccgtgaattgaggggacatggccattgggttaattcgttggcattgagcactgagtatgttcttcgcactggagcttttgatcatactggaaaacagtattcatctccagaggaaatgaagaag

SEQ ID NO: 46662 - DNA, 1557 bp, Glycine max
  Peptide Sequence Number=SeqID_163440
atggccaatgctgcagcaattgcagctgcctttgggggaggtttgcctcctggcataactggaacaaatgaaaggtgtacagttcttgtcgcaaatctcaatcccgatagaatagatgaggataaaatgttcaacttgttctccatttatgggaacattgtcagaattaaacttctccgaaataagccagatcatgcacttatccagatgggagatggttttcaagctgaattggcagtacattttctgaagggagccatgttgtttggaaagcgattggaggtcaactattcaaagcatgcaaacataacccaaggtgctgatacacacgagtacgccaattcaaatctcaatcgattcaatcgtaatgctgctaagaactaccggtattgctgctctccaacaaagatgatccacttgtccaccctcccgcaagacataaccgaagaggagattgtgagccttttggaggagcatggaaccattgtcaacagcaaggtctttgagatgaatggaaaaaagcaggcacttgttcagtttgagactgaggagcaggctactgaagcccttgtggaagccgccgccggcagccagaagaacaacagcaacaaggccttcgatgcggcggcgttcgaggcggagcggttggccctcgacgcggagtcccggcgagccatggcggaggctgcctaccccaaggcctggaaatgggtaatccgtaagagaatatgggatgtgatggaagctcgcaacttcgccaacaacccccggcccgttcaccaccgcattcccaatttcgttggcgcctctgttgcggctgaaaagatgagggagctagatgtgtttcaggtagcacaatgtgtaaaggttaatccagactctcctcagaaacaagtcaggtttctcactctttcagatggcaagaagttgttgactcctcaacctcggccgagaacaggtttcttctctgtacttgattccaatatgttaactttggataccatcaaggaagcctgcacttctgttggggttgccaagcatggacagccgattgggttagacaaaaagataaaggtagatcttattgttattggatctgttgctgttgacccaaggacagtgaaccttggtgcaacggtaaggttgctgccttgtgacctagtgctcatggattcaaatcctacagacagcctctcagcttacgagggtggagctgagtatatctaccctcctgagacctcactagtagtgagcctcgtgttggaacttgaatatggtatgctgaggtacatgggagccatcgatgattcaacaccagttgttacctctgtgcatgactgccaattggtggacgatattcctgttgaaaagctgttaatccatgacgtaccagtggatatcatttgtactccaacacagttgtctcctgagaagttgggacaaattcgtatactgagggagttcaagaagaggattgaacaagagactggacagaagcttcctactggtccatcagagaaattaccccctattgctcaacgaagtagaaggggttga

SEQ ID NO: 46663 - DNA, 276 bp, Glycine max
  Peptide Sequence Number=SeqID_163441
atgattggtaggggccaatatgatggtgcattgcatggagttcctcttaaatttgaaattggtcctcacgatgtggctaatgaaagcgtggtgatatccaagagagatatccctgggaagcaagggaaactgtttggaatctctatagagccttcaaatttggagacttatgttgaacacaagttagatgagatacaatcatctttattggaaagggcaattgcttttcgagataggttcattcttttaatgctacttttagcctgtgattcataa

SEQ ID NO: 46664 - DNA, 291 bp, Glycine max
  Peptide Sequence Number=SeqID_163442
atggctcagggatggtggcctgagatgatgcatcctgtacctattgaggataccttctcaatgaactgctctaccgacagaatggaccctggaggagctaccacctatgagcctggaggagctggtgtaggagtagcagaagtggaaggagctagtagagtagaagaaaaaggaacattagttggtctcacccttgccttcctcccccctctgaagttaactgtaactcctctagctctgcatagggtagtgatcaaggctggaaatctgagcctagaagagttactctga

SEQ ID NO: 46665 - DNA, 171 bp, Glycine max
  Peptide Sequence Number=SeqID_163443
atgccgcatgtcaccagacttcacgggtcaggacgacaaaaggtgcagaggacgatgttagtctccgcgcgtcaacgggctcgtttgccccttgttgacgaaaggacgacaaaaggtgcagaagacgatgttagtctccgcgcgtcaacgggctcgtttgcccctggttga

SEQ ID NO: 46666 - DNA, 694 bp, Glycine max
  Peptide Sequence Number=SeqID_163444
gatggacatgaacattggcggtttgatctctggacaaatgaccatgatcgctcagtctaactcttctagattaggctttctagctttaatcacagccttttgtagatcgaggggagtgggatttgatgcccttacctcctatgaaaacctaagaccggccattgacttagcttatatcataaacaactgttggaatgtgaatgaccaaacagttaattttccagagacaaggaagaccaagctcagagcagctgatattccctcttcctttacaccaatagctggcatccctgcatcttctacttcagccccacctctagctttagcagacttatctgcccagagccctcagacatcagatgccaaatttcaaagcttttcgttgagaaggtggcctggcaaggagcccgaccttcttttgtgggggataatgaaagttttacaaccaaggcacctcaacagcatgagccagaaccagaaaacaatcactcatctgaagccaccatctctggagctgttatccaatgaggctgctcatcatggaccaatgccagcgtcagctaattcaccatttccaagagtggatccatcttcacctcagcacgtagcagactcttccattcctgtcttaaagatacatgagggccagaccataccaattctgcctttggacacttctcctccagctactcca

SEQ ID NO: 46667 - DNA, 1591 bp, Glycine max
  Peptide Sequence Number=SeqID_163445
gggacatcggcctgctcggctcgctgttttacctgagctacggcctgtcgaaattcgccgccgggctgtggcacgacggccacgggcagcgcaggtttatggggatcggcctgttcgccaccggcttgctgaacgtggcgttcgccttcggcgaatcgctgacgctgctgctggcggtctgggcgctgaacggcttctttcagggctggggctggccgccctgcgcgcggctgctgacccactggtattcgcgcaacgagcgcggcttctggtggggctgctggaatatgtcgatcaacctcggcggcgcgatcgtgccgctgatcagcgccttcgccgcccagcgctggggctggcaggcggcgatgctgatcccgggcgccgtcagcatggtgttgggcatctggctcacgcggcggctgacgggcacgccgcaggaagaaggcctgccgtcggtcggccggtggcgccacgatccgctggagctgcgccaggaacagcaaagcccgccgatggggctgtggcagatgttgcgcaccacgatgctgaagaacccgatgatctggctgctcggcgtctcttacgtgctggtctacctgatccgcatcgcgttgaacgactggggcaatctctggctgacggaaagccacggcgtcaacctgctcagcgccaacgccacggtgatgctgttcgaggtaggcggcctgctcggcgcgctgttcgccggctggggctcggatttgctgttcggcgggcagcgcgcgccgatgattttgctgttcacgctcgggctgatggtttccgtcgccgcgctgtggctggcgccggtgcatcactacgcgctgctggcgggctgtttctttacggtgggcttttttgtcttcggcccacagatgctgattggcctcgccgccgtggaatgcgggcacaaaggcgcagcgggctccatcaccggttttctcggcctgttcgcttacctgggggccgcgctggcgggctggccgctgtcgcagatcatcgaaggctacggctggtcaggcatgttcagtttgctgtcgatcgccgccgttcttatgggtttattgctgatgccgctgctgatggcgagcgttaccacctctaccgagagaaggataaaacaatgaaaaaaaccttagtcactaccctgatagcttccggcatcgcgctggccacgctgagcggcgccgcgcacgccaagggccgcctggtggtctactgcagcgccaccaatgaaatgtgcgaagcggaaaccaaagccttcggcgagaaatatgacgtgaaaacctcgttcatccgcaacggctccggcagcacgctggctaaagtggacgccgagaagaaaaacccgcatgcggacgtctggtacggcggcacgctcgatccgcaatcccaggccggtgaaatggggctgctgcagccatataaatcgccaaacctcgaacaggtgatgccacaattccgcgatccggcgaagctgagaggcactactcctcggcggtctacgtcggcattctcggcttttggcttcaatacccagcacctgaaaagagaaaaacctgccggtgcccaa

SEQ ID NO: 46668 - DNA, 1032 bp, Glycine max
  Peptide Sequence Number=SeqID_163446
atgatgcttactgtttgtaaaggacctacctcatttgaggatttaagaacagttgataatgttcaatattctacatataaagaagcatgttttgctatgagatttttgcaagatgataaagaatttattgaggcaatcaaagaagcaaaagactggggttcagcacattatataagaaagttatttgtgttgttacttttagctgcaacgatgagcaaacctgaacaagtttgggaccaaacttggcattggatggctgatgacattgtctataattataaaaaatcatcaacaagtacaacattgcagcttgatgatagaactcttcaaaatttggtcttgcttgaaattgaacaactgctgcaagcaaatcaaagatcgctaagagactatccttcaatgccatatccagaggatgcgaattgtccaacttatctagacaatagccttatattagctgaactgaactacaacaatgaagaacttagatcagagtttgaacatctattttctcacatgacagcttcaatttgcaaccagattgttgaagctgttaataaagatgaaggtgatatgttttttctctatggatatggaggtacaggaaaaacatacatttggaaaacacttgcaagttcactgagagctgacaataaaattgtaataatggtggcctctagcggcatagtttctatgctattgcctagaggtagaactgtacattctaaatttaaaattccagttccagtttttgaagactcaacttgcaatatgcatcaaggaactcaattagctgagctattaaatcagacaagtcaaatcatttgggatgaagcacccatggctcacaaattctgctttgaggcacttgatcacagtcttagagatatcatcaaacacaactcaaaggacagtacaatctttggaggtaaagtcatggtctttggtggagatttccggcagatcctgccagtcattccaagaggcagccgcaataattccaaactgttatcttacttatatacattctaa

SEQ ID NO: 46669 - DNA, 198 bp, Glycine max
  Peptide Sequence Number=SeqID_163447
atggatacctcagagctctacactggggcaatgaaaggcaccatgcatgagcctcaggtgaacctaggggcaggtcaaaaggcatacactttgagggagttcccgaagagatttgcaaaagataggatgaggttgcatgaattatcacctctttcaaaaatcaaatcaaaatcacaaaatagggaaagaatgtcatga

SEQ ID NO: 46670 - DNA, 234 bp, Glycine max
  Peptide Sequence Number=SeqID_163448
atgacaaaaaaagatgcaaagaagatggcggatagggtacctgggaatggccactttgatgacggcgacggaggacatcagtgtaggttttgggtgagagaagaggtagcccccataggatttgggagaagagattgtggcaacggaggggtttggttggagggttttgagcaactaagagagggaacaaaagttttcgaaggagctaggggaaggaatgaccagatagagtga

SEQ ID NO: 46671 - DNA, 360 bp, Glycine max
  Peptide Sequence Number=SeqID_163449
gtgtgttcggtgagggagaacagctcagatgagaggaggttttcagtgagtacggggacgaagaagaggctgcatttgagggcggagagcagggaagatagagcctcctgggtggaggcaatgagtgccgtcaaggacttgtttcctcgcttgcccaaatcagaagctatgtcacccttttcctcgccgctagtttccacacagaggttgagagatcgccttttaatggagggtgtgcgtgaaactgctattagggaagttgaggaaatcgtcaagttcgagttctcccagttgcagaagcatattgtggctcttaagcagaaacagtcgctacttatggacacgctgcgccatttagag

SEQ ID NO: 46672 - DNA, 387 bp, Glycine max
  Peptide Sequence Number=SeqID_163450
atggaggaaccatcaaagaagcacaaaggttcttcgagtagaagccaacgacactccgaggctcaggatactccaattccttcctccatttcctcatcctcattgttctcatcggaagaacaacacatacggtacacaaaccgcttctcctctcgttctatcattgaccctaagttcataaatatggatttcttttctgatgagagttttgaatgcattcaagcatttcaaaactcaaatctcattccctttatatctctaaaattgcctgtgtattctgaattagtaaaagctttttattctaatcttgaaattcaagaaagtaccttgatttcagaagtttatgggataaagatggcattgaccaatccctcttctatgatttga

SEQ ID NO: 46673 - DNA, 159 bp, Glycine max
  Peptide Sequence Number=SeqID_163451
atggacattccagaatctgcatgcgatagaactccgggtgcgcatctggaactggaagcaagcaaccctgaattcttcaatgagatcgtcatgcatcaagctcgttgtctagtgtttggattgcgagttgacaccatcaatgttgtgtggggtcactaa

SEQ ID NO: 46674 - DNA, 144 bp, Glycine max
  Peptide Sequence Number=SeqID_163452
atgatgattgtgaaaaagaggctaagttttgaattgcaaaaagtaacagttggactaagcgcttatccacagctaagcgcagcttcagcatgcttagcacaaaggagaatctggcagagcattagcatcaaagtcgcgcgttaa

SEQ ID NO: 46675 - DNA, 102 bp, Glycine max
  Peptide Sequence Number=SeqID_163453
atgttggattttgataaggtgaccaagttgatcaaattcaaggcttggagttggctcaatgcaaaggaggttgggccacttttgagggcgacggaatggtaa

SEQ ID NO: 46676 - DNA, 282 bp, Glycine max
  Peptide Sequence Number=SeqID_163454
atggcagaaaaaggaaaaataaaatgggtttttggagtggtggagtcgatatggttagaaaagagaaagttaggattgaaagatatggcacagctggaagcaatggacaggaagagtcagcatatccctgttgggccaaagagcaaaagttaccctagacgtggttcgttggattggagcagtgttattaatggaaccaattcattcacacacagggtagtgagcctcacggagacacgcagatgcttcgcttttcacaggggggtggggggaccttcctag

SEQ ID NO: 46677 - DNA, 330 bp, Glycine max
  Peptide Sequence Number=SeqID_163455
ggaagaggggtggttgagcctcactgcccggtgccatttgttaaactcaatactgatattctcgaggccgagtctttgaacttgctcgccgaagccacagttgtagatactctcttgactggcattgcctgttttgtcagaagaggagcaacatgccccctttcagctactccgcctcacccggctggtttacacggtgggatgttttctcacatctttatttatgacaatgttgtcctagttgtccttttcgagatattggcaacaccaactatgcaattaaggccagctaggcgtaaatggcaattaaggtggctttctaatgtgtag

SEQ ID NO: 46678 - DNA, 420 bp, Glycine max
  Peptide Sequence Number=SeqID_163456
atgggtttcagagtattaggagtttctcttcttatcttcatctatctcattaatcttgctcctgcatatcctcttcaaaacaaattgttttcagcctgtgaggcattcctaagtgaagaggtccactttgcagtcaatacttcaaccaagtacgaagataagggaatatatgaaagtaagatagaaggaggtgctggtcatggaggcagttcacatggaaatggaaattcaagatcacctgaaacacgaggaggaggtgcagcagttatacccgtttatgcagcaggtgctgcaaacaaaaatcaccaacatcagacccgtcatggtgctgcaaactgcaaccttaataaaatcagattttccaacatgcttatgatcatcttggtctatcctctcatactgtcatttttgttgatgtag

SEQ ID NO: 46679 - DNA, 156 bp, Glycine max
  Peptide Sequence Number=SeqID_163457
atggtgggttgggttgatccatgggttacgatccatttttacggctctatccttttgcatgttgctgctagtgaattgactctgctccatgaaaaaattattttagcaaaactcacggttttattctacgtgtgtaacaagaaggtccccagataa

SEQ ID NO: 46680 - DNA, 333 bp, Glycine max
  Peptide Sequence Number=SeqID_163458
atggacatagactatactataagaaaagatgaaccacctgcaatcattgatgaaagtaacccagttcctattgtgctatatgagtggtgggagagatccaaccggtttagcgtgatgttcattaagaccaaaatctcggctgggatacatggttttgtcgaccaacatgaaaagtttatcacttcagatgaggctttagcaaacaccttgatcatgaagttctcctctctccggctcactagtgtgaaaggaagaagaaagggatgtaatggagatggtgagagtgcattgctaacaacggtttgtgggaagaacaaagcaactaagtcttga

SEQ ID NO: 46681 - DNA, 365 bp, Glycine max
  Peptide Sequence Number=SeqID_163459
atgagtgcagtgaaggtaacaataatgaggtcatgatagaagagggggagtggagtgtagacacaggtagttatgctaacaataacaggaaaattgtgaaggatgagaaaagtggggtgatggggatggagataatggaatttggtagagtcgtattggcaatgttacgggttgaaataggtggcagaatgacaatggctttgcaatctgataccttaacaagaggggagggaattttggaagggataccacgtgagctatcaactaatggacaaacaagaacttggctaaataatttcaagaaactgtggagtgtggagttaccaatcaaaacaggcaaactggcatacttaacttacttttga

SEQ ID NO: 46682 - DNA, 405 bp, Glycine max
  Peptide Sequence Number=SeqID_163460
atggaaccagaaccaatagccactagaacgacagcggccatgtggctagcgcgacaaccagcggcaacgaacgggactccagtgggaggcacgacggtgcagcagcggaggtgcttcctggtgcgacggtggcgggagacgaccgagcttcgtcgacagcagcatgcttcttgtatacgaggtaactcttcagtaggtaatttagttccactagatttggaaatagaagccacttgcaagagaaacgacatagagagaaggagaaaaattttgcaggaaaggacagtacaaccaagttttgaggaagctcaatcatctcagtcatcttcagcattcccagagttaagagaatccaaagtaggtgcatcagaagctcatatcatggttgaagatcaaccacagagg

SEQ ID NO: 46683 - DNA, 1020 bp, Glycine max
  Peptide Sequence Number=SeqID_163461
atgaagatgttggtaatggagagatgttggatcattttgtctcttctcaagcgagcagatgcgctaagcgcaagggcttttaaaactcaaacgtcatatggacacgataagcgcaactgtgcgctaagcgcaccatacaaaaatgccaaaaattataagagtctggatttccagatgaacgtgctaagcgcaactatcgcgctaagcgcgttcatcttctctgttgagttatctgttgaactcactaagcacggttgtgcgctaagcgagtattgtatggcttctcgtaaaaggaagtcaccagcttcagtgtcccaggcacgatatgatagatcaaaattcacatcacaagatgcctgggacagatatgcagacaatattcttggccggaaaatccttccggaaaggaatgtgaagctgttctatgctgaatttgatgaattgagaagggaagttgagaggaggaactggcataaggagctcaccaacttctcagagggaagcattgatgttgctattgttaaagaattttatgctaacctctatgaccctgaagacaaatcgcttaagcaggtaagggtgcgagggaacctaattaaatttgatgttgacgccctcaacaccatcttgaagacaccagtggtcatagaggaaggggagagcttgcccgcctactccaggtttgctaatcagaggcctgttcctgaagagcttgcagcccatctatgtctccctgggagaggatttgagttgaatgcagacggcctacctctgaagatcttgaggaagaatctgactactctggcccagacctggagtgttctatccttttcaaacttagccacaacatcccacacttctgacattactctagatatggctaagttgatatgcgggctcgtcatgaagatggatattaaattggggtccctcatctcaggtcagatctctcttatagcacaacatgactcctcgaggctaggttttccagcccttattactgctttatgcaaggtttga

SEQ ID NO: 46684 - DNA, 867 bp, Glycine max
  Peptide Sequence Number=SeqID_163462
atggtggtgtcagtaattttgatgttcaaggcacattgtctctccaaattcttaaccaagaggatggacatattcaagtacaggcatgctgaccaaaaggtaaaatataagggagtaagagaaaaggaaaacacaaaaagggaaagagaccatatagctgtggcaattcagttaggcaaaaagatgaaaattgaaagggaagataatggtggttacaattcctgtagggtgataatagtgccagttccttggtttgtccataaagtccaaactggtgacaatcaagctgtctctttcaagacacaccctaacatgaataaagaattatttgccaatgattatatactaggcctaaaagatcccaacaggcctttccccactggtcaagccagtgatgctgcaggtgttggtcttttaaagtggagaatgcaaagtactgatgagtcaatggtgcctctgacaatcaactgctggccctcttcttctggaaacgaaacttatgtcagcattgaatatgaggcttcatcaatgtttgatctgcaaaatgttgtgatctcagtacctcttccagctcttcgagaagcgccatctgttaggcagattgatggggaatggaggtatgactctaggaattccattttggagtggtctgtccttctgattgataattccaatcgcagtgggtcaatggagtttgttgttccactagcagattcatcagtgttctttcccatttcagtccgctttatggcaactgatacttttagtgacctgaaggttaccaacatcataccattaaagggtggcaatcctcccaaatttgctcagagaacacagctgataacggatagctaccaagttgtgtga

SEQ ID NO: 46685 - DNA, 530 bp, Glycine max
  Peptide Sequence Number=SeqID_163463
ttttccttgttgttgctgatgaatcggctggtaggagtgttccttttgtatttcttgaacgggtgaaggatgactttatgaagcgctatggtgctagcattaagaatgaaggtgcccatccactcgccgatgatgatgacgatgacgatttgtttgaggacagatttagcatagcatataatcttgatagagaatttggaccagcactcaaggagcatatgcagtattgcatgaaccatccagaagaaatgagtaaactatcaaaattgaaggctcaaataactgaggtcaaggggataatgatggacaatattgagaaggttttggatcgtggagagaagattgaactgttggtggacaaaacggaaaacttgcagttccagcttccagaggcagggcaggcagctgagaaggaagatgtggctgcagaatctccaaatgaagctgatggtgggaggaggaatccttatcttaattataattctgtgggttattgcttgtcggggtttcaaatgttgatagagccataa

SEQ ID NO: 46686 - DNA, 156 bp, Glycine max
  Peptide Sequence Number=SeqID_163464
atggttagttggaaaggagaaggggctttagagaagaagggagtgagcaggggagagagaactgagggaaggaaaagaaaagcccaagcagacaagcctagcccaatcatgcgaaaagcacagaaagcaacagcaagctgggctgctacaagttag

SEQ ID NO: 46687 - DNA, 292 bp, Glycine max
  Peptide Sequence Number=SeqID_163465
atggtggagaaatcaaagaacttaatcggcggcaatgtcatggtcatggctagaggtcttagcggtgctactctagctagggctggtgttcttaattttctgatgggagagaccttcctcaactggctctttgcatacaatgccatacaggaaaccaaaggttctcaaatagatgttgatgcaatgttgggagttgctttgggcaccaacagaattgctggtgcattgtttacggtaattcgtcaacaagtggtgattgtcgcggtggttgatttggccattaatggcgaag

SEQ ID NO: 46688 - DNA, 357 bp, Glycine max
  Peptide Sequence Number=SeqID_163466
atgaggatcatcttctttgttggacattggcgtgtggggctgctgttggtggtttggtggatggtggaggaagggcataattcatggaaggcaaagtctgcatggtctgcacagtttgcagagccgtggtatcgcataaggctagcaatcggatccaggtactctcaaaatcaatcccaagggattgagctggatgtacataaggagaagatgtgtgctgaaatggaagggatgagtttgatagaggtggttgctgatgaatggttgtgtggagaggatgcgacaggaagaggtggactagtgggtggtgtggaattgtttgatttaagagaaataagtgaaaaatacactggttaa

SEQ ID NO: 46689 - DNA, 1119 bp, Glycine max
  Peptide Sequence Number=SeqID_163467
atgatgatatcgataacaacaatagtgatattggtggtgatagtagcagtgaggaaagtggcactggcgataccaatgtcaatggtggttggtggtgctggtaccgataataatggtgacagtgataatgatgatagtaatgattcttgtagtggtggtaatgataataattgtggtgatagtgtccatagtaatgcaactagtggtggtgacaataacaatccaatgacgaaaacgaaattcaggaaaccatcttcgtacgcactacgcagcatagctgttatcttcttccccttcccctctcgtggcaaacgcgccgcaaatgacagaacgagcaactccaaggatccatcgacacagataaaagagtattccctcgctccctccacagttctagggttcacttttgaacacacgttgccaaaccccgcaacaatcctcttcttatgcttcgcgtaccttaaaaacctcggtttcactctcttctccctccccttcctctactcttcgctgatctcattcttagtctcaatcgcatctcacccttccatcaaccttccaatacttctcggcaaaaccaccgacggaagcttccccctgttctcactcataatcttcagcccttacatctacttcgtcagaatcttctctctgctccgaagactccgaagcggagaacctgcttacaccgaagtccacgagggtctctatgtcggtggctggccatcgtcgcctcagaagctgccacctggcgatcccgccatcgttgattgcacgtgcgagttcccgcgtgtgaaggatttcactacggggttgccttaccggtgctttccgacgtgggacacgaggtcgcctcaacccgctgatatcgaatccgctgttaagtgggcatctcgacagagagaactaaacaggcccattttcgttcactgtgcttatggtcatggaagaagtgttgctgttatgtgtgcactgttagtagcactaggcatcacagaggattggaagaatgctgagaagctgatcaggcaaaaacgaccttacatccggatgaatgctctccatcgcaaggcacttgaagaatggtccagacaccgattgtctgcaccaaagaagtag

SEQ ID NO: 46690 - DNA, 1617 bp, Glycine max
  Peptide Sequence Number=SeqID_163468
atggaagcgaatctagagaaggtgacgatgaatcaagaggacgacgagttggagtccaaggagagtgtgcttcaaaagtacttcctccaagaatggaacatcgtcaagtcactcctcgacgacatcgtttccaattcccgcgtctccgacccttcctctgtccacagaatcagatccattttggacaagtatcaggagcaaggccaacttctagaaccctaccttgaaaccatagtttgtcctctgatgaacattcttcgctcacgaacacttgaactcggggtagcttctgatgaaattcttgaaataatcaaacctatatgcataattgtatatacgttagtcacggtttgtggctacaaatctgtaatcaagttctttccacatcaagtttccgatctcgaactcgccgtgtctcttttggagaagtgtcaccacacaaattcagggacttcgttaaggcaggaaagcacgggagagatggaagctaaatgcgtgactctgttgtggctctatatacttgtgttggttccttttgacatttccactgttgacaccagcattgcgaacaatgacaatttgactgagtttgagctcagtcctcttgtgttgagaattatagggttttgtaaggattacctctcgactgctgggccaatgcggactatggctggactagtcctctcgaggctacttactcgtccggatatgcctaaagcttttaccagctttgtagagtggacacatacggtcatgtcctctgtaacagaagatttactccatcatttccagttacttggggttgttgaagcactggctgctattttcaaggcaggtagtcggaatctcttgcttgatgcaattcctgttgtttggaataacactacaatgctgtacaagtcctcagatgcagctcgaagtcctttgctccgcaagtatctgatgaagttaacccaacgaattgggcttactgctcttcctcatcgtttgccttcatggcgatatatgggaagagttgccaaactgaatgtttctttgaatacgtccaataaaattgatcagtccaatttaggtgtgaacagccatgattccaactcaaacgaaatgttagacagggaggaagatgaggatatggatgttccagaaaatgttgaagagattattgagatgttgttatctggtttgaaggatatggatactgttgtccgctggtctgcagcaaaaggtattgggcgcataagttcacatcttacatcttccttttctgaggaggttttatcatcagttttggagctgttttcacctggtgagggtgatggttcatggcatggaggctgcttagctttggctgaacttgctcgtagaggcttgctcttacctgctagtcttcccaaagttgttcctgtgattgtgaaggcactacattatgatgttcgaagaggtccacacagtgttgggtctcatgtacgcgatgctgctgcatatgtatgttgggcgtttggacgtgcatattatcatacagatatgaggagcatcttaaaagagtttgccccacacctcctaacagtggcatgctatgaccgtgaggtccttatatcttttatgtccttctcatga

SEQ ID NO: 46691 - DNA, 2088 bp, Glycine max
  misc_feature (15)..(15): n is a, c, g, or t
  Peptide Sequence Number=SeqID_163469
atgaaggatatcttnttccatttgtggatgacctgctggatagaaaaatctgtcactggggaaatcatgcatagaagagagatgacagaggataaaagcttgcgagaacttgcggcagaggccctatcgtttcttgtaaaatatgaccctcagcattttgcgagcactgtcatggaaaagttaattccttgtactctttcatcggatttatgcatgcgccatggtgcaacgttggcaacaggagaaattgttttagctttacaccaatgcaattttgctcttccctcagataaacagagaagtcttgctggcgttgctcctgctattgagaaagcacggctttatcgtggaaagggaggagagataatgcgtgcagctgtttctcgatttattgaatgcatctccatatataaagtggtattatcagaaaagataaagaaaagcctacttgatactcttaatgagaatttgagacatcctaattctcagatacagaatgcagctgtcaaaggcctgaaacactttatccgtgcatacttgcatgcttcagataataaaggtataagtgatgtgacagcaaagtacctcagtatgttgactgatccaaatgtagctgtaaggagaggatctgcattggcaataggtgttttgccatatgagttattagccagtcaatggagaaatgtgcttttgaagctttgtggctcttgtaaaattgaggaaaaccctgaagacagagatgctgaagcacgagtaaatgctgtcaaagggctcacattagtgtgtgaaacattaattaatggaagagaagatactgctacctcttttgttgaggatgatttttccctgtttattctgataaagaatgaggtgatgataagtttatttaaagctcttgatgattattctgttgataatagaggtgatgtaggttcttgggttcgtgaggctgcattggatggcctagaaaaatgtacatacatgctctgtaagatagacaagtcagtttgtttgtctggaagatcagatggaaatgaaattgaacctattgcatatccttcgattgatagcatgcttaagaacaaccgagagctttttttattcaatgaaaatcttgctaccaatttagttggaggaatttgtaagcaagctgtggagaagatggataaactgagagaagcagcagcaaatgttctctgcagaattttgtacaaccagatgattcatattccatatatacctttccgagaaaagttagaagaaatcattccgaaggaagcagatgcacaatggggtgttccttcctattcttatccacgctttatacagtttcttcaatttgcttgttatagcagagatgtgctatcaggtttagttatatctattggtgggttgcaagattctttgaagagggtatcactcttggcactgttagagtatctagaaggggttgaatatgaagaccctagtacaagaacatctagggtatacatgctatctgctgacatcctgtgggttctccaacaatacaagaaatctgacagagttatcgtacccaccttaaagaccattgagattctgttcagcaaaaagatattccttaatatggaggctcacactccggctttttgtggtgctgttttggattctctgtcatttgaattgaagggatcaaaagacttctctaaattgtatgctggtattgcaatacttggttatgtagcttcagttcaggaacctatcaatatgagggccttttctcaacttcttaactttcttggtcatcgttaccctaagattcgaaaagcttcagctgaacaactgtaccttgtcctcttggaaaatggggatcttgtggctgaagacaagattgataaagcacttgaaattatttctgagacttgctgggatggagatatggattcagctaaacaccaaagattaaaattctctgagattgtaggtctggaggttgggtcacttggcaacaatagtgatggaacatcaaggaaaaccagcagtaagaagcctacagacttggatgaaaatgcatcatattcctcattagttgaggcatccgggttctaa

SEQ ID NO: 46692 - DNA, 423 bp, Glycine max
  Peptide Sequence Number=SeqID_163470
atggcttgggggaccaaggcccctgcttccccctccatcccagaagtaaggtggaaatataagattggtctagtggtgaagggagaagggaaggggagagagcgaacatgtgttacattctcgttccatcacttccgtcttagttcatctatccatactaaactcgactcgaatcgcaaaggaataacagacaacatcgtaataattgactccaataaatcgctccgatctcaagaactaactaaaaaaggaaagtacggcgaaggcgaagacgaattctcacttgtccctggagagggaggttggggagcggaagaaggcgtcggagggaagagagaaaagaggaatggagcgcggatcggaaaccctaccaccgtgaacggcgaaggaaggagcgaggaaagcattggtgagagtcattga

SEQ ID NO: 46693 - DNA, 687 bp, Glycine max
  Peptide Sequence Number=SeqID_163471
atggcaggaaatactagatttgatttaagtgcagctaaatcagacgaattggctttcaaggggagttttacaaatgggcagagagggaatttgacgaatggcactttggacaggtctacaagctttcgtgagggtaatgaggggcagatgtttatttcgggtgctaatatgtcgcgggggaattccacatcagcaggggatttggcttctgttgctcaatgtttaatgttagatccaataaccatgggagatcaaaaatatactaggtcaggtgagttaagacgagtcctggggatatcttttggaaatattcttgaagattgtgcttttggaactgctaatctgaaggctccccctccagtggctactgaggaactaaaacgattcaaagcaagtgtacaagaggcttctgtcagggctagatatagatcaaaaaggttggatgaatctttagacaaattgaacaaatgttgggaggctgtaagcttaaagaagcaactttggaacgatttggtgccaaatgaaaggctgggtggatctcacttctcgaagatgggaagtcagactcatcgaagaccatcagagcttgtgaatcaaagaccagagaacagacctaagaatgtcattctgaataagcgcatccgtacatcagttgctgagacacgggtttgtagccagtgtttttaa

SEQ ID NO: 46694 - DNA, 381 bp, Glycine max
  Peptide Sequence Number=SeqID_163472
atggtgacaatagtgcaggatgagggattcgacgacgacacagggcagaaagagaaagggcacgagagatataggtcgtttggaagtgcgcttaatgagttagctgaaggcaaggatgctttggagttgcccaactatgcatactataaggaactgaatgtggtgttggtaaagaaaatgtggatattggacaaagagttgaatgtggtgtgtgatggggaaggtgtcgatattggacaacgagttgaatatgtggtgttggtgagcaaggaaagatatgccttatggagattggagagtgcaacctcctttgtgatgaccatcgattttaagagtgatgctacaatggccgccaactataaaggaggtgagagactctga

SEQ ID NO: 46695 - DNA, 2316 bp, Glycine max
  Peptide Sequence Number=SeqID_163473
atgggaaaggatagagacaacatcaaggatggtagcagaggctgtgatatttttgaagagaagattcgaagattaccaggtggagaaacatgggatagaaaaatgaaaagaaaacgttccgtgggtactgttgttgccagatccattgatggtgaaggagagctgaaaaaggttatgcatataaggctagctaatgagtcaggtccgcagggttctgatgcccaaggtttgagatcaggatattctggcagtaatagcaagcttgatggtgcttccgtgcctgccacttttacgactgccaataatgagcaagaaaaggtgtcaaggggttcagtggatggatcaaataaggaacgggttgtgcttaaaggaaataagtttaatgttcgcaacaataattatacaggtggtatccatactttgacaaaaggaaaagcttcaaggccacctcgaactggtgctttgatggctggaaactcatcttctgttccttgttcttctgaaatacttgatgctgaggaacaaccttcaaatgtgaacaagcctcattcagtaagtggtactataaatcgtaagcgtcctttgcctgtaggatcatcttcatctcctatggcccaatgggttggacagagaccccaaaaaatttctcgcactcgaagagcaaatgtggtatcccctgtcccaagttctgatgaagtgcatacgtcattagaaggttgttccccttcggatgtcattaccagaaagactactgctgcaactagtggatttcttatttccaatggtgctatcaacggtggcattcacccagggaaaatgaaacatgaaagtgtttcatccccaaccaaattatctgaaagtgaagaatctggtgcaggagaaaatggtgaaagtaaaatggagaaaggattggaaagtaatgaagttgatggaagtgccataaataattcttataatacaagttcctccatgttaacatcgaaaaagaaaaaaatacccaacaaggaagaggttggagatggtctgcgtagacagggaaggggtagtaggggctcttcagttttgaagaatggcatctcaccaatgaaagagaagttagagactccaaccttgatgaagccaattaaaaatatgaagcctgcttctgaaaagaatggaagtaaatcagggcgtcctcctttgaagaaatcatgcgataggaaatctattactcgtattggtcatccatcaactaacaattccccagatattgcagtggaggatgatgatcgtgaggaacttttagctgctgctaactttgctagcaatgccagctttttatacttgccagttgccacatttgatattggctgttctagttcattttggaagaaactggaacctatcttttctcctgtcagcttgaaagacatgtcctacttgaagcagctggttaaaacaacagaggctgatctaagatgtttgtctcagatgctaggcattggaagtgatgcactggatagacttacacatacggaaagccctctgtcacaaagttctatctctagagcaagagagagaagcattgtaaatcaaactgattccaaggagatatcctcaatggatgacatggttggtcaacatctggatgttagtattttgtgccaacaaatggattcagaaggaaacaaacttgtgcctttgtatcaaagagtattgacagctctgatcattgatgaagaaattgttgaagatggaaatatgccttctctttgtgaaagagatgactctcctcaggtggcttgtcactttcaggatgttgagaaccaatccagcatcaggatggattttgaattcaactctgacaaggtttcttgtaatgggaatgctacctttactagttgcacagacatccatgatcaagaacttggtatttttctgcaaatgaatcagggatcattgcatctagaaactgagagggtgtccatgttatctgaaaatggtaatgatgagtcaatgggtatgcatggagtttcttgttcagcatctttcagttgccattttgagcaaatgagtatggaggataaactcttactggagctacagagtgttggcctatatccagaaccagtgcctgatcttgctgatggagattgtgaagctattaatcaagatattattcaattacagaagggactcttccaacaggtcaataaaaagagagaatgctttatgaaacttattcaagcagtagaacaaggcagagaaatggaacaaggagcccttgagcaagttgctatggacaaacttgttgagttggctcataagaaaaagctg

SEQ ID NO: 46696 - DNA, 294 bp, Glycine max
  Peptide Sequence Number=SeqID_163474
atgagtttcgtgccaaaggagacaatcgaagtcatcgcacagagcatcggcatcaccaacttgtcccccgatgttgccctcgctctcgctcccgatctcgaatatcgcattcgcgaaatcatgcaggtacccccatcacattattctcgcacccttttgcgcaattttgaatttttcgcgggaatcggtaaaatgcatgcgccattcaatgagaacttttcttactacagaggatgtggatactgcacttgcattgagaaatttggaggtgacttgctttgctattggaattag

SEQ ID NO: 46697 - DNA, 792 bp, Glycine max
  Peptide Sequence Number=SeqID_163475
atgaggctagtagatgcttttgaaggggatatagcatctgccgttgaagagggcatttcggagaaaataaaagaagggattgtgaatattgataatttattgcaatctcttccagagaagatctcactagacaaaaccgctgcactaaatgtttcttttgttggaaatcctgtgttgaggaaaaatgaagttttagtacctcggggttaccagaaaggagtgaagatttctgctgcctgtggtggtttacaaaagatgttaaaggtttcgatacatgaaaatgtgttcaaatctgctttcctagtttactacaatgcaggtaaaagaaaattgattattgatgaactgcctgatcagaacattttgaacactgctgaatggagattcatagttccccaattatacaagcgatatccaaatgatgacatgcagcttaatatctctatatcttctccacaagttatacaagtgacctaccaagatattggtgcaactatttttgtagatataacaattgatgttctggaagacgatgaagtcatacctgttgcatgcatctcagtggaaattagtgcttcaagtgctgtggaagttgaaggaaacaatactgctggttggctcagattacaaacattttctgaatacttgacgtggagcaaaatagggaaattgcgtgtgcatctgatccagtcactaatgtcaagtgtcctcaaaactgtcgtccttccatacctgaacttcaaattaaagagaggattcccattaccaattattgatggttatggtgtgtag

SEQ ID NO: 46698 - DNA, 291 bp, Glycine max
  Peptide Sequence Number=SeqID_163476
atggcactcactattgttttctctctgctatcccttctgttggtttcagcttgttgctatgtgcaaccccttgaagagagttccatctctggggtcatatctgacaagggccttgaatatgccaaggagttgttgatagagaaaggtattgcctccattgtgatgctacagctaccagagattgagaattttgtccaagtccctctggatgttcaagtcaattcttcatctgttaagactggggagagtggtggtattgttcttgttgtttcaggtgccatgctaatttga

SEQ ID NO: 46699 - DNA, 1536 bp, Glycine max
  Peptide Sequence Number=SeqID_163477
atggcccctcctccttatagtgcctacaacggagaaatcgatggggaaaatctacctctagcttttgatatctgggaaaatctatgggcctatggctattaccctcatcaacctatttcggagatcaatagcacttctacattggttgatttccccttttgcgatggcaccatcgtcagggataacaaaagggtaaagagaaccgtgtgcttccctatttataacagcattaattgccatagtttcttcaacaccaacaacagcagtagtaggaatagcataccaaagctccacttcagagatcacatacggacttacactcaaagatatctcgcagctgaacccgtagaagatacaaacagttcagaaagtagtggaggcgaagaagatgggtgtgcagatggagtgaggcttgttcagcttctaatagcatgtgcggaagcggtggcttgtcgtgacaaatcacacgcttccatattactatccgaacttaaagcgaatgctttagtgttcggatcctcattccaaagagttgcttcctgtttcgtccaaggcctgatcgagaggctcaatctgattcagcccatcgggcctgctggccccatgatgccctccatgatgaacatcatggacgtggcctcagacgaaatggaggaagcattcaggttggtttatgaactgtgtccgcacatccagttcggacactatttggctaattccacaatattggaagcctttgagggtgagagttttgtccatgtcgtggacctaggcatgagcctgggtctacgacacggacaccaatggagaggtctgatccagaatcttgccggtcgtgtaggcggcgaacgtgttcgtcgcctgcggatcacgggggtggggctctgtgagaggcttcaaaccattggagaagaactctccgtttatgcaaacaatttgggcgtcaacttggagttctccgtggtggagaagaatttggaaaatctgaaaccagaggacattaaagtgagggaagaagaggttcttgtggtgaacagcattctgcagctgcattgcgtggtgaaggaaagccgcggggctttgaattcggtgctgcagatgattcacgggcttggacccaaagtgttggtgatggtggagcaggactcgagtcataatggacccttttttctagggaggtttatggaatcattgcactattactcttcaatttttgactcgttggatgttatgctgccaaagtatgacactaagagggcgaagatggagcagttttactttgctgaggaaataaagaacattgtgagttgtgaggggcctttgaggatggagagacacgagagagtggaccagtggaggaggagaatgagcagggctgggtttcaggctgcgcctattaagatggtggctcaggcgaagcagtggcttctcaagaacaaggtttgtgaggggtatactgttgtggaagagaaggggtgtttggttcttggatggaaatcgaggcctattgttgcagtttcttgctggaaatgctga

SEQ ID NO: 46700 - DNA, 246 bp, Glycine max
  Peptide Sequence Number=SeqID_163478
atggtcgatgtgagacttgaatttttcacaatatccattgtttcactttctatgcgtcgctcaaaattgattgctagttacaaaccagattcaccatatcaaggagtgacgatggtggttgtgcgaggaagggttcgcgacagtggctcaaggcttaatggtggttgcacgaggaaggtgccgagacaatggttgcatgagggagggaccacaatggtggctcgagggggaacagtggttgtgtaa

SEQ ID NO: 46701 - DNA, 666 bp, Glycine max
  Peptide Sequence Number=SeqID_163479
atggaagctgtgtgtggaagtgtttgggtcacatcctctcttccacgctcacccaagtccactctctctctattccgctctactcatcaacacctaacagcatttccttcacaatcccatcttttcttatatcaccctcctccctatgctaatgctaaaaccctccgcgccagaacctcctccaaacccgccattttccttccccacttaattgcttctctggaacaagttgaccagacttacataatggtcaagcccgacggcgtgcaacgtggcctcgtgggagaaattatttctaggtttgagaagaaagggtttaagttaactggcttgaagctcttccagtgctcaaaggaattggctgaggagcattacaaggacctaaaacaaaagtcattcttccccaagctgattgactatattacttcaggtcctgttgtgtgtatgggtgttggggtagtcgcatcggcccgtaagcttataggggctacagatcctcttcaagctgaaccaggcacaataagaggagaccttgctgttcagacaggaaggaatgttgttcatggcagtgacagtcctgagaatggcaagcgtgaaataggtaaggcctcttatgctatccagtttaacccaaatacatgcaacaaacatagatgtgaattgtga

SEQ ID NO: 46702 - DNA, 480 bp, Glycine max
  Peptide Sequence Number=SeqID_163480
atgtataagatcatatatatgtttgaatctcagtgccaccattataaaaagaagaagaagaagaagaagaaacagcttgatcgacatagtaacgaggagtttagaaaacaccaaagcaccgcaactgcactactcaacaacagaattgtcatactcacaccatttaacctccttaataaatggatgctgtctatgtccaagttctcgtgcctagaccagaacaagttgtttgatagggttggaactgctcgaacaccaaaaacttccattggtccactgaaatgtgttaagcgcataattgatagttcatgcccaattaatctcaaaggaatattatttttggtccttatttctgtggatgtagtgtggtcgaaggcagtgaaaggtttagcattcgccggtcgtgaaggtggagacgatcgaggcggtgaggcaaagggagaggagtacaagactggaagaagaagtggtgaagattga

SEQ ID NO: 46703 - DNA, 342 bp, Glycine max
  Peptide Sequence Number=SeqID_163481
atggagggggaaggaggaagggggagggggaggcagcatgaagtggaggggagagggagggaggaaagagaaggaagaacaaggtggaggggaggggtagggaagaaagacgagatcaccgttgaggaaataggagggtcttcgacaaaaaggaagtctcgagtcacctttgcaattgaagaagatactcaccttattagttcatggctcaacatttcaatcaattcaattgttggtgttggtcaaggaaaagaagcgttttggttgagagtcacgaaaaattacaacaaatttcgagatgaactctgcgaaagaatagttagtcaaatgaaatcacgatga

SEQ ID NO: 46704 - DNA, 963 bp, Glycine max
  Peptide Sequence Number=SeqID_163482
atggaagatgtgaatcgcaccccaagagaagcaaaggattactattctagatcaatatggttgtcagaaactgcgcagacatttgggaatatcaagagaagtgacagaaatgttgttgatggcagagattcctacggctataactcccaagaaatagtgactcctgaagtttctggagcattcgatgaaatcaaaggtttaatcagagttaatgatgagggtgttggtgaagaaagcggtgactatggccactattctagacaatcgttgacaacagaaattgtagagatagttgaagatggcaagagcataagcaacaaagatagaagagttgatgatctttatgtggctgttggcaaagatgacttggatgcagtgaaatgggctcttgatcatgcagtttctcccggttcccggatttttcttatccatgtctcttctccaatcacattgattcctacaccagttggtaagtttgaaagaagtaaactgacccagcaacaagtgggaatatacgtgaatgaggtgaacaacaagaggaaggatcttttgcaaaagtacattcagatgagtaatgaagccaaggtaactgcagaaacgttgctcctggaaagcaatgacacagaaaaagcaattctggacctcatctctattctcaacataaccaacattgtcatcggaatcaaaaagctaccctacacacggcgcaagaacaaattgagcaaaggagagttcgtaaagaaacatgcaccgagttcctgtgaagttaccttggtttataacggcgaggtgttagtgtctgacccttacatggatggcttggtatcctatggcctagcatcgcaaaataaaagtcactcgaaaaacaacttctttcagtgcatgtgcttttcaggcaagttctgtcaactattgatcttctctctaaactcttgtacttctgttgtatgggggaaggtatag

SEQ ID NO: 46705 - DNA, 801 bp, Glycine max
  Peptide Sequence Number=SeqID_163483
atgcccttaatgcttatttggcctagttttagtcatgaaggaatagagattcgaccagataggcaaacactattatggagtgctacatggccaagggaggttgaaactctggcaaggcagtttctgcgcaacccatacaaggtaattattggctcaccatacctgaaggcaaatcaatccataaatcaagttgttgaagttttaacagacatggagaaatacaatagattaatcaggctgctgaaagaagtgatggacgggagccgaattctaatatttatggagacaaaaaagggatgtgatcaagttaccagacaaatgagagtggatggatggccagcactatccatccatggtgataaaaaccaggctgaaagggattgggtcttggctgaatttaagagtggcagaagtccaataatgactgccactgatgttgctgcacggggtcttgatgtgaaagacataaaatgtgtgatcaattatgattttccatcaagcctggaagattatgtccacagaattggtcgaactggtcgtgcaggggctaaaggaactgcatacaccttttttacacatgccaatgccaagtttgctagggatctgattaagattttacaagatgctggtcaggttgtgagtcctgctttgtctgcattggttcggtcggctggttctggtcaatttggatcagggggaagttttcgctcaagaggacgaggaggctatggaaatcgaggtttaacgtcaggttccaatgccattcctctaggttcgaagaggccctggcagtgtctgtag

SEQ ID NO: 46706 - DNA, 666 bp, Glycine max
  Peptide Sequence Number=SeqID_163484
atggcgggaagaaaagttctgataaaatctattgttcaatctataccttcctatgtcaggagctgtttcttgtttctggtaactacttgctctcaaattgatagcatgacaagctgcttcttttggggaggatctctagagcctttgatatggctttgttgtctaaacaatggtggagaattctttgtgttggaaaactcattgttgtctgtcactcttgaagtgaagtattatcctaggactcatcctctctgtgccaagtgcagatgggtaatggaagagggaactttttggagaattggagatggtcaaacaactaggatttggccggacaaatgggtgcccaacctaagagataatcgaattcattgtgttcgcccagaagacagggaccctgacatatgtgtatcttttctgtttacaaaacaggagtcagagtgggatgacaggaacaaaactggtttcggagtggttttcagagatgccgaaggccgtgttttagggggtgcaacagatttgagacaggttggatatcaacctcatattgctgaagttttatgctttaaatgggctttgaaggtagcttctcagatgtgcttccatatgatcattttgaaactgataatgttcaaatttataatgcttggcatcgcaaggatggcataa

SEQ ID NO: 46707 - DNA, 1296 bp, Glycine max
  Peptide Sequence Number=SeqID_163485
atggcatgcagcaccactttacttgctgctattctaaaacttctcatcattttcttattcgcaggttgggtttctctttggcttctgaagccaacccaaatatggacaacaaaatggaaacatgcagaagatagcgccaatgatacaatctttggatactatggtcttagcttcgctgtgtacacatttcctatagttgctattgctatacttggacttcttttattggatttgaaagctggatatcaaagaagcagaagcgcaaggagtccatcaaaatcaaacttcttctcaaatccactggtgcatggacctactactcgtatttctgcagacttcaaaaagttgatgccatacaaatcactgaagttgaatacatggcaactcaagtatcacaaaatagcaatccggtttggcttgctagcagaaccttgcatggctctgttgcttcttcctattctaagggggttggctgtgtttcgcatacttggcattcagtttgaagcttcagttagataccacacatgggtcggaactgcaatgattatttttgctacaatacattgcgcaagcactttgttggtctgggggatcagccaccatatacaggatgagatatggaagtggcaaaagactggacgcaaatatcttgctggggagattgcatgtgttgttgggctagtcatttgggtcacttcacttccccaaattagaaggagaaagtttgaaatcttctactacacacatcatttgtatgcattctttccagtatttttcttgtttcatgctggggataggcacttttatccggtcttcccgggaatattcctttttagccttgataaactgatccgaatcatacaatcaagtccaaaaacttgcatggtttcagctagaatttttcccagcagagctgtggagctaattctgcccgaagatccagggatgaaatataaccctacttgcgttatatatttgaagataccaaccatatctcatcttcaatggcactctttcagtataatatctagttccagggctgatgaccacattttgtctgtgataattaaatgtgaagggtggtgggctaattctctttatgacctgatacatgctgaactagacaaaactgcggatacaaggaagggaatacctgttgccatcgaaggaccttatggacctgcttcattagactttttgagatatgattcccttcttttggttgctggaggaagtggaataaccccatttctgagcattttggcagaaactgattcatctaccagcaaaagttga

SEQ ID NO: 46708 - DNA, 3381 bp, Glycine max
  Peptide Sequence Number=SeqID_163486
atggcaaccggttcccgattgttcctgatccccgctgcgaggcccgttctctgcaaaaacgtcttcttcatttcctcttattctactcgcacgctcgaactgtgcgaatcatcatcgtcttcctcttcctctgcgctcgcagaggaagagtcccgaaacgtgagggtttgggcttggtgggacgtcaaaaactgccacgtgccccccaatttcgacgcttccaaagttgcccccaaaatcatggaggcagtgagagccaacggcatcaaaggccctctcaacatcactgcctttggcgacgttcagctactcacccgggcccaccaggaagcactcgcctacaccggcgttcgcttcacccacgttaacgatggaaagagtagtgccgatattctttttgacttaatgtattgggtttcgcaaaaccctccacccgcgcatatactcttgatatccggcgatagagacttcgccggcgtgttgcataggttgagaatgagtaactacaatgtcttgctcgctactccagagagcgcgcctggtgttcttcacagtgctgccacgatagcgtggcaatggtcttcgatgctcaagggagaaaatcttactggaaaatgtttcaaccatccacctgatgggcggtatcgttcttggtatggaagctacaagctgacggcttgtcttgaaaagccggctccggttgtggctcaggaggcttctgctgctgcctctttgcccaatgtggaggcttacgagccttcttcttcgggtttgggttcggttccgaaatcggttgtgaagcaggttaggcatatattgagtttgcatccagaagggataggcattagtgttcttcgcgccgagttggcaaagtgtggtgtgcgtttggataaaggtttctttggacataaaaggttttcccgctttctgttgtcgttgccacatgtacagcttcagcccagtggtgatgctaatttttctgtgcatttggttccttgggaattcccagaaccttgtgagagtattcctgtggcatcaacaatgtctggtgcgaatagtgaggagaaaggaagtgcagcaactccaaaggtaaacggtgaggataaaagaaaggttagggttgctgatgagaaattctcaatcacctcgatccttgaaaggagttcggatgacaatttaaagccagtccaaccggggctttcacaagggagatccaatgaggaatatatggatggtgaatcatcatctcctgtattggttgaaaaacatgtttgtcagccaccaaatgagttgcagaaatcttctgtagcttctgacaaggttgtgaatgtggctaatgcacaacaatcagagactcaactgccacccaaggacaacaaagattccgaaacgaagatggattccttaaaagtgacttctcaaaaatcgtctgttgaagacattgttaggtctgaggttgcaagtcataaaagtaagggaaaaaatgcaacttcagtgaatcactcagctggaaatggtcaatcaatggcggaagactatgttatcacaaattatgaatctggagatgttgaagcagagaacaaatatgaggatccaactagaatggaggttgatgaagttgttcacagtccatcttcttcaccagttgatggctctccagttgtccaaacacctgctggaagtcctgaaactaataacagaagtccaacattctttagatggattagaagtttgtggccatttgggaaaagcaatgaaaagtatgatgatttgatcgctaatcagaacaagctggttagccatgttgaggattccaagttatctgaactggacccgactgttagtcaatctgaagagcccaagttatcagaactggatcagaatgttagttatgttgaagattccaagttatctgaattggaccagactgttaggcaacttgaagagcccaagttaacagaattggatcagagtgttagtcattctggaaagcctgagttattttctagtgcttccttttggaatgatatggaatctttcatttttgcgcccaagggatcacttcttttctcccagtcaagaagcagggaggatgtggtgcataaattacaaaatggtggacccctggttcttagatcactccccaaagaagacttccttcaattggtggaattgttaataacagagaaaaaatggttggaggaaagcccctccaaaacatttccttttaagataactcaacctgttcagaagaattcattggtgaaatcccatggtgcaaatgctttgagatctctctttataggtagaagaacatcacagttgaacttgccaaaatcattagaacatgatgtggagaaacacaatcagagtatttctcttgctcgagtttctgcaccggctacggaaacaaaatatactgagcgatctagaaatgatatattagaagactgtaaaaaactcgtgagtgagatactgagggaacacccggaggggtataatattggtgctttcggaagactatttgttgataggtatggctatcatcttgatatacagaagctgggttatcaaaagttggcagccttgttacagataatgcctggggttaaattagagtccacttatatttttccttctgttcctgctgtctgtgattctgacttggaaacttctatcctcaaaactcaagcaaccactgatattcatgcagcttccaactcagatagtgaattatctgagtcagccccgaaagatgataacatggaatccccatggcaggagttaggtcctgtttctttggatttgaagtcaagtcagaaagctatagaactggatacatcaaaatcaaagcatcttgattatgaacctgtcgaatcagatgatgagttttctgcatctgaaggagatggctcttgtttaactcaatcagcagagcaaagaaagccaaaatgtaatgaacaagacagttctttttggcaagttatggatttgcggcacagtagcaaggaaaaagagaacagtggcaagaagtcagacaatgttgacagcttgggcatttctctggctggaattttagattcatccactgagtcaactggggataccctttccgaaattccttcattgaaatacagagagaataatggcaagaagtcagacaatgttgacagcttggacgcttctctgactgatttgtttaattcatccactgagtcaactaggggtacactttccaaaattccttcatcaaattacagagagaagcaaaggtctcgtaagaactattcctttgttgctgatccagtcttacctaacaaggacaagctggttgatgacttcaagaacaagaaagcaaatgggtcaaagatgcaaaactga

SEQ ID NO: 46709 - DNA, 1029 bp, Glycine max
  Peptide Sequence Number=SeqID_163487
atggaaggaaaaaatatgaatgattggcttcccatcactaaatccaggaacgcaaagtggtggaattccgctgttcacaatgtcgctgctatggttggagcaggagtgttgggttttccctacgctatgtctgaactaggatggtgttggggtgttacaatattgatagtttcatggatttgcactctctacactgcatggcaaatgattcaaatgcacgagcctgaaccgggaaagagactcgataggtattatgaattggggcagtatgcgtttggggaaaagcttggagtgtggattgtggtgcctcagcaactaatggttgaggtttctattaatataatttatatgatcactggtgggaattctctaatgaagattcatcagattctttgtgataactgtgagcccattaagagaacttacttcatcatgatgtttgcttccgttcaattcgttctctcccatctccctggtttcaactccatctctggtatttctttggctgcagctgttatgtccctcagttactcggctattgcctggatagcttcatttcacaggggcgttgtaccaggcgtggaatatggtagcagattttcaaccgatgcaggaaatgtgtttgggttcttaggtgggttgggaacaatggcttttgggtatgctgggcacaatgtagttttggagatccaagcaaccatgccttccacacctgaaaagccctccaaaatagccatgtggaggggcttttttgttgcttatctcatagtggctatgctttattttcctattgctgtttgtggctactgggcttttggaaacactgttgaagacaacatccttatgtcccttgagaaaccacgctggctcattgtagctgctaatgtatttgttgttgtccatgtaactggaagctatcagatctgcattgcatttggagtgttattgttggtgttagcccctattggcggattgaggctgcatgattttactcatgacccatctttttgcacaaaggaggctgcatga

SEQ ID NO: 46710 - DNA, 307 bp, Glycine max
  Peptide Sequence Number=SeqID_163488
atggcgaaaagggcacagaatgaccataatttgtctctgcgtgccatcggacacgatcctattgggatggcaaaaggctcaccgcctctggatgaaaaaagggcgcagaatgaccataatttgtctctacgtgccatcggacacgattgtctccgaatggcaaaaagggcgcagaatgaccataatttttctctgcatgccatcggacacgatcgtatctggatggcaaaagacacgattgtctccgaatggcgaaaaggtgtgcggaatgatcataatttttctccacatgtcacaagacctcagg

SEQ ID NO: 46711 - DNA, 1938 bp, Glycine max
  Peptide Sequence Number=SeqID_163489
atggggaaatcacgaaagtactcaaaaggtcatgccaccggttttgttccagattttcgccatgctgttgagactatgggtgaatcagaaggacttggtaacttgggaagggttgataatgagttgacaatgtcagaaatttcatgtgccccaaagagaaaaagggttgatgagagttttgatgtgccatttcaactgttatctttaacaaagatggcccgttctgggagaaaggacttgacactgagattaaaatccgaacttgaagaagtaaggaaacttcaaaagaaaattgctggtatgagttcaatcactactgaattatctccatatagtgacataaggagctgcagtgtgggagagaagaggcctccactggaatcattagcactgcatggtaagaagcgcccactactaaagcataacggtcctaaaacaaagagaagtatttctgggcgatttatatctgcgaaatctgctgcaccagtaactccttcatatgccgtgctgatgaagcagtgtgagacattgcttaagcgcgtgatgtctcatcaatttggtaaagtttttgacaaaccggttgacattgtgaaatggaacattccagactatttcactatcatcaagcacccgatggatttgggtactgtgaagagtaagctgatttcgtgtgaatatacaagtcttatggattttgctgcagatgtgcggctgactttctcaaatgcaatgagttataatccaccgggcaatgatgtgcatgtcatggcagagacactaagtaaatattttgaaacaagatggaagcctatagagaagattcttgccattgatgatgtgccatctgagccttcaaaacccactacttgtattgaaaaatccgaaattgttgatcctcctgtgaaaaaaaagaaaataacaccaaatggcactaatgtcaagccagagcccattaaaagaatcatgactggtgaggagaagcaaaagttgagtatggaattggatgcgtcagttgttgaattgcctgaaaacattattgatttcttgaaggagcaaagttataatgctagccaaataaatgacgatgaaattgagattgatatagatgccctcagtgatgatacattatttaaactgcggaagcttcttgatgattttatgctagagaagcaaaaaaccctggcaaaacctggaccatgtgaaattcagccagccaatgaatctggatttagcaattcattgcaacaatgtgaaggcaatgaaccaattgaagaggaggttgacattgttggtggggatgatcctcctcttccaagttaccctccagcagagattgagaatggtggcaccaacaaaacaagtgaacacagttcaagcagctctagtagtgaatctggctcttcatccagtgatagtgagtcagatagtgaaccaggcattgctaaagcatcagaccattttaatcctatgaaggaaaaggttggatctggcttgtctattgatcaaaaggaggggaatcttgataattcagaaactgaaatcgactccatgaatgcagctggccatgttgagcagagttcccagactgattcagttagtgatgaacctgaaaaccaccaagagggggagaatgctccatctaagaagcaagtatcccccgataagctctaccgtgcagctttattaagaagccgatttgctgacaccatacttaaagctcaggaaaagacacttgaaaagggtgacaagtgggatcctgaaaaacttaggatggaacgaaaagagctagaaaggcggcagaaggaggagaaagctcggttgcaggcagaggcaaaggctgcagaagaggttcggaggaaagctgaagccgaagcagcaactgaagcccaaagtaagagggaactggaaagagaagccgctcgtcaggctttgccaaag

SEQ ID NO: 46712 - DNA, 330 bp, Glycine max
  Peptide Sequence Number=SeqID_163490
atggcggatgctgatgccaaacctttcaccgccagcctggaccgcctcaaggccaccatggctacactcgctgcagcccaagcttccatggattccaatctctctcaacttcgtttcgccatgacccaagccttcatgctcttcaaactcgatctcattatcctgaaaccggatatcatgatatttcgccaaggctccccgtttccttcttcggttcagccaccaccgtcatcgccatcgccatcgtcgccagctcctccatcaaacgcttattcttaccaccccagccagtaccctcctccgcctcgccctcacgtgcctcctccttag

SEQ ID NO: 46713 - DNA, 577 bp, Glycine max
  Peptide Sequence Number=SeqID_163491
gactcttccaagcacgacgacgactaagaaggtgtggagagcaccgaattggatgaggcattcaacgtcacaacgaacatttgtggttgccgctgacgccaatcggctcttgcagaagatgtcgagtgaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaaagaaagaaagaaagaaagatgcattttgaacgttgctctgccactctacactcagttgctatgttgctattgcaatcaatacccaccgttggaaaaaacaaccttgttctcaaggttggacaacaaaaacaagctgaaataggggattgggtgtgtgacccgcaccgtggagcaatcgaggaaggtgttaaagacggtgggggagatgatggtggaggaggtgacttcgaaggtggttgtggatgtggcggtgggcgttga

SEQ ID NO: 46714 - DNA, 336 bp, Glycine max
  Peptide Sequence Number=SeqID_163492
atggaggagtatacacaaagtgttggttttataggaattgtgaaagggacacgtgtgaggatagaggggagtgagtggggaagggcattggttggggcgggaaacgtgtcatgtgttgggagaaggaaaggttgggacaaggaagagattgttccagatggtggtgaccaccacgtgtgtgtgccaatggcagtgagattagagatcgagccaggtggatggctaatcagaattaagcctccctcattcggaccattatacttagtacttgcagcatacgcaagcactcttctcccctaccacaactgtgaaagatcaaatagatgtgctacctaa

SEQ ID NO: 46715 - DNA, 870 bp, Glycine max
  Peptide Sequence Number=SeqID_163493
atggatttaagaggaggctgttgcatcgccaggtatgtacccggtgcatcccacgtgtccaccgtcgacaaaataatgcttaggtttcgtccaatcgctcccaaacccgccgccggagccaccgcttccgacggatcttcgtctgaaaccagcgacgcttttctcagaaacggaaacacgaagagaaagtacgtaagagatagcaactacaccagcaaacgtagaatctgccggagaaagaactctaattcctcaccggagcagaagcagaagcaaacgacgccggctgtgactcttcctttgcttccagaaactcccgatcggaaggattttccggcaaaggatctaactccatcaccagtgcgaaacaacaacaacaacaacagcagcaacaagagcaagaagttgaatattattaacaagaacgtgccggtgtgggtgagttttgcgaatcgaagccttacgatgatgggagggtggtgttcgtgtgtgacggtggagagcttgacggacacgtgggtggagggcgagtggctggggagtacggacgaggaacgcagagtgaatctgagcaaggacacgtgtccggggttcatatcagacggttacgggagggtgacggggacgaatgaagcatacgagaagatgatggagggtgatgagggacagggaccagtgttgctggtgaataaggtgaacacagtggttccgcacgcgtcgttcacgtgcttggtgagggtggtgcaatacgcgtgtgggagggagagaagctctctcacggtgccctgcgacgtgtggagaatggactctggtgggtttgcatggagattagacgttgaaactgcgcttagcttgagactgggttactaa

SEQ ID NO: 46716 - DNA, 381 bp, Glycine max
  Peptide Sequence Number=SeqID_163494
atggcattttctttctcggcgacatgggcccgccagcggggctcgtcgatctcggggggcctggggaggcccacgatctcttggagctggcgggagagatgggcctcgaggtcggcgagtctggccttggcgtcgtccacctgctcgtgggtggggcgggccccgatgagcttgaggacggatcgggtctgggagacgtcggagatggcgcgggtcatggaggccaacatttcagggtcggcgagattgggcatttggccgacgacggatgaaggagaagaagaggaaggtggttgttcgatgtcgaaattatgggaatgggaaggggaaacggcggtgggggttctggcgccgaaggaagggagacgggacatgacgtag

SEQ ID NO: 46717 - DNA, 2544 bp, Glycine max
  Peptide Sequence Number=SeqID_163495
atggttggcttgagggcaaagatatgttctatcttcagtttcagtgctgatgaaaatttaattctgagatatgttgatgaagatggcgacctggtgactctagttgatgatgatgatttgcgtgatgtgatgaggcagcaattgaagttcttgagaattgatgtacatatgaacaatgacggtggtgataaatcaaatgctggctctagtggaagtgccaccccctcagaaacttgtcctgtcacaagcccatttctgcttagaaatgctatggtacgtgaacatctttctaaaaaagcagcatcttcaagtcctgtggttgataatcttgccaattcaattttgaaaatgggactaaattcccatttccagcctcctgatacagctggtaaaagctcaaaaactggtgttcctgaagaacctatcactaaagcaatgggtccacaatcttcacatgtggactcagcctccaatgctagtgtcaatagtgatagtgctacccccataagatctccaattccaaacccttatctaagtggaaatgctgttaaagttgacgtctcatgttctgtgcccgaaccagtacgccagtttttttccaaatcatcaagttcaaatgctgctgcgtcttcaagtcagctgcctgcaaatctcgctgatttaatttccctagtgcctgaaccagtacgcgagtttctttccaatttatcacattcaaatgctgcatcttcaaatcagctgcctgttaatctcactgatttagtttccctactgggacaatctattctaaattctcattgccagcctcatgttgcaactggtccattcgcaaaaaatggtgttactgaagaacctatcacttctgaagcaagaggtcaacagatcccatctgcagactcggcttccaatgccactcaacaggtggaggcaggagttgccactattgatctcaatgcccctccttttgatccctttttagctcagttcacttgtgaaaataaggctccactttcatcagaagctcctaatggtcatggcaagaagggtaaaatgccgactgtcgatagttctgctggtaagggtgacagtagtgggatatcctcaagttttgctgctcctaataattcaacccagactacatcattgacttctggtgctttcattgaatgcccatttgctgggacatatattaattcttggacaccacttcctggaaactctcaaatgcccccatttaaaaggagccatagtcacactgatgcaatgtctggtatgttccataagggggtccgctgtgatggctgtggtgtctatccaataactggacctcgtttcaaatccaaagtaaaggaaaattatgatctttgcaacatttgtttcaatgaaatgggtaatgggacagattatatcagaatggaccgccctgcatctgctcgggcccctcgatacttacatggacatacaaaaaactttccaacattaccaccacatatttttaagaaaggtgccattttgaagcatgcaaagccaaaactagatagtaggtttattttggatgttaatgtgatagatggtacaatgatggctccatctactgcatttacaaagatctggcggatgcgcaataatggcactatagtctggcacaagggaactcaacttgtttggattggaggagacaagtttagtgactctcattcagttgacttagaggttcctgaggatggtgtccctttggagaaggaacttgacattgccgttgacttcacagcacctccattacctggtcgttacatatcatattggaggatgacaactccatctggacatcaatttggccaacgtgtttgggtccttatacaggttgatgcctctctcaaggactcattttatgataactctcaaggtctgaacttgaatattcccctcgatatcagtggctctaaaggacctcatattatagatatcaatgtccagcctactgaggatgatactgttcttcaaacccgcaagcctaatgctcccattgagcctttgaatcaaatggttgatgaggaaccaaggttggagctggaaaacgaattccctataaatgaagctacatttgttgcccctgttgcctcagccccagctgcaacctctgtggcatcttcatcagtgccttgtcctataattgatctgtctgaaacaaccccagctgttccatctaatcagcaatccccaaccgtggatgtgccatcgtcatctatgggtactggtggaggaattaattctgtggaggagaatctacttaaagagcttgaggagatgggttttaaacaggttgatttgaacaaggagatcttgaggaagaatgagtacgatctggaccaatccctagacgctctctgtggtgttgatgtctgtggtgtttctgagtgggaccatatgcttgaagagttacaggagatgggttttcgtgacaaagagatgaataagagactgcttgagaaaaacaatggaagcctcaaacgtgttgttatggatttaataaacggcgagtag

SEQ ID NO: 46718 - DNA, 393 bp, Glycine max
  Peptide Sequence Number=SeqID_163496
atggccgttcctgtgctctgcagcaatttggaagaggagcattgctctgccctaaaaaatgtggtttgtcccgtttgtgaagaaaatatagggaaggatgcaatcatgcaatttacacattcaagctctcgaaggtgggcgtggaagcctgagaaatctagcatctggcctggtaactccgcaatgcttggcaagaagctggccaccaggggaaacaaacaagaatcaataactgatccacttttgtcaccatttatctgcaacgtgcctattccaaactctaacaatttccatccagatgaaaactccaggtccagcaataaggatatagacattcctgatgcaaaaagaaaacttgagaaacttatagtggggagtgcatgggcagcatga

SEQ ID NO: 46719 - DNA, 543 bp, Glycine max
  Peptide Sequence Number=SeqID_163497
atgaagaagaggccagagctccaacaacaccaagactttgaagttctgaaagctgttgcacaggcatggtacagccactccggcacttgcaagcccatgagcgaatttgaagcgcacagaagaaacttcagaggcaagccttcaaggtttaagcttgaagcattgaacaagccacaagcttcttcttccagttctagggacacttctacttactgggattttcagcagtcactttgggactcctatgagcttgtcacagtgtccagaaggattgagactgggttaactttggataacccttttgatgaattgtgtggttcccctccaatccaacaaaagcgcaagcctgagagtaagaatagcctcaggaacctgtcttccacttgtgcaattcaaagcgacccttatcttcttgttggtgcactgatccctttcaacatccacgacttcaccaccctctgtctcagcaggagtggtttcatcatacccaacccttgcattagaaaggatcttgtgatggctgtgttggttgttgaaggctag

SEQ ID NO: 46720 - DNA, 1062 bp, Glycine max
  Peptide Sequence Number=SeqID_163498
atgcacgattcctacgagaagctcctcaaggacgccgagaagcgactcgtcaagatttacgagggcgatggcgaaagcgacaacgacaacaacaacgacaacgagggtgaggtaaaagaagaggttgaggagatactgcatgaggcccacggaaaaggcatcgagcgggtggatctttccgggaagcgcctcaagctcctgcctccagcgtttggccacattcctgcattggtcgtgctcgatgtctccaccaatcaactctcggtgattcctgattcgatatccggattggcaaatctcgaggagcttaatctctcttccaatgctttggagtcactgccagattcaattggcttgttgcagaagttgaaattcctcaatgtgtctggaaacaagctcagtgctcttcctgattccatcagtcagtgcaggtcattggtggagctagatgcaggctttaatagcctgacatatttgccaacaaacattggatatgaattgcttaatttacagaagctcatgattcagctgaacaagattcggtctcttccctcatctgtttgcgagatgaaatccttgcgctatctggatgctcacttcaatgaactgcgcgggcttcctattgcaattgggaaattgactaatcttgaagttctaaacctgagcagcaacttcagtgaccttagagaacttccagagacatttggtgatctgattagcctcagggaattggacctcagcaacaaccaaattcatgcacttcctgacacatttggtcgccttgatagtttgaccaagctaaacttggaccagaatcctgttgaagttccacctatggagattgtgaatcaaggggtccaagccgtgaagagtttcatggtccagaggtggattgatatattggcagaggaagaaagaaaaagcacgcaagtgttgcaagaaggagagaatgactggttaacacgaagcacctcttggctgaagaatgtttctgaaaatgtaactgagatgattatgtcccccagaactcccaaggaatcttttcttgatcagcagctatga

SEQ ID NO: 46721 - DNA, 837 bp, Glycine max
  Peptide Sequence Number=SeqID_163499
atgattcaaaagaatggcagcattcgcaagggtgatggttacaatgaaatgctcaataggtatcaatcaccaaggatccactcaatgccacctcgaggaaagtaccaagagaacaatcttgttggtgtcaagactcaaccgatggagccttatgcatcatcctccaacaacaacattaatgcatcactgacaacaccaactatatacaatcaaatgttgcctttagtttttccaagtgctcctcaagagcaaactggtcaccgtagtattgatcttttgatacctccatcgcaaatagactcaattaaaaatttctcactcaatgatgtcagtttaaaaggtcacacaagtggttttccaaatccttcaataggaactatatttcatgacccaaaaaaccttccaagctatcccaatggagcaaactccctatacccaaatcatcaaaggaataaatcctcagattttcattatttaaaacctcatccaagggttatcgtaaataattctcatggtgtaaaggatgttgctaagccaagtctcttgcctccaaatcaaattcaaaaattggacctgctttcttataagggtgtagctcgtgagagagcaatgaagcgtcccttacgtgaatttcaagaatttgacatcatgacaagtgcttcaaaaaggccaaggatgaactttaccccacttaattattatgaaggagtgcaatctaggatggaaaagatatttcctttcaaggatgagaataatcaagtttctacctttaagattaaaactgatgcaaaagagaatattgataaggacaacctggatctctcactacacctctga

SEQ ID NO: 46722 - DNA, 1758 bp, Glycine max
  Peptide Sequence Number=SeqID_163500
atgatctccgtcattgacgctctccaaacggtccttaacgcctctaaacgtcttcccccactcactgttccccttcacgatgccctaggcaaggtcttggcccaagatgttcgcgcccccgatcctctccctccctacccggcctccgtcaaggacggttacgccgtcgtctccgccgatggccccggcgagtatcccgtcgttgccgaatcgagagctggagatgacgctctcggcctcactctctcccctggaactgtcgcttacgtcacaaccggaggaccgatacctgatggtgctgatgcagttgttcaggttgagaatactgaaatagtgaacaatgcctccgatggtactaagagggtcagaatattgctacaaaccaccaaaggcaatgatatacgcccagtgggagttgatattaagaaagatgcagtagtcttgacatctggagaaaggttaggtgcttcagaaattggtttgcttgctacagttggtgttacaatggttaaggtgtatcctactccaacagttgctgttctttctactggagacgagcttgtggagccaactactgggcatctgaatcgtggtcagattagggactctaatcgtgccatgctgctggcagctgcggtacagcatcagtgcaaagttctggactttggtattgctaaggatgacaaagaatatcaaggaaggatcttggataaagcatttgcgtctggaattcatattcttctaacttcaggaggtgtttcaatgggagacaaagattttatcaagcctttgcttgaaaagcgaggaaaagtacatttcgataaggtgtgtattaaaccaggcaagccatttacatttgcagagattgactttcaatctacagagagcaaaattctagcttttgggctacctggaaatcctgtcagctctttagtttgcttccatctctttgtggtccctgcaatacgctaccttgcagggtggacaaatcctcatcattttagggtacaagctcggcttcgtcaaccaataaagacagatccaattaggccagaatatcatcgtgcttctgttatatggactgacaatgatggatcaggcaatccaggttttgttgctgtgagcactggtcatcaggtaagcagtcgactacttagtatgaagtcagctaatgccttgttggagtttccagcaacaggcagtgtagtttctgcagggactgctgtgtcagctatcataatttctgacctaagacctatggcatgtgatgagaatcataagtcatcagactcagcctttgctttgccaggaattaaatcaaataaaataactactgattcttcaggggatgctgaagtcaaagtggctattcttacagttagtgatacagttgctatgggtgctggcccagatcgaagtggtcccagggcagtttctgttattaattcttcttcagaaagactaggaggagcaagagttgtagccactgctgtggttccagatgatgtggcaaaaattcaggacattctaagaagatggagtgatattgaacaaatggatctcataattactcttggggggactggctttacctctcgagatttaacgccagaagctacaaaaccattgattgagaaagaaacacctggccttctgcatgtaatgatgcaagagagtttaaaggtgaccaaatctgcaatgctttcacgctctgcagctggaatcagaggatcaaccttggtaaggcaaaaatgctaa

SEQ ID NO: 46723 - DNA, 252 bp, Glycine max
  Peptide Sequence Number=SeqID_163501
atggcaaatttgctatcacagaaaagcatggcagatgggatggtaatctcaaagtgcagtaaaagtcatctcagccaaatgacttcactggagactgaggagagtgtccgatattctgcctctattgaagatttagacacagtgggttatttttttgacttccatgatattaaagcatctcctagaaacacacaggaaccagatgtggatctacgtgtgtccaaacatcctccccaatcagcatctgcatag

SEQ ID NO: 46724 - DNA, 759 bp, Glycine max
  Peptide Sequence Number=SeqID_163502
atggtaaagactcaatttgcagcttcaatcaaatgtctaagatcagataatgctcaggagttagctcttacagacttcctagcatctcaaggcaccttacatcaattctcatgtgttgaaagaccttacaaaattctgttgttgagaggaaacatcagcatttacttaatgttgctagagcattatttttccagtccaagattgccttcaccattgctgaaacaaaatactccatatcaagttctttatggttctgcacctgattattccattttgagatcttttggttaccttgcctttgcaactactttgaattctgagaggaacaaattctctccaagaacagttccttctgtgtttgttggttatccacaaggcgtcaaggggtacaggttgtataacttgcatactaggaaattttatgtttcaagggatctagtctttcatgagagcattttcctttttcaaactttaccaaattcctctcaagagcctgatttccttagtgaattagctatttccttacctattcctgaatctatatcctcaaccattccacctagagccattgaaaccaatatttctgaacccaatatttctcctcacacaaataatctgcctattcaattatctgattctgcagttgatactaccattaatgcctcatctacattcccttctcctcctttaagaagatccattagaacatcaaaccctccaccttatcttcttgattacattagactgcaacctagataa

SEQ ID NO: 46725 - DNA, 771 bp, Glycine max
  Peptide Sequence Number=SeqID_163503
atgggttcaaggacacagccagcagcatctgatcgtgtctacgaagactttgtaccattgtatgaatgggatagaaatgaaaggcttgtcaatgttatgctaccaggttttagaagggatcaattgaaggttcaagtgacctcaaagcccaccctaaggctaatgggtgaacgactgataactgagaacagatggcgtcgtttcaatttagaactgcccctcctttctgattatgacactgacagtgtcactgccaagtttgagggtgctaagctatcaatcaaatttggagaactttcactgactaagcctaaggaaacattaataactcctccatcacaaaaaatagaacagcaaaaggcacctgccccagaagcaaagaccaatggtgaagtctctgatcaaaagacaccacagaataaggaggaaaccaacaaaactgaaacaactcatggcacagacaaaggagctcaggaagcaaaaactaatgacttgagtgaaacaaaagaagcactaacccctacagctcccaagactaggcctgtttcaagatccaaaactaggctaatagatttcggccttggttctggatcaaatcatgttgatgatcaagtcattgaagatttggaggcagggaagaacaagtgcaagagattggtgaaatggatggtgataatctacttggttgtggcccttgtgggacttggggtttattatggcaaaaatgcattgacatcataccctgaagaatcatacttccaagagctgtga

SEQ ID NO: 46726 - DNA, 615 bp, Glycine max
  Peptide Sequence Number=SeqID_163504
atgacagctgagatcaaagctttggaatccaataacacatggaccttggttccccttccagttggaaaacaatgcattggctgcaggtgggtgtataaggcgaaattcaaacctgatggcattgtggatcgccacaaagctagattggtagttaagggctacacacaacaagctggcattgatttttctgatactttttctccaattgctaaacttacatcagaagttaatatggagcttccaaaagggtataattcagttgataaaaatcttgtttgcaaactcaaaaaatccatttatggccttagacaagcttctagacaatggttttgtaaattttcaacaacattaattgctaatggtttctctcagtcaaagaatgattattctctctttaccattggcaaaggtcaaacttcaagctctgttcaaactgaagatccttggttccttgaaatattttctgggtttggaagttgcaaaatccagcaagggcattgtcctaacttagcgaaaatatgctctttctctgttagaagatactggcttccttggctgcaaaccatcttctcttccaatggatccaaatttaaagctcaacatgctcaatggtga

SEQ ID NO: 46727 - DNA, 195 bp, Glycine max
  Peptide Sequence Number=SeqID_163505
atggagctggagctgaagactccaacaagtttgatttttggtgttaatggtgagaagtttgagctctacaacgttgacccttcaatcactttactcgaattcttgcgaaatcacactagtttcaagagtgtcaagctcggctgtggtgaaggtcttggaatggttttccaattccagatcattttttggagttaa

SEQ ID NO: 46728 - DNA, 666 bp, Glycine max
  Peptide Sequence Number=SeqID_163506
atgaggggccctggggaggtgcagggatcatttactgctgaagctattatagaaaatgttgcagctacactttcaatggatgtagattctgtcagaagcattaatcttcacacatacaaaagtcttcttcagtcattctctgagtactatcatggcgaaccttacgagtataccttgccttcaatatggagtgaaacagatggctgcgtgtatgctctcggtgctattcaatgtgatggaactgaaggtctcttggacaaaatatgggttgtacaatctgatacggtgagcttgattcaaggaggcttcactgctgggagcactacatcagagtcaagctgtgaagcagttaggctttcctgtaatgtcttggtaaagaggctaaagcctcttaaggaaaagctgcaggaggaaatggactctatcaagtgggagactcttattcttcaggcatacatgcaagctgtgaacttatcagcatcttcattttatgtacccagtaatgactcctcgagttaccttaactatggtgctgcaacaagccatgctactgaagtaactgacttatcttatattggcatgctaaacaatgggaattatttctcaggtcgaaatagatcttctgaatggagaaaccagatttctgcaaacagatattatttatga

SEQ ID NO: 46729 - DNA, 3944 bp, Glycine max
  Peptide Sequence Number=SeqID_163507
gtggttgtggtgcttgcgtagttttaatctccaaatatgatcctgtgcatgacagagttgaggattttacggcaagctcttgtctcacactactttgcagcatacatggatgttccataacaacaagtgaaggcattggaaacagtaaagatgggttccacccaattcatgaaagaattgcaggattccatgccactcaatgtggcttctgcactcctggaatgtgtgtttccctctatggtactcttgtcaatgctgaaaagaccaatcgtccggagccaccttctggattctcaaaagtgactgctgctgaggctgaaaaggctattgcagggaacctttgccgctgtaccggttacagacccattgctgatgcctgcaaaagttttgcagctgattttgatatagaggatttggggctcaactctttttggagaaagggagagggcaaggacttaaagcttagtaggttgcctcagtatgacaaaaatcataatagtattagatttcctttgtttttgaaggaaatcaagcctattgtgtccttggcttcggagaaatactgttggtacagtcctactagtctagaggagcttcagagaatattggcgctaaaccaagtcaatgggacccggatgaagcttgttgttagtaatacaggtatgggatattacaaagataatgaagtctatgatatgtacgttgatctaaggggcatttctgagctctcaaagatcagaaaggattggaaaggaattgaaattggagcaacagtgacaatatctaaagccattgaagcactaaaggaagagagcaaaggtgactttctctcagattatgtaatgatacttgaaaagattgctgaccatatgaacaaagttgcctcaggttctattaggaacacagccagtgttggtggcaatctagtgatggcacaaaagcatcattttccctcagatattgccacaatacttcttgcagtggattcaatggttcacataatgactggtacacaatttgagtggctgacattggaggagtttctggaaagaccaccattaagcttggatagtgtgcttttaagcattaaagttcctagtttggaactcaataaacgtgaatcctcagaaccagaaagtagattcttctttgaatcttaccgagcttctcctcgaccccttggaaatgcccttccctacttaaatgctgctttcctggctaaggtgtctccttgcaaggattctggtggaactgtgatagacagttgtaggttgtcttttggtgcttatgggactaagcatgcgataagagcaaaaaaagttgagaaattcttaactggaaatctgttaagtgttagcattctatatgatgctattaacttggtcacagacactattgtacctgatgatgacacctcacaaactgcttaccgttcaagtctttctgctggttttatttttcagttctttaacctattgattggcagtcctgagagaataaccaatggttatttaaaaggacatactaatctgtcatctgtggaggcttttgaattatcaaagaatcagaagcaggttcatcatggcaaatttccagccttactgtcatctggggagcaggtccttgaagcaggtactaagtatgaacccattggtgagccagtcatcaaatctggtgctgctctacaagcttcaggtgaggctgtgtttgttgatgacattccatcaccaaaaaattgcctacatggagcatatatctatagttcaaaacctttagcaagggtaaagagtataaaactcagccccgaattggaactggatggagtgagggatatcatttcaagtaaagatattcccaatgggggccagaaccttggatcaaagactagatttggtgacgaacctttatttgctgaagagatagctagatgtgtcggtgatcgtctggcctttgtggttgcagatactcagaaaaatgcagatattgctgcaaactcagctattgttgattacggtcttgaaaatcttgaaccacctattctaactgtggaagatgctgttaaaagatctagcatttttaaattacctccttttctctccccaagtcaagttggtgatgtgccaaaaggaatggctgaagcagatcacaagattctttctgctgagttgacacttgggtctcaatactatttctacatggagacacaagctgcccttgctgtacccgacgaagacaattgcattgtggtttacatttcaagtcaaagtcctgagtatgttcattctaatgtagcaagatgcctaggtattccagaaaataatgttcgtgtcattacaagaagggttggtggaggttttggtggaaaggccttgagagccacagcatgtgctacatcatgtgcattggcagcacacaaattgcggcgcccagtcaggatgtatctaaatcgaaagacagatatgataatggctggaggaaggcatcccatgaaaataacttacagtgttggtttcaagaatgatgggaagattacagcattagatcttaagatattggtcaatgcagggatatatgtggatgttagtccaataataccacgcaacatgattggtgcacttaaaaagtatgattggggtgctctctcttttgatataaaactatgcaaaacaaaccatcctagtagagctgcaatgagagccccaggggatgcgcaaggatcatacattgccgaagctataatagaaaaggttgcagccacactttcaattgatgtagattctgtaaggagcattaatcttcacacatacacaagtcttaaagcattctacgaggactcttctggtgagcctcatgagtatactatgcctttaatatggagtaagttaaatgtttctgcaaactatgaagtgagagttgaaatggtgaaagagtttaacaggattaacacttggaaaaaaagggggatttctcgagtgccagtgttgtatgaggtgaatgtaaaacctactacaggaaaagtcagtattttttcagatgggtctgttgttgttgaagttggaggaattgaattgggtcagggtctatggacaaaggtgaagcagatggctgcatttgcacttggtgcagtgcaatgtgatagaattgatagtcttttggacaaagtaagggttgtgcaaactgatacggtgagcttgattcaaggggggttaactgctggaagcacaacatcagagtcaagctgtgaagctgttaggctttgctgtgatatcttggttgaaaggttaaagcccctcaaggaaaaactacaggaggaaatgggttctgtcaagtgggagacgcttattcagcaggcatacgcacaaccggtgaatttatcagcgtcttcattttatgtacccggtaacaattccattaggtacattaattatggtgctgcagtggaaatagatcttctgactggagaaaccagatgtttgcagacagatattatctatgattgtggacagagtctcaacccagctgtggatttaggacagattgaaggatcttttatccaagggttgggttttttcatgcttgaagaatatgaaacaaatcttgacggtttgatcttggtagatggtacatggaactacaaaattcctacattggacactattcctcaaaagtttaatgttcaaatcctcaacagtgaacaccaccaacaacgtgttctctcttcaaaggcttccggtgaaccaccactacttctagcagcttctgttcactgtgcaacaagagcagctgcaaaagaagccaagaagcagcttctatcatggagcaacttagatggaccagattcaacatttcagttgaaggtccctgctaccatgcctgtggtcaaggaactctgcggactggacattgtacaaacttacttgaaatggaaaatgggcaacaagtaa

SEQ ID NO: 46730 - DNA, 4090 bp, Glycine max
  Peptide Sequence Number=SeqID_163508
atggaactgaagaagacaccaacaagtttggtttttgctgttaatggtgagaggttcgacctctcccacgttgacccttcaaccactttactcgaattcttacgcactcgcactcgtttcaagagtgtcaagctcggttgtggtgaaggtggttgtggtgcttgcgtagttttaatctccaaatatgatcctgtgcatgaccaagttgaggattttacagcaagctcttgtctcacactactttgcagcatacatggctggtcaataacgactagtgaaggcattggcaatactaaagaaggattccacccaattcatgaaagatttgcaggattccatgctactcaatgtggcttttgtacacctggaatgtgtgtctcactctatggaacacttgtcaatgctgaaaaaactagttctccaaaaccaccagctgggttctctaaagtaactgttactgaggctgaaaaggctattgcaggaaatctttgtcgctgtacagggtatcgagcaattgctgatgtctgcaaaagcttttcagctgatgttgatatggaggatttgggtctcaactctttctggagaaaaggagacagccaggactcaaagcttagtaggttgcctcagtatgaccatactcaatcaattagtagatttcctatgtttttgaaggagatcaagcatgatgtgttcttggcttctgacaaacacagttggcacagacctattagtctaacggagcttcagaacttactgaaattaaaccatgccaatagtacccggataaaaattgttgttagtaatacaggtatgggatattacaaagataaagaaggttatgataagtacattgatttacggggaatttctgagctttcaaagatcagaaaggatcaaacagggattgaaattggagcagcagtgacaatatctaaagctattcaaacactgaaggaagagagcagaaatgactttctctcagattatgtaatgatacttgaaaagattgctgaccatatgagcaaagttgcctcaggatttattcgaaacacggccagtgttggtggcaatttagttatggcacaaaagaataattttccatcagatattgctgtaatacttcttgctgtagatgcaatggttcacataatgactgatacacaatttgaatggctggcattagaggaatttctggaaagaccaacattaggttttgaaagtgtgcttttgagcattaaaattcctagtttggaactcaataaaagtgaatcctcagaaccagaaagtagattcctctttgaaacttaccgagctgctcctcgaccccttggaaatgcccttccctacttaaatgctgctttcctggctaaggtgtttccatgcaaggactctggtggaactgtgatagacacttgtaggttgtcttttggtacttatggaattaagcatgcaatcagagcaaaaaatgttgaggaatttttagctggaaagcttttaaatgttagcattctgcacgatgctgtcaacttggttacagaaactattgtacctaaagatgatacctcaaaaactgcttaccgttcaagtttggcagctggttttatttttcagttcttaaacccacttttcaacacttcggtaataacaaatagttatttgaatggacatattaatcttcctttggttaaggatcttgaattaaaagagaatcagaagcaggttcatcatgacaatgttccaactttactatcatctgggaagcaagtccttgaagcaggctgtgagtatcatcctgttggggagccaatcatgaaatctggagctgcgctacaagcttcaggtgaggctgtgtttgtggatgacattccatcaccatcaaattgcttacatggagcatacattcatagtgcaaaacctttagcaagggtaaggagtataaaactaacgcctgaattgcaactggatggagtgagggatatcatttcaagtaaagacattcccaatggtggggaaaacattggatctaagactatatttggtatcgaacctctatttgcagaagagataaccagatgtgttggtgaacgccttgcattcgtggttgcagatactcaaaaacttgcagatatggctgcaaactcagctgttgttgattatgataatgaaaatcttgaaccacctattttatctgttgaagatgctgttgaaagatctagcttttttgaagttcctccttttctctatccaaaacatgttggtgatatatcaaaaggaatggctgaagcagatcacaagattctttctgctgagatgaaacttgggtctcaatactatttttatatggagacacaaactgcacttgctgtaccagatgaagacaattgcattacagtttattcctccagccaatgccccgagtttacacattctattatagcgagatgtctaggaattcctgaaaataatgtccgtgtaattacaagaagggttgggggcggttttggtggaaaggctataaaagccatgccagttgccatatcatgtgcactggcagcacagaaattacagcgctcagttaggatgtatctaaatcgaaggacagatatgataatggctggaggaaggcatcccatgaagataacttacagtgttgggtttaggaatgatggtaagattactgcactagaccttcagatattggtcaatgcagggatatatgtggatataagtgcaattatgccacataatatagtttgcgcacttaaaaagtacgactggggtgcactatcttttgatataaaggtatgcagaacaaaccatcctagtagatcttcaatgaggggccctggggaggtgcagggatcatttattgctgaagctattatagaaaatgttgcagctacactttcaatggatgtagattctgtcagaagcattaatcttcacacatacaaaagtcttcagtcattctatgagtattctcatggtgaaccttatgagtatacattgccttcaatatggagtaagttagctgtttctgcaaactatgaccagagaaataaattggtgcaagagtttaacagagttaacacctggaagaaaaggggaatctctcgggtaccagttgtaattcaactgatgctaagaccaactcctggtaaagtaagcattttttctgacgggtctatcgttgttgaagttggaggaattgaattgggtcaaggtctttggacaaaggtgaaacagacgactgcatatgctctcggtgttattcaatgtgatggaactgaaggtctcttggacaaagtacgggttgtgcaatctgatacggtgagcttgattcaaggaggcttcactgctgggagcactacatcagagtcaagctgtgaagcagttaggctttgctgtaatgtcttggtagagaggctaaagcctcttaaggaaaagctgcaggaggaaatgggctctatcaagtgggagacccttattcatcaggcatacatgcaagctgtgaacttattagcatcttcattttatgcacccagtgttaactccatgagttacctaaattatggtgctgcagtaagtgaggtggaaattgatcttctgaatggagaaaccagatttttgcaaacagacattatttatgattgtggacagagtctaaaccctgctgttgatttaggacagattgaaggagcttttgtccaggggttagggtttttcatgcttgaagaatacgaaacaaatcttgatggtttggtgttacaagatggcacttggaactacaaaatccctacgatagacactatacctaaacagtttaatgttcaaatcctcaacagtgggcaccaccagcaacgtgttctctcttcaaaagcttctggcgagccgccattacttctagcagcttccattcactgtgccacaagagcagctgtaaaagaagcaaggaaacagcttctttcatggagcaaccaagatggagaagattcaacatttcagttgggagtccctgcaaccatgcctgtggtcaaggaactctgtggactggacattgtagaaagatacttgaaatggaaaatgggaa

SEQ ID NO: 46731 - DNA, 225 bp, Glycine max
  Peptide Sequence Number=SeqID_163509
atgaagaacaagcttgttcgcacatcgatcaactacttccaatatgtagatgttgtttacacaaataagtacatcttaaaagcgtactccgcacaatggtggccccttgggaatgaagcgacaattcctccttttgatgactcatggacacttatacctgatccaactacaattcgtgcgaaatgttggccaaaatcaacaaggataaggaataagatggattga

SEQ ID NO: 46732 - DNA, 905 bp, Glycine max
  Peptide Sequence Number=SeqID_163510
atgtctcagcatctttgttgtacaaatgtctgtgttgctagagtcggtatcacgatcaaacaatactttaaaccggctccaaagagctcctgcacatctacgtccatgactcccgaagacctgaagcaactgacacaaaaaatcaaggaccaactggaggagtcgcctaaggttgatccttttgcttcctgtgtcagcacaaagggaagctgtgtcgatccctcgagagttcatgaggggtcgacaatcatccacaacgtccttttgcccaatgatcaagtaaaggtcgatgttgaggaaattcaagatgttgatgcttgcgtccttataccccttcaagaggaaaatcaaggagctgaggaaccaacgaaacttgtagataggccagaacttgatgatgatcccttgtaccagatgacgttgatgatcccgcaacttttccttaggcctttacaagtgtcgtgggatgcaactgtgtctcagcatctctgttgtacaaatgtttgtgctgctagagccgatatgcaatcgcaaatgcaatcacaaggactcgcactgcctcctaagcctgaggacccagacacgggtgactcaatgaaatgtgggttgtatgttgatgaaaatccttctagcccggttgcccttggaagagtttatgaggggtcgacaatcatccgcaatgtccctttgaccaatgatcaagtgaaggtcgatgttgatgaagttcaagatgttgatgcttgtgtccctatacccattcaagaggaaaatcaaggagctgagggaccgatgaaacttgtagataggccagaacttgatgatgaaccactgtaccagatgacattgacgatcccgcatcttttcctcaagcctttacaagtgccgtgggatgcaactgtgttggg

SEQ ID NO: 46733 - DNA, 2860 bp, Glycine max
  Peptide Sequence Number=SeqID_163511
atgaaggtggaaatcaagatagagatgaaaccattgaaagttaggatagaagatgctcgggccaaggtttctgacacatcagcaaggaagtataatgatgttcttgatgcacatgagaaatccaaagatttagagaatacattaaaagatgtaacgaaagaacttcaaaactttaacaaagagaaagaggttattgaaaagcgacgaacagtggcattaaagaagcacacagagcttgagcttgatgtcaaagacttgcaagagaagatctctggaaatacccgagccaaagaagatgctgcaagacaactggagatacttgagaaagaaattcaagattcaactgctgaactgggcaaaattgttcctttacatgaagatcaagttcagaaagaaaaagacattgtcaaacgtgctgagcaccattatgagaagacagtttttctcacagaattggcacatactctacttttattcaagttggattacttcttttttatgcatttgttcattaactatgcttcattactaattggcttccttccaaatactccagctcaatttggtcttgctgttgatttttggaagctgcttgtagaagctaaggagaagcctgttactacacaatctcagactcagctgaatggaactttttatgctgcttattttaaaatgaactgggagcaaaagcttttggatgaaattgatcggcttaaagaagaactacaggattgtgatgagaacataaacagacgtaaatcagaaattactactttggaatctctcattgctcagtcacgtgaagggcttaatcgttacaaagaagagagagacaagttacatggggagagaaagtccctatggggcaaagagaatgaacttactgctgaaattgataagctgagagctgaagttgagaaggctgaaaagagtcttgatcatgcaattcctggtgatgtgagaagagggttgaattcagttaggaagatctgcagggagtataacatttctggagttcatggtccaattattgagttgctgaattgtgatgaaaagtttttcactgctgttgaagttactgcaggaaacagagtaaagggtccacgcatcacttatccacagagttcggatgtcatacctcttttaaagaaattgaactttaaacatgactatactcctgcattcagtcagacctcttttgcgttgcattttcgagttgtggttggagtggttgtgatcgcgcttctgattctgaagcccaaggacgattcattttcacacgggtggcatgagctaacaaagaacatggttagtgatgggttgggtcttaaggttatctgcaagaatttggatgtggcttcaagggttgctcgttctgatggtctggactgcataacactggatggtgatcaagtaagcaagaaaggtagtatgactggaggattttatgatcacagacgatcaagattgaggtttatgaatatcattaagcagaatgcagacactattcatattagagaggaggaattggagaaaatagaccaaaagattaatgaaattgttgctgagcagcagaagattgatgccaaatgtgctcatgacaaatctgtgattgaacagcttaagcaggatattgctaatgctaataagcagaagctgttgatttctaaagcacttacaaaaaaggagaagtctgttggggatgtccagaatcaaattgaacagcttaatgctagtatcgctatgaagaaagctgagatgggcactgagctcattgatcatttaacaccagaggagaaaaagcttttgtcagatttgaaccctgaaatcaaagaccttaaagagaagcttgttgcttgcaagactgatcgcattgagactgaagcacggagagcagagctggataccaatctaaccactaaccttaggagaaggaaacaagagctggaggctgtaatatcatctgcagatgctgactctttggttgctgatgctgaatcaaagtggcaggaacttagtgatgctaaaatattggttgatgatgcaatagggcagcttagaagtgttactgaaagtataaatgaccgaacacgacaaattaaaaagatcaaagatgaattgaataaattgaaggatgagtatgaaaggaaacttcaagaagatgcaaaagagttagagcaattgcagagtaaaaaaaacacatatgctgctaaagaagaggaatatgccaagaaaataagggaactgggaccattgacatcagatgcttttgaggcgtgcaatgagcaattgcagcagttcagtcatgtaaacaagaaagcccttgaccagtatataaattttacagaacaacgagaagaacttcagaaaagacaggctgaacttgatgcaggagatgagaaaattaaggagctaataacagtgctagatcaacggaaggacgagtcaatagagcgcactttcaaaggtgttgctaggcattttcgggaagtattttccgaacttgtgctggggggacatggtcatctggttatgatgaaaaagaaggatggtgatcatgatgacgacgaagatgaggatggtcctcgtgaagcaaatccagaggggagagtagaaaagtacattggagtgaaagtgaaggcaaggtttgttaacctcacccgttgggatgagtctattgttgtttgtatcagaatgcttgaaggggagacacagtccatgaagcagttgtctgggggtcaaaaaactgttgtcgcccttacacttatctttgccatacagcgatgtgatcctgctcccttttatctatttgatgagatcgatgcagcgctggatccacagtacagaactgctgttggaa

SEQ ID NO: 46734 - DNA, 258 bp, Glycine max
  Peptide Sequence Number=SeqID_163512
atggcatgtggatttgatttgacctcaaaaaggttagtggagctgggagcacgtgtggagaaacacgatttcatgccaatgttgggctcaaacgttgccgttaaggatgatgtggaaggctgccttcaaccggtgttggcaaggcacgtggaggggttgatggaagggaaggaggtgaagtggtgggtggaggagagtgaacggttgaaaaggtttgttgatgagaagaatctggttgaaaggaggttaaactgttaa

SEQ ID NO: 46735 - DNA, 255 bp, Glycine max
  Peptide Sequence Number=SeqID_163513
atggctgttgagggcggggtttggcattttgtgggcaaattttttaaattagggggtctgtttttgaaggggactcaccagtggggttggcgagttggacacgtggcggcgcctggtggacttgccagtggagttggcgagttgctgtccacgtggcgggtcccaccactcgaatgtccgtttgaggcccataatatgtcaaaatgctcgaaattgaatgaagaatcccttggcaaattcccgaaggggatttga

SEQ ID NO: 46736 - DNA, 1245 bp, Glycine max
  Peptide Sequence Number=SeqID_163514
atgaaaataatatctgacttgctgatatccgtttcaaaggctgagagacaagaagcaaggttgaaagtacggcaagactcattgagacttggaaatgttggtgtaatcagttcaattatgaattgtagagctggaactgtcatatccgagacctgggaagatggtcaagctttaaaggatctgaatgcccagcttaaacaactaatagaaacaaaggaggcaatcgagcggcagcgcaagttattgaagaaaaaacaatctgataagggtgatggaacagcagatgcagaggctggattaccagaagatattctaattcatgatgagatctacaaatctcgattagctagccttaaaagagaaaatgttcaggaagaagaaaatattttgcgggagagagaacgatatgaaatagagaaggggaggttaattcgtgaaatgaaacgtatacgagatgaagatggttcgcggtttaacaactttcagattctaaatcatcgctatgcccttcttaaccttcttggaaaaggaggattcagtgaggtgtacaaggcttttgacttggttgagcatagatatgttgcatgcaagcttcatggtttaaatgctcaatggagtgaagagaagaagcaaagctacatacgccatgcaattcgggagtataatattcacaagactcttgtacatcgtcacattgttcgtttatgggacatttttgagattgatcaaaacacattttgcaccgttctagagtattgtagtgggaaagatcttgatgctgtcctcaaggcaacacctatattacccgagagggaggctaaggtcatcatagttcaaatttttcaaggccttatttacatgaataaaagagcacagaagattatccattatgatttgaagcctggaaatgttctgtttgatgagcttggtgttgccaaagtgactgattttggtcttagtaagatagtggaggatgatgtgggatcccagggcatggaacttacatcccagggagctggaacatactggtatttacctcctgaatgctttgagctcagcaagacacctcttatatcatcaaaggttgatgtctggtctgctggaattttgtattatcaaatcctctttggccgacgtccttttgggcatgaccaaacacaagagagaatacttcgtgaagacacaattattaaggcacgcaaggttgaatttccttctagacctaccatttctaatgaggcaaag

SEQ ID NO: 46737 - DNA, 1125 bp, Glycine max
  Peptide Sequence Number=SeqID_163515
atgggcatccacacggattgccgtgcaccactgttgatgaatttggatcatgatcatgtttgttttcttcttcttattcttctcgtgccgtccatcacggctcagttacaaaactcgccgccaccgccaccgccatcgtcggatcctttcacgaggttaaggttcgacaagaccatggctgcggttttggtcatcctggtagttgttttttttgcattgggatttgtttctatatacacgcgccaatgcgcggagcggaggatcagagggaggctcgacctcgccgtggagatcgccgccgggatggagcgccggcagccccgcggcctcgacgcggcggtggtggacacgttcccgaccttcgtgtactccgaggttaaggcgctgaagatcggaagggtgacgacgctggaatgcgccgtgtgcctcaacgagttcctcgatgacgaaacgctgcgtttgattcccaagtgctgccacgtgttccaccccgattgcatcgacgcgtggctggtgaaccactctacttgtcccgtttgccgcgccaacctcgctccaaagcccgaggacgcgccttcttctgttgagattcatgttccagatccggcccggcccattgggcccaatgacatcaaccgggtggaagaagagcatgaaggtgaacaaaacagaattgttacggagccgccacgtgttttagatgatcttaaccgggctcgaccggttcggtctaaatcgaccgggattggaaatgcgagactgtttccgcgatctctctcgacgggtcactcgctggttcgaccgggtgatgattgcgagcggttcacactgcggttaccggaggaggtgaaggaccggctcgtgagatcggcgacgctgaaccggacgaagagttgtggggtgacgtggcagcggcagagcagtgggaggaggggttaccggacgaggagtgtggggcggtacgagcggttcggtggggagggccggttggaccggtgggggttcatgtggaccccaccgttttggggtaggactggttcggtgaagtcacctaagcctacgagggtgaaggatgaagttgacgtgggagaacgttcctctgatcgtttgttttccaaggattga

SEQ ID NO: 46738 - DNA, 1533 bp, Glycine max
  Peptide Sequence Number=SeqID_163516
atggcgtttccgaaaccccgtcagagccatcacctctctttcctctctccgccactcctccgccgcttctgctccctccctccgccgtcacctcgcgacgaaagcgacgccgaactgatctcgaagctcctcctgcagcaccacaaccccttccacgccaccgagtctcccctccagctccacggcatcaccctcacccccaccctcctcttccacaccctcctccgcctcaaaaaccactccaaaatcgccctctccctcttccactacgccaaaaccctccccaacccccctctctcccactcctccttcaccctcctcatcgacaccatggctaaggttcgccaattcgacgtcgcgtggcaactcatcgtcgaaatggaccaacgccaccacctcaccccaaccccttccactttcctaaccctaattcgccgcctcatctgcgccggcctcacgcgccaagccgtacgcgccttccacgacatcgacgccttctcagaaaccaaaacgacaccccaagacttctgcgttttgctcgacacgctctgcaagtacggccacgtcagactcgccgtcgaggttttcaacaaaaacaaacacactttcccccccaccgtgaaaatgtacaccgttttgatctacggctggtgcaaaatagggaggatcaaaacggcacagtcgtttttaaacgaaatgattgataaaggaattgagcctaatgttgttacttataacgttttgttgaatggagtttgtaggaaggtgagtttgcatcctgaggagaggtttgagaggactataaggaatgcagaggaggtgtttgatcaaatgcgtgagagcgggattgagcctgatgtcactagcttttcgatcttgcttcatgtttatagccgcgcgcacaagccgcagcttgtgctggataagctgagcttgatgaaggagaaagggatatgtcccaatgtggtgatgtacacctcggttatcaagtgtcttgcctcgtgcgggtggcttgaggatgctgagaggttgcttggtgagatggtgagggatggggtgagtccgtgtgccgcgacttataattgcttcttcaaggagtttagagggaggaaggatggggagagtgctttgagaatgtttaagaggatgaaggaggatggattgtgcatgccgagttcgcatacgtatgtgattttgataaggatgtttttgaggttggacatgatcaaggttgtgaaggagatatggcaggatatgaaagagacaggggcggggccggatttggatttgtatacggttttgatacatgggttgtgtgagaggcagagatggagggaggcttgccattattttgttgagatgatagagaatgggtttcttcctctgaaaggtacctttgagtcactttacagggggctgattcaggctgatatgttgagaacttggaggaggttgaagaagaagcttgatgaggaatcaatcacgtttggttcagagtttcagaattatcaattgaagccctacaggagataa

SEQ ID NO: 46739 - DNA, 369 bp, Glycine max
  Peptide Sequence Number=SeqID_163517
atgtcagatgacatgctcattcatttctcatccaactcttccaaccaatcagatcagtctctgcctacaaagattgctaagttggaagctcgaatggttggtaagggttcctccaccgctgctcagcaatcaggttggtcctctgcgtctgttccttctgctgggaaatttggcggagctgctgaaaatttggctgaaccatccacttccagtgattctgatgatgatcttatttgcttaaggtttaaatatcggtcacggtcgccgttgcattggacaaatgcggctgatgctgtcccaattggagggtcgcgctgcggtcgtggacagttaaaaaaccttgattttgcagcgcgaaccgttttttaa

SEQ ID NO: 46740 - DNA, 255 bp, Glycine max
  Peptide Sequence Number=SeqID_163518
atgactattaggtataaatttgatgatgagagggtgactaaagaagacactaaacgggcattagaggagcaatatggtggcgaggaagagttaccgcagacaaatcctggatttaacaacactccttttaaattcaccaaatattcaaatgcttatatgctggtgtatatacgtgaagctgacaaggacaaagtaatatgcaatgtggatgaaaaagacattgctgaacatttaaggatggctaatttattttaa

SEQ ID NO: 46741 - DNA, 141 bp, Glycine max
  Peptide Sequence Number=SeqID_163519
gacgaggtggctaaagagtttggaataccagttcaattccagcgcttttggctatgggcaaagcggcaaaaccatacgtatcgtccaaatcgaccattgacacacatggaagaagcacaatctgtaaattctttagcttga

SEQ ID NO: 46742 - DNA, 210 bp, Glycine max
  Peptide Sequence Number=SeqID_163520
atgcaacaaccagtttacctcattcagaaatgtgctataggattcacatgcataattgcatccacttttgcttacggaagtgtatgggtgatccggtgccttgtgagcgctgtggtggcaacggctttatgccaagaatacgatgaacattttaaaatattaggagcgaggatatcactattcatgtgtataaacactggcttgatttga

SEQ ID NO: 46743 - DNA, 1809 bp, Glycine max
  Peptide Sequence Number=SeqID_163521
gttggacaattgagagaggtatcaaacaaggttcacaatgcagaattgaaattgtttttggaagtggagcttgggctggatgtatgtcccattgcaccacctgacaagacaaaggatgatatattacttttcttcaagttatatgatcctgaaaaagaggagctacgttatgctggaaggctctttgtgaagagtactggtaagccatcagaaatcttaaccaggttaaataaaatggctggttatgatcctgatgaagagattggactatatgaggaaattaagtttgagccaaatgttatgtgtgaacctattgataagaaagtaacatttcgagcaagccagttagaagatggagatattatatgctttcagaaagctcctgctatagacaatgaacacgtccgctatccagatgtgccttcataccttgaatatgtgcacaatcgccaggttgttcactttcgatctctagaaaaaccaaaggaagatgacttctgcctggagatgtcaaggctctatacatatgatgatgtggtggagaaagtggctcaacaacttggtttggatgatccatccataattaggcttacccctcacaattgctactctcaacaaccaaaaccccaacctattaagtatcgtggtgtggaacatttgtctgatatgctggttcactacaatcagacttcggatatattgtactatgaagtacttgacatccctctgccagaactacaaggattgaaaactctgaaagttgcatttcaccatgctaccaaggatgaagtggttattcataccatcagactcccaaagcagagcactgtgggggatgtccttaatgatctgaaaacaaaggtggaattgtctgatcctgaagccgagcttaggttgcttgaagttttctatcacaagatatacaaggtcttccctcccaatgaaaagattgaaagtataaatgatcaatactggacattacgtgcagaggagattccagaagaagagaaaaatctgggtcctcatgatcgtctaatccatgtgtatcatttcactaaagacacagctcagaaccaaatgcaaattcagaactttggggaaccctttttcttggtcatacatgaaggggagactttggctgaaattaaagtaagaatacagaagaaacttcaagtccctgatgatgagtttgtcaagggcgtcctgaataccttcaggattctgacattgtgtccagtcgttttcaggagagatgtttatggtgcttgggagcaatatcttggtttggagcatactgataatgctcctaaaagatcatatgctgttaaccaggcacaaaaactggtcgctcttgaacaatctgaccatgacatgatttcttatgtttctaaggcccaatctgtcgttgaggagatgaaaatatatctagaggctgacactttaaaagaaatgaagaagaaactagataatgtgtacgtaatgctggttcttcaaggaatgcatccagactataagcatgttcacgatcaaattcttactaccaacaagaggactcgtgctggcttcaatgcagcagtctttgccatgcagtgttttgaaattttggtagatgccaagattaaagctaccccagatttctctcgtgcatctctctcttgcacacttttgaattccaatcctctgtgctatacaaagggaaagttgtcgagtaacgagtcccaaggtgatgttgttgcgttgtatggcatcctaacaggggtcggaggtggtggtctaagactcaaagttagtgcgaaggcggaggagtga

SEQ ID NO: 46744 - DNA, 189 bp, Glycine max
  Peptide Sequence Number=SeqID_163522
atgaagaaccttaaggccaaggaagagagaaagagcaatggcggccaaaacactgacagtgacgataagtgtttgcgtgtcgaaatagaaagtggtggcgacgccgttaaagagcaaaatggggtcgatgatcgtcaacagcctcggcttgatgggataaaggtaaggagaagggaaatagagaggtaa

SEQ ID NO: 46745 - DNA, 450 bp, Glycine max
  Peptide Sequence Number=SeqID_163523
accaacgtggagacacttcagaaggtccgcaaggcatgggaggtggtgcgaaagaaggacaaagaactcaggggcagtaacaatgggcccatcggtggctaccgtaagtggttgagagctctcgtgcaaggtttggattggctcccgagtttgagaaccgctaaaagggaggaatttgaggcactgaaggaagacgaagaagtgcagacccttagggcagaactcaagcaagcccaaatagtcaaagaaaggttcaaatcagcagctctgaaaatccaaaaggagaataccgaactaagagatgtaaatgtggctaccaccaaagccttggaacgagaaaccaagagggcttgtagggaagaacacggccggaacaaattccgaggggctctgtggggcagcaacatcgagcttaaactccgaagagaggaaagggccaatcacgagtag

SEQ ID NO: 46746 - DNA, 250 bp, Glycine max
  Peptide Sequence Number=SeqID_163524
gctgtcgtcccttgtgacggacgtgtggggtgctaataccttccccgcgcgtaaatacaactcccgagcctttcacttaaaagttcgtagatcgcgtcttttccggtttttccgacgtttgcctcaaataaacgttggtggcgactctgcgcgtattcctttcgtggaacatgcatcccgtgagtcacgcgtcgccctcccgccgaagggtaggttgcgacactactgtttactcttaaagcacccatga

SEQ ID NO: 46747 - DNA, 302 bp, Glycine max
  Peptide Sequence Number=SeqID_163525
gagtggatggtggcattggagagggagtacggtgcgagggagtggatcgagatgatactagattgggagttgcgggtgagattcacggagccgaatttgacggtggcgtgaccggtggtttgaaggagcatggtgatgagcttacaggtgggggggaaggcgtgaaggttggaccgggaggaggacgtggtagtgaaggatggtggcaagggtggccagggagaggtggtggccagcagctaggtaggcattggggacgacgagaatggagaaggaggagtgacctgagagatccacgatga

SEQ ID NO: 46748 - DNA, 606 bp, Glycine max
  Peptide Sequence Number=SeqID_163526
atgtgcaatgcaagttccctccttatactcaactttgctcacaagaacttgacaggccagattccacaatgccttggaacatttccttctctttatgtgttggatttgcaagtgaacaaccttcatggaaacatgccttggaacttttctaagggaaattcatttgaaactataaagttgaatgaaaaccggttggtgggacaactaccacagtctttggctaactgcacaaaactcgaagttttggaccttggaaacaataacatagaggacacatttccccattggctagaaactctgcaagagtttcaggagaaattccgaaagtcattggagaattgcattctctcaaagggcttaacctttcacacaatagtatcactgaaatttggaattgttggacctctcatggaatcagttgaagggcgagattcccttggctttgacaaatttgaattttctgtcttgaacctatcacaaaaccagtttgagggtatcataccaacaggtagacagtttaatacacttggaaatgattcctatgctggaaatccaatgctatgcggattccctttgtcaaaatcctgcaatgaggatgaagaatga

SEQ ID NO: 46749 - DNA, 549 bp, Glycine max
  Peptide Sequence Number=SeqID_163527
atggggtcgtggggttcgtattggatattgaactctgaaagttctatagaccaggccaccatcctccctgctagttcaagcttttgcaaaacctgcttcatggggactgacaatgttgcaatggtcttcttgaaggctaagaaggcttattcacaggccaaagggcatgaccttgtagtagaagttggcatctctagtgatgaatatcattttctcctcgtttggagcgtgcatcctaatttggttgtatcaagaattagtatagtcggtgcacatatgccatttgccgttggcctttttgaccatgacgatattggtgagccaggtgtaatatttgacttctctgatgaagttgatgacaagcttgtggaagataatgcttgggtggatttcgggcatgtcagatggctgccaagcgaacagggcgaaggcaaaatagataagccaaatagttcgtctcccagggagaatacgagcgaagtcaccaccaacgtttattcgaggaaaatggttgacaagggtgtttcccttgctcctacgtatcttcag

SEQ ID NO: 46750 - DNA, 1485 bp, Glycine max
  Peptide Sequence Number=SeqID_163528
atggtgaaggcctatgagattttgtgcccttttttcaacatctggcctagtgtgccggtcttcatgtttttcttcctgacgaagttgactaacaagattggttgggtcctggctgccaatgtcggggttgatggtttgccacttatgtttaacagggacggggatccccgcttcccgttctattggcagtttgaccccaccaggccctttctaaagcaagatgaacttgttggtgggactgtgccaccgtccatggtcccccctactattggagaagggggccaaccttctggtgaggttggccctgttgttggtattgtcgaggtcacccccaatgctccttcttctgttttggctaagaggaatcaagatgacgatgttggggtgtcaggccacaagaaggttgacgcctggttcgggtcacccttcaagtttacaagatgtgccttcaactctgcgcaaggtggtgtccttggaggtggagagtgccctaaggtagctaacaccaccatcgccttcgctgaagctgtgaggtcaaaccaccaactatcttccaaggttggtagtgtcttggccaagttgcttcgccaaggcattgcgacagagatggaaaagcttgccaaggtggttgcagagttagaggctgggctgaaagagttggagtccaagatgggtgagtctgagttgtgggtgtctaaggagagggaggccagtaaggagcttgaaggggagctgatagacatcaggcaggctgggttctttgccaatgacattgacttgggtctttttgaccctttcaaggacgtgaaggacgatgttctgctcgatgaggaagatattgctgtcgaggaagaagctgttaaggaggaggctagcgaggaggcacaagatgttggggccaatgaagcagaccttggtgatttaggaagcaaggccttggtggtcttgtgtgaagtaaaaagtgtaatttgcacccggttgaaggtcttgccaaacagtctggtggtagttcgttttgtggaacttggacttttgaatgtggttttcatggttcttaaggaaacgtactttgggttttatgaacctgtgaaactcaccaaggacgtgtccgtcctggattttggcgagactcgccaagggcagaccttggatttgatgagcttggtgtgtgtagtgtatgtgtcatgctcatgcatacatgtcactcatggagcggtatgtcctggagatgtggtgttgtgctcttgcatatgtgtcactactgaagtgtcatgtactggagacatgatgtcgtgctcttgcatacgtgtcactcatggagtgacacgtacaagaggactcaccaagggtgaaccttgggttttgcaagccctttggagaaacgaccagcgacgcgttcatcatggattttggcaagactcaccaagggaaaaccttgggtttgacgagcctgtggagctgggaccatggatgtacctgtcttga

SEQ ID NO: 46751 - DNA, 864 bp, Glycine max
  Peptide Sequence Number=SeqID_163529
atgtgggacaaaggaactaagaccacaaactctaacacatacgagttgatgctcgcttgggcgagctggagctcgcttgggcgagctgctggtgaggtccctattgagttgcatacactaccttggtttgggtccgaactgcagcttgacgagctcttcgataggctttgggcttttgtcagtagtttcatcatgcgaatatacatagaatttgttgtccaggcttgcttggtaaaccgtcagggctcaaattggagaccttttatccgtgctcatgacctgagtggtaccatccgttgtggggtgaggtttggcaggttccctgtcacgatcactcccgttaaggtggggaacttcatctttagatgcagtgtggagacgatggctccgactcttggagagttggccttgaccaaaggtggtcataaggttgacatagcctctggtctctactcgttcctttgtgaagctgaggagtggatcgacgtgaggctgaatggtgtccttggacaacatgaagttggcgattatgatggagacaaccatggggtcgtcttggttgatggggttgatacacttgaagtctctgttgtcgatcacatcttgaatggttgtgtctctgtcttcctcaattgtttgctttgtcttttcttctgttcgcgtcatgattcttgtgctaatcctcttggtgtccttcggggcctagcagtcttctatgttgtgactaatgccgcaatggtatttgttgtatttggtcgctctaacctcgtccagggaggtttcatcggaggtagcttgatgggtacttccatgttgaaagcctcctcgaggattgtagtgcaattggctgtcaggggtgtgtga

SEQ ID NO: 46752 - DNA, 148 bp, Glycine max
  Peptide Sequence Number=SeqID_163530
ggctcttgcctcagtagaatccttatctactaaggagtatatgaggaagttagttgaggatgcaagacttgctgccttgggaagcaaggccaccatgatggagatagatggtgatcctatacctaagaatttgttcctgaatctatga

SEQ ID NO: 46753 - DNA, 642 bp, Glycine max
  Peptide Sequence Number=SeqID_163531
atgattccagggaaagatcctttgccatggtctggtcgagtgcaaattgcgctagattcagcaagaggccttgaatatattcacgagcacactgtgcctgtgtatatccatcgtgatgtaaaatcagcaaatatattaatagacaagaacatccgtggaaaggttgcattgttatcattcttcatgatcctcactccacatcctgatttttcatatttttttagactaaaccgtgatattactagatatgctcaatatggtgacatttctccaaaagtagatgtatatgcttttggagtggttctttatgaacttatttctgcaaagaatgctgttctaaagacaggtgaatctgttgctgaatcaaagggccttgtagctttgtttgaagaagcacttaatcagagtaatccttcagaaagtattcgcaaactggtggatcctaggcttggcgaaaactatccaattgattcagttctcaagattgctcaacttgggagagcttgtacaagagataacccactactacgcccgagtatgaggtctatagttgttgctctcatgacactttcatcacctactgaggattgcgacacttcctacgaaaatcagactctcataaatctactgtctgtgagatga

SEQ ID NO: 46754 - DNA, 1380 bp, Glycine max
  Peptide Sequence Number=SeqID_163532
atggaagaaacgaagtgggtggtccaaatcaatgaggagctcaagagtgatggtacttctgtacctgagaaggagcaatggaagagacattcaatttacaagataccctcacgtgtcactgcgttgaaccaaaaggcctacaaacctcaagcggtgtcttttggtccttatcaccatggagaggaacatctgaaggacatggaatatcacaaacatcgtgctctgattcattttctcaagaggtgcaaaaagcccatcgagctgatattccattgcatggatcaagtggttgatgagttgagaggctcgtacaatccactcgatcaaatttggatgcaggacacgcctaggttcctgcaaatgatgattcttgatggctgtttcgtgttggagattttacgagcccatgatggtgtgcctgatgactatgctgacaatgatcctgtctttggtgaacacgggaaactcaatgttgtgccatatatcaaacgtgatatgcttatgcttgagaatcaattgcccttgatggttcttcgtatattaattgagattgaaactgacacaacccagggagatgagttgttgatcaaacaaatcctcaagttcttcagcccaggcaccccagaaacaggaaccaatggcaaatgcatgcacgtgttagacgtgtacagaaaaagcctgattcagcaaggacccacaaagcgaacacgcgtgtccaaagcaaaacgaagaagattatggttgagtattgaggaacacgacgatgacgagatcatccgctccgcaatggagctccaagatgccggaatccgcttcaagaaaagccgaacccacagcctcggcgacatatcgttcgtctacggcgtgctccggctcccagccctagtggtggacgacacgacagagtacatgttcctcaacctcatcgccttcgagcgcctccatgccggagcaggcaacgagatcacctcgtacatcttcttcatggacaccatcatcgacagcgagatggacgtggcgcttcttcatcggaatgggatccttgtcaatgccctagggtgcgacagggcggtggccaaactgttcaattcattgtcgaaggatatcgccgtggatcgacaaggagtgttggatgtggtgaggatgagcatgagtaactactgcaagaaaccctggaacttgtggcgcgctaatcttattcatacctatttcaggaacccttgggctattgtgtcgcttgttgctgccatttttctctttgctcttactattgttcagacggtttacactattgctcaatattatcaacccccaactactccttctgattcgtcctcaccgtttgtgataccttctccaagaccttggtttcgtccctag

SEQ ID NO: 46755 - DNA, 2547 bp, Glycine max
  Peptide Sequence Number=SeqID_163533
atggaacacagtttcagattaccagttttcttcttgttatgtgcctctatagcgttcagtgcagaatccaagtgtagcaggggttgtgatttagctctagcttcctactatctatcacaaggtgacttgacatatgtatcaaagcttatggaatctgaggttgtttcaaaacctgaagatattctcagctacaacactgacaccataacaaacaaagacctgttgcctgcctctatcagagtgaacgttccattcccttgtgactgcattgatgaagagtttcttggccatacttttcaatacaaccttacaacaggagacacttatttgtccattgccactcagaactactctaatttgaccactgctgagtggttgcggagcttcaacagatatttaccagctaatattcctgatagtgggactcttaatgtcaccattaactgttcctgtgggaatagtgaagtttccaaggattatggattgttcatcacgtaccctcttagacctgaggattctttgcagtcgattgccaacgagactggcgttgatcgtgacttgctggttaagtacaacccgggtgtaaattttagccaagggagtggtctggtttatattccaggaaaaggtcttgcgggtggtgttattgctggaatatctattggagtagtaacaggacttctgctattggcattttgtgtgtatgttacatattaccgaagaaagaaggtatggaagaaggatttgctctcagaagaatccaggaagaactctgctagagttaagaatgatgaagcctctggtgattcggctgcagaaggtggtactaacaccattggcattagggtgaacaaatcagcagagttttcatatgaggaactagccaatgccacaaataacttcagtttggctaataaaattggtcaaggtggttttggggtagtctattatgcagagctgaatggagagggctccctttttcttgtctatgagtacattgagaatggcaacttaggacaacatctacgtaaatcaggtttcaatcctttgccatggtctacccgagttcaaattgctctggattcagccagaggtcttcaatacattcatgagcatacggtacctgtatatatccatcgtgacataaagtcggaaaacattttaatagacaaaaacttcggtgcaaaggttgcagactttggattaaccaagttgattgatgttggaagttcatcacttcccactgttaatatgaagggcacatttggttacatgccaccagaatatgcatatggcaatgtttctcccaaaatagatgtctatgcttttggagttgttctttatgaactaatttctggtaaagaagcattgagcagaggtggtgtctctggtgctgaactaaagggcctttttgatgaagtatttgatcagcaagataccacagaaggtcttaaaaaactggtggatcctaggcttggagataactacccaattgattcagtttgcaagatggcacaacttgctagagcatgcacagagagcgatccacaacaacgtccaaatatgagttctgttgtggttactctcacagcacttacttcaactactgaggattgggatattgcttccatcattgaaaatccaactcttgcaaatctaatgtctgctttcgcttcctactatgtcagtccggatttaagcttagaaaatatagcgcggttgatggaatcaagcattgaagttataatcagcttcaatgaagacaatatatcgaatggttatccgctatccttttacagactcaatattccattcccctgtgactgtattggtggtgagtttctggggcatgtgtttgagtactcagcttctgcaggtgacacctatgattcgattgcgaaagtgacatacgccaatctcaccaccgttgagcttttgcggaggttcaatggctatgatcaaaatggtatacctgcaaatgccagggttaatgtcacggtcaattgttcttgtgggaacagccaggtttcaaaagattatgggatgtttattacctatccactcaggcctgggaataatttgcatgatattgccaatgaggctcgtcttgatgcacagttgctgcagcgttacaatcctggtgtcaatttcagcaaagagagtgggactgttttcattccaggaagaggtcttgctaggggtgctgcagttggaatatctatagcaggaatatgcagtcttctattattagtaatttgcttatatggcaagtacttccagaagaaggaaggagagaaaactaaattgccaacagaaaattctatggcgttttcaactcaagatggtacggtctctggaagtgcagaatatgaaacttcaggatccagtgggactgctagtgctactggcctcacaggcattatggtggcaaaatcaatggagttctcatatcaagaactagccaaggctacaaataactttagcttggagaataaaattggtcaaggtggatttggagctgtctattatgcagaactgagaggcgag

SEQ ID NO: 46756 - DNA, 249 bp, Glycine max
  Peptide Sequence Number=SeqID_163534
atgaagggttcgccatctaaaatatctttgatcaagttggatgtactcctttccttgaaacgttcagtgcttggtactatggtacatactctttttttctggggaactacttgtcatgatgcattatccaacaaaggcattgtcaacaggaaagaagtgataatctctctagttaccatcgttgcaatgtatggatgtctagaagagggactagtgtttggcaaagattggaagaaggatatatcatag

SEQ ID NO: 46757 - DNA, 546 bp, Glycine max
  Peptide Sequence Number=SeqID_163535
atggaggctcaagaaggaatagcaattatacatataccggtgatctttcctttgcccatgcctccaaaggcaacacttcctccttcaactagccttaggacaaggaacatagacttttctcctgtcatgtgtcatgagcaaccattatccagaagtcacatttgtttgaatcaaactgtgacttggaggatgatgcctcttttactaagcctcagccagacttatgatgttgaggtaaaaacctgggacaatgaacaagtcaacagttttctgatggccaacacaaatgaacaagttgagatatccttggtaagaaaaggtcggagtttatgttggtacctggatagtgtttgctcacaacacatgacgagggaaaggtctatgttcctcggcctaaagttagttgaagtaggaaccattaactttggaggcatgggcaaaggaaagatcactggtatagcatacaccagtgcatattcaagacaaaagacatcaattccttctttaccgttagacaacataacaatttgtatgatattgatttga

SEQ ID NO: 46758 - DNA, 521 bp, Glycine max
  Peptide Sequence Number=SeqID_163536
atggctaagggtactaatgccactggacccaaaaagatttgggtgccaaaatctcatattgttcctattgtggatatccttagtaggaaaaggctaaagtttaagttggaggaagtgttgcctttggaggcatgggcaaaggaaagatcaccggccgttacaactatgcatatggatctgtttggaccaactaaaacgttgagtctgggaggaaagaaatatggatctaggatagttgatgactattcaagatatatagggatttacttccttgcacataaacatgaggcttttaaggtctttgaaatattctataagagatttgaaaatgaaaaaggtttttgtatctcttctattagaagtgaccatgggactgagtttgaaaatgatgacttcaaatctctctatgaaaagagtgggtacatctacttgggtttgactgagaacaagagagggtacatctcttgtggatcagttctagtggagggtacatccactaggttcaaagagaacaagggagg

SEQ ID NO: 46759 - DNA, 180 bp, Glycine max
  Peptide Sequence Number=SeqID_163537
atggtgatgcccatattggggtctagagactttgtcagcgatagggacatgttttgcatgtacaaggtggtgatgggtgaaaagctgaaaggcatgacctttctgaagattggaattgttgataactttcaaaagcatattaaaagaaagatcaagaaagaaccaaatgaggaaccataa

SEQ ID NO: 46760 - DNA, 321 bp, Glycine max
  Peptide Sequence Number=SeqID_163538
atggatggtgctaaacctatgaaaacccctatgcatgcttcgaatcctctaagcaaagacaaattagggaaaccaatagtgatgcaatcctaccccccaagggcattggatagaagaatccaagaagattgggccagagatgcaagagaagtccctaaggcatcaacaacgaagatgatgccaagagaatgtttccagaggattctttcatccgtggatgctggaggcactgttaaagcaaaggaagtgatcatctctctagaaacccttgttgctacatctggatgtttggaagaagggttggtgtttgacaaagaatag

SEQ ID NO: 46761 - DNA, 153 bp, Glycine max
  Peptide Sequence Number=SeqID_163539
atggtgttcaaaaatcaacacgcgcacaccaaaaaggctatagctggagctggtggtgcccttggtgggcgtcctgtgaccagaattactattaatgggtatttaacacagtgcattcaaggtttggggcctatgacaccagaggaggtataa

SEQ ID NO: 46762 - DNA, 216 bp, Glycine max
  Peptide Sequence Number=SeqID_163540
atgaagttaagagaaaaagttggaaaggcgtttgctgttgcaactgcatttatatttggtggtgctgcattggtatttggtgtggtggcttccaagttagagctgcataatgctgagaatatgtcacgaaagtggcatatggaaagggacgatgttaagcagaagactatcgtaaaggagctgtctaaaatttggggtgcaaaaagaacagattga

SEQ ID NO: 46763 - DNA, 498 bp, Glycine max
  Peptide Sequence Number=SeqID_163541
atggaacggcgggaacaaagtacaagctggaagatgagttttctcgcgggaaggttagctgggaaagaagctgcgtactttttccaggaatccaaacaagccgtgggaaaactagcccaaaaaaatcctcttcctaagaccaacaacaacaacaaccttaactttcatgaagtacatgattgttcggatgtgcttcccgaggttctaaggcactcccttccttccaaagtgttcagaaatgatgaagccacctctttttccttctctgcgtccaaatgggtccttcgttccgaccccaaaacccaatcttccgtatcccctgatgctctcaatcctctgcgtgcttatctttccctgccccaagtcagctttggccctaaaaggtggcaactgcctgaagcagcaaacacggtttcagcctcaacagctaatgaatcgcgtcaagacaggtctttctacttagcaacttggtcccaccagtttgagttgatgcgatag

SEQ ID NO: 46764 - DNA, 333 bp, Glycine max
  Peptide Sequence Number=SeqID_163542
atggaggcactttgggaatctttattgccacagcctttgtgtgctaggggtcttcgagttgtcatcgtggaaagaaatgtactaaaaggagtaatttcagcttcattgactgagatatcagcattctatcctacgcagaaaagagtcgataaattctttgaaggagagcaagaatggaatatatcaactacggagcttttggaacttgtagaagtcggagtcctggaagaagatgatattgaaagagccacagcagtaaaattcaatcctgtaattcctgaacttcttgagtttagttgccaatctctatgtagcaagaatcatctcgattag

SEQ ID NO: 46765 - DNA, 1851 bp, Glycine max
  Peptide Sequence Number=SeqID_163543
atggctgcatcattatttatgccttcatccatagtggaggaagaagcgaggttcgaagccgaagtggcggaggtgcaagcatggtggaactctgagaggttcaggctaacaaaaaggccatacacagcaagagatgtagtgtccctccgaggcaacctcagacaaacctatgcctcgaacgagatggcgaaaaagctatggcgcctcctgaagaaccaccaagctaatggaacagcctcgaggacttttggtgcacttgatcctgttcaggtcacccaaatggccaagcacttggatacgatctatgtctcagggtggcagtgttcagccacacacaccacgagcaacgagcccggtcctgaccttgctgattacccttatgacactgtcccaaacaaggttgagcacctcttctttgctcagcagtaccatgacaggaagcaaaaagaggagaggatgagaatgagcagggaagagagggcaaggacaccttatgttgattacttgaggccaatcatagctgatggtgacactggctttggtggcaccacagcaactgtcaagctatgcaagctctttgttgagagaggtgctgctggaatccacattgaggaccagtcttcagtgaccaaaaaatgtggtcacatggctgggaaagtgcttgttgccatcagtgaacacatcaacaggcttgtggctgcaaggcttcagtttgatgtcatgggggtggaaactgttctggtggcaagaacagatgcagaagctgctaatttgattcaatcaaacattgacacaagggaccatcaatttatcttgggagtgaccaaccccaaccttaaggggaagagcttagcaactcttatgcaacaaggcatggctgctggaaaaaatggagctgagcttcaggctttggaggatgagtggctctcaaaggcacagttgaagactctctcagaagcagttgtggaggcaattgagaggcagaacaacattggagaggaagaaaaaagaaggaagctaaatgagtggatgcaccattcaagctatgaaaggtgcctttctaatgaggaaggtagggaaattgctgaaaagttaggagtgagaaacctcttttgggattgggacttgcctaggactagagaaggtttttataggttcaaaggttcagtgactgcatcagttgttagaggttgtgctttttctccacatgctgatgttatatggatggagactgcaagcccaaatgtggttgagtgcacagagttttccgagggggttaggtcaaagcaccctcagatgatgcttggatacaacctctctccatctttcaactgggatgcttctggaatgagtgatgaacaaatgaaggatttcattccaaagattgcaaagttggggtatgtgtggcagttcatcactgtgggaggtcttcattccaatgcactcataacttcaacatttgcaagggattttgccaataggggaatgctggcttatgtggagaggattcagagagaggagaggaacaatggggttgacacactagctcaccaaaaatgggctggtgctaattactatgataggtacctcaagactgtccagggaggtgtggcttcaactgctgcaatgggaaaaggcaagtcatatatatttacacacttggtcactaacaataatgtaccatgctttaatttcttgatgcaaaccatggttttaaaatgcggttacagtaagctagaaaacctttacattgcgggagtaactgaagagcagtttaaagaatcatggactagatcaggagctgtaaacattgatagaggcagtattgtggttgctaaggccagaatgtga

SEQ ID NO: 46766 - DNA, 1227 bp, Glycine max
  Peptide Sequence Number=SeqID_163544
atggaaggagagaaagaaaatcccgatggtaacgccgctttggtgaactccttctgcgaaatcacttcctcttccaaggaagaagctcttttctttttggagagccacaatttcgacctagacgctgccgtttcgactttcctcgacaacgccaacaaccccctcatccctctcaacgacgaccttgccattcccaaccccaacgccgtttcccctccctcagattctcactctccggacttcaacccttctcgctcgccgtctccgtctccttcgcccacccgcaccccctacgagctccgatcccgtaggtctctcggcaagaaaccctccaccagtcgccaaggcaaaattcgcaccctcggcgatctcaaacgcccctcccgcgacgacgatgattccggttccgatcctgatttcgaacccgacgagtactacaccggcggcgaaaagagtgggatgcttgttcgagatcctaccagaggaaacaacaacaacaatttggatgatattttcgatcaagcaaggcaggttgctgttgatgcgcccccggagaatcctcgaagctcttcgaggtcgagaagttttagtggcacggcgaggttgctctccggagagactgtgccatctgctcctcagcgtgtagaggaggttactcacactgtcattttctggaggaatggattctctgtcaatgatggtcctctacggaggttggatgatccgcagaacgcaccgtttctggagagcattaagaagtctgaatgtcccaaagagcttgaaccagcagataggaggactgctgtccatgtcaacctcacaaggcgggatgaagactaccctgaaccagtgaagccacgccaacgtgcttttcagggcgttggaagaactttaggtagcaccagctccagcaatgatgaacctattcaaacaactggtgcttcaccaaatactgcaccaatgccaacaatgggtttagttgtagatgagtcgcagccagtgacatcaatccagctgaggttggctgatggcacgcgcatggtttctcgcttcaatcaccaccatacaatcagagatgttcgagcattcattgacgcatcaagacccgggggagtaagaagttaccaactgcagacaatgggttttcctcccaaacaactcactgatttggaccagtctatagaacaagctggtatagccaactcagttgtcatccaaaagttgtag

SEQ ID NO: 46767 - DNA, 345 bp, Glycine max
  Peptide Sequence Number=SeqID_163545
atggcgactctggattccgacgtgcctatggttcccgccggcgagccctcgagcagcgccggtccttcttccaagaagcccaagcgcttcgagatcaagaagtggaacgccgtcgctctctgggcttgggacatcgttgtcgataactgtgctatctgccggaaccacatcatggatctctgcatcgagtgccaagccaaccaggctagcgccactagcgaggaatgcactgtggcatgggttagagtgcttcagtctcagctgcaaggttgttattgggctatggtggctgctattgtctccttgatcttgttgagtgaggcaaatggtgtgattcactcttag

SEQ ID NO: 46768 - DNA, 258 bp, Glycine max
  Peptide Sequence Number=SeqID_163546
atggagaaataccataaatccagattacaatcctcccataaagaatatgaacaaaaaactctcaaaaacatttttaaacttgtatccaaacatatcgataatttcaataaggaagaggaaattaaagaggtagaggttgaggaaattttcgcagaagaggacatggcaatttcaactaagggagagaacaatttcaactcacctgatcaaggaaagtgtgggaataattttggtctgcaaatcaaggaaaaggaatag

SEQ ID NO: 46769 - DNA, 1815 bp, Glycine max
  Peptide Sequence Number=SeqID_163547
atgccttcgatgatagcaaggaacaacaacaacgttggagggttttttggatcatcttcatcacctttcactcttgcccagccgaacctgatggacgcgttggagatgggtcagaacactcccgagagtgagattcctcgaatccgtgaggatgagttcgacagtgccaccaagtccggtagtgaaaaccatgaaggtgcctccggtgaagaccaagaccctcgtcccaacaaaaagaaacgttaccaccgccacacccaacaccagatccaagaaatggaagcttttttcaaggagtgtccgcacccagatgataagcaaaggaaggaactgagcagggaattagggttagagccattgcaggttaagttttggtttcagaacaagcgtactcagatgaagacacaacacgagcggcacgagaatacaaatcttagaaccgaaaacgagaagcttcgagcagataacatgaggtatagggaggcacttagcaatgcttcgtgtcccaattgtggtggaccaactgctataggagaaatgtcattcgatgaacatcacttgagacttgaaaacgcaaggctaagagaagagattgatcggatttcagcaattgctgcaaagtatgtagggaagcctgtggtgaattattcaaatatttctccttctctccctcctcgtccattagaaattggtgttggtggtgctggttttggaggccaaccagggattggtgtggacatgtatggagctggggatcttcttaggtcaatcagtggacccactgaagctgataagccaataatcatagagctagctgttgcagctatggaggagcttattggaatggcacaaatgggtgagcctctttggttaactacacttgatggcacatccactatgctcaatgaggatgagtacattaggtcttttcctcgaggtattggtccaaaacctagtggcttcaaatgtgaagcttcaagagaaactgctgttgttatcatgaaccatgtcaacctcgttgagattctcatggatgtgaaccaatggtccacagtgttctctggtatagtctcaagagccatgactctagaagtgttatcaacaggggttgccgggaactacaatggtgccttacaagtgatgacagcagaactacaactacctacaccacttgtgccaactcgtgagagttattttgtaaggtattgtaagcaacatggagatgggacttgggctgttgtggatgtttctttggataatttgcgcccaagtccttcagccagatgtagaagaaggccttctggctgcctaattcaagaaatgccaaatggctattcaaaggtcacatgggttgagcatgtggaagtggatgatagaggtgttcacaatctttacaagcagcttgttagctccggacatgcatttggtgcaaaacgtttggtagcaaccttagatcgacaatgtgaaagactcgctagtgccatggcaacaaacattcccactgtagatgttggtgtgataacaaaccaagaagggagaaaaagcatgatgaagctggctgaaagaatggtgataagcttttgtgctggagtgagtgcttccactgctcacacatggacaacactctcagggacaggtgctgatgatgtaagggttatgactcgaaagagtgtggatgaccctggaagaccccctggcattgttctcagtgctgccacttctttttggcttcctgttcctcctaaacgagtctttgacttcctccgtgacgaaaactctaggaatgaggtatgtgcaaaaattccaaaaagctaa

SEQ ID NO: 46770 - DNA, 1767 bp, Glycine max
  Peptide Sequence Number=SeqID_163548
atggttctagttgcaagtcatggcgaggaggaaaaaggggcagaaggcattgctactgttgattttcgaggtcaccctgtggacaagacaaaaactggaggatggctagcagcagggctcatcttaggtactgaattggcagaaagaatatgtgtgatgggtataagcatgaacttagtgacctacttggttggagttttgaatctcccttcagctgattctgccaccatagttaccaatgtcatgggaactctcaaccttcttggccttcttggtggcttcatagctgatgctaaacttggcagatacttaactgttgccatatctgcaatcatagctgctttgggggtgtgtttgttaactgtggctactaccattcctggcatgaggcctcctgtatgcagcagtgtcagaaaacaacaccatgaatgcattcaggccagtggaaaacaattggctttgctatttgtagcactttacacagtagcagtgggtggtggaggaataaaatccaatgtctcaggttttggatcagatcagtttgatacaacagaccccaaggaggaaaggaggatggtgtttttcttcaacaggttctacttcttcatcagcatagggtccttgttctctgtggtggtgctggtgtatgtgcaagacaacataggaagagggtggggttatggaatttcagcagggacaatggtgattgctgttgctgttttgctttgtggcaccccattttatagattcaagaggccacaaggaagccccttaactgttatttggagagtgctgtttttggcttggaagaagaggagccttcctaatccttcacaacactcctttctcaatggttatcttgaagctaaggtcccacatactcagaggttcaggttccttgacaaagctgcaatcctagatgagaactgctcaaaggatgaaaacaaggaaaatccatggatagtttccacagtgactcaggttgaggaggttaaaatggtactcaagctccttcctatttggtctacatgtatcctcttctggacaatctattctcaaatgaacaccttcaccattgagcaagctacattcatgaatcgaaaagttggatctctagttgtcccagcaggatctctatcagcttttctcatcattaccattctcctctttacttccctaaatgagaaactcactgtgcccttagctcggaaactcacggacaatgtccaagggctcacaagtcttcagagggttggaattggactcgttttctccagtgttgccatggcagttgctgcaattgttgagaaagaaaggagggtgaatgcagtaaaaaataatactacaataagtgctttttggctggtccctcaattttttctagtgggtgcaggggaagcatttgcctatgttggacaactagaatttttcattagggaggcaccagagagaatgaaatctatgagcactggacttttcctatctacactttcaatgggttattttgtcagtagcttattggtggcaatcgtggacaaagcaagtaagaaaagatggctaagaagcaatctgaacaagggcaggctagattacttctattggttgctcgcagtgctgggagtacagaatttcatattttttctggtcttagcaatgaggcatcagtacaaagttcagcacagcacaaagcctaatgacagtgcagaaaaagagcttgtgagtgcaaatgatgtgaaagttggagttggtggaaaggaagaagcataa

SEQ ID NO: 46771 - DNA, 1335 bp, Glycine max
  Peptide Sequence Number=SeqID_163549
atggcatacgacggtgatgttgttgagatcaatattgaggagatgctgaagggggcatgggcacccgtaattactgagtgttgcatctacaaagtgccgtttagtatccgaagacacaacgaagaagcctacaccccaaaggttatttctattggcccttttcaccacggccatcctcgcctccgagacatggaggaacacaaaatctattactccaaggcttttctcgaacgatctcaaacaactttggacagttttatcggatggattgatgagatggagcccaagtttcgtcgctgttattcacacactcttgagttcagcaaggagcaactcgtcaaaataatctttgtggattgtgcttttatacttgagctcttctgcagagaccatgatcaaggattgaaccaggacagtctctataatctgtccttccgtttactgaatgatgaccgttcattacttgagcgtacgtttcacttttttcgacatttcaatagatcacaattagacatgggaaatattcaaaaaataagccacttcacagatctgataagaacttttcacttgcaagatcctctgccgtctaggattgatggtaacataataaaacatcttcctagtgccactgagttatcagaagcaggattgaggtttaaggttcttgaaagtgagtcttgtttactaaagttagacttttccggacgggttcttgaaatcccgcagttggtagtggaagatccgactgaaactttgtttcgcaatatggtggcattggagcagtgtcactatcatttccaatcttacattacggactacgtttgttttttagacttccttgtaaacaccaacagagatgtggatatactagttcaagagagagtctttattaattggctaggggacactgattctgtggctatgatgattaatggccttatgaaaaatattacgacatcaaataatatcagttctcaatactttgatgtcagtgaaaagttgaatgcttttcataaaaatccttgtcgtaagttgatatcggctctgagacgagattattgtagaggtccttggcaaactgctgcttccattgctgcaattattcttctcattctctcttttgttcaaacagccctctcccaaagacctgcagctcgccgtcggatcccaccggcggcggaggagagggcaatgccggcggcagcatgctgtacgtggcattggtgggcttgcttccggagcagaggaggatacggtggaggacgcggaggaggaaccgccggagcagggaaacgcggtggtggaaccgtcgccggagggtggaggaacggctga

SEQ ID NO: 46772 - DNA, 1032 bp, Glycine max
  Peptide Sequence Number=SeqID_163550
atgtcaggcgacgaagccaccaccgtctccgccgcagactccccggaaaaagtccaaaccgcgatcgaatccctatcctccatcgtcccctctctctccatcaccacccccacctccctcctctccaaccccgaaatctactcccacatctcctccctccttcggcgccccaactccggtgccggcgacaacaacctctgccggtggctctacgacaccttccaatccggcgtcacggaactccagctcctcgtcctccgcttcctccccgtcatcgccggcgtctacctctcccgcgtcgccgacaggaaaccccaagccggattcgaagccgtcctcttagccctgtacgcgcacgaaacaacctcacgcgccgggcaagccgtgtccgtcacgatccccgacctcgcacaacctagcctctaccacgatccaaaagcgttaacccctaataacaacaagaacattaactccagcaccgaactcaacgtcgctgtggtgtccccttcgcttgagccacacggcaccgtccggtccacacgtagagcccgaatcgtgggcgtggcgctggagctcttctacgccaaaatcccccacatgccggtgtcctcaaagatcgatttttgcgagttttgtaaactgtgggcggggcaagacggtgacatgtacaagaatttggaagaggaggaggataatggagaagaaagtgttgtttttgttgatgctgaggcggagcttgaagagaaggagaaggggaaggtggagtctagggttccgctgccatgggagttgttggaaccggttttgaggattctggggcactgtttgttggggcagaataagagggacgtggagctttttgaggcggcgagtgaggcatgcaggtgcttgtttgccaggagcatgcatgatgttaacgccaaggctattttaccaatcaggagtctcttgaggctttccaaaactcttgtgcaaaataataacgagcttgatcccactgagctacccttcactgatgttatttctctttaa

SEQ ID NO: 46773 - DNA, 2961 bp, Glycine max
  Peptide Sequence Number=SeqID_163551
atgcaacactacatccacccactctcacgctcacgctccttcctcctcccactctgcaaccgctcggagctgcggaaccctaactctctccaaaacgccgtcgtttcgttccctcaccgttcacgcgtttctgtgattcctcaacccctgattttcagcactctaattatttcacgggctttattagcgccacacttagttttcgtcgctcattgtttttggcgatgtaaaatttctgatgatgcctgcaatttaagacaacccatctttctacctgataggattaaaacatgcaactttggctacatacaagtgataagcatgggagaaggaagtgaccatcaagctatggcagacaatggaaatgctgaatctagtgaaggtggagttagtagtgctgaaaacaactctggttctcatgttcgggttggggtttctgagccatatgtgggtagggaatttgattctgaagatgctgcaaaggctttctacattgagtatggcaaacgagtgggtttcagctgcaaagctggcctatatggtggttgttccacagctgatggggcaaatatgtaccgggagtttgtgtgtggcagggaagattcaaaaagaaagcctcctgaaagctgcaatgcaatgattaggatcgagcagaagggtcaaaataagtgggttgttacaaaatttataaaggatcatagccattcccttggtaaccttagtaaggtgcataatattcggccacgtaagcccttttctagtgttggaagaaccatgcctgaaacttaccaaggagtggggcttgttccaagtggtgtgatgtatgtatctatggataagaattgcattcccactaagaatattcagggaattaagaatattcctgcagctgctgctgttgctgaaacaaatcagccagttaaaagtcctacaatgatgaattatgctgttaggccacctagtcgaaagaggacattagggaaggatgctcagaacctgctggagtactttaagaaaatgcaagctgagaaccctggtttcttctatgcaatccaacttgatgaagataatcatatgtctaatgtgttttgggcagatgcaagatcaaggacttcttacagtcattttggtgatgcagttactctggacacaacatacagaataaatcaatatggagtgccatttgctccattcactggggtaaaccatcatggtcagatgattttgtttggctgtgcacttcttttggatgattctgaagcttcttttgtgtggctttttaagacatttctgacagcgatgaatgaccgataccctgtctctatcactactgatcaagacagagccatacagacagccgtttcacaagtttttcctcaaacacgccactgtataagcaaatggcatgtcttgcgagaaggccatgaaaagttggcccatgtatgcaacatgcatccaaattttcagattgaactttataattgtattaatctgacggaaacaattgaggagtttgattcatcttggaattttatcatcaataaatatgaactcacaaaaaatgattggcttcagtccttgtacagtgctcgtgctcaatgggttccagcatattttcgtgattcattttttgcagcaatatctcctaatcaaggatttgatggttcttatttttatggttttgtcaaccaccagacaacattaccactgttctttaggcagtatgaacaagctttggagtgctggtttgaaaaagaattagaatcagattatgagacaatttgtaccacccctgttctgaagacaccttccccgatggagaagcaggctgcgaatctctatacgcggaaaatattttcaaagtttcaagaagagctagttgaaacttttgcttatactgccaacagaattgaagaagatggagaaaatagcatattcagggttgcaaaatttgaggatgaccaaaaggcatatgttgtcacattaaacctttctgagttgagagctaactgtagttgccaaatgtttgagtattcaggcattctttgtagacatgttctaactgtttttactgtgactaatgtacttacattaccatctcattacattttaaaacggtggacaagaaatgcaaaaagcagtgctggatcagttgaacttgctggtgaatcacttggacacgagtctttgacatcacgatatagcaatctttgttgggaagccatcaagtatgctgaagaaggggcattgactgtggaaatttatgatactgcaattagtgctcttagagaaagtggaaagaagatttctttcatgaggagaagtgttgccaaagttgcccctcccagtcatccagccagtgggactgcttatgatgacagaaaatcccctacttcaacagtagatacaaaccctcttttgtggccattgcaggatgaaacaacacagaggtttaatcttaatgatgctagtactcccgttcaatcagttgctgatctaaatttaccgcaaatgaccccagtgtctctccagcgagatgatggtccaccagaaaacatggtggtttatccatgtctgaaatcattgacgtgggtaatggagaacaggaactcaacaccagggaatagagtagctgttatcagtcttaagttgcaagattatagcaggattccttcaacagaatccgaggttaagtttaatctctcaaaagttagcttggaaccattgtttaaccatatggtcaacatcagtgatcagctttccacaccaactaggaagtttgctgtattgaatctcaagcttcccgtcgccgagacaacttctggtgcgagtgaagttaagtttcaggtgtccaaggacacattgggtgctgtactacgatcaatggcctatatccgcgagcaactcttgggtcctggtgatgcacagacagaacctctgtcaaaaaggcctcgaaagtga

SEQ ID NO: 46774 - DNA, 1224 bp, Glycine max
  Peptide Sequence Number=SeqID_163552
atggaacacaaagtagccacaacaactgaaggacaatccataagatgtaaagcggcaatttgtcgcaaagcaggtgaaccactgagtattgaggagatcattgtggcgccaccaatgcctggtgaagctcgcattcgtattatatgctcctctctctgtcaaaccgatatcagttttcggaacatgcaggaccatcctgccatttatccaagaattctgggtcacgaggcaataggggttgtggaaagtgtaggagaggatgtaactgaagttacaaaaggagatgtggttgttccaattttcttacctgattgtggggagtgtatcgattgcaaatcaagcaagagcaacctttgttcaaagtttccatttgaggtgtctccctggatgcctagatatgccacttctagattcacagatttaaaaggagagatcatacatcatttcttgtctgtttctagttttagcgagtacactgtggtcgacattgcccatctaatcaagattgatccggcaataccacccaacagggcatgcctcatcagctgtggtatatcagcagggataggtgctgcttggagagcagcaggtgtggagccagggtctacagtagctatttttgggctggggagtattggattagcagttgctgagggagctagactttgtggagcaactaagattataggtgtggatgtcaacccagaaagatatgaaatcggaaaaaggtttggactcacggactttgtccattctggagaatgtgaaaataaatctgtgagccagattttcttctcatatggggttgtgaagcaggttatcatagagatgactggtgggggagcagattattgctttgaatgtgttggtatggcatcattgatgcacgaggcatatgcttcttgtagaaagcaattgttaaaactaatgctttgcgtacagggttgggggaaaacaatagttttgggagtggacaagccaggatccaagttgaaccttagctgtagtgaggtcctagttagtgggaagagcctcaggggatgtttatttggaggactcaaacctaagtctcatgtacccattctccttaaacgctacatggacaaggaactgaatttggacgagtttgtcacacatgagatggagttcaaggatatcaataaagcttttgatctattgattgaaggacagtgtcttcgatgtgtgatttggatggacaaatga

SEQ ID NO: 46775 - DNA, 1347 bp, Glycine max
  Peptide Sequence Number=SeqID_163553
atggctgcgaaaattcaaactagtttttgtttacctacattttccattccaacctcaaaacctaaaccctacttaaagtcgttcaccatcaaagcctccaaatccatctccggccgcaagctccgagcggcagtgatcggcggcggccccgccggatcctccgcggcggaggccctagcttctggcggagtcgagaccttcctcttcgagcgcaacccgccgtccgtcgcgaaaccatgcggcggcgccatccctctctgcatgctcgaagagttcgacatccctaaccacctcatcgaccgccacgtcacgcacatgcgcatcttctccccttccaacatcgccgtcgacttcggcaaaacactaaaaccccacgagttcatcgccatgctccgccgtgaggtcctcgactccttcctccgctcccgcgcgcacgccgccggcgccaccgcgatctccggcctcgtcaccgccctcgacctccccgcctcgccggacgcgccctacaccgtccactacaccgccaacggctcctcgcgccgctccctcgccgtggacgtcgtgatcggtgccgacggagccaacagccgcgtggccaaagccatcggcgccggcgactacgcctgcgccatcgcgttccaggagcggatcaagttaccggacgagaaaatggcgtactacgaaaatctggcggagatgtacgtaggcgacgacgtatcaccagatttctacgcgtgggtttttcccaagtgcgaccacgtggcagtgggcacgggtacagtgcggtcaaagaaagacattaagctgtaccagcgcgggatcagggaaagagtgaaaccaaagatcaacggtgggaaagtgatcaaagtggaggcgcaccctattccggaacacccgcgtccggttcgggtgaggggacgcgtggcgctcgtaggagacgctgctggctacgtgaccaagtgttcgggtgagggtatttatttcgcggcgaaatcgggtcgcgtgtgcggaaacggtgtcgtaagggcttcggagggtggggataggatgattgacgagtgtgatctgaggagggagtacctgaagccgtgggacgccgagtatgctaacacgtttaggtttttggatctgctgcagagggttttctacggtagtaacgcgtgcagggaggctctggtggagctgtgtggtgatgagtatgttcaacgcatgacgtttgagagctatttgtataagaagttggcccgtgggagagtcttggatcatgctaagcttttcatgaatacccttggcagcttggtcaggtctaaagttgttcaaacaagcatggagagtttcatactatga

SEQ ID NO: 46776 - DNA, 1311 bp, Glycine max
  Peptide Sequence Number=SeqID_163554
atgagaaggtctattgttgttcattctgttcctgaagttctgctaataggcattctcagcatagttcatggacagttcacagacacaccaactaccaatgctcatgtgacgaatagctcacgtgtgtcggcattgtatgtgttaggggattcctcagttgattgtggagacaacactctgttctaccctctgcttcacggtcgactctctttgtatccatgtaacggctctgatgccacccttcttcctcaactacttggtacttctctttatcttttttcttcatcatttggactctgcattcgtgattcaagcaaattggacagaaccactgaaatcccacatgcaggaagttataatttggaaccattgcattcgtgtcaggataaaagaaaactttctttcagtgattcttataagttctgtcaatatcatgctgagaagattggattgacctcaatcaggccattttatggacaaaatggatctctggaggaggttcttggtggtctcaactttgggtcaacacaagctacaatcatgaaccagggaagctacagccatcagtctcttaaccaacaactacgccaagtttctgagactatgcagctgttgcaactgcaactgaatgaggacactgctctccaatttataaaatcctccatctttttcctgtcctttggcaaagaagattatattgaactattcctccataactcttccagttccagcggaatgatgtttcggaacagttcccaatattttgctacaattttggtcaaccaagtcgcaaatgctgcaaggtatctttataatgcaaatgcaaggaaaatcatatgtttgggaattatgcctctgggatgcacacctcgtatggcctgggagttgaatcacacatcagctggagattataatgcaagcagttgtgtggaacatgtcaatgacttggtctttgaatacaatagattgctggatgaacaaataggcaagcttaattcggaattttctgatgctcagatggtgttctgtgatgtttacaatggaatgatggagattatcaacgaaccaaggctttacggttttgaagacgtgaagagtgcatgttgcggacttggtttgaatggtgccatgatagggtgtgtctccatggacatggcctgtgatcaagcttcaactcatgtttggtgggatttgttcaaccctactcaagcagtcaacaaaatcctagctgatgcagcctggtctggccaaccgatacctgatctttgccgtcctatcaccatccatgaattggttaacatgaaagtctag

SEQ ID NO: 46777 - DNA, 171 bp, Glycine max
  Peptide Sequence Number=SeqID_163555
atgacaatgagatgcagatttcactgttctgaaggtcttccttcttcattcttggaaaaggagttctggcatgagatggctcatggagagaaggaaacagtcgacttgagtatagagtcaatgttgagggcagtgccttttcatgagatcctgatgataggcttggaataa

SEQ ID NO: 46778 - DNA, 1023 bp, Glycine max
  Peptide Sequence Number=SeqID_163556
gcgactattccgacgacgcagtcgtggtctctttcctcggaaggggttcgttacgcgattgaatcgttgagtgtgtacaagttcgaggagttgcagaaggctacggggttcttcggcgaagagaacaagatcaagggttctgtttatagggcttctttcaagggtgattatgccgcggtgaagattctcaaaggtgatgtgtcgggtgagattaaccttctcaggaggattaaccacttcaacattataaggttgtcgggtttctgtgtctacaaaggtgacacctatcttgtgtacgagttcgcggagaatgattctcttgaggattggcttcacagtggtagcaagaagtacgagaattctacatctctgagttgggtgcagagggttcatattgctcatgatgttgctgacgcacttaactaccttcataactatactagtcctcctcacgtacacaagaatttgaagagtgggaacgtgcttttggatggcaattttagggctaaagtttcgaatttgggattggcaagagctgtggaggatcacggggatgatggggggtttcaattgacaaggcatgtggtggggactcatgggtacatggcacctgagtacattgagaatggtttgattactccaaagatggatgtttttgcgtttggggttgtgcttttggagcttctttcggggagagaagctgttgttggtggagaccagaatggatctggggagaagatgctgtcggcaactgtgaatcacgtgcttgaaggagagaatgttagagagaaacttagaggtttcatggatccaaatttgagagatgaatatcccttggaactggcttattccatggccgaacttgccaaactctgtgttgctcgtgacctcaatgcaaggccacagatttctgaagctttcatgattttgtctaagattcaatcctccacgttggattgggatccgtctgacgagcttgaacggtctagatctgttggccaaatctctgatagcagcagatag

SEQ ID NO: 46779 - DNA, 1377 bp, Glycine max
  Peptide Sequence Number=SeqID_163557
atgggtatcgatcaacgtcggtggcggtggtggaacgccgtcgtttttatcggaatggtcggcgttaccggttccaacagccaggagaagcagaaacaagtggtgtctcgaattgcctttggatcatgctccaaccagagcgctcctcagcccatttgggatgcagtggttgacttccatccccaagtttttatatggctgggagataacatttatggagacttcaaacgccctttcaaaatatttggacaggaaaggactgttgggccgtggaagaatgttccacgatttgttccttcctctgagcaagaaatgaagactagatatgaaaaagctaagtctaatcctggctatgctcgacttcaacagaatgctgaggttattggtacatgggatgatcatgattatggattaaatgatgcagggaaagaatttcatggcaaaataaccaaccaaaagttgcttcttgatttcttggacgaacctcaagatagcccacggcggaaacaggctggtgtatatgcctcatatatgtatggtcctgtaggtagagatatcaagattgtcctcttagataccagatatcacagagaccctgtaggaagtgatggaaccattttggggaattcacaatggttgtggttggagaaagagctcaagggtccaccaacagctcttaccataattggatcttctattcaggttatatcaaatctttcagcaaccattcgtccattgtttgcaatggaatcatgggctcgttttccaaaggaaagagatcgcctttttaaattaatcgctgatagtaagagggctggagtattttttattagtggagatgttcactttggagaaatcacgagatatgattgtgctttggactatccactatatgatttaacctcaagtggagttacacaatcagttgaggaggttgtcccacatttcttgcgttcttttgtgagatttgtggcatggttgaccccatctacaatgagagttaaggaccaaaactgcagatacaaatcttgtatttatggtcagacaaactttggaactattgaaatagattgggactctcacccagtgactctgaaattcaaagtcagggacaaggatagcatcatggttacaggtgttgatgtttcattaatggaattacaaccatcaaattcagaggttttagacagagcaaaaacagaacataataattcaaaacattgcactcttgaagttagtctgccatggattgtaagacatcgcctggcgatcttgtttttttccgccttatttgtgttgcttgttgtattcgtagtgctagtttacacttgcttcagattttgccgacttgaaagctgcaaaagaaagcacgattga

SEQ ID NO: 46780 - DNA, 258 bp, Glycine max
  Peptide Sequence Number=SeqID_163558
atgatgctggcgtttacttccaaacttcaactccggtgcccattcgagtaccaaacaacttgtatgaaattgataaatgatgacgatgtcaacacaatgttaatgagtaatgatcaattttcttgtgttggtccgattgagttattatgcactgttggaagaacaccagatggaataataaacttacttcaacgcactaggccccgtactcatgacgcgatcctgtattacaacgagaaatggaacatgccaccgtag

SEQ ID NO: 46781 - DNA, 219 bp, Glycine max
  Peptide Sequence Number=SeqID_163559
atggcccacgagcacaaagtagtggacgaatatgcccgagtgtacgcgaaaaaggaggccagaggaaggaaaatggcgtccatgatggatgccatgctaggaatgagacaactaatggaaagtaatgcggccaccgccaccgctgttagttcggctgccgaagcaaacccaacactcccaactaccgcgcaccaccctatcccgaacgtggtgggatga

SEQ ID NO: 46782 - DNA, 480 bp, Glycine max
  Peptide Sequence Number=SeqID_163560
atgattgccaaggcccacacagtaaaccaagccttggacactgccattgcgttgagggacccacacaagatccacgaagccatgcgctactccctccttgccggcggcaagagggtctgccccatgctctgcatcaccacatgcgagctcgtcggtggcacagaggccaccgccatccccgccgcctgcaccgtcgagatgatccacaccatgtcgctcatccacgacaacctgccatgtatggaaaatgatgaccttcgccccgaaaagccgaccaagcacgacgtggcggtcctcaccggcgacgtgctcctcgcattcgcgttcgagcacgtggcagcgtccacggagggagtgtcactgtcacccgtggttcgagcgattgaggagttagcaaaatcggtcggtacggaagggattgcctttatttctaggagatcatttggttatcctttttctctcaaccagatggtccactga

SEQ ID NO: 46783 - DNA, 708 bp, Glycine max
  Peptide Sequence Number=SeqID_163561
atgacacaactcttcaaattcttgtcttttactctcttggtggacttggtgggaggatactatgatgcaggggatcatgtgaaatttggtttaccaatggcattcaccatcacaatgctctcatggagtgccatagagtataggcaacaaattgaagatgcaggtgaactagaacacacaatggaggcaatcaaatggggcactgattatttcatcaaagctcacactagcccaaatgtcctatgggctgaggtgggtgatggtgacactgaccattattgttggcaacggccagaggacatgacaacttcacggcgagcatttaagatagacgagaataaccctggttcagatctggccggagagactgcagcagccatggcagctgcttccattctgttcaggaaaacaaacccacattactctcacttgcttctacatcatgccctgcagttgtttgagttcggggacaagtataggggaaattatgatgctagtgtcggagtggtaaagagctactatgcgtcggtgagtggatacatggatgagttgctgtgggctgccacgtggctgtacaaggccaccgacaacaaaatgtatcttcagtacgttatttccaatgctcatacctttggtgggactggttggtccatttcagaattcatctgggatgttaagtatgctggccttcaactcatggtctctaag

SEQ ID NO: 46784 - DNA, 468 bp, Glycine max
  Peptide Sequence Number=SeqID_163562
atgacatttggaggcaaaggaacgtcatggagccgccacggaagtagtcaaggacaagaagaaagccatccaacaacagatggacgatcaccaacgcaaaagggaggaacgttagtggttttccaatttaccattaaagtcgatgttagctttctaggagatcaacaaagaaggtcagatctcgcggtcaacaaagaacaaacactgaaaggaggtcaatctattcgacatcaatatctaaaacaatatcttgatagtttcagtaaggagatcatccaagaaactaatcaacatggaagagatatgagcgaaggaaaaaaacatgttaaggccgaagaagaagaagttgatcagagacataaggaacaaacaaatgtaaaactagatgatcaccatcacatggtagggcgtttgagctttgaaggacgactcaaagatatgggtgagaaaaacaaaagacacttctaa

SEQ ID NO: 46785 - DNA, 300 bp, Glycine max
  Peptide Sequence Number=SeqID_163563
atgaagagtgcttggaatggaaggagttgtctgtgcttatccatgaagatgaggaagtggagaagatggttgtgtagtagtttgtctgaaaatgatgacatgatagtgttctttaaagcaatgattgtactggcagaaattgagtctttaaaggttagagcactttaccaaaaggggcttgcactggcagaaattgagtctttaaaggttagagctattgggttctttaaagcaatgattgtacattatcaacagttacaatatccattcatgcaaaacagggaaacaccatgtagatga

SEQ ID NO: 46786 - DNA, 117 bp, Glycine max
  Peptide Sequence Number=SeqID_163564
atggcgacggcccaaaaggaaccaagtttgatcatgttgacttgtcaaattaagaatttgccaagtttgggaacagtcgaatgcaaagagagtgagcgtgagcacccattacagtag

SEQ ID NO: 46787 - DNA, 213 bp, Glycine max
  Peptide Sequence Number=SeqID_163565
atggctattcctaggaacttcagattgctggaggagcttgaacgtggtgaaaaaggaattggagatggcacagttagctatggaatggatgatggtgatgacatttacatgcgctcttggactggcacgattattggcccccataatttatcagttgcatgtaagaggctgcccccaaaaaggttaaattggaattttctattccaaagataa

SEQ ID NO: 46788 - DNA, 219 bp, Glycine max
  Peptide Sequence Number=SeqID_163566
atgcctagtggaacacagaatgaaggcgctgccatggctatgaaaatgtcatccaactccaagaaagaaaatcgtaaatgcacacattgtaatggaaccaaccatatcgtggatacttactttaagctacacggttatcctgaatggcacccaaaaggaaaaaattggagtctcccaaggacaactccaccgctgcaactagatttgttgctaagttaa

SEQ ID NO: 46789 - DNA, 1524 bp, Glycine max
  Peptide Sequence Number=SeqID_163567
gcttttgcaaagctgaagttcattgatttgagctattctgaagatctaattcaaactccaatagtttctggggctccatgtcttgaaagaatgcttcttataggttgtataaaccttgttgaggttcacccttcagttggacagcacaagagacttgttgtattgtgcatgaagaactgcaaaaatcttcaaatcatgccaagaaaattggaaatggattctttggaggaattgattctttctggctgctcaaaggttaaaaaactcccagaatttggaaagaatatgaaatctttatcactgcttagtgtggagaattgcataaatcttctttgcctaccaaattctatttgcaatttgaaatctcttagaaaactcaacatttctggctgctcaagattgtcaacactgcctaatggtttgaatgaaaatgagtctttggaggagcttgatgtgagtggcacagctataagagaaattactttatcaaaagttcgtttagaaaaacttaaagagctctcctttggtggaaggaaagaactagcacccaactcacaaaacttgcttctatggatctcaaagtttatgaggcaaccaaatctgaaggagtcaaccatgcctcctctttccagcttacttgccttggtgtccttggatttaagttactgcgaccttaacgatgaatcatttcctagccaccttggttctctatcattgttgcaggatttagatctaagtggtaacaattttgttaacccacctgcccagtgcattattaatctttctatgttgcagaatttgtccttcaatgattgcccaagacttgaatccttgccagtgcttccaccaaatttacaaggcttgtatgcaaataattgtcctaaattgaaaccatttaatttggatgaagaaatgctatggaagatatatgagacacaatcacggcccgaggtttggttcatcataccagggaatgaaattccatgttggtttgacaatcaaaactgccttgcaattgattcatcacatcatccatatgacaagttgggttgtgattcagttacatcaataacagtggatgtacctaaggattgccagttaagtaaatggtggggaattgcagtatgcctagtattagaaccttcaaatatggaggaggaggactcatctcgatcttatgtgagaccaacttctacaggaaatgaggaaatgtgcatttattattgggtctgtaaagctcctgatcgagaccctgacccaaagtttcctatagcatccaagtttggacacttggtttacaaactcaatgacccttacatccatattatattcttgagtgctgatcatgaaaaaattgaagaatggcgcaagcactcagatggtcttaatatatcaagattaacagaagtgaatgatgatgaggaatttcgtcgtgaattggtggtggaagagcctacttctccaaatacattctcttcaacggacaaaacagcagtaaacactgcccttggtaaaatgatctga

SEQ ID NO: 46790 - DNA, 3123 bp, Glycine max
  Peptide Sequence Number=SeqID_163568
atggcactacataatgcggcaagcagaacaatcatttgtgagcattcctcacttacctcagaggccaacatgatgatgtccacaaagcttgtatcgtttcagttgattattatattcactttcttctgttcacttttaaggctctcttatttggaagtttctggcatttcttttgccaatgctactgttatggttggctatgaagctgcagaagatgaagacattgaagcaataagtgctctattgaagtggaaagccaaccttgataaccaaagccaggctttcttgtcttcttggtccacctttacttgcccttgcaagtggaaaggaattgtttgtgatgaatccaactctgtcagcactgtaaatgtttcaaattttggactaaaaggtacacttctcagtctaaactttccgtcatttcataagctcctcaatctggatgtaagtcacaacttcttctatggatctattccccaccaaattggtaacatgtccagaatttctcagttgaaaatggatcataatctttttaatggtttcatcccgccaacaattggtatgttgacaaatcttgttatacttgatttgtcatccaacaatctctctggtgcaatcccttcaactattagaaacttgacaaatttggaacaacttatcctctttaaaaacattctctcaggccctattcctgaggagttgggaagacttcattctctcacaataatcaaattgctaaaaaatgatttttctgggtcaatcccatcttccataggagacttggctaatttgagaacacttcaactcagtcgtaataaacttcatggatcaattccttccactcttggaaacttgacaaacctcaatgaattgtccatgtctagaaacaagctttctggatcaattccagcttccgttggaaacttggtctatctacagaagcttcaccttgcagaaaatgaactttctgggcctattccatctaccttcagaaatttgacaaatctcaccttcctattacttcatatgaacaaccttagtggtagtttttcaacagcaataagtaaccttaccaatttaataaacttacaactaagctcgaatcatttcactggccctttgcctcaacatatttttggagggtcacttttatattttgctgccaataagaatcatttcattggtccaattccaacaagtttgaagaactgctccagccttgttaggctcaaccttgcagaaaatatgttgaccggaaatatttcaaatgattttggtgtatatccaaatttgaactacattgatctgagtagcaattgcctttatggccacctttcatcaaattgggccaaaagccatgatctcataggcctaatgatttcatacaatagtttatccggtgctatacccccagagctaggtcaggcacctaagttacaaaagcttgaactgtcttcaaatcatctaacaggaaaaattccaaaagaacttggcaacttgacctccttgactcaactctccataagtaacaacaaactttcaggcaacattcccatagaaataggatctttaaagcaacttcatcgcttggatcttgcaacaaatgatttaagtggctcaatcccaaaacagctcggagggttgctcagtttaattcacttaaacttaagccataacaaattcatggaaagcattccctctgaatttagccaattgcaatttcttcaagatcttgatcttagtggaaattttttaaatggaaaaattccagcagcacttggaaaattgaaggtattggaaatgttgaacctctcccacaacagtctctctggatccattccttgtaattttaagcatatgttgagcttgacaaatgttgacatatctaacaaccaattagagggtgcaattccaaacagtccagccttccttaaggcaccatttgaagcattggaaaaaaacaaacgcttgtgtggtaatgcttcagggttggaaccttgtccattgagtcacaatcctaatggtgaaaagagaaaggtcataatgttggcactattcattagtttgggtgcactattgctaatagtgtttgtgattggagtttcattatatattcattggcaaagagcaagaaaaataaaaaagcaggacacggaagaacaaattcaagatcttttttccatatggcattatgatggaaaaatagtgtacgaaaatataatcgaagcaacaaatgattttgatgacaaatatctcattggagaaggggggtttggatgtgtttacaaggctatcttgccctctggccagattgttgctgtgaaaaaacttgaggctgaagtggacaatgaagtgcgtaattttaaggcttttacaagtgaagttcaggccttgacagaaatcaaacatcgtcacattgtgaagttgtatggattttgtgcgcatcggcattattgttttttggtttatgagttcctagaaggtggcagcttggataaagtcctaaacaacgacacacatgcagtgaagtttgattggaataagagggttaacgttgttaaaggtgtggcaaatgctttgtatcatatgcatcatggttgctctcctcctattgttcatcgcgacatatcaagcaagaatgttcttatagatttggaatttgaagctcgcatctctgactttggaacagcaaagattctaaatcataattcacgcaatttgagttcgtttgcaggcacttatggatatgctgcaccagagcttgcttatactatggaagtgaatgagaaatgtgatgtcttcagttttggggtcctttgtttggaaataataatgggaaatcatccaggcgatctcatttcttcaatgtgttcaccctcttcaagaccagtaacatctaatttgctattgaaggatgtgctggaccaaagacttcctcttccaatgatgccagttgctaaggtggtggtcttgattgcaaaagtggcatttgcttgtttgaatgaacgaccactttctcgcccaaccatggaagatgtgtacaacatgtttgtgatgcataaatcacctttaatgaaggagacattagacaccattgcacttggacaacttcaaaatcattga

SEQ ID NO: 46791 - DNA, 1647 bp, Glycine max
  Peptide Sequence Number=SeqID_163569
atgctgggaacaagtgtgatgattccatcatggattgttcatgccatgggaggaagtgatggtgacaaggcacgggtaatacaggctctgctctttgtagctggcattaacacacttctccaaacgctttttggaaccagattgcctacagtagttggaggaggttcatctgcgtatatatatcctattgcttatattatcactgactcatccttgcaacaaattagtgactctcatgaattgttgtcaaagctttccaccacgtctctcagctgcaaacaagcgacacaggtagtggcatcagcattgcagtgttgttcttggactagtcaaaggactagtacactgcaagcccgaatgggtgctgggactgtggagtgtggtgtgatgttaggatccaattgcaagatatgggacttgagtcctacattggaaagatttatacagacaatgcgagcaatacaaggagctttgattgtagcatcaagtattcagataatcctgggttacagccaagtctggggactcttttcaagatttttcagtccccttggcatggcacctgtagttggattggttggattaggattatttcaacgtggattccctgtgttgggggactgtgtagaaattggtataccaatgctgttgttagtaattggtttgtcacaatatctaaagcacgtgagaccatttagagatatccctatctttgaacgatttccagtgttgatttgtgtcccatttgtttggatctatgctgttatcttgactgccggtggagcttaccgacacaagtctgacataacacaacatagttgtcgaacagacagagcaaatctgatatcaactgccccatggttcatgttcccatatcctttccaatggggtccacctacattttccgctggccattcatttgctatgatgtcggcagttattgtctcaatggtggagtcaactggtgcatacatggcggcctctcggctagcaattgctactccacctcctgcttatgtattgagtcgaggcattggctggcaggggattggcgtcttacttgatggtctttatggaacagtgattggttccactgtttctgtggaaaatgtgggactccttggactaacccgagttggaagtcgcagagttgttcagatttctgctggctttatgatattcttctctattttaggaaaatttggagctgtgtttgcttcaatacccttcccaatatttgctgcactgtactgtattctctttggccttgtggcttcaattggaatatcatttcttcagttcacaaacatgaactccatgagaaatcttattatcatcgggctcacacttttccttggaatatctgttcctcaatttttcaatcaatactggactctttcacgacatggccttgttcatactaatgctggatggtttaatgcattcttaaataccttattctcctcacctccaacagtgggtttgatagtggcagtgttgcttgacaacactcttgaggtagaaaggtcaaagaaagatcgagggatgccatggtgggtgaaatttagaacattcaaaggagataatagaaacgaagaattctatactttgccattcaatctcaatagattcttcccacctacttga

SEQ ID NO: 46792 - DNA, 1485 bp, Glycine max
  Peptide Sequence Number=SeqID_163570
atgtttgaggtatcactagccgacaatgaactttctggcaacattcctacaaaaataggagctttgtccagccttgaaaatctggagcttgcaccaaataatatgggtggaccaattccaaatcaggtgggagcattactcaatttagttcacttgaacttgagcaagaataatttcacagaaagcattcctgatagcacgcagcagcatcacctctctccacagcactctcgaccccaacgagagaccaacaagccagcttatttacgtgactacgtagatgcttgtcggctttgcttttgtgcacgtagtgcatatgtaatagaagttcttgatcttagttggaatttgttaaatggagaaataccagcagcacttgcgactatgcaaagattggaaacactaaatctctggcacaacaatctctctggagccattccatctaattttaaggatatggttagtttgaccagtcttaacatatctaacaaccaattggagggttcatatcctaataatccaggctttcttaaggctccatttgatgcattgaaaaacaacaaaggcttgtgtggaaatgcctccggtttggtgtcttgtccagagttgagtcacaaccctcatggtaaaatgagaagtgtcatcatggcaacaaaggccaaaaaggaggaggttaaagaagaaaaaactcaggatcattattccttgtggagttatggtggaaaaatagtatatgaaaatatcattgaagccacagaggactttgatgacaaatctcattggagaaggagggactgcatctgtttaaaaattaaaacttcgtaccccattgtccagaggctcttcgctatgcgaaggtatgggggagggatattgtacgcagccttacccttgcatatgcaaagaggctgtttccggattcgaacccatgaccaacaagtcaccaaggcacaactttaccgctgcaccaggactgcatctgtttataaggaaaaattacccaccggacagattgttgctgtgaaaaaacttcatgctgcacccaacgaagaaacacttgatttgaaggctttacaactgagagggggcagtttggatgaagtactaaacaatgtacgcgtgcaacaatatttgattgggaaaggaggggaagagaatgagaaatgtgatgtcttcagttttggagtgctttgtttggaaataatgatgggaaagcatccaggagatctcatctcttcattattttcaggatcagcgtctaatttgctattaaaggatgtgttggaccaacgactacctcatccagagaagccagatgttgaggaggtgatcttgattgcgaaaatagcatttgcttgcttaactgaaattaagtccatggttttaagcccaaaaaggagagattacaatggtactaaacgaggcacagacactccatcagcatctgcttgcaacaagaggctaaggaaagccgagggttgctga

SEQ ID NO: 46793 - DNA, 198 bp, Glycine max
  Peptide Sequence Number=SeqID_163571
atgttgcctgaggataatgtcgattcgacaagtgattggttaccttttaattttatgatatctaccagcacaatcaacctgaaagtgtcatgcatcccttactccgtggcttgcttcagcgcgatgctagtgttctactattccctcctaaatccacctcctgaacctcctagtactcaacattttcacgttatgtga

SEQ ID NO: 46794 - DNA, 1572 bp, Glycine max
  Peptide Sequence Number=SeqID_163572
atgaatttaataataaaaacatggaaatcgcgatctaagaaacacactctctgcacaccacattcccagaaacatcctcaacaacacatccgaaaacaaacacaaaacgcaaaaccagagcctctctctctctctcgctctgtttctctccacagaagcagagaatgcatcgcttcatcgtcctcaccattctcctctccctcaccctcgcaggcaatgctcacctctacaaatggaggttccattggagttaactacggtcgaatagcgaacaaccttccctccgcggttaaggtcgttcacctcctcaaatcgcaaggactgacacgtgtcaaagtctacgacaccgacccagcagtgctccgggcactatccggatccggaatcagagtgacggttgatcttccaaaccagcaactcttcgcagcagccaaagctccctcctttgcatcctcatgggtcgaaaggaacgtcgccgcatactacccacacacccaaatcgaagccattgcggtcggcaacgaggttttcgtggacccacacaacaccaccaagttcctcgtacccgccatgaagaacatccaaaaagccctcaccaaacacaacctcgacaaagacattaaggtttcctcccccattgcactttccgcactagcaaactcttacccttcctccgccgggtcgttccgacccgaacttgttgaacccgttttcaagcccatgctagacttcctccgcgaaaccgggtcataccttatggttaacgtgtacccgttcttcgcgtatgagtccaacgctgacgtcatctctttagactacgctctgttccgtgataaccccggagtggtggatcccggtaacgggttgagatattataacctatttgacgcccaaattgacgccgttttctccgcgctaagtgctttgaaatacgacgacgttaagatcgtggttaccgaaacaggttggccttctaagggagatagtaatgaggtgggtgcgagtgtagacaacgctgctgcgtacaacgggaatctcgtccgtaagatcttgaccgctggtgggacccctctcaggcccaaagcggatctcatcgtttttctgttcgcgctttttaatgagaaccagaagcccgggcctacttccgagagaaactttgggcttttctaccctgacgagaggagggtttacaatgttccgttaacgacggaggaactcaaggactaccacgatcgtccggcgccggtgagcggcggcggacagcagaagggaacgccggcgccggcgccggttgtgagcggcggggtctccaagagtaccactggaaacacgtggtgcgttgcaaacccggatgcggataaggttaagctgcaggcggctctagatttcgcttgtggtgagggaggtgctgattgccgtccgattcagcgcggttccacgtgttacgatcctaacacgcttgtggcccacgcttctttcgcgttcaacagttattaccagaagcagtcgcgcaagggtggtagctgctatttcgggggtacgtcgtacgttgtcacgcaggagccgatttag

SEQ ID NO: 46795 - DNA, 777 bp, Glycine max
  Peptide Sequence Number=SeqID_163573
atggatgacacatcgtccaatagagagacaaaagaagaagcaaattttgcttacaaaagcctaaggaaagattttaaaaacctttctaaagaccataccgagcttaagaaggctcatcaagatatcattctcttaactgaacctaatcaagacaaaaaagactatgataccttgaaagaaaaggaatcacaacttttactggaaaatgataatctctcaaaagaacgtgatacattgatggaaaactttaagatcttagaagaaatggttcagtctttgcaaacagagatgaaacaattaaatgaacttcaggatcatcttgaagaagaaaggtatgatctatggaaagaatgttcacaatcactccatgattatgaaaacttgggaataagtaaacataatctatgggttaaatgtgaaaattacaagaaaactccaaagtttctaaatgataagcttgagaagaatgataatctcaagggacaacctcaagatgtgacaaaacttcatcaagagattgaatccttaagagagactatttccaaatttgttggaagcattgagaatattgacaaattgttaagatacaacatatttccttcaaacaaatttgaatatggatataagagaaacacatgtgttcatgataaggagacaaccatatgttatttatatggaaaaattagacatataacttccaagtgtagaaatcttcttaagactaggtcgtccaattctttcaaatctaacaagaaaaggcccaaaaggatttggtaa

SEQ ID NO: 46796 - DNA, 1670 bp, Glycine max
  Peptide Sequence Number=SeqID_163574
atgttacgtggagaatcttcctcaaactcttggcgatggacataccatgttttcttgagttttagaggagaagacacccgtttagattttacagatcacttgtacgctgcgttggtgcgaaagggaatcatagcttttcgagatgacaaacaactcgagaaaggagatgcgattgcagaagaactccctaaagcaattgaggagtcccttggtgccatagtcattctctctgagaactatgcttcttcctcttggtgtttggatgagctcaacaaaattcttgaatcaaatagagttctggggagggaagtttttcctgtcttctatggggttagtcctggtgaggttcaacaccagaagacccagagtttttatgaggcttttaagaaacatgaaagaagatctgggaaagacacagaaaaggtgcaaaaatggagagattccttgaaggaacttggccaaattcctggttgggagtccaaacattatcagcatcaaacagagctcattgaaaatattgttgaatcggtatggacaaaacttcgtcctaaaatgccatctttcaatgatgggctaattggaattggctctagagttaagaaaatggattcacttctaagcatagaatcggaggacgttcgctttatcggaatatggggcatgggtggcattggaaagacaacagtagcgagagttgtcttccagaaaatcaaggatcagtttgatgttagctgcttccttgacaacgttagagagatttctagagaaaccaatggcatgcttcgcttgcaaacaaaacttctgtctcatttggcaataaaaggcttagaaattatcgatttggacgaaggaaagaacacaataataaaccttttatccgagaagaaagttttacttgtccttgatgatgttgatgacactagccaactaggtaatttggctaagagggtagaatggtttggacgtgggagcagagttataatcacaacaagagacacacaagtattaatatcacatggagtagttgaaaattacaacattgagttcttaaattcggatgaatcccttcaactcttgagtcagaaagccttcaaaagagatgaacctctagagcattatttggagttgtcaaaagttgtagccaaacatgctggaggccttcctttggccttggagcttttaggttcatttctttgtggaagaagtgaattccaatggagagaagttgtggatatgataaaagaagtctctgccagtcatattgtgatgaaatcgcttagaataagctacaatgggttaccacgatgtcataaagctttgtttcttgatattgcatgcttcttcaaagggagggtaaaagagcttgcaacacaaactctagaaatttgtgaccgctatccagcagttggaattgaacttctagttgaaaaatcattggcaacttacgatggctttactatagggatgcatgacttgcttcaagaaacagcaagggaaattgttatagaagaatctcatgtagatgctggaaaacgtagtaggttatggtctctagaggacacaaatcaagtattaaaatacagtagggaaaatgaatcgattgaaggcatagctttgaactcacccgaaaaggacgaagcaaactgggatcctgaagcattctcaaggat

SEQ ID NO: 46797 - DNA, 408 bp, Glycine max
  Peptide Sequence Number=SeqID_163575
atgtactatgagggatgggagaaagcctacaactctcacgtccctagagccctctacgcaaaaaatgctgacaaggtgaacatgctcaacaaaagcatcctccacaaggttagttcaaaaactacactccctgatttacaaaattttttgctattccaccttatggaaaacctgcaatttgacctatcaaacaccatctacatcaacattgtctgcattctgagaaacttgagaggaatggacgacatctactatattgttctcataaacaagatattatgggatcaaggtgtttaccatgtatttaataagctgaacgatgaatctaagcataacatcatggtcaaaggttctattgtgttcaacaaaacaaacctgaaagcaataaagataacgatggaggagtag

SEQ ID NO: 46798 - DNA, 1539 bp, Glycine max
  Peptide Sequence Number=SeqID_163576
atgacaccgaaaagctatgcacagtgcagcgcattaaccaagtcaagtttatacctagagctagctccaatggcagcagggaagaaggggcacatcgtgatgatacctttcatggcacaaggccacatcatcccattcctcgcattagcaaggcaaatccaacagagaacaacaagcttcaccatcaccatagccaacacacccctcaacattcaatacctacgatcttcactttcttctcccaatgaaatccatcttgctgagttacccttcaactccacccaacacggtttgccacccaacatagagaacaccgagaagctccctctcactcacatagcaaaactcttcctttcaacactcagcctcgaagctcctcttcgctccttgatatcacagatcacagaacaagagggtcaccctccactttgcattatatctgacgtgttccttggctgggttaacaacgttgcaaagactttaggtattaggaacctaagcttcaccacttgtggtgcttatggaactttggcctatatttctatctggtccaacctacctcataggaaaacagactctgatgagttccatgttccggggttccctcaaaactacaaattccaccgcacccaattgcataaatttctaagagcagctgatggcactgatgagtggtcacagtttttcattccacagattgcactttctatcaagtctgatgggtggatttgcaacacggttgaggagattgagcctttggggttgcatcttctgaggaactatcttcaacttcccgtttggaatgtggggcctctcttgccacctgtttcactcagtggctctaaacatcgtgcaggaaaggaacctggcatagcccttgaagcatgtatggagtggctggatttgaaagatgagaattctgttgtctacatttcatttgggtcacagaacactatcagtgcctcccaaatgatggcattggcggaggggttggaagagagtgggatatcgtttatttgggttataaggccaccttttggttttgacattaatagagagttcattgcagaatggttgccaaaagggtttgaagagagaatgagggacaccaaacgtggccttttggtgaacaaatggggaccccagttggagattctgtcacacagttccacaggagcatttctaagccattgtggatggaactctgtgttggagagtctcagctatggggtgcctatgattgggtggccactagctgctgaacaagcatacaatgtgaagatgttggtggaggaaatgggtgtggctattgagctcactcgaactgtggaaactgtgatctctggggagcaggttaagaaggttatagaaatagctatggagcaagaagggaagggaaaggagatgaaggagaaggcgaatgagattgcagctcacatgagagaggccataacagagaaaggtaaagaaaaggggtcttctgtgagagcaatggatgatcttgttacaaccattttatcacccaacaaggctgtatga

SEQ ID NO: 46799 - DNA, 327 bp, Glycine max
  Peptide Sequence Number=SeqID_163577
tttggaggccttctgaccgctggtatcttggccttctctgggacggtgagccattgccacattgatgttgaggatgaagagtttatttcattgtcttggttgcacgtatacaagctaggttgggtatcacagatattgtctgaagtattaggtataattgcttttactaaatcaaagtctgggtccaaactctataaaaatcaaatcactaacttcagagtctgggatgtcaaccaagggatggttaacctggtgcttcagaagatgagcagggcacctgctatcttcacagagttatgctcaaattatatcatatcaaatggttga

SEQ ID NO: 46800 - DNA, 536 bp, Glycine max
  Peptide Sequence Number=SeqID_163578
atggcctccttcagggacctcacaaggctcttgaacggcctctccctaatcgccaacgaattcgcgaaacgctctttgcctgccacaacctctgatttcgaaaccctaatcaagaaaactctcgtctccgccaccgacctctccggcatcaccaggggaaaggttcgccacttccccgatactcctccctcctctaacaccacacaacacgaccacgctgctgcgtctagttccgttgtttttttcgccgacgacaatccttcttctcaatctcattccactccggcaacaacaactgtaacaaacattgatgatgttgcctattcttcttccgacgcaaatcaccggcaagcttccgatgcaaatgtttgtgctgcggaggaggagaaaagtgaggttgtgacctctgctgaaacggttaatcaaggtgcgagtagggaattggcaccggcaccggaacctccgccgtcgccgttgaggaaacgaaggccgagggagaggaaggttcctgcaactcctttttctagggctcttgg

SEQ ID NO: 46801 - DNA, 507 bp, Glycine max
  Peptide Sequence Number=SeqID_163579
atggacgaagagggtggttcaagagtaaaagccaataaggatgaagatcaagagcatgttaagtacagaggggtacgtaggaggccatggggaaaatttgcagcagagattcgtgactcaatgagacaaggtcaaaggttgtggcttggaacattcaacactgcagaggaagcagctagagcctatgatagagctgcgtatgccatgagaggtccctttgcagtcctcaatttccctaatgaatacccccctttagcaattggtgcttcctcttcttcttcttcttcttcttcttcttcttcttcttcttcttcttcttcttcttcttcttcttcttcttcctccaatgcttcttcggcttcggctttggcttcaccctcttcaagtcatgtggaaggaagtggaaggagtgagcaagcaaaccaagtgattgagtttgagtactttgatgacaagttgttggaggagcttcttggttacgaagacaaaaataaacctgacaagtga

SEQ ID NO: 46802 - DNA, 927 bp, Glycine max
  Peptide Sequence Number=SeqID_163580
atgtgtgtggagattattggaagggaaaatgagaggatgtatttggcgagtcgaaagaacaaacacggggagacacctctctttcaagctgctataaacggcaggaaagaggcctttgcttatctctctaacatctccgacaacagcgcccccttgcaagatcttgtaggaaacgatggggacactattcttcattgcgctatcaggaatgaatatttcgatttggctgtcataatattgcattattatgatttccttagcatatttatgaataaggatggagagtatcctctccatgtccttgctactagaccctccgcctttaaaagttcaacctatctttcattctgggagcgaatcctctacccctgtatacatgtggaacaactggacgctagaagctcaatggaagcccttttagaaaagacgaagaatcatcataattctgatgaagtgaattatccaaagaactacaccgtgttaattgctgtgtttacactactaaaagaccagttttttacaattctatgcggtataggcaaactacgtatgcaaaggaagaatcaaggtgacctagaaaacctctcaaatagaattggattaggtactcggcaggttggatttttgccaccaaatcatcaaaccattctccaatttgtcaagtatcattttgtattgatactagggcttttaggacaagacataaaggaagtaaggaatacaaaaaagaagcatgaatgtagtcgtcaagtctttaaagcactaatgcaaagagctgatgaagcattgacgggaagcgggggtgtaccgactgatgtagaaattgatccggatatgtataatgtttatagccagtggcagcaagacgatacagggtacaagggatacccaacccatacaaatcgtgcaaatgatacagttctgtga

SEQ ID NO: 46803 - DNA, 2301 bp, Glycine max
  Peptide Sequence Number=SeqID_163581
atgaatcctagaggtttggagggagcaggaagaggaagaggaagaggaagagtcacaacccttctgattaagtgcacgttggcaggtaaatgggaaggggttatcgacatgtaccgtaatttcccaacgtgtcagatcacaaagatcaccgagtccctgggcactgcactgcacgtggccgtagacatgaacaaagaagatgcggttgaagccctcgtgaaccaaatcatcgaacatctccatcatgcagaaaccaatcctctggaagtgaagaacaagagcggtgacacccctctacatgttgcggcatcgagggggttcgccaaaatatgtaagataatcattggaaagcataatgagaggaagagtttggtgagtcaaagaaacaaccgtggggagacacctctctttcaagctgttatcaacggccacagccaggcattttgctatctgtctagcatttcccacgacaacatggcagatcttgtgcgagacaacaaagatactattcttcactgtgctatcagcaacgaatatttcggtatacttgtagaaccacgtctggacgttgaaaggcaaatagaggcgaatttggcagagatggataagcctacagagtctgatgaactgaattatccaaagaactacgccacattatatgaattctttgctcgatcgttgagtctcgctattggcaaaatgtcttggcaaaacaaacaggttgacacagaaaacccaccaatcaatgaacagtttggatttggacttttgccacctaattataacacctttcaacagtttgttaggtctggatttgtacatattcttggcctttcaggatcgggagtggacataaacgaagtaaagaagacaaaagagaggcatcaatggggttatcaactctttgaggagctaatgatgaaaatgattgcagaaggggatttactgcctgatagggaatttgacccagccatatttaatatgtatagcgaatacacaccagaacaaggagaatgtagccactcacaagagttggaagaagaaacaagaccacaggttgatggcaacacagatactttaagtcaaaatgacacaaagaatgaaactgatcaacattttgatgagcagaacattgtcataataagaagagaaatcactcgctcggaagtgttggaagaaaaaagaaaaccaaaggttgatggcagaatagaaactctatgtcaaagtgaagcaaggaaggaagttgaacaacatgctgatgagaagaacattttcataataagaagagaaaccaaatgcttggaattgttggaagaagaaagaaaaccaaaagcaaaaacttcaagtgacatactagatgatgacacagttttggttgcagcaagaaatggcatagttgaaatagtgaatgaaattttaactcaatttataagtgtcttctatacaactaactcacaggaagaaaatattttgcttgtcgcagtgaggaacaagaaacctcttgtagttgaaaatttgagaaagaaatttcaaaaggaatacccagaagtttggaataccttaactctggcagtaaacaaggatgggaagaccatgttgcacatggcagcatatgcttcagaagagtataagccttggcaaatatctggttccgccttacagttgatgtgggacgtaaattggtttcagcagtatattaagagccttgtgccagaacactatcatcttagaagcgacaagaacaatcaaaccgcagatgaaatcttcaaggaagaacataaagaacttaggaaggagagtagcgagtggctgaaggagacatctgaatcttgctctgttgtggctgcccttgttgccggtgtttcctttgctacggcagccaccatccccggtggcaacgacgataaagggtatcctcatctagaagacaagcctgcattccacgcatttgttatttcttcagtagttggacttggcttctcactcactggactcattatgttcctcactatactcacttctcgaaagctataccgagcgtttcgcatagatttgccactcaaacttcttcttggcttaagttctcttttcgtatccattgttgcattgattctttctttctgcaccagccattcttttctgttcactcacaaatacaagacagttatattccccatttatgtagccacttgtttacctgtcactttctatgccgtagctcagttgccactctacttagatcttctaacattcattttatttaaggtgccaaaggcaactagtgaaggagacagtttatag

SEQ ID NO: 46804 - DNA, 141 bp, Glycine max
  Peptide Sequence Number=SeqID_163582
atgggtaagactagaggaagtggtccaaatcgactcccaagatctaagggcacatgcacaaaaaaggaccactggacactggtggatctaacactatgtactctgtatttgtgcaaatgcgaggtaggctacatggcctaa

SEQ ID NO: 46805 - DNA, 543 bp, Glycine max
  Peptide Sequence Number=SeqID_163583
atgaaattccaagatttggctgtgataatagtgcattattatgattttcttagcacacgcataagaataaagagggactcactcctctcacagtccttgccactaaggccttcggccttcagaagtgctagcaaactttcatggtggaagcaaatcttgtaccactgtatacttgtagaaccactggatactgaaagacaaatgaaggaaaatttggcaaagatggagaagcaaccagaatctgacaaattgaattatccaaaggactacgccacattatatgatttctttgctggatcgtcaagtgttactgctctaattggaaaaatgcctacgaaaaacatcgatcattctctgcaagctgctgcattagatggaatatatatggagcaaaacatattaatttttctgttttatctctttttctcacttttgctcagtcagaaagtgacacagctagctagcagcgaatcaacagttccagaaaaggaagaagataacggaagtcgtgttgcacgacatgatagcttgctagctagctaa

SEQ ID NO: 46806 - DNA, 360 bp, Glycine max
  Peptide Sequence Number=SeqID_163584
atgaaggttggacacaccattgcttgctttgatgacaaacatactttagaggagccttatccagttgtacttccagtgatagagctaccttacattttatctactctcttagcttggactttcactggtcttctctacatatgcccagacaaacctcctaagatgtcatcaccagtcaggcatgcatccttccttcaaatggtcaagatcctggctgcattagaaattgttcgtcaaggtgcagatgtgatgccaaagagccagcttaatcaagttttaaatgctgaattaggtcctggctggtcatcaaaattaattagttttgattatgaacctatagctgctgcaagtattggccag

SEQ ID NO: 46807 - DNA, 295 bp, Glycine max
  Peptide Sequence Number=SeqID_163585
gggtttggatcccttagcccctctcttcttttcactgagtgatatgccttcaaatttatcagtggccaaagaagaattatctcgcgagtgtgattacaagttggaggcagcaaatcagaagcggttccgagatcttcttactggcacagacggattttatgttccaatagttgtggataatatttcaagcaaaagagtattaactactgagcttgttcgtgctgcagctgcatttgacatcctgtttagatggcaatgctctcaatatgtagtattatttgcatggaagatatag

SEQ ID NO: 46808 - DNA, 228 bp, Glycine max
  Peptide Sequence Number=SeqID_163586
atggaaaaagtgtttccagcgcaaaaagaaataaataaaagtgtgttggaaaaaaaacggaggcaagaggaaatcgacatagttgtgccaggaggggcttttgacaacgatctagttgtcgaagtcaaagttgaagatgcaaaagggggcagaggagtgagggtccaagaagtgcaatgggggatatcaatgggagggagagtgttgttccatggaattggatggtga

SEQ ID NO: 46809 - DNA, 323 bp, Glycine max
  Peptide Sequence Number=SeqID_163587
gcttatccatcgaaggagatgatgaattttccgatggcaaagagttcttgtattcctctgatgaaaaggagttgagtagaccttatcctttgccagctacacccccacgtggcaatgaggctcgaaacacaaaggaaaaggaagtgaaggcttgtagagataccctctcctctttctccaattccacacttgacactagtagtggtgttacttcaccaatttgctgcatctctagtcccggtgatgatccaaaagatgtaaaggctcggctcaagctgtgggcacaggcagtagcagcatctgcatccagatacggcacttaa

SEQ ID NO: 46810 - DNA, 426 bp, Glycine max
  Peptide Sequence Number=SeqID_163588
atggagatgatgagagcgaaccacaggctaaaaactaccacgttgaagtcagcaacattgcaagaagaagcaattactaattacaaacaagcattgcggaatcataaaatagacggagatgatgatgagagagaaggaacgaaccttgtcgagcaacaagttagggaagaggttggtgttggtgaggtagtcgccgcagcaagggcaatcgctcttgttgcggaggtgcgtgatgatgcacatgtagcagaagctgtggccgcacgcggtgaggaacgggtccttgatgatctgcatgcaaatcggacagaggaagtccttgtccggctccgacgtggaggccgggaacgtgccgccggaggcagcggcggaggcgcctttggacggttcaggtttgacgacggcggggacgagaggccccgctga

SEQ ID NO: 46811 - DNA, 222 bp, Glycine max
  Peptide Sequence Number=SeqID_163589
atgacaccaatgctaccaaaaactggctcaaccctcctcaattggatctccttaaatagcaaggcaaagaaagaccaagaactcgccaagaaagatattgaactccaggtaaaggattggataatccaagagctcaaggacaagattgaaaaaaagaaccgcaagattcaaaggagggacaaaaggatttcaagacaagatgaaagcattcaaaagttgtag

SEQ ID NO: 46812 - DNA, 1323 bp, Glycine max
  Peptide Sequence Number=SeqID_163590
atgcagtatgctattgtggattacctctggtataggagtctcaagggtgatagcaattctcttggttttgatatgattgataaatggggaagaatgctccctgaccctgaaagatggccttcttcaagaggagggggagggttcactgaagtagccaataaagtacatagtatgggtttaaagtttgggattcatctaatggctggaatcagtacacaggcatacaataagaacacgccaatactagatacggcaacgggacaaccttacatggaatctggtcgagtgtggaacgcaaaagacataggaatcccatcaagggcttgtaaatggatgactaatggtttcatggctataaatgcaaaaacaggagctggaaaagcctttttaagatcaatttatgagctgtatgcttcatggggagttgattttgtaaaacttgactgtgtgtttggtgaggacttggatttggatgaaataacatttgtatcagagtttttcaatggccttgagcgccccattgttttttctctgtctcctggagtcagtgcaacaccactaatggctaactcggttagtagtctagttaacacataccgtgtaacaggagacgactgggatgaatggtcagcaatcttagctcattttaatgtagcaagagactttgctgcatctaatttgataggaggaaaaggtttaaagggaaaatcatggcctgatttggacatgctaccatttggatggctaactgatccagctgctcatgaaggtccacacagcgctactaggctaactcaagatgagcaaagaactcagtttcttgatatcacaacattaaatgatgtcaagactgaaggacacaatgtcacaaaagtaccatttacttactccctagcaatcacagaatgcactgatccaaaagtaagtggttggtctagtgaaaaaaagcaatcatctatccaatctgaacaaatatggaagttgaaatcaaatgggactttggttaatggttattctggcaagtgtgcaacagtgggacgtgtcctagatgtaggcgatcttaatccgattcgatcttgggttgcaacgcatacagaaagagggaagatctatgttgcttttttcaatctaaataaagagacaacaacaatatctgcaaatatagcagacttgccagcagtttcgcgtttgggtacaagaagaaagttgaaaatttgcgcaggaaccgaaatttggagtagaagtatcgtaagaacaaaaactacattctcggcacaagtaccaggtcatggaagcgcgttatttgtcctcagctgcctttga

SEQ ID NO: 46813 - DNA, 270 bp, Glycine max
  Peptide Sequence Number=SeqID_163591
atggccttcttcaagagagggagagggttcactgatgtagctaataaagtacatagtacgggtttgaagtttgggattcatcttatggctggaatcagtacacaggcattcaataacaaacgagattttgctacatctaatttaataggaggaaaaggtttaaagggtaaatcttggcctgatttggacatgctaccatttggatggctaactgatccagggaaggtgcagaacactttaattgctactaatgtttacatttatgtttga

SEQ ID NO: 46814 - DNA, 222 bp, Glycine max
  Peptide Sequence Number=SeqID_163592
atgtcgaatgcccaaccccttcctcattctctctcatgcctatttagaggaaatgagggtatttgtgactatggtagctcgcccaggcgagctggagcttgcccaggtgagctgatgcttagtcctgaagaaactggctcgcccagcttcctcacctggaatacttttccaagagaaattcttatatcatatgttgcggagaatatgctattacttatctaa

SEQ ID NO: 46815 - DNA, 1980 bp, Glycine max
  Peptide Sequence Number=SeqID_163593
atgtcagcgatgctgcaacctcagatcattctgttgaaggaaggcacggacacttcgcaagggaagccgcaggtggtgagcaacatcaatgcctgcaccgccgtcgccgacgtcgtccgcaccaccctcggccctcgcggcatggacaagctaatccacgacgacaagggaaccgtcaccatctccaacgacggcgccaccatcatgaagctcctcgacatcgttcaccccgccgccagaatcctcgtcgacatcgccaagtctcaggactccgaggttggcgatggaaccaccactgtggtgttgcttgcagcggagtttttaagggaggccaagcctttcattgaagatggtgttcactcacaaaacttgatacgaagctataggacggcctgctccttggctattgagaagattaaagatctagctgttagcatagaggggaaaagtctggaagaaaagaaaaacttgcttgcaaagtgtgcttctaccactctttcttcgaagcttataggtggagaaaaagaattctttgcacccatggttgtggatgctgtaatttcaattgggaatgaagacaggttgaacatgattggaataaagaaggttcctggtggtaccatgcgggactcatttctagtaaatggtgttgccttcaaaaagactttttcatatgctgggtttgaacaacagcccaagaagtttctcaatcctaaaatactattactaaatgtcgagttggagctaaaatctgagaaagaaaatgctgaaataaggttatcagatcctgcgcaatatcaatcaatagttgatgcagaatggaacattatttatgataagttggataaatgtgtcagcagtggtgccaaagttgttctttcacgattggctatcggtgatctagctacacagtattttgcagaccgagatattttctgtgctggtcgtgtagctgaagaagatctaaaaagggttgctgctgcgactggtggaaccgtacaaacatctgtgaataacgtgattgatgaggtccttggaacttgtgaagtttttgaggaaaggcaggttggaaatgagaggttcaatattttcagtggatgttcatctggccaaacagccaccatagttcttcgtggtggagctgatcagttcatagaggaagcagagcgaagtttgcatgatgcaatcatgattgttaggagggctttgaagaattcaacagtggttgctgggggaggtgcaatagatatggagataagccggtatctgaggcagcatgcacgtacaatagctggaaagtctcagcttttcattaactcctatgcaaaagctcttgaggttatacctagacaattatgtgacaatgccggatttgatgcaactgatgttctgaataaactaaggcagaaacatgcgctcccttctggtgaggggggaccatatggggtggacatagccactggtggaattgctgactcgtttgctaactttgtctgggagcctgcaattgtgaagatcaatgctataaatgctgcaacagaggctgcttgccttatcttaagtgtggatgaaacaattaaaaatcccaagcatattatcgggatcctcagtccgtatggtatttgtctttacaatttggccaaacggacggggctcgatcccgataacattcaacgcatcactgcccatatacttgaacttgagatactggttaagttagaagttgccacctatttaagggacacacatctgagagtgcacaaggagatgctgctgcaagtgccatgggcagaggtcgtggaggtgcattccgtggtcgaggacgaggaatgcgaagatgatgagaagtgcattctatgggttgagtgtctgttcattgtctgtctaattcgtgaggccaatgcatgcttgtttctgctacttgatgttgctagaagcatgccgatttttgaacttacaaatcatgaaatgaaaatgtaa

SEQ ID NO: 46816 - DNA, 657 bp, Glycine max
  Peptide Sequence Number=SeqID_163594
gtattatctgatttgaacaggagacttgtgtcgcatattggtgttattgtagacgttcatcatacaggtggaaattattgttcggacaagaaacctgctgcagtgaattggatcgagggacgtgggaaatcagttgtttgtgaagcaatcatcaaagaagaagtggtgcagaaggtattgaagaccaacgtgtctgccctggtggagcttaacatgctcaaaaaccttgctggttctgctgtcgctggtgctcttggtgggtttaatgctcatgctagtaacattgtttctgccatctttatagccactggccaagatccagctcaaaatgttgagagttcccattgcataaccatgatggaagccatcaatgatgggagggaccttcacatctcagtgaccatgccctccattgaggtgggtactgttgggggtggaactcaacttgcatcccaatctgcttgcttgaatttacttggtgtgaagggtgcaagcaaggagtcaccaggatcaaactcaagactcttggccaccattgttgctggatctgttttagcaggagagctgtctctgatgtctgccattgcagcagggcagctagtgaacagccatatgaaatacaacagatcaagcaaagatgtaaccaaaatatcataa

SEQ ID NO: 46817 - DNA, 1029 bp, Glycine max
  Peptide Sequence Number=SeqID_163595
atgcatagcaatagcaacttggagaacacagaccagcacccagcgaaggagagagaaccaaaagatgagctagaaccaccagcaacttcagcaatgcagatggctgcttgcaggaaattgtttatgagaaggaagatgcatttggttttgggcttgctgtttgttagccctagtgccaagaaatacccatcaaggcagcgcttgacacttcctgtccaacctggatcaaaggaaaggcctgttgtccttaattacaagaagagtctgaaagactatacaattggaaattcagaaaccttaactgttgtattcaaggacttgggcccacaagtttcttaccgtacactttttttctgcgagtatttgggacctttgcttctctatccagtcttctattatctccctgtctaccaatattttggctacaaaggtgaacgtgtcatccaccctgtgcagacatatgccttgtactactggtgtttccattatgccaaacgaattctggaaacattttttgtgcattgcttcagccatgcaacctcacccctttccaatgtgtttcgtaactgtgcttattactggacctttggctcctatattgcttattatgtgaaccaccctttatatacccctgtaaacgacctccaaatgaagattgggtttggatttgggatactttgtcaaatttcaaatttctattgccatattattctgaagaatcttcgtagtcctggtggtgaaggtggataccaaatcccaaggggctttctcttcaatattgttacctgtgcaaattatacaactgagatctatcagtggctgggattcaacattgcaacacaaactgttgcaggctacattttccttgtggttgctacttttataatgaccaattgggctttggccaagcacaggcgtttaaagaagttaaacatatggattcaaaaagcactgctccttttgtttgatggaaaggaagggagacctaggtatcctcgtcgatgggtaatattgcccccattcctgtag

SEQ ID NO: 46818 - DNA, 723 bp, Glycine max
  Peptide Sequence Number=SeqID_163596
atggaagccaatgcggttgcagttgctgctactagggctattgctaagcacgccttcccgccatatggcttgcctcccaactatacaccacccgatgtggcgtacactcccaatgagaatgtcaataactccactcccatactcgttgagagccgaaaaacccaaactaatcatgcatatgtctctcaaaccgtggaggagacacatgaaattccccaccacaatctagccgactccaagccttgcctcggatatgccactgaagggcaagcaattggtgatatacccctgcaaaacactttggagggccctcaatatcacccacaaccacaccccttgcattccacagcgattaaaaaccctcatgctatggcggaattgggaaaggtggatcatctaaaggaaagtcttagggccattgaaggaggcaaagattatgcctttgctaatctagaagagttgttcctagtactcgaacactggccattcccaagttcaaggtgccagactttgacaagtacaaggggactacttgccctaagaaaccatctaaagatgtgttgtcggaagatggtgacatatgcaaacgatgaggaattgctgatacattccttccaagaaagtcttactggggtagctgttacctggtacactaacttggaaccttcccgagtccattcatggaaggacctaatggttgccttctggtatggctctagatag

SEQ ID NO: 46819 - DNA, 255 bp, Glycine max
  Peptide Sequence Number=SeqID_163597
atggaggttgaggaaccttggttggcgttatggctaccattgaattatcaagtagataatggagcaagtcagcataggacaccgaaatttgggacaggctttatggttgatttagggatggcctttgtggataactgggtggtgggtaaggagaggacccgctttgatccttttcccgacgaagaccaaatccgcaaagcttcgaaggtgccacttgagctgtcagatccctccacctttgggtgtattctttga

SEQ ID NO: 46820 - DNA, 258 bp, Glycine max
  Peptide Sequence Number=SeqID_163598
atggcgagtccaatgacatgcgagggtaccttatggttatcagcaccttttgtcaaccagaggcaagcgagcccagacgacgagtccgatgacgtgcgggggtaccttatggttatccgaaccttttgtcatccagagatggcgagtccgatgacatgcgggggtaccttagggttttactttcttcatccagagacattcaagcccgacgacacacaagattcttctctgctaggcagggacgatcgagcccgatag

SEQ ID NO: 46821 - DNA, 915 bp, Glycine max
  Peptide Sequence Number=SeqID_163599
atgatggaaaaccaaatccctctcatagttctcaaaaggatctctggaatactttttcccgaaatttttacagacggtggtacagacaaattgatacaaaatcttgcactttctatattgggctacaacgctccggattccgatttcaaagcctctcatttactcgagtttgttcaccaggatttgaagagttctataagcagtggagaagttccaaataccagacatggaaaacaaaatctacagcgctgcgctactaggctcgaagcagctggggttacaatcggacctccacaggcacagagcgagaatgcaaatatggaagctggggtaacagctgaacctgcagaggcacagagcgaggttacaacacaaccttcagaggcactgagcgaggctgcaaatatggaagatggggttacagacaaaccgccaaaggcacagagcgaggttacaactcaatctccagaggcactgagcaaggctgcaaatatggaagttgtggttaatgtcagacctagggttgcagctgagaccaggtttgacttgaaggtaacattcagcgacgggaaactagaaattccgcaactacatattactgaaaccaccgaagctaagtggagaaacttcattgcttgggagcttaacagaactaccctagaaaaacagcgcggggtgattgagaatttgaactcgcacccaactactgtagatcgtgtcacgacaaccagtaaaatcatgtggcatattttcatatgctttctaacatggagctggtaccaatgtagaggcacatatcgggggttgagacgtgtttattttccttcgggatggaaactaatagcactgcttgcagctgcactgggacttggtctaaccatcgcccagactgttttttcggcactcggtcaataa

SEQ ID NO: 46822 - DNA, 258 bp, Glycine max
  Peptide Sequence Number=SeqID_163600
atgccctcctttctttttttggagcagaaatgggcaccaaaggttgaagctttgttgggcaacaatggtggatgggagaaaagaagaagaaggctgcgtgagagagagggagagcttctgaatttttctgttttgctgagtgaggagagagaacagcttttgctatgccacacgtctccatttgagtggagcaaaaagggcccactttctcttttgatggtgacccatactcagccacaaaaagtgagaaaaatctga

SEQ ID NO: 46823 - DNA, 177 bp, Glycine max
  Peptide Sequence Number=SeqID_163601
atgcctgctgcaacctcccagactaagatgttcaaggccactaaagtgtgggcatatgtgctgctgtacaacttgttcttcacacttgaccaattgtcctctatgccggcgacagatagagaaggttgtgaagactttccgtcattgagtgttgagcatacatggcatacatggtag

SEQ ID NO: 46824 - DNA, 1563 bp, Glycine max
  Peptide Sequence Number=SeqID_163602
atgctgcagaagctgtgtttgatggcttctcatggatgccctcccggactttctttgcagcaagagctggccatggttggctgcaccattaccaaggtggttaaggattcggtactaagtcttactttcttcatgggtgtgtattcgaatctcccagagggttgtaaaccattattgccttctcctgtattgaaactagaaattatcagatatgggtcctccctaaatccattcgaggagtctagcaagtcccagaaagagtggttcaattctaatcagattgtcaacatgaacttgtcgactcaaaggcctatgctcattgatgtccaagaaacctatccaagcccagtagattttggctttggcatcgttgaacaatgcagtgagcacgataaaattttgcagtgtatcatgtctgagagtgctgaagctgggataggtggagtacatatatctttgttgtctgacttgatgggtttacaattgccaggcattgatgaacctcaaaaaccattgacacctcttatcccaaaaagcaaattctttatcccgaagcttttgctcgatatttttcaagattcagcctttagttcaaagattacagttcatccagatggtcaagtcacttttatgggcactgcaattgagatgaaagatcttctttctgtagttgctgactcatacttattacgtaagggtgaaaaacaatctatgcttgttccgcacttcagcaggatgagtatcaatgaagtagaagttacaagtctttcctccacattggatattcattctacattgactgttcctttaaagagtcctgagaaagtcaaagtcaagccatcacaaaagaagaacaagaaagtagccagagagagggatctattcaagaagaactacttacatgcatgtgagagccttctgtccctaatggttgacaagaggcgacaacggaaaaccgcaattctctcactgaagaaatctggccctgagcttcctgagctcctcacacaattttctgctggtattgctggtactggccttgctgtcctgctatctgtgatctgtaagctagcttgtggaaggggggtttccttttgtgcgtataagctcctcaacactgggtttggatttggtctggtttggctttcttgggcagttaataagctaagggatacaattgtcagcatgaacaagaatacaggaaagcttggactgaaagatgaggaaatgattcaaaaggtcgataagagcctaagagaggtttacttcagagccgccacgttgctagcagtggcagtgctaagagctgtaagcttcgcaaggccacacattggaacaaccattatacctgatcagttggatcacaagattgtggatgattggcttgatcagcacttggatggtgtacttacggtatggttagtacctcattttaataaacaaagcaagcaacatactcgtatgcttggcattagggcgcgcatggattatctctgcaaaagattaacgcatgctgtaatgctagtgccactaatattcatcacatatagcagtaatctttga

SEQ ID NO: 46825 - DNA, 870 bp, Glycine max
  Peptide Sequence Number=SeqID_163603
atgattccttggggtggcctcagttgctgtttgagtgccgctgctctttaccttctcggcagaagcagtggcagggatgctgaaattcttaaatccgttacaagggtcaaccagttgaaggaactaggtttgtgtctttttcgggagctgaagcctctactgtccccacacttgggggtgggggaactcttgcggcatgaacttggggttgagtttggtccaaactcaaattctaagatggtatcagaatctatgttagcagttgttattaaaccctatcaggcctcacactatcggactattatcaaaccacatgcttgttgggcctctcctagccagctgttggatatcccacttgactgcttccaggggccaaatgttgttggtttctggctagaaagttctatgtggttatggtttctgatcatgcttgggattccttacttttcagctcaactattagatgcagaaatattacccttgattgttacaatttctggaagagttagctctgaaaccccaattaactgcgagttcagtggtttaagaggtgtaatagttgaagaaacagcagagcaacattttcttaaacacaatgatgctggttcctggatacaagattctgctttgatgctatcaatgagtaaagaggttccttggtatctggatgatgggactgatcgtgtgcatgtggttggagctcggggtgctgctggttttgcattacctgttggaagtgaggcatttgaagagtcgggtcgctcacttgtacgtggaactttggattatctgcaaggtctcaaggtgcgagtgttcgcatccatccaatccttctgctcccctctccctgcaaaaataaaagaaaaatag

SEQ ID NO: 46826 - DNA, 738 bp, Glycine max
  Peptide Sequence Number=SeqID_163604
atggtgaacaacaacaacaacaataacaacaacaagaagaaaatgatgattataccgagaagaggttcttcttcttcttcttcttcatcatcatcagaggcacagcgcggtggccggcaggtcgtcgtcgttgtcgtcgtcggcatcggatggtgggaggacgcagtcctggccgtcgtcgacgacggaggaagaagagtcgcaatcgctgtggcaatcgtcttcgtcgtcgttgagagggatgatagggttaacaaccacaacaaggggcttagcgcgagaggaggaggagggaaccctaggcccgctgaaggactccacggtgctgctcatgccgctgctcgtgggccggttcacctggacgacgggctcgaacttggtggaaagcccatgggcctggtagagcggaatctgcgagtggtggtccgcctctgccgggccggggaagggggggaaattggttttggccttgggcccgcggaaggatcgggcagccttgtcgtaggcccgcgcggcatcctcggcggaatcgaaggtccccagccaaacgcgctgcttcttccacggatctcgaatctccgccgcgaatcgcccccacggccgcttcctcacgccacggaaccgcgtcgtctccttggcctggtccggcgtgggatccacaacggcggcagcggcggcggcggtttgggtttgggtttggggtcccatgatgcggtctcgccttgtttgctccaatag

SEQ ID NO: 46827 - DNA, 273 bp, Glycine max
  Peptide Sequence Number=SeqID_163605
atgtctcgaatttgtgcggaattgagttttcttcttcagaaaccaaacccgatcgggggatgcggaaaaaaaaaattaacgggatctgcgatctgtacgccgaataccgataatgaagaagctgcaattgaaatgggaaatagtgcgatgacgcgccttgcgcgtggttttcagcgatgccttagcctactcgctttgcttccgggacacgtgtgcatcgcaatgcaacggtacgcaaaatctcgcggaagcgaacgagtaacgacagcgtga

SEQ ID NO: 46828 - DNA, 1170 bp, Glycine max
  Peptide Sequence Number=SeqID_163606
atgacaagtgaacttaagagccttacaaacaaatgtgctgaacaggttttggaaatcaagtctttaaaaacattgactgaaaagttacagaaggagaatcaggaattagagtttattctggatatgcatggccaggagaattatgataaaagacattcagaagtaagagaatctgaaagaaaagctcactctcaagctgaaatgctgaagaatgctttagacgagcatagcctagagttgagagtaaaagctgctaacgaagctgaagctgcttgtgaacaaaggctttctgccgcagaagctgaaatagaggacttgagatccaagctggatgcatctgagagaaaagtctttggtgatgaggagtggggaagggatattttggagctgactgaggctgttaaagttaaagatgctgaggcagaggcatatatatccgaaattgagactattggtcaagcatatgaagatatgcagacacagaaccaaaatctgttggaccaggtgatcgagagggatgactataatattaagcttgtatcagatagtgtgaagacaaaacaggcgcacaacactttaatgtcccagaagcaggccttagctaagcaacttcaacaaattaatacatcaatagaacattcaaagacaaggattacacacagtgaagagcagacgaaagctattctatccgatgccattaaatgtaatcaagaagaaaaacaccttgcagtcaccctggaatttgcaaaatgggaattgggcgatactgagaaggaattgaagttgctcaagtctgctgtttcctcttcagagaaagaatacgatcaaattccgaaagatacggaagctattcaaatggaattggagagtgaaaggagtttacggaagaagcttgaggaagaacttggagaattgaacagcaaaattgatgagctgacttctgaaactggagaaaccacaatacaaaaactcgaaaaagaaataaggatttgcaagaacatgatcaagtgtactgtctgtactgatcgtccaaaggaggttgtgattgtcaagtgctatcatctgttctgcaatccatgcattcagagaaatctagagcttcggcaccgcaaatgtcctgcatgtggaacagcatttggacagagtgatgtccgctttgtaaaaatatga

SEQ ID NO: 46829 - DNA, 335 bp, Glycine max
  Peptide Sequence Number=SeqID_163607
ctctggttacgggcctctgtcagtcctatagggtgcccgtccccccagcaaggtcacgccatcatgacatagggatcgtgcctgcaagacacccaatggacccggagaagtccaacagggtcctcgggtttccaactttgattacgagcctctgtcagttttacgaagtgcctgtcacccccaacaagggcgaaacaccacagcagcctggggaaggccggcagcgggcaataagcgcgccaccaccacctttagagttcacctcagctcatccacaaaaagtcattaggcgtccagctcaagacgttaaagaagcgctactaggaggcaaccta

SEQ ID NO: 46830 - DNA, 674 bp, Glycine max
  Peptide Sequence Number=SeqID_163608
ggcgatgaattgaattggggaagaagtaagcggttttccgtgacagtggaaggttgttatttgggcgtgggaagaacgcatttcatcatcgatacttttgagagacatcgcgtggtgttcacagttggaacttccattgcttccgttgccactgcttggttcggttattccttgcgccatttacatgacaccaaagttgatcaaaggcttcaatccattgaaaatgctatgaaaaacaataccaatctccaacattccgaaatcaaagacattgtcgccgaaggttgtagtatccctgcttgtgtcgccactgctggaacctccttgattatcgggtatgccttaggatggagaggtggaatctggtatgcaactaagaagttcagaaaggagcagatgaaaatgctgggacagattacacctaaaagatggcaattgcttgggaagataaaacctagagggttggaatttcagttccttagaaggaaacttacaagatccaaagtgtttgatactgccacaaaaacatctgaaacaagtataaaggatgcttctaccacacatattgctggaaaatccgataaggcgagccctggtgcagcggtaaagttgtgccttggtgacttgttggtcatgggttcgaatccggaaacagcctctttgcatatgcaagg

SEQ ID NO: 46831 - DNA, 708 bp, Glycine max
  Peptide Sequence Number=SeqID_163609
atggcaaacacatcagtctcaacactccttgtgattctcttctggggtttaactcttgcaactggaagaaaattatcaccacttagcactaccactacattgtcatcatcccctagtgatggtatttgcttatcaatggtgatgccacaaggcaaaacttgtgaagaacacttggtgacaacgcaagatggttatattcttaacttggcaagaattagaataagagaatcaagggggccaccggttcttctacagcatggacttttcatggatggcataacatggttattgctaccttcaaaccagtctcttgcattccttttggtggataatgggtttgatgtttgggttgctaacactcgtggaaccaaatttagccggcaacatacatctttaccttctaatagctcggattattggaattggtcatgggatgaattagttgcacatgatcttccagccacattcaagtatgtgcatgatctaactggacaaaaaatgcactatgttggtcattcacagggaactttgattgcattggctgctctttcccaagatcagttacttaacatgttgagatcagctgccttacttagcccaattgcttatgttggtcagctgacttcacccctagctaaaaatgctgctgaaaactttattgcagaggtggatagaataagatcagagccagaatccatcctgatgtga

SEQ ID NO: 46832 - DNA, 201 bp, Glycine max
  Peptide Sequence Number=SeqID_163610
atgatggttcaggagcttgatacacccggtcatggtgggccagaagtgctgcagcctgttatccctccacttttaggagccaggagacccgagccttcgcctgagtcccaggacccaactcttaacttggagtgggcaggccagcattatgcatctactagcccaaccgagcatagcccaagccatgttccatcactttga

SEQ ID NO: 46833 - DNA, 373 bp, Glycine max
  Peptide Sequence Number=SeqID_163611
agaaggaaccacttcaatgtttgattatgagaaccgagatgagaacatgaaacactatggacaacccactcctccagtatatgacatgacaagacttccaaatgaccttcctatcttcctgagttatggaggggctgatgctctttctgatgttaaggatgtgcaacgtctgttagaaattcttaaagatcatgatgcagataagctagtagtgcagtatagaaatgattatgcacatgcagattatgttatgggtgaaaatgctcaccgagatgatgattattcagaagggcttatcttgggaaacctaaaactgctaaaggaagaactagctgtgtatcttgacatgccattggaagccatcagggattag

SEQ ID NO: 46834 - DNA, 1078 bp, Glycine max
  Peptide Sequence Number=SeqID_163612
tgggaaaaaactgatcgtgaggcaaattgagaaagagaaagtagtggttgtaatgggagccaccggagcagggaagtcaaggctttcaattgacctagcaacatgttttccatcagaaatcataaacgccgacaaaatccaagtcttcgaaggtctagacatagtcacaaacaaaatctccaaggaagagcaacgcggggttccgcaccacttactaggaacaataaagcccaacatggatttcagcgtcaacgatttctgtgacacgtcatcagaggccattgactcaatcacgaggtgccagaagcttccaatcgtcgttggaggctcaaactcgtatctggaggccctcatggacgacgacgattacaagttccgatcgcgctacgatattctctgcctctgggttgacgtggaaatgtccgtgcttaagtcctacgtggcagaccgtgtcgaccacatgttttataaaggaatggtcgatgagctgagaccgttttatagtcccaacggggattactcgcgaggggtgaaaagggcaattggggtgcccgagttccacgagtattttgggagggaagaggttgctgacgaggagacaaaacagaggttgttggaacaagcggttaaggaaatcaaactgaacacgtgcaagctagcgatgaagcagttggggaagattcgtaggctcaggaacgttaagagatggcatattcatcgattggatgctacgcccgtcttccgaatgcgtggggaagaagccaacgatgcttggaagaggctggtggcaaagcctagtgctttgatcgttgctcgctttctctataataacaactccaaaaataatgccaacgttgtttctggttctggacttagagtgcaaccagctgcttcagagaatgaatcgtcttcttcttcctcaaactcaaagtcgtctagatctatcatcactagtgccacccttcgagcatctatccctaccaaagttaagcgacaagacacaaacgatggtgcacaagacttaggtaacatcgacttggtgaaattagggcaaaaagatcttcctcaaagttgttag

SEQ ID NO: 46835 - DNA, 339 bp, Glycine max
  Peptide Sequence Number=SeqID_163613
atgcagacacatcccacaaaagagataggcattaacaatggggggacaaagggtgacccttggagcttggtcttgggtggtgccagtgtgccacactatgctcaagcagaatttgggttgtccataattatttgcaactgtttggaagtcaatggattggcaacagttccttaccaacccatgactagggatcacgtaccactcgagtcactaggccaaaatgctgatgttcaaagttctctaatgagccttcaagtcggatgcacaaaagaagttgttacctgcaaaaattccaatgctcaagtcactgagtgtgaaattacagtcgatgaattataa

SEQ ID NO: 46836 - DNA, 4341 bp, Glycine max
  Peptide Sequence Number=SeqID_163614
atgggaatgatgatggtagcagcagtggtagtggcaatgatcaacaatattggtggcaatgacaatagttgcagcaatggtggtgatggaaataacaatattgataattgtagtgatggtagtgtggcatgcaatgataatggtagtgtggcagcaatggtgatttcactggtgatagtggtggcaggggttgtagcagtagtggcaaatggtaatgatggggatggttgtagccacaacaacaattatggtagtggtggaataaagaagttgtgtaagcctttctgcaatcctgctgatgtggaagcatttactgaggagaaaaaacagtctattcttggaaaacgtcatggaaagggtgctgaatttggtcgtgctgttaaggagataattgaagtttttgagaaattaaaaaaagagactcagcttgatgaaactggctctggtggtgatgttgctaatgcagatgtttcaaatcctgttaactcatctgccaagtatcagacagatgctcctgagttggcacatacattaccaatgaattcttcaaattctattatcaacaaacatgaggtggtatgtgtagctgaggatgactcagccgctgtatttaaagatgaatctcataataaggaggcaatgttgggggagcctgctgataagattgctgccgtaaaatctcccaagccagttacttactcttctcgaaaaagatctatgggtgacttgtgtctgcagggctgtgtaacagatagacatacctcagtacgaaggtctagaaattcatcacgtgcccaaaactgtgtgttgccttgcaatgacaatggaaagagtgctggtaacccatcaactactgcagctcagagtgcatgtacatgtaggaatagaagtgtcaggaaatcatctgatctttttggctgtgatgattttgagtcatctgcttttgtcttgaatggtagcatggaggacaacagttccgaaattatcacaactgattctgatacatttagcttgaatgagggtagtacaatggattcaaattttaaacttgaactatctgaagctattgattgtccagaaattgagttgaacaaagggcttgatcttgaaataaaatctgtagtcaataagaaaaaaagaaaacccaataggaagagggcagctaatgatgcttctaagccaaccagtgggccagaggaggagattggtgtgcagaatgccagtcaaagttcacagaatatttgtggaaattccaaagaaagatgctttgaacaagatggagatgaacacttgccccttgtgaaacgagcaagagtcagaatgggtaaatcatccgttgagggagaactacatagcactctccaatctcaagaaaaaaattgtaaggaagatactaactcagcgccgcagatgatcacatcctcaaattgtgagaataatagccccgccgatggagactcatctttgctgaatggagctttggataatgtttctccaaaaatttcagttccatgttctaacactcagatttgtaatgctaagaaagatcaaaccttcagctctgtggatgttgaagctgctttacctccatctaaacgcctccatcgtgctttagaagccatgtcagccaatgctgctgaagaaggtcaagctcatttggaagcatcctcctccataatgacatcaagtggtatgcgctgtatatctaatggcaagagatgtccgagtatggccattaataatcaagaaggtaattgtttagagccacaaaagttggatacttgcaacattgattcttctcatatcaaagtgtatggtttctcaatcagttcaaatccaatgatttttacagagaataaatcacctatccaagtgggtaagcaaatgaccaagatacaaaaacatgaaactggcaaggatgttctcccaggtgctacagatcaagttggtggagagcttagtgatcatatggtttgtcagacagctaaagcagatttaaaaattcagtcaaatggacaaatttcttctaatcttgattcaaaattttgtgatgttggaagcattcaagattcacccaatccatcattaccggcaaatggtgaagacaacattagaactgtgaataattcaaatacagcatctgatggatcagaacataatggaataagccttgaccctgtaattggtgagaaggaaaatgatgcttccttacctcataatattgatgtgcctcagaatgagggtgctgtatgtgaagatacagaatgcttgaagccagcagttgttgatattggcacagcaaatgatatgcatgagattgtgaatgatgcaaaatgtaaaggtccagaggaggatatgaattctgtctcaacatctgatgaccatttgggtgagaatggaattttggacattcggtcaagtccatccttaacagatgggggagattgtgttccgcaaggttcgcctcctactacatctatttgcaatgtttcgacatccgacagtagtaatatccttcacaatggaagttgtagccctgatgtacatttacaccagaaacaaactgtatctggtcctgtcgatggtagtaaagatggggatgtggcaactcaacaatcaagatgtatgggtaagtcaactgaagcaggacgtgctgctttgttgtactttgaagcgatgcttgggacattgacaaggacaaaggaaagtattggtcgagcaacacgcatagctattgactgtgcaaagtttggtattgcagataaggtcatggaaattcttgcccattgtctggaaatggagtctagcgtgcatcggagggtggatttgttttttcttgttgactctattgcacagttttctcgtggtttaaaaggtgatgtatgtggagtatattcatctgctatccaagcatcccttccacgactattatctgctgctgctcctcctggaaatactgcccaagaaaaccggaggcagtgtctcaaggcaagtggtatctacttgcggcgatctttgagaacagagagggctttggatgaccctgttagagaaatggagggcatgcttgttgatgaatatggaagcaactcaacttttcagctgcctgggttctgcatgccccgaatgcttaaagatgaagatgatggagaagggagtgattctgatggcgggaactttgaggctgtcacaccggagcatacacttgaagtatatgaaatgacttctgcaattgaaaaacacagacatattttggaagatgttgatggtgaacttgaaatggaagatgtggctccctcgaatgcagtagaaatgaattcaatttgtaatgtcgatacaggaaatgccaagcagtgtgagaagaatctgcctctgtcctttgctcctctacatcaggatgtgcgatcttcttccccacccccaccatcattccttcctccacccccaccacctcctcgtcctccacccccacctcctatgtcacaccacatgccgtccacctctgatccatatgacaccgtagttaattcaaaaggttgtactgtttcacagactctgaaagacaacccccttcactctgtggctcagcccatggctgcaccaaggcatagccaacctatcagtgatgcagtgcaccatctggtccctgaataccgagaaatgcagatgcacatgccagaatctacttgctgtttcaacagttttcctgtgccacccccagacaattttcgacatactgatggtgttactatgcataataaaggatactctatacggccacctcaacatgtgccatccaatcagttttcttttgttaatggggaacagcatgtgaaacatcaaagggaggttccaccaccccctccttactccagtagtcaacactttgtgcagaacatggagagagagaacttctataataatcatgagagattaaggccacctccttatgtttacgaagatagatggaatggtcctgcatcttatcccggtcctcggtatcaggaaaaaggtgtgcctcctccttatgtttgtcatccatgtgaatcaagtagaataccagatcatgggtggagatttcctcctcggtctatgaatcagaggaactcaatgccatttagaccaccctttgaagatgcaattccagttgcaaacagagtggccatcaactattgggatgcttggggcccctctcataaaaacgtgctggcctatggcagtggtttgttagagtttgtaggtagagttggcgtgttcaactgtgatgacagcgttgagaatgatgaagggggtgaatttgtgcttaaagtgagttcaactgaattggagagaaatgggtga

SEQ ID NO: 46837 - DNA, 1812 bp, Glycine max
  Peptide Sequence Number=SeqID_163615
atgggtttcaattctgtctatagaagcttgcaggagatatttccgcaggttgatcccaggctactgagagctgtggctattgaacacccaaaggatgctgatctagcggctggaatagttattgcagaagtcatcccattcatgtccaaaaaattacctgctgcaattcctccacagcacaataactatgtagcctcactaaatgttgaagttgaaagtgaggaggaaggcaataggttgaggcaccgtcagcttgttgatgacgtaactgtggggccttcctctgctccacattctatatctgtagaagttatcaaaacagctgattattcttttgtaccagatctgaatgaggctctggacaagtctacaatgtcaaatgatggtactgataaatttcttgaaatgaatgatattaaggagctagatatttaccagaatgctgaagataacttcagtggagagaccttgaatgagattgctcaggagatgtcaaatggctttagtcaggaagataatgaaaattttgagagacgatttgttgatgttgattgtgaaaatttgatatcttctggtatttgtcaagagatggaacctaagcataataaccttagcaaggaggctgcttccaataatggtgatggcaatagaattggaaacgattcaaatgaaatggggtggttagaagttgtaagttctttagttgatgattatgatgccactacaagtcacagattggaagaatgtgaaacatacttgattgagttggaaacttcagaggctccaaaagtttgtcatgttcaaggcgatgcattaaattataaagatagtcttcaatcagaattggttgctggttcttctagtactggtgacaatactagtgatgtcgaagatgatattggtgcaaagaatgcaggtagccaatatagtcatgtatgcaggattgatctgcttgaggaaatcattgatgaggcaaaaactaacaagaaaatgttgttttcatcaatggaatctcttatcaacttaatgagagaagtggaacttcaggagaaagctgcagagcaggctaatatggaagctgctactggagggtctaatattctggccaggatagaagagtacaaaactatggtggtgcaagctaacgaagcgaatgacatgcattctggagaagtttatggggaaaaagcaattctcacaactgaactgaaggaacttcaatcacgcttgctcggcttgtctgatgaaagggacaggtctcttgcaattctcgatgagatccgccacattcttgaagtgcgactagctgcagcagaagaactgaggaaagcagctgagcaactaaagctggaaaaggaggaatctgcacggaaggctcttgttgaacaggagagactggtggagaaggtagtacacgaatcacaaagactacagcaggaggcagaggagaattcaaagttacaggagttcctaattgatcgtgggcgggttgttgatatgttgcaaggagaaatctctgttatatgtcaggatattaagcttctaaaagagaaatttgatgcaaatcttccactgagtaaatccttcacctcaagccagactagttgcaagttagcttcatcaggatcttcccacaaaacattggcatctgatgcaggttccgagcatagtgagtcatctgaaatacggaagacaagccggacagcctcaattgaaagcctttcttccaagagtgggcacgacgaggaagaaaaatccaaagctgatcacaatgctcttcttgatgatgggtggtatattttgtcggactga

SEQ ID NO: 46838 - DNA, 528 bp, Glycine max
  Peptide Sequence Number=SeqID_163616
atgaagctgacaggtcatggtctttggagatcaacattgagttgtaaggtgaagaggtggcacagaggttcaagattggttgcggtggcacatgcaattaggcatgttgttgcaactgtgagcatgtcgaagggagagccaacttttagtgtccttgtgtcaagattcttgctcggaaaagcattcccaataccagtttatctgtcactgctgccaattattggtggtggtgcactagctgcagtgactaagctcaatttcaacatgattggcttcacgggggctatgatatcaaatttggaatttgtctattgcaatatattctcaaagaaggggatgaagggaatgtctattagtggaatgaacaactattcttgtttttccataatgttactgtcaattctcacaacttttgccattgttgttgaggaccccaaggtgggtagctgctcagagcgtcttctaccacctcctatcaatgttcttggtatcgccattgcaattcttggtaccttcctctattcacag

SEQ ID NO: 46839 - DNA, 336 bp, Glycine max
  Peptide Sequence Number=SeqID_163617
atggagaagagattaatgattgttttggggattggcagaagtggagcttggaccaggcaggcatgcatgtgggagattttggagaagaaggagtggagcgcaacatcgacgatgaaggcgcacttggtggatttgacaccaagctggggttctaaagggggtgaaatgagtccaaccaagggtggtgttgtgaggcttgatggagggcaaaccacttcaattggaaaaaggacacatccttcagaattgagagatttcgatttacaccgagtagcaagtccagaaagggtcgaacattctctggttgctgctggcattaatctccaggtcatataa

SEQ ID NO: 46840 - DNA, 216 bp, Glycine max
  Peptide Sequence Number=SeqID_163618
atgtcaatgaactattttataaccgagcaacacctttgtttgtatgttatttatttagctgctagaataactatctgcatggttactggtgatatccgtatggtgatggcaccatccttaacgctcgaaaggcataagttcatggccaatttgaggaaaatgtttcatgaggttgttgttgttactagtgatggaactaatgatggccctacatag

SEQ ID NO: 46841 - DNA, 465 bp, Glycine max
  Peptide Sequence Number=SeqID_163619
atggaaggatttgaagtcgaggtattcacaaggagatttgctgagaatttcagaattgcagcaggatatgacatctatcaaacaagaattacgctcctagaggaggaacatgaagtcaaagtggctttggtagaggaaattcaggaggaaaaggaagtaagctatgtacatattgtggtttcattaaccacactattgatgaatgctacacaaagcatggctatcctcctcaacacaggttttacaagtctcaagcagtataaagctttgatggcactattgcaacaacaaaacataactcacaacaatttacatgttagtcaaattggtacaactagcaacaaaggtagtactctatccattacttgtagtgtaagcaagatcagtcaagaagagtggatccttgactcaggtgccacagaccatgttacagtctttcctcataaagttggtaatcaattatag

SEQ ID NO: 46842 - DNA, 372 bp, Glycine max
  Peptide Sequence Number=SeqID_163620
atggtggggtatgcaccttcaagctttgcggatttggtcttcgccggcaaaaggatcgaagcgggtctaaaaagaggcaaatttgatcatcctactttgattagtgagaaagctggaatgaagaggatgagaatgagggagaaaacccttgctatgactaccattcctacatggccaaatttcccaccagcccaacaatgtcatcactcagccaataacagcccttctccttacccaccacccagttatccacgaaggtcatccctaaatgaaccacaaaacccacctaccacacaaccaatgctaaacaccacctttggcatgaaccaaaacaccaaccaaggaaggaattttgcagcaaaaagcctatag

SEQ ID NO: 46843 - DNA, 516 bp, Glycine max
  Peptide Sequence Number=SeqID_163621
atggatgttttgatgataacgaagatgataacgaaagatgatgacaaaggtgatgacaaaaagctcaaaggtcaatcaaagaatgagttcaagatattcaagatagaatcaagaacacttcaagactcaagaggaaagttgatttcaagaatcaagaatcaagattcaagagatcaagatttcaagaatcaagattcaagagatcaagattcaagaatcaagagaaggcttaatcaagataagtgtgaaaaagagcatgatggctcttgggtgaagaaaggtactcgacatgttggtgaagaaggacgtgatggagaggattcatctctcctttcaaagattttagataggtttgatggttttcaaaccattgttggtgagaggtttgacaatttggaattacaagtggatatgcgcttcaatgaaatggagtcaagaatcacaaaggttaaagaagatgtgtcttacattcgttcaagtttcgatcttccaccaccgccgccaccatcatcttag

SEQ ID NO: 46844 - DNA, 162 bp, Glycine max
  Peptide Sequence Number=SeqID_163622
atgaagacattaaagactactttggatggtaaaactgatcatgctgcacctcaatggattgaagtaaagagtcaggttcaaagcgggggctatgagtgtgactattatgtcatacattggatgtggaacatagtaatcgggggggggggggttaaagaatga

SEQ ID NO: 46845 - DNA, 192 bp, Glycine max
  Peptide Sequence Number=SeqID_163623
atgtttaaacatatatatactacagttgtggatgatgcaagtttatgggcgagtggagttcaagcttgggtcatggttccgtgtatggattccttgagcctcaatccatacacaatgcaaaggatagacatgttgaatgtcaacattacattcaaacattggttaaggaatcccaatgagaggtctacttag

SEQ ID NO: 46846 - DNA, 789 bp, Glycine max
  Peptide Sequence Number=SeqID_163624
atgaaccatccttgctcaacttctcatctctgcaaactatcgatctttccggtactagttattcccctgcctttgacttctcttgttgaacttgatttatcaaataatcaacttgaaggaaccattcgaacttctttgggaaatttgacttgtcttgttgaacttgatttatcagctaatcaacttgaaggaaccattccaacttctttgggaaatttgacttctcttgttaaacttcaattatcacgtaatcaacttgaaggaaccattccaacttctttgggaaatttgacttctctggttagacttgatttgtcatataatcaacttgaaggaacaattccaacttctttggctaatctctgcaacttaatggagattgatttctcatatctcaaactcaaccaacaggttaatgaacttttagaaattctagctccttgtatttcccatggactcacagcacttgcagttcagagttcacgactttcaggcaatctgacagatcatattggggcatttaaaaatattgacacgttacttttttccaacaactcaattggtggtgctcttcctagatcatttggaaaactttcatcattaacatatctcgatctgtctattaataaattcagtggaaatccatttgaaagtcttagatcgctttctaagatgtcatctcttcagattgatggcaataattttcaaggagttgtcaaggaagatgatcttgcaaatcttacaagtttgatggagtttcatgcatcagggaacaatttcactttaaaa

SEQ ID NO: 46847 - DNA, 171 bp, Glycine max
  Peptide Sequence Number=SeqID_163625
atgattcagaaactgagaaaacgaggcaccctgatcaagaaaagtggagaaacggggattggagagggaaaagatcagagctttggcaaagggggaaagaggctgttggattttgggagcttcgagattcttggttggcacgtgaacaatccgggtttcttattctcctag

SEQ ID NO: 46848 - DNA, 363 bp, Glycine max
  Peptide Sequence Number=SeqID_163626
atggcgcgcccagcgcgcgatctgaacgcgctaagcgcgaggtgtggcgctgagcgcaactacgaaggcccagttgatgtgtttgcatgtgatgccaaattagttggtggtattcatgatgttaacaaacttagcatcccaggcattggtgggaatttcattggtggtgttgtcccaggcaatattggtggtggttatattggtgtggttccatcctacctagtcattggtggggtttacctcggtggtgcaatcccaggcattggtggtagtggattccctaatattggtggtggcttccaaggtcaagcgtttcagaatgcactgggaagatgcttaaggtgctgctcaatctcaacataa

SEQ ID NO: 46849 - DNA, 561 bp, Glycine max
  Peptide Sequence Number=SeqID_163627
atggcatttatatgtgaaaggaatttgattagtgctcctgctggaaaggttgtaggcatggaagtagcacttacattgggtttggagaaccaggaagagtctttgaagctgaaactcaaggactgtgggtctaatttgtggagatttcaaaatcagaaagcaggtgccaacatatttgcatacatgacaattgatgttttggaagaagatgaagtaataccaatggcatgcatatcattggtaattcaaggtactggcctggtcaaaatcaaaggaaacaacttcgtaggttctatcagattgaatgactttcaaatgtcatcgaaatggagcaacattggaaatctgcggatgtacctcattcagccagttgtgtggacacttattgaaaccatcttcttgccatatgcaaatgcacgcctcagtagggggttacctttgcccatcattcatggtttcatcttacaaaacgcagagataatcttgtcaacttcaggacttgcagtttgcagtgatgtagcttttgcagattcaaacaagcgttttcttcaattaaactga

SEQ ID NO: 46850 - DNA, 414 bp, Glycine max
  Peptide Sequence Number=SeqID_163628
atggcacttttctttgttctgtttctattagcctcttcattgactcaagggtatgctcaatttcaactcaaaaacgaagcttttatatccctgttgattacccaaaatggccttgactttatgaaggagttgctggtgaacaaggcgatttcctcactggcctcacttggattgccgaatattgaaaagactgtgaaaatcccagtagtgggtagtgtctacatggtgctctctaacatctcaagttatcatattgatgttccttcctcgcatgtcaagccaggggagactggaatttccataatagcttctggggttacttgtaatttgagcatcaattggtattactcttatagtacatggtttgtgcctgttaagacatctgacagagatagggcagaagttcaggcatga

SEQ ID NO: 46851 - DNA, 525 bp, Glycine max
  Peptide Sequence Number=SeqID_163629
atggcggtggcttcgacggtgctcctctccttgggcgctttgtaccggtggaaacgctccccgacggtgtacctggtggacttcgcgtgctacaagccgaagaaagaacacaaaatatcgatggaaggatttctaaagatgaccaaagagagtgaggggttcgaggaagagtctctccaattccagaggaagatttccacaaggacgggtttgggcgacaagacctaccttcccagaggaatcacttcttgcccgcccaagctttgcatgaacgaagtgcatctagaggaaaacatcgtcatgttcaatgccctggatgctcttttggccaaaacggggattgatccgaaggacattgacattccggtggtgaattgtggtttgttcaacccaacaccatctctctcggccatgattgtgaaccactataggctgagaagcaacataaagagctacaacactcgcagccacactgtttctgatgatgagcattactttccacaaattctagatgttcaattctaa

SEQ ID NO: 46852 - DNA, 1095 bp, Glycine max
  Peptide Sequence Number=SeqID_163630
atgggtctaccaccagaaagacttttgatacaagggatccccaaggaaacttcacgtactccaagtcttggacttttaatcgtggagcacttcgtcttttcttgtggactccaaattttcaacacgactgtgcgacaatccaatgtaaaatgttggttgaggatccatggccctcctcaagaatattggagagacaatattttgtttgccattgccagaggcgtgggtgtgcccctagcccttgatgtggccaccaccaatagagattacggtcactttgctagagttttggtggaggttgacctaactctccctttacgtgagcattctctggataaatgtagacataagcacggggttattcttatccagcctagagtaagcaataaagaagctcccttatcctcctgtgatgaatcgctccacccggagtcgccttctggagatgaattggtgatggattccatcaatgaggccgtgcaagtccagcaagatttgcatgtcctggctaagacctggggcgatatggctcaagaggatagctgctttactccttatcagagtcacagcacacaaaacttaacaggaaaaagggcaagaaggttttctctttgcgggatatcaaagcccaaggtcggcgctgtttcacactcgttgggcatcagcccattaataaagcaacatctctcactgcaactcacaacagcttgcctttacggctatcctcctcctcagatgccaccaccaacaccaccaaagccagggttgttgaagccaccgcccaagccagggttgttgaagccaccgcccaagccagggttgttgaagccaccgccaccaaagccagggaagccgccgccaccaaagccagggaagccgccgccaccaaagccagggaagccgccgccaccaccaaagccagggaagccgccgccaccaaagccagggaagccgccgccaccaaagccagggaagccgccgccaccaccaaagccagggaagccgccgccaccaccaaagccagggaagctaccaacaccaaagccagggaagccaccaccaaagccaggggagccaccaccaaagccaccatag

SEQ ID NO: 46853 - DNA, 222 bp, Glycine max
  Peptide Sequence Number=SeqID_163631
atgacggagattatagtaatttcttgtgacgagcatccgtgggactcttaccactcagatgtgtcaatagacgtgaccaagcatcacacgcctaagtcgttaacggacaaggttgctttccgggctgtcaagtttctaagggttctctctgatatgtacttcaaggaacggtatgggtgccatgctatgatgctggaaacaattgcagcagttcttggaatg

SEQ ID NO: 46854 - DNA, 670 bp, Glycine max
  Peptide Sequence Number=SeqID_163632
atggattctgcgttctccatcaccaccaaggcgcacgtggcgcttttcagagtgctccaccgtcatttccacggagctcctaaacgcgtcttgcttcgctgcaacctcaaacgccttattgcttcctacagtagcagcaactgctgccgcattccgtgttctttcgcctccgcaccgtcgccttcctcgctcggatccttccgcggactactcccgcgaacgccgccgtgcagtccgcgctgcatttcctttgcttctcctgccggcggtggaaatggcggcgctggaaccggagacggtggtggaggtggcggttctggcggggagtccggagatgttaatctcaaactggttggagacgcgtctcaggagctttcggcactttcacccgatgttatcattctcgatgtttcgggaatggtatgcgggggatgtgcggctactgtgaaaaggatactggaaagtcaaacgattaacatcaaggtggaagaatcatgcttaggtttcaaagcaatgcctcaagtgtcatctgctagtgtaaatttaacaacagagacagcaatagtctggcctgtatctgaagcaaaaaatgcaccaaattggcaaaagcaattaggggaggcacttgcagagcatttaactagttgtggctataattctagccttcgag

SEQ ID NO: 46855 - DNA, 198 bp, Glycine max
  Peptide Sequence Number=SeqID_163633
atggtgccatcaccactggcgcttccgcgtaggagctgccacgtgaagagggacgcgcaagtagcagcagcggcttggccttctgcttacgtggagagggacgcgcaagcaaggacaacagctttggcagaccaggagcagcttttgcaacaggagcagggagggtctggaagcgcaaatggtgttggcgttttaggg

SEQ ID NO: 46856 - DNA, 162 bp, Glycine max
  Peptide Sequence Number=SeqID_163634
atgcagagtaagctaaaggatttagagctcgaggccaatgcattaattttcgtgggaggaaaagtttccgttgatatattaccgttgatgaagctgttaagctttgcggtgggtgttcttcctgatcatgttcccaagttgttggctttgctatcaccataa

SEQ ID NO: 46857 - DNA, 288 bp, Glycine max
  Peptide Sequence Number=SeqID_163635
atgggttcgaagatggcaatagtgatcgtagccttgttcgccgtgctccttttcatctcccaagaggtggcatgcagggatttcaaagaggagctaggtgaggttgtcaaagagactaatgaggagagtgatgccagattagccggtagtggtggtggtgaccttgattattgtccgggttacgacaccattagaaagtggataggacgttgccgttgtggctgttgtcagtggaccacagagccggaagtttgcatagattgctgtacagtaatgcaccacaattga

SEQ ID NO: 46858 - DNA, 999 bp, Glycine max
  Peptide Sequence Number=SeqID_163636
atgaagctcattgcactgagttctacggttcggcgcgctctgctcaatggtcggaaccaaaactgtaaccgcctaggttcggcggcggagacgaggctactctgcgctggcggcgcgaatggagggttcttctactggaagaggacgatggcttcgccggcggaagcgaagtttccggagaaggagaaggccgaggctgagaagagcgtggtggagtccagttattgggggatttcgaggccgaaggtttcgagagaggacgggacggagtggccttggaactgcttcatggtgaggattctgtttctgattaggaatcaagccttgggagacttatcgtcaaacgtgtccatagatcttactaagcatcacgtgccaaagaattttctggataaagttgcttacaggacggtgaagctcctcagaattccaacagatttattttttaagagacgttatggttgccgtgcaatgatgctggaaaccgttgcagctgtccctggcatggtaggagggatgttgttgcacctgaggtcactccgtaagtttcagccaagtggtggttggataaaagcattgttggaggaagcagagaatgagagaatgcacctaatgactatggtggaacttgtgaagcctaaatggtacgaaagactgctggttcttgctgtacaaggagttttcttcaatgcgtttttcgtgctttacattctctccccgaaggtggctcatagaatagttgggtatcttgaggaggaggctatacattcttacaccgagtacttgaaggatcttgaaagtggtgcaattgaaaatgttcctgctcctgccattgccatagactattggaggcttcccaaggatgccaaattgaaagatgttgtaacagtcattcgtgctgatgaggctcaccatcgagatgtgaaccactttgcttctgatatccactttcaaggtaaagaactgcgggatgcaccagctcctgttggttatcattag

SEQ ID NO: 46859 - DNA, 411 bp, Glycine max
  Peptide Sequence Number=SeqID_163637
atggcctcgttcgatgaaactcctcccagaaactccaagaacggcgagaagatcttcaaaaccaagtgcgctcagtgccacaccatcgacaaaggtgccgacaacaaacaaggtatctatcgtcactcatcaccttcggttcaagagttactctgtattgatgttgagggaaacattatgcttgttgaggaaaagaagataggaaagaaaaatgaaataagcttatcccgtaagcttaaattagccaattgtctgatggcgcaaattctgctccatgggactcttcacgccactgtctatgaagtcgataagctcaaaattggtggaggcaactttttaaccaagtttattgataatcttgcaatggtatccgcgctgcctctgttactgccttctccaaacagagaataa

SEQ ID NO: 46860 - DNA, 471 bp, Glycine max
  Peptide Sequence Number=SeqID_163638
atgtggggatggataccacagacaactccacagaaagaaacatgcttgaatgctttaggtgatggtggagtcttcgttctccttgttgttgccgttatcgccgccattcttcttcttctgcaacatcatcaacacaaaatcaaagcagtgaaactaagcggattaaccattattccttcttatccttcacgggattggggcctagggtttctgcccaatgagacacacgatgccacaagtgagagagagatgatgcacttcgacggagctcttcaccaagggaaggcaaacttgttgacggagggtggcggtggaagttcgagagatcgagcttgctgcgtggaagctcaaggattcaagagatttttgctggctgcgtggaagctcaagggttcgagagatttttgctggctgcgtgtggacacatacattggacttttaaattcaactgagataacgacgggtgtttaa

SEQ ID NO: 46861 - DNA, 366 bp, Glycine max
  Peptide Sequence Number=SeqID_163639
atgggttcgaagatggctatagtgatcgtagccttgttcgccgtgctccttttcatctccccagaggtggcatgcagggatttcaaagaggagctaggtgaggttgtcaaagagactaatgaggagagtgatgccagattagccggtagtggtggtggtgaccttgatctgtctcatgttggtggtggggataagcttgagcttgatgataagataatttgtccacctatcagtagtcttgaggtttacgattttcctccaaagaaagaatttggaaattgccgttgtggctgttgtttacggatcccagagttgggaggttgcaaatactgctgcccagaagttcgtcgtcaacgcgcgccctag

SEQ ID NO: 46862 - DNA, 846 bp, Glycine max
  Peptide Sequence Number=SeqID_163640
atggaggaaagacatagacaattaagagaaagtggtcgtgagctagctgtttcttgggctctatgtgctgtctgtcttgttggccatttctctcatttctttgcagcaaaggcaccatggatccatgtatttcattccattgggtttcatctttccttgtctttgtttacgttgcttggtcctggccgccaacttatccttgatggcttaaaaagccttcttaaaaggacgccaaatatgaacaccttagttggtctcggggctttatcatcatttacagtcagttcatttgctgccttgctgccaagattgggttggaaggccttcttcgaggaaccaattatgctaattgcatttgttttgttaggaaggaatcttgaacagagagctaagattaaagcaaccagtgatatgacaggacttcttagtttattaccaccaaaagctcgccttcttttgaacaatagggaaacagaggttggctcggttgttgaagttccttctgacagtctttctgttggagaccaaattattgtattacctggagatcgtattccagctgatggaattgtgagatctggtagaagcactgtagacgaatcaagttttactggtgaaccactgcctgtaacaaaagtagccgggagtgaggtagcagctgggagtataaatcttaatggaactcttacaatggaagtgcagagaccaggtggtgagactgctatggcaaacattgttcgtctagttgaagaggcacaaagtagggaagctcctgtacagcggttggctgacaaggtgacctttctaggggggtcaaagcatcctattcctcctgttaaggagtga

SEQ ID NO: 46863 - DNA, 744 bp, Glycine max
  Peptide Sequence Number=SeqID_163641
atgaccggtggccacgatcgcgtgaagggttcatggagtcctcaggaggatgcgacgttgctgaaactcgtgaacgagcacggggcacgcaactggtccgtcataagcgccggaatttccgggcgttccggcaagtcgtgccgtctgcggtggtgcaaccagctgagtccggaggtgcagcaccgtccgttcactccggcggaggacaagatgatcataaaggcgcacgccattcacggaaacaaatgggccaccatctcgcgcctcctccccggccgcaccgacaacgccatcaagaaccactggaactccactctccgccgccgtcgcgcggtggagtcatcctcctcctcatcggcgtctccgccggcgaaacgtcactcttccttgtttgacacgcttcaccctttcaagaaacagtgcatcgagaaggaaaacgaagaagagcgagtgctgagtcccgttacgacgtcgttgagtcttttccctcctggggaaaaatcagaggaagaagaggaagaggaagaacaagaagaagaagaaaaggagaaagaagagttgtttcaagtgaatgttaatgttaatcagaaggttacggatcagaattacttcatgcagatgatgcagcggatgatagcggaagaagttaggaattacatggagactttgcgaaattgccaaaggaacaacggtctctcccttgagcctgggttagatcttcttcctccgacgcttccaaagtaa

SEQ ID NO: 46864 - DNA, 333 bp, Glycine max
  Peptide Sequence Number=SeqID_163642
atgacttccaagatacaaatattatcaatcctaggcatgttggccatgttctttcttatctccacggaggtgttagccactggattacatggtgttggtgttggtggtggattacctggtgttggtgttagcgctggattacctggtgttggcactggattacatggtgttggcggcgctggattatctggtgctggtggcgttggattatctgccgacgcgggattatctcgtgctggtgacgctggattatctggtgctggtggcggccgtcgtggtcgtgctggctccccttcttatcatgcaagttcccccagtggtggtgtcaaataa

SEQ ID NO: 46865 - DNA, 267 bp, Glycine max
  Peptide Sequence Number=SeqID_163643
atggggcccggaggaggcagttatggtggtggtatacctggaatgggtttgcctggtggtgggtacagtggcgggcccaaaggaggcggttacggtggtggtattcctataatgggtttacctgatggggatgggcccggtggaggttatggtggcgggcctggaaacggttttcctggtggtgattatggtggcgggcctggtggtggatatgatggagggcctggaggtagtcttcccggtgggggttacaggggaggaccctga

SEQ ID NO: 46866 - DNA, 1038 bp, Glycine max
  Peptide Sequence Number=SeqID_163644
atgcatgcctcactagtgtctctctcacttgccaataacctttatgttcttcaacagtgcaaaatgtttaccataatcacaatgtttttggttgttgcttgtccatgtgcacttgggttagccacacctactgcagtgctggttggaacatctttgggagctaagagaggattacttctgcgtggtggaaacattctagagaagtttgccatggtaaacaccattgtgtttgacaaaacagggaccctcacggttggtagacctgttgtgacaaacattgtcattcctacttgcataaaaaatgcaatttcaagacttgcagttaaaagccaaactgaagaaaatgctttgtctgatgttgaagttctaaggttagcagctgcagtggaatcaaattcagtacatccagttggtcaagcgattgtcaatgctgctcaggctgctaattgtcatgatgctaaggtaaaagatggaacattcctggaagaacctggatctggtgctgtggcaacaattgataacaaaaaggtttctgttgggacgttggaatggattaccaggcatggagttattaacagtatacatcaagaagtggagaagagtaataaccaatcctttgtctatgttggagttgatgatactttagctggcctaatttattttgaagatgagataagggaagatgcaagagacgttgttgacagattgtcaaagcaaaatataggtgtatacatgctatcaggagacaagaggaatgctgctgagcatgttgcttcccttgttggaattcccaaagagaaggtgctatctcaagtaaaaccagatgagaaaaagaagttcataaatgaactacagaaagataagaacattgtagcaatggttggtgatggaattaacgatgcagctgccctggcttcttcacatgttggtattgcattaggtggaggtgttggggctgctagtgaggtgtcttctattgtattaatgcgcaatcagctctcacagtattcatctgtcaaccataaaatttatggttaa

SEQ ID NO: 46867 - DNA, 978 bp, Glycine max
  Peptide Sequence Number=SeqID_163645
atgtctcacttcggacgttcgggtcccccagacatttccgacacttactctcttctcgttctgaacatcaccttccgtaccaccgccgacgacctattccctctcttcgacaagtatgggaaggtcgtcgacatcttcatccccaaggatcgaaggactggtgaatcgaggggttttgcgttcgtgcgttacaagtatgctgatgaggctcagaaggccgttgagaggctcgacgggagaatggttgatggtcgcgaaataacggtccagtttgcgaaatatgggcctaatgctgaaaggattagtagtgttgttgtttggggtgagaatggaatgcctggagaaggaagatattactatatgctggtcacaaaggaaggattattgaaacatccccaagatcaaggcgatcaaggagccgtagcccaaggaaaaggcatcgtgatgattacagagacagagattataggagaagaagtcgcagcagaagttatgataggtatgaacgtgacaggcatcgtgggagagacaaagattatcgtcgcagaagtaggagccgtagtgccagtcttgattacaagggtcgtggtagaggacgctatgatgatgagcgtaatagtagaagccggagcagatcagttgataggtattcattcattgttagctagctctttcaactgtgagtcccctccccctcagaggagcacttcccctcaaaggagtacttcccctaggaagagtccacggggtgaaagtcctgcaaatcgtagccgtgaggaacgttcccctacccctcgcagtgtctcaccacgcggtcgccctgatgcttcacgaagtccttcccctcgaaattcaaacggggatctgactgttgctgccctttatgctggaatcgggttggcaatggtatcagcggttgatactgatgatggctgtctagctgtgctgctggtttctgttgattccaaagccacttga

SEQ ID NO: 46868 - DNA, 331 bp, Glycine max
  Peptide Sequence Number=SeqID_163646
tttggtacctgttgaattattagaaatcgagcggcaacttgatgcccgacttcgagtcttttatcatccggaacaattagacaatggtgttactcctggttggtatatatgcctcaaagacttcaatgcattgcccaaaaaagacttagtcattgtcacatgtgaccttttttatgcttgttgcctcacgacattaaaacccccaagcatggacactagaatacataatggattttgcaacaatgtaagagcttcaagacataggtgggtcatatttcatatatatcaagcttcttcacatatttgttttaagcatatctcttttgactaa

SEQ ID NO: 46869 - DNA, 177 bp, Glycine max
  Peptide Sequence Number=SeqID_163647
atgcagtccaagtttcaatcgcagatgcaatcacagggactcacactgcctcctaagtctgaggttggtccttcaattactcatgtcagcacaaacgagagttgtgttgatccctcagggaacgacccagacacagctgactcagagaaatgtggattggagctatggaaccagtga

SEQ ID NO: 46870 - DNA, 279 bp, Glycine max
  Peptide Sequence Number=SeqID_163648
atggtgaagaaaccaactcacctaggcgagctcattacttcagcactaagtttcagctcgcctgggcgagctgcaactaccccaaatgaccctttgcctataaataggcatcctaggggtgttttaaggggttccaaggcattttcctcgaataaacgttggtggcgaatcccggacattttcatttttggaagacgctcctttggcttttcgctcgccctcccatcaaagggtaggttgcaacagatggcgactccactggggatgttagagagttaa

SEQ ID NO: 46871 - DNA, 159 bp, Glycine max
  Peptide Sequence Number=SeqID_163649
atggcccaagatgagtgtgttggttggggcacatactatggcgcgtttgaggaagaagacgaagacaaatatatctctacaatcttcacgggagaaacaggacagtattacaaggactcaggcatacaagtcctagtgtcgactagaaccgtgttctag

SEQ ID NO: 46872 - DNA, 510 bp, Glycine max
  Peptide Sequence Number=SeqID_163650
atgaaggacaacatggcaccggtggcggcaactagcgaggaggttcaccaggaaggagtcaggtggcttattgatgacaacagtgaggtggatcctaataaggatatgcatgatgtatcctcacagggatcctattatagtttggcaaccatgattgagtacaagcagtttttagttggtgagagtttgccattgtaccatggcaaaatcgataagccaaagcaaccgtctccaagggagaaaatgagcggagtcgccaccaacgtttattcgagaaaaatgttagaaaaaccaaaaagaggtctgcaaattttgaaaagaagggttcgggaattgtttacgcatggggaaggtattagcaccccacacgcctgtcacaagggacagcagcctttaatcgagtggcacaacatgacttcaagattatttattttccctttttatatttttttgctttttggggtcgacaagggtgttgcccttgctcctacctatcctcaggtgcgatga

SEQ ID NO: 46873 - DNA, 213 bp, Glycine max
  Peptide Sequence Number=SeqID_163651
atggcgtccaaccgaaaaagcagcagctgggctcgcggtggaggagaaggctcgcggaagagggaagcaacgttgagggcagcggtgaaggtgaaggtaccggcgtcgagcgttgcgatggtcggtggcggcaaacgagacgtatggacatacttccggatcaagttgatccctaagtgttttacggatcaacttgatccggaagcggcttga

SEQ ID NO: 46874 - DNA, 973 bp, Glycine max
  Peptide Sequence Number=SeqID_163652
atggcctctctccttcctcaaccccaagaaaccaaacccaccgccaccaccgccacagaaaccactcccagcgaaacatctatcactgctagtgccaacaaaagcagcagcagcaacaacaacaatagtagtagcaatagtcgtaagtgcaaaggtaaaggtggccccgacaacaacaaatttaggtaccgcggcgtcagacaacgaagctggggcaaatgggtcgccgagatccgcgagccacgtaagcgtacgcgcaagtggctcggaacatttgccaccgccgaggacgccgccagagcttacgaccgcgccgccatcatcctctacggttcgagagcacagctcaacctacaaccctccggttcctcttctcaatcttcctcttctcgctcctcttcctcttccactcaaaccctaagacccttgcttcctcgcccttctggttttactttcaattttcccttcaactccgcccccgccaccaccgtgccttacccttataacaatagtcacaattacacttacaccccacccgtgttgtaccctattgataatagtaagaatcacaatattaatacagtgcaagttcatcatccacatcactatcgttgtcctgaggaagtggtgcaagtgccacattcggaatctgatttggggggtttaggtgggaataataatattgttgttgatggttctattagatcaacctcgtaccagcggcatggttttctggataatattaataataacaataaccatgtgcatgtgcaagtgcaacatggggttttttcgaatcaacagcagcaacatcagaatagcgtggtggagggagtgaattcctccgtcgtgggttcggtttcgtcttccatggatgcttcttcggtggatccggatctggcgttggtggggacaatggggcttggatcttcttcgcctttttggtccatggcgaacgaggatgattacactg

SEQ ID NO: 46875 - DNA, 180 bp, Glycine max
  Peptide Sequence Number=SeqID_163653
atgacaatggtggtgatgtcgtgtggtggaggcatcaaaggcaaggttcaatggtggtggaacggtggaggcgatagtgatgatagtgatagtgtggtggtgaggttacatcaacaggatgtaatgacagtggtagcactgaatggtggtgacaacgacggaagtgatgatatcagttag

SEQ ID NO: 46876 - DNA, 1086 bp, Glycine max
  Peptide Sequence Number=SeqID_163654
atggatagtttcacacctttttcgccaagaggtgaggcatgcctgcccgttagaaagccaccgttcatgcacaaagaaaggaagggcgaattgggaccaactcttagcaaacagagagggagcatctgtcaactgaatctcattcttgcgataaggcaactttgctacccgacgagaggggcaccactagaggaagagctcgcacctgtcatttcacgagggttcagtgagaccaacgtggagacgcttcggaaggtccgcaaagaatgggaagtggtacaaaagaaggacaaagagctcagaggcagtaacaataggcccattggtggctaccgtgagtggttgaaagcccacgtgcaaggtttggaaatgctcccaagtctgagaaccgctaaaagggagggaattgaggcactggaggaagacgaagaggtgcaggctcttaggacagaactcgagcaagctcaaacaatcaaagaaaggttcaaatcagcagctctgaaaatccgaaaagagaatgccgaactgagggatacaaatatagctaccaccaaggccttggaacgagagaccaagagggctcgtagggaagaacacggccggaacaagtttcgaggggctctgtggggcagcaacagcgagcttaagctccgaagagaggaaagggaccgatcacgagtagacagtttgatcttgaaagatgagttgaaggtttgctcaaggtccaaaagaaacttgtctcagcaattatgcgagacagagaccaacatgttagctatcgtcagcaaataccaagaagagctaaatctagccacggcccacgagcataaagtggcggacgagtattcccgagtgtatgcagaaaaggagtctagaggaagggtgatcgactcgttacatcaagaggcaacaatgtggatggaccgatttgttcttaccttgaacgggagtcaagaacttccccgattgctagccaaggccaaagcgatggcagacacctactccacccccgaggagatccacggacttctcggctattgtcagcatatgatagatttaatggcccatataattagaaaccgctag

SEQ ID NO: 46877 - DNA, 594 bp, Glycine max
  Peptide Sequence Number=SeqID_163655
tacatggaaaccttctcctattgcatccccagcgttgacgacgtgggctacatcacctttggctacgaccctgacactgactttgataaaagaatcaaatacacccctttagtcatccctcaaggtggcctaaaccattacggtctcagcatcactggcatcgccatcgatggtgatatactccctggccttaacttcagccaaatcaaccatgccggcttcatcattgactccggcaccgtcttcacccgcctccccccgaccatttacgcaactctccgttcagtatttcagcaacgtttgtccaactatcccactgccccctcgcacaatgtatttgacacgtgttatgatcttactggatatcattatccaattcctgaaatgtcattcgtctttcctggcgtcacagtggacctacacccgccaggggtactctatgagttcgatgataaacagtcttgtttggcatttattcccaataaagatgatagtcaaataaccatatttgggaacgtccaacaaaaaacccttgagattgtgtatgataatccgggtaatagaatagggtttcgttctgatggttgcagttga

SEQ ID NO: 46878 - DNA, 915 bp, Glycine max
  Peptide Sequence Number=SeqID_163656
atggaattggtgatcctcgggtcgtgggtagaaacgggtgatattttagtgggtaaattaacacctcaaatggcaaaagaatcctcgtattcccccgaagatagattattacgagctatacttggcattcagaaacgtgaaattaaagtaggagataaagtggctgggagacatggaaataaaggtatcgtttcaaaaattttgtctagacaggatatgccttatttgcaagatggaagacccgttgatatggtcttcaatccactaggggtaccttcacgaatgaatgtaggacaaatatttgaatgctcgctcgggttagcaggaggtatgctagaaagacattatcgaataacaccttttgatgagagatatgaacaagaagcttcgagaaaactagtgttttctgaattatatgaagccagtaaacaaacatctaatccatggatatttgaacccgagtatccaggaaaaagcaaaatctttgatggaagaacagggaattcttttaaacagcctgctataatgggaaaaccttatattttgaaattaattcatcaagttgatgataaaatacatggacgttccagtggacattatgcacttgttacacaacaaccacttagaggaagggccaagcagggaggacaacgggtaggcgaaatggaggtttgggccttggaaggatttggtgttgctcatattttacaagagatgcttacttataaatctgatcatattaaaactcgccaagaagtactcgggactacgatcattggaggaacaatacctaaacctacagatgctccagaatcttttagattgctagttcgagaattacgatctttagctatggaactgaatcatttccttgtatccgagaagaacttccggattcataggaaggaagcttaa

SEQ ID NO: 46879 - DNA, 1247 bp, Glycine max
  Peptide Sequence Number=SeqID_163657
atgaataatgttctatccgcgatgatggtctccccaggcttgttaccatcagggactttgctagattctctgattcatgtgtgcaatgaagttggctcaatggagaagtttcccttggtacacacaagaaacgtttcaaccatgataaggaggatcaaacttctctcttctttgtttgaagagattcaagaaacggatactccactccctccttcctcgatcctgtgtctcacagaactcttctctgtgataagaagagtcaaagttttgatccaagattgcaaggatggaagttctctttggagtctcatacagttagagttcatatccaaccaattttatgtgcttgttaaggagatgggaagggcccttgatatcctttccttgagtttgcttaatgtaacctcagatattaaggaacaagtggagcttcttcacaagcaagcaaagagggctgagttactcattgatcctagagagcttcaccgaagagaacagcttatacaagtaatggccaacaacagtttacaaaacaagaagaagaaggggctcgttgactttggcaaagtggaagagatattaagtagcattggtttgagaactccatcagattatgaagaggaaatatccaagttagaggctgaagctcagaaccaagctggcacaggaggattaattgttgtctccaatataaacaatctcatatctctgatgtgctattccaaatccatgatattcaaagaaggagagagtgatacaaaagaagattgtaagccactatcttcatttttgtataacaaagtatatgatagttcttcatcctctcagtccatgacacctaatgttcctgatgaatttcgttgtccaatttcacttgacttaatgagggacccggtgattgtgtcatcagggcactcttatgatagaatctcaattgcacaatggataaactctggtcatcacacatgccccaaaagtgggcaaaggctaattcacacggctctcataccaaactatgcattgaagagccttgttcagcaatggtgccatgacaacaatgttccagtggatgagcctaccaccgaaggaaacaagaacagcagcaagaagttgaaggaagatgctgtagaccatatttctgcaaacaaagccgctgcggatgctgtcaaaatgacagcagaatttctagttggaaaattggcaactggttctgctgacatccaaaggcaagctgcatatgagcttcg

SEQ ID NO: 46880 - DNA, 1278 bp, Glycine max
  Peptide Sequence Number=SeqID_163658
atggcgacttctttgaccttcacttgtattacagttttcttttccttcttcttgtctttcaacaactatgttaaaggtgatctcattccaccatctacttgcaatcgtacttctattaaaggtctcaatagaaaaatatcattggagttggtgcatatggatggaccatgctcccatttgaagcgtaacaatgttgtcaacgacaatgattttctgagggaccatgaaagggtgaagtacattcagtcacgaatttttaagaataataatttgactgaattagattcatcagtgagcataccaacgattccaggtcttccactttcaactttaaactacattatcgttattcgtcttggaacgccagaaaatagttatcaaatggttcagtttgctcagataagacatgtaaaggccctcatgaatactagacaaggtctcaaatgtagtaaggatatacgcctatgccactatagtatccgttatggagatggatcatatagcacaggcttctttggcaaggatcgtctagccctatacagcaacatatctcctaacagcggcataacagatgacttctactttggttgtggcataatcaataagggactttttcatcgtactgcaggcgttttcggcctaggccgaggagagctctcctttgtgtctcaaacctcgtcacagtacatggaaaccttctcctactgcatccccaacattgataaggttggttacatcacctttggccctgaccctgatgctgaccacgatgagagaattgaatacacccctttagtcatccctcaaggtggcctatcacattacggtctcaacatcactggcatcgccatcgatggtgatatactcatgggccttgacttcaacgaaatcgaccacggcggcttcatcatcgactccggctgcatcgtcacccgcttacccccgaccatctacgccaagctccgctcagtgtatcagcagcgtatgtccaactatccctccgcaccaacatacactccatttgacacgtgttacgatcttagtggatttcattatccaattcccgaaatgtcattcgtgtttcccggtgtcactgtggacttgccccgggcagggacattctatcagctcaatccaaaacaatattgtttggcatttattcccaataaagacgatagtcaaataagcatatttggcaacatccaacaaaaaacccttgagattgtgcatgataatctgggtaataaaataggatttcgtccaaatggttgtggttga

SEQ ID NO: 46881 - DNA, 246 bp, Glycine max
  Peptide Sequence Number=SeqID_163659
atggtttaccaaagatcaaagtgtcatccgcaaatttcaaggaggtcagatctagagataggtgatgtcggcatcaaggacaatgatgtaacatggtggaggggcccggatttgaccgtgaagaggtcagatctagagaaagatgatgtcgatgtcgacgacaacaagagaacacgtgaatctaagagcaactttagtatcaaatctgttggaaataaggcttttatgtttaggaaaagtgtttag

SEQ ID NO: 46882 - DNA, 322 bp, Glycine max
  Peptide Sequence Number=SeqID_163660
atgatcgaaagttttcaacaacaacaacaaatatcagttctagaattgtacgtagaaaaggatgttgctggtggttcgatttttcatgctgcaaattctgttacgtcatgtggatgtaatgtatctcatcatgaatcggaactgccaagaaatataagtaatttacatgatgatgaagatgatgatgatgacgattaccttgcatctaactcatacgttgaagagtctttcaatgaagatgatagtgatgatggaatatctgatacagacgatgaagtcactgacatcgttgaaccagtttcaattgttcacccaaccaaag

SEQ ID NO: 46883 - DNA, 903 bp, Glycine max
  Peptide Sequence Number=SeqID_163661
atggcagcatcacccaccacaccagacaacataatttcaaaggaacctcccacaaagatcattgtgtgctgtcagtacatacatgactccaacatgctatctggtgtggcgcgggagcacgaagaagcatgcagggcaacgaatcaagccgttggcattgcaagaagaacagcttctaaatccgtttttctctgtgaagactttgtggcttccgttgcactcatcgcacactacgaatctgaagcctccgcaagaatcgcaggcgttgttctggttggagcgcgggaggcgttcgatgagccggtggagctcgccgctctcgtggagctggcggacgtcgtcagctccgccaacgtagatgccaccgacgaatacgcgcggcagggcgaggttgctgcggcagccgaggacggcgtggagctcgtcgcggaagcggtcgtcgatggagacgtcgcgctcgtcgacggcgacgcggaggccgcgcaggatggatcggacggcgcggcagtcacgacgacgccttggtcgaggccgggcgggagtgcggcgggaacggtggcgcgtgaggccccccaggcgcggagcacggcggtggagatccggacgcggcggaagagagacggagatttgggagcggcgggttcggattcggggttgtcttggaagaggctctggatatctttgaaggaggagcaggagaagctgaaggagcgagttcgagaatgcgatggcgatgacgacggagagggtgagggcggtggagtgttgcggaacccgctcggtgagttgagccacggtggccacatgagaagtggtaagaggaaaagggttttgagggtagtgaagagtggagaaggtgatgggcacgcaaagaaaacgaaacgaagggggtgggggttataa

SEQ ID NO: 46884 - DNA, 1938 bp, Glycine max
  Peptide Sequence Number=SeqID_163662
atggccaagaacaggaaactcactcggttcaaggatctttctatagcttttcgctttgtggcagtttttttcttgcttcagaaattggggttgtgttgttctttaaatgaagaaggtaatgctcttttgaagttgaggcagcgaatagtgagtgacccttttggtgctttgtcaaattggatagatgatgaagtatctgttgacccttgtaattggtttggagttgagtgctcagatggaagagttgttgtggccttgaatttgaaggatctctgccttggaggaactctggggcctgagcttgtgaaacttgtcaacataaaatctattattttgcggaataactctttttctgggatcatccctgaaggatttgtagaattggaagaattggaggttttggatttgggatacaactacttcagtggacatctaccagctgatcttaggagtgatatctcactagcaattcttttgctggataacaatgattttcttgttggtttctctcccgaaataaatgaactgaggatgctttctgaatgtcaagtagatgaaaataagttaactaatgctgctaaaatgccagcttgtacaaaaagagtcaccacatggaatatcgatcaaggtaaaagtactcgtggcctactacaacaaaaggctaaaccccgtactaatcaaggccatttttatcgtgtggctgatccacctgtcaagagctctcctcctcctccctctgcttccccatcagcctcagcaaaaccaccagggccaaagttagctcctcataggaaaaatggttctgattctcctcctccccactctacaccaggttctggaacattatctaaaactgaaagcaactcaccaaaggttcatacatttcctattttgcccggagtcataggtggtgctgtgtttcttattttttcaagcattggcatatatctttgtaaaacaaaggtagctaatgtcagaccttgggccacgggactaagtggacagcttcagaaggcatttgtaactggtgcgcaaaagctaaggagatcagatcttgaagcagcatgtgaagattttagtaatgtaattggtacttcacccatcggtacactgtacaaaggaactttgtctagtggcgttgaaatagctgtagcttttgttccggtaacatcatccaggaattggtcaaagactttagaagctcaatttagaagcaagatagatacattgtcgaaagtgaaccacaagaattttgtcaatcttattggatactgtgaagaagaggatcctttcaccagagtgttggtttttgaatatgccccaaacggaacactatttgagcatttacacataaaagaggctgagcacttggattggggaacaagacttagagttgcaacgggtatggcttattgcctgcaacatatgcaccagttggaccctcctatgacccttatcaagctgaattcttcagccgtttacctcaccaatgactacgctgccaagctttcagatttaagtttctccaatgacataacctcagctgaggcaagagccattgacatgccaatagcaactccagaaagtaatgtttatagctttggtgttctactatttgaaatggtcacgggtcgtcttccttattcagtggaacatagggactcacttgaaaactgggcatcacactatttagaaggggaccagcccctcatagaaatggtggatccaattctagtgtcttaccaagaggatcagctggaacaagttgctgcattgattacatcttgtgtccaccctgatccacagcagagaccaacaatgaaagatgtgagtgagagactcagagagataacaaaaataacacctgaatcagcagttccaaaactttctcctctttggtgggcagaacttgagattgcttctgcagaagcacgctga

SEQ ID NO: 46885 - DNA, 1770 bp, Glycine max
  Peptide Sequence Number=SeqID_163663
atgtcaaacactgaagaagaagaagaagcaactccttcgaaccctaacaatcacagtcaacactccaccaacaacgatgtggaacctcgtgacgacgaagacatcgaagaagacgacgacgacgtcgttcaggaaccgaatcgcggaattccccaatccgcagcgtccaagttgcgggagcagcgtttcaaggtggaaagcctatcgcggcgcttgtcgtcggagctggttccgatccgagtccacgacgttgtcataaacggcaacacgaagacgaaggattgggtgattgaagcggagctgaaagacatcgagaacgccaccagcatgcaggagcttatgcaagcctcgcaaatcgccgttgccaggcttcagggcctcgaaatcttcgattcctgcaaggttcgcctcgaggctggaccccgagagcttccaaacactgccaatgtcatcgtcgacgttgtcgaaaccgataacaaagtttccggcgaattcggcgtttataccaaaccctcgtttcatcctggtgttctcccattagaattagagtttcatctcggtaagttggataatcctttaatgcaaacctttattatacggattactgaggtgaaactccaattcttattggagaacacaaatagcacctatggaactatatctaagttctgtcctaagattttacatactagttcttggactgctgaaggtgctcttaagtataagaatttgttgggttatggtgatctatgggatgcttctttggcctatggtgccaaccaagcaaccgaggtgagtgtaggggtgtatgcccctcgagttaaaggatttttgactcctattgtaacacgaatatccatgctttcccaagattggcaagagtcttcctcatacaaagagcggttgttgggtgcatctcttggcttaatctcaacaaagcaccatgacttagcatacactcttggatggcgtaccttaacagatccttcacagatgtcatccaggtctataaggaggcagcttgggcatggtttagtgtcatctttgaagtatacttttaaaattgataggagaaattctcctattaggccaactaaaggatatgcttttctttccaccactcatgttggtggccttacaccggatcccaggagcttgcggtttctacgtcaggagtttgatgttcgctttgctgtcccttttgggttttacaatacagcactaaaccttgggatatctgctggtgctgtttttccatgggggcatggattcagaaccaagtcttctccccttccagaaaggttttatttgggtggtgatttttctccagtttgcaccctaggaggaccaacaacattatggggatttaaaactagaggattaggtcctactgaacctcggaggcaaaatagagatgggtctaatgatgacaatgttgattcctctggatgggacttcgttggtggagatcttgctgttactgcttttgcagatctctctttcgatcttccaattaggtggttgagagaacatggaatccatgggcatgtttttgctggttcggggaatgctgctaaattaactcagaatgaatataagcacttctctcctcggaagttcttagaatcctttcgaatgtcagtgggatgtggagttgttattcctactagactcttccgcctagagggtaactacttttacatactcagaaaggatgaacatgatcgtgggaagactggatttaggtttagcttctcagctccatcatag

SEQ ID NO: 46886 - DNA, 1080 bp, Glycine max
  Peptide Sequence Number=SeqID_163664
atggcttccctaataacctccagcttctccattctcctcttgctatgcatgctaaagtccaccactgcctcgagcaatttctcggccatctttgcctttggggactccacggtggaccccggcaacaacaaccacttgttcactctcttccgaggggaccacttcccctatggtcgcgactttcccactcacctggcaactgggaggttttcaaatgggaaaatcgcaaccgattaccttgcccaattcctaggccttaaggaccttttacccgcttactttgacccgctagtgactgttagtgatatggtcaccggcgttagttttgcctctgggggctctggcttggatcccaataccgtggcattggccagggttttggacttgtcctcacagcttgcttcctttgaacaagccttgcagaggataacaagagtcgttggaaatcaaaaggccaatgatatactagaaaatgccttgtttgttatcagtattgggaccaatgacatgctctacaatgcatatttgatgccagcaacatcaaggatgattcgctatggttctatttcgggctaccaagattatctccttcaaaatcttaatgattttgttcagacactttatggagcaggagcacgtaggattttggtggcaggtcttccaccaattgggtgtctcccagtgcaagtgactttaagcagcatcaaagacctacattggctccaacgtgtgtgtgacgcccaacagaacatggattctcaagcctacaacaacaagcttcaatcccatatccatttactccaatccacactcaatgatgctaagatcgcttatttcgatatctatacacccattctcgatatggtccaaaatccaaccaaatatggctttgcgcaaactcttcaaggatgctgtgggacagggctcttggagatgggtcctgtgtgcaatgcacttgacctaacttgccccgatccgtctaagtacttgttctgggatgctgtgcaccttactgaagcaggaaactacgttcttgctgagaatggtcagcaaaatgtgattccataccttagtaattag

SEQ ID NO: 46887 - DNA, 138 bp, Glycine max
  Peptide Sequence Number=SeqID_163665
atggatgctccaaattcagtcatcacaagcctaggacataaggatgagctgggaagaattacatggaacaatggctggcttctcttcagaattttgaagcgtagaaagaaaactacatcatcttatggacctttttga

SEQ ID NO: 46888 - DNA, 2004 bp, Glycine max
  Peptide Sequence Number=SeqID_163666
atggctgccacaatgcacgcaaagattaaccgtagaaagttagacaagctcaacatcatcaatatttgcgaggagattctgaacccatcgattcctatggctcttagactttctggaattctcatggggggagtagtgattgtctatgagagaaaagtgaagctcctttatgatgacgtgacccgttttctggtacaaagctcaacattaacatttcctgcgaattcggtttctttttctttacacttctctgcatttgtttcctatgggtacaaggttgaaataaacgaagcctggaaagtaaaagctgctccagatcctacattgcttcccaagtccaaatccaaggccaagaaagaggctgttactctgccagggaccggtgagacgaatgtggcagatattgaacagtcccttcagttttccaacacaggcaccacaaatggatttcaacataacgcatattttaccatgcgacttgacagtgtggatgaacccttcattagtaatggagcaagagaggaccaagatcaatcagaacttctccatcaagttgacgcggagaatattaccttatttgaacgctttgaaacattccaagctaatgcggatccttacaatcatctcttatttgaacgctttgagaggtttgatattgaaggagatgaggaaacacaggtaaacgtaacttcagcagatcaaattccaaccacgcttgtgccctccccacctcatcaagacgaacccaccagagcttatgccaatactggggttttgatggaagagactactgtaccatctagaccaaactcgttcatgacccaacctcggtatggtttgacaactccatcaaacttagttcctcatcataacttagaagcttggaaagttgtgtgtcctgatacgtttcaagaccatcatcctggacacccagacattcagcaacctagtgaaggcatgatacctagacaggaacctaaaaggcggggaccaaataaaaggaaaagaggacagccatcgactatagaaatggattatgagcaaaccattattcctgctcatatatatcaacactggcttcagaatgcttctgatattgtctcgcgaagaggaagaaagaaaaagctaaccgatgtcatgtcttcaacaaagatagccaacctcatgaagctgccacccgttgtgctaattggtgatttatttactgctgaaaatgacaatatatattatccaaaagctattatggacttatggattaagagcattcaaccacctcatgattcaccttcagcccaccatcctccagaaccatcattttcatcgcctccaggagtacagaatgaagatttcatgcaatttccttctgaagattttgacagtaggccagactaccaggcacctccaatggaaaaggctcgggaacatatcctcttggatgaactgacaactagccttttgagagggcatgaagctactcctcatatctcatcagggaaagctggagacagtgtacattcctttccaagaccaacgtctgaaaatggtcctgcctcacattcagattttgattcgggaagaactgttaacagattcaaaaataaaaggtattcatcatctgcaaacagcagtggaggcctcgagccactaggaggccttgagccactagctgaagatgtaaatttcaagttagctagactgtatgaagatggtcccacacctgatcaagaactctttgtggaaacaggacccactcaaacacaagcaaacatcaatcatcctagtgacaagataaccgattcaatccaagcgcaaatgaaggcacattttgacacgcctggagctcctccagttgaatcccttcataacctagctgctggaatgacacggacatcagcagcacaacttttctatcaaatttgtgttcttgcttcccgcgatgcgctgaaagttgaccaaaaggttccctatggagagattgtcttctctagaggattaaaaatgtga

SEQ ID NO: 46889 - DNA, 413 bp, Glycine max
  Peptide Sequence Number=SeqID_163667
tttacaatcctaacaaggtaagtgttgttaaggctgaggcagttcctgtgctggttgagttgcttatggatgacaaggctggcataacagatgatgctcttgctgttcttgctttgctcctaggttgctctgaggggctagaagagataaggaacagtagagcattggtgccacttcttattgatcttctgagatttggatcagtgaaagggaaggaaaattcaataacccttttgctaggactgtgcaaacaagagggggaagtggtggcaaggaggctcttggcaaatccaaggagcattccttcactgcaaagcttggctgctgatgggtctttgagagctaggagaaaggcagatgcagtgcttaggtttctcaataggtgctgctctcagcctcatcattgtgtttag

SEQ ID NO: 46890 - DNA, 534 bp, Glycine max
  Peptide Sequence Number=SeqID_163668
atgggtgccaagtacctcgaagcggtcaagcaaaggttgcatgccatcaaacaatggttcccagacgaaattaggactttacaaggaaccactcagacattgacacatgacattgacatgtggcagttaacgtctgaagttaacggtcaacgtccaaattgggcttctaggaccaattttgtagcggtcacacccctggactatgcccagggctggccttggacgggcttgctaacaactaaggatgtttgggaaattgagcatttagaaatgcacaaagaagcaaaaggtggcagtggcactgatcaaaacaacgacactctcgtgtttctcttcttcactgccacacattttgtggcacttgttagatcattggcttttgtagtgatgtttctttcaatcatgagaaaactaggcttagcatttgcatctctcttcctctcattgccaaatcgtcctttggattgctactgcaacctcccttatgtcttgaagttgttggatttcccaaagtcatattgcaagcttcattga

SEQ ID NO: 46891 - DNA, 462 bp, Glycine max
  Peptide Sequence Number=SeqID_163669
atgtctatctctttgacccgtttggcatggtcaatgtggggagggagaggaaaggagaaaaagcccgtttcttccaaagcctctgctttgaattccaaacaatcttctgaatggggtcttgctaaggagacaaagatgggcccaccacataggaaagttggaaggaacaaggaagagagaagagtggatagagagtacgatgatgatgttgtgttggtaccatgtgataatgattgtaactgtgattgttgcttgtctggttctgaatctgatgactcagattggtccattgggtggttggagcctctagcctctgattttcggagcaatggtgatgatggttttgcagtgctggttccttgctataaacctagctgctgcaaggtggtggaggaggcatcaaacaaggcgcttttgggtgtcatcaagaacctctccaatgaattttcttcagaaatgtag

SEQ ID NO: 46892 - DNA, 1788 bp, Glycine max
  Peptide Sequence Number=SeqID_163670
atggcgattttagctgaagacttcttcaaggagagaaaataccctttcattgtcactctcttaatcttgctcatttgcgtcacgctcttcctcttcagcttcaaccacaccacctcaaacactgttgctttctattctgttatccaagagaaaccaccccttaacccttctcaagcatctgctgattatactgcaaatccaaaagtgcaagagcttcccccaaacgtgaccaatgtgaggttcgattggaagctatgtaaggaaccgcagaatgttgattttataccctgtttggataatttcaaggcgattaaggctcttaagtctaggaggcacatggagcacagggaaaggcattgtcctgagactagactgcactgtttgctttcccttcccaaagggtataaagtcccagttccgtggcccaagagcagggacaagatttggtatgataacgtcccttattcaaagctggtggagtacaagaaagaccaacactgggtagtgaagtctgggaaatatctggtctttccaggtggtggtactcagtttaaagatggggttgaccattatattaagttcatagagaagacattacctgcaattaagtggggaaagcataccagggttattctagatgttggctgtggtgttgctagctttggtggctatctgctggacaaaaatgttattactatgtcatttgccccaaaagatgaacatgaagctcaaatacaatttgctttggaacgaggaattcctgcaactctttctgtcattggaacacaaaaactgacttttcctgataatgggtttgatttgattcattgtgcacgatgcagggttcattgggatgcagatggtgggaagcccttatatgagctcaataggattcttagaccaggcggtttctttgcatggtctgctacaccagtttaccgtgatgatgaaagagaccagaaagtatggaatgccatggtggatataacaaaagccatgtgctggaaggttgtggctaagggtcatgattcatctggaattggacttgttatataccaaaagccaacctcatcttcttgctatgagaaacgtgaagagaacaatccacctttatgtgaaaataaggatggcaagaatatctcatggtatgccagactcgatagttgtcttactcctcttccggttgatggtaagggtaacctgcagagctggcccaaaccttggccccagaggcttaccagtaagccaccgagcttacctacagattcagatgccaaggacaagttcttcaaggacagcaaacgttggtctgaattagtttcagacgtttatatgaatggtctttcaataaagtggtcaagtgttcgaaatgtaatggacatgaatgctggttatgcaggatttgccgcagctctcattgatctaccagtctgggtgatgaatgtagtacctattgatgtgccagatactctttctattataatggacagagggttaataggaatgtatcatgattggtgtgagtcctttaacacctatcctcgcacatacgatcttcttcatgctagctttcttttcaaatatcttgagcaaagatgtgacatcgtagatgtggctgtggagattgatcgcatattgagaccaaatggatatctcgtggttcaagattctgtggaaatacttaacaagctcaatccaatcttgcgttcacttaactggtctgtaacgttgcatcaaaatcagtttcttgtaggtagaaaaggtttctggcgtcctacgagctcttga

SEQ ID NO: 46893 - DNA, 396 bp, Glycine max
  Peptide Sequence Number=SeqID_163671
atggagaacctagcgcaggttgcagggttgaacgcaatgagcgtgacgaacacggtgataacggcggcgcacaacgcgagggcgcaccggcggaactgcgagcgcatggcggcgcaggtgaggatgatatggaacctattggaggcgctgaaatcgacggaggtggcgcggttgcctgcgacgaaggaacccttggacggtctcgaagaggctctgcaggaagcgttggatttggtggaaagttgcaaagacaggagttacctgtacatgcttgccatgggttggagcgtagtgaatcagttccgccacgttcaggcgcagatcgatcgctaccttggactcgtgccattgatttccgtagtccatgactttcgtatgcaggttagagacaaatga

SEQ ID NO: 46894 - DNA, 192 bp, Glycine max
  Peptide Sequence Number=SeqID_163672
atgagtactcttcctttagaaaacaccttgccggcttcgcaaccggtacgttcggtcagtgatgtggcaaggctgatcaacacccgcagtagcaaaaacaactatgcgcgcatgattgtgtttctcgcgttgggtggcgtgttcctcgacgcctacgacctgaccacactgtcgtacggcatcgatgacgtg

SEQ ID NO: 46895 - DNA, 714 bp, Glycine max
  Peptide Sequence Number=SeqID_163673
atgaccggggaacagaagctgattgactatgtgggtgagcatatcgcgccggactacggcctgaagctggaggcggtcggtgtgcaggatccggtgcaggcggaccgtgcggtagcagaagggcagtatgctgcgacggtctatcagcatcagtggtggctgaagcaggtggtcgatgctaacggcttccagctcacttccagcctgcctctgttccagtgggcctttggtatttactccgatcgctaccactcggtggcggatctgccgcagggcgcaaccattgtggtgcccgacgatggggcgaatcagggccaggcgctctggctgctggcgcgtcagggattgatcaccctcgatccaacggtagaaccgcgcaccgccaaactgaaaaacattgtcggtaatccgcacggtttcgtgtttaaagaactggatctgctgaccatgccgcgggcgcttaattcggtcgatgcagcgattggttatgtgtcgcagtttgacgccggtaaagtcccgcgtgacaaaggtattctgttcccgcccgcgccgcgcacctttgcctcgcagctggtgatcggtacgccttacctggagcaggagaacatcgtcaaactcaggcaggcttttgccgatccgcgcgtacagcagtggctaaaaaccaccgatgacccgctggtcaaaggcgtgctggtgccggtttctgctgaataa

SEQ ID NO: 46896 - DNA, 584 bp, Glycine max
  Peptide Sequence Number=SeqID_163674
agagtcatgaaaggaggcccttggactttagtcacaatcttcctctcggattcgctaccattgttgttggccagaacatagggaatttcctaggggaattcctcgactatgatgacaagcataactcgatatcatggatgtccttcatgaagattagggttctattggacataaccaaacctctcgagtgcactaagaagatcagaaaagagggtggagatgaaaagatcatcaacttcaaatatgaaaggctaagtctgttttgctatttatgtggtttcttaggacacacagaagatttctgcagcaaactcttcaaggttcaggtggatgatggccaacgatcatgggacactcctccgtcgtcaatggcagccggttcacgctatctcagggaagaaggccagtcttcctacgtggcacaacaagatttgggggttgcaaattcaatgccatttaattcgaatttgaaacctgccaataatgaggcacttattgccgcggaaaagaagcataacgagctgttgattgcagcattaaagtcaccgaatattctcctaccacagccatcaatagcgcattaa

SEQ ID NO: 46897 - DNA, 747 bp, Glycine max
  Peptide Sequence Number=SeqID_163675
cacgtcctcgctttcagaggactacacgtcctcgccttcagaggactacacgtcctcgccatcagaggactacacgtccccaccttcaaaggtttgcacgtcctcaccatcagagggctgcatgtcctcaccttcagagggctgcacgacctcaccttcagagggctacacgccttcaccttcagagggctacacgtcctcaccattagagggctgcacgccctcacctttagaggattgcacgtcctcgccaccagaggactacacgtcctcgccttcagaggactacgcgtcctcaccttcagagggctacatgccctcgccttcagagggctacacgcccttacctttagagcattacacgtcctcacctttagaggactacacgtcctcgtcatcagagggctacacgtcctcacattcagagggctacacgccatcaccttcagaggactacacatcttcacctttagagggttgcacgtccttgccttcagagggctgcacaccctctcctttagtgggctgcacgccctcgcttttagagggctggacgcccttgtcttcaaagggggtcgcgcccacaagacacccagtggacccagagaagtccaacaaggtcctggggtttctagctcgggttatgggcctctggatcacgcccgcaagacacccagtggacccggagaagttcaacagggtcttggggtttcgagctgtgattacgggcctttgtcagttctatga

SEQ ID NO: 46898 - DNA, 433 bp, Glycine max
  Peptide Sequence Number=SeqID_163676
atggtgccgctaagcgtgaaccttgagaagcttagcgcaaatccttgtggcaacgtccagctaagcgaaccatgtctcactaagccgccaatggcttctaggaaacacaagaccattggttcaagacccacaacacaatatgatacaaggagatttcactccttagattcttggaaccgatacacagataatgtcctggggagaaacatctttcctgagaggaaggtggagctctaccacactgagcaagatgattttaagattgaattggagaggcataatttccataaacaccttaccaatttggttgatgggagcatagacttggctttgggaccttcaccaaagcaagccagagtcaaaggccatttagtgaagattgatgctgacagtctcaacacattcctagagacacctgtggtattgttagagg

SEQ ID NO: 46899 - DNA, 411 bp, Glycine max
  Peptide Sequence Number=SeqID_163677
atgacaaaacctaggcttcaatgcacaagctgctcctcttctctgcttctagggctcttttccccaaataggcctgtggctgctcaagaattctatgccctggccgtctgtagaagctgtcataaatgtgtcataaaggtgcgcactgatctcgcgcatattgcacggtgtcgcaacctacccttcagcgggagggcgacgcgagggctcacgggtgcctcttccaaggaaggaaaacgcgcggagtcgccaccggcgtttattcgaggaaaacgtcggaaaaaccggaaaaaggcattgtctacaactttaagtgggaaaggttcgggagttgtatttacgcatggggaagggtgtttcctttgctcctatgtatttctcaattgtgataaggaaatcagacctacgtag

SEQ ID NO: 46900 - DNA, 1204 bp, Glycine max
  Peptide Sequence Number=SeqID_163678
atggcaattccattcaagacaaaagatgtcaacgaggaagtaacctctaaggacatcaagagcctaatggaacaggcaaattataccaataaatatttacaagctttaggagaaaccataaaaactaaggtagttcctaaacaaaaatcaattgaggaagcttcgccaagtatccccattgaaaaacctttattcaaacctttcaaagttagtgagaaggctaaacgaaaaattagggaacttagaaaaactaaatccttaattgaaggcgtaggtgataaccatagtgaattacttaacaagattggtagtttacttaaggtcattccagatactccccaagcctcggaaaatacttccaaaatggtaacaagaagtacctccaaattgattaatgttattaatgaagatagtgaccaaaactcagattacacaactgagataggatcagtgtcagaaaagaatataaattcaattaattccaaacactggaaaacaccctccaaattatattatcaacgtccaactgcccctgacctactattagaggaaagagatgcacaaacggagtataacatcatgaatacactccaacatatgaccatggtagccatgacttaccaaacctcccatgaatgttcagaagaaaccattatagatatcttagtggcaggattttctggacaactgaaaggatggtgggataattatctcactaacgaagaaaagtcaaaaatttacagtgcagttaagacggatctcaatggaaaagtcattactaatgacgatgataaagagattcctgacgctgttaacacattaatttttacaatagcccaacatttcattggagacccatccttgtggaaagataggtctgcagaattattatcaaatcttaagtgtagaaccttagcatattttaggtggtacagagatactttcctaactagggtttacacaagagaagatagtcaacaacctttttggaaagaaaaatttctagccggtcttcccagatcattaggagacaaggttagagataaaatccgaagtcaatctgccaatggagatattccatatgaaagtttaagttatggccaattaatttcttacgttcaaaaggtagtcttaaaaatttgtcaggatgacaaaattcagaggcaattagccaaagaaaaggctcaaacaaagaaagatttag

SEQ ID NO: 46901 - DNA, 450 bp, Glycine max
  Peptide Sequence Number=SeqID_163679
atgcctcatatagtagtcataactcttgcaagaagaaagaaggaaaatactaagattgtgactattatgaagaaagacataggtcacatcttagacctcactcccataggaaagaaaaagaaagaaagcctcaagaggctaacattaacctctcatactcccataggaaagaaaaagaaagaaagcctcaagaggctaacattaagggtagagcaacaacttaaaagaaagtctacttcaaaatcttatggctctcactcttatccaaagaaagaccaaggtcaaggcatcttaggggtgacaccttctaagcccaaagatgataaggggaagacaatagaaaagcaaccccttaaggctagtatgaaagagaagggtagctccatgaagtggtttaattgtcttggaagaggacacattacttctcaatgccctaccataaaaccatga

SEQ ID NO: 46902 - DNA, 544 bp, Glycine max
  Peptide Sequence Number=SeqID_163680
gcataacattatcatgaatctccggtgccgctgccccgaacggccaacgcaactgcaaggctggagactgacgtcagattgtacaccggtttcaccggacggcaaaggaatagaaaacgaaaaaggggccgaagccccttttcgcttacctgccgaatcacggggattcaacaggctaatgtttggagcgggaaacgaggctcgaactcgcgacctcaaccttggcaaggttgcgctctaccaactgagctactcccgcatgggcttgcatgtctggcgccgtggcgcacttttcagtggcgccgccggcctttcagcctgcaaaccatttcttattgccaaccgctttcgcgattgcccgatcaacttggttatcgatcagaaggcgcgcattctacatgatttttttcgatcgtgcttgccgtcgctaatttcaggcgcatgtttcatcgcttgtttgccagggccagcggatcgcttcaagtgctttaagctttacgccgccggggttgaatcggctgccaagctcaatcaagtaatatga

SEQ ID NO: 46903 - DNA, 1146 bp, Glycine max
  Peptide Sequence Number=SeqID_163681
gcaagcacaacggcctgtacgacatgcaggcggtgctgggactatgagcccggccgccaccatgaaaaaaaggacccgcgcgggtcctttttcatttgtgtgccggcggcttcacacgaccacgggttcgggttccagcgccacgccatagcgatccatgaccgcgtcctggatcgcacgcgccagcgccatgatgtcggccgccgtggcgccgccgcgattcaccagcaccagcgcttgccgatcatgcacgccggcggcgcccagctggcgtcctttccagccgcattgatcgatcaaccagcccgcggcaagcttgaaacgcccgtccggttgcgcataggaaaccagccctgggaaacgctcgagcagcgcatcacgctgcgcggccgcgacgatgggattcttgaaaaagctgccggcattgcccgtaacggtgggatccggcaacttggcgcgccggatctcgcagaccgcatcgaagatggcgcgcgcggtcggttcccccgcgaccaggcccggatggcgctgcaagtcgggatatgccagcaccggacgccacggccgcggcaggcgcaagcgcaccgccacgatgacccagccgccgggcggctcatgcttgaacacgctgtcgcgataggcgaagcggcagtcggcggcggtcatctccacgtagcggcccgcgcgcacatcccaggccgtcaaactgtggaagcggtcggccagctcgacgccataggcaccgatgttctgcaccggcgccgcgcccacggtgcccgagatcagggccaggttttccagaccgtcccagccctgccggacgcactcggcgacgaagccatgccaggtttcaccgccggcggcctccaccagccaggcatcgggctgcgcccgcagcaggcgcacaccgcgcaacgccacccgcgccaccaggccgggcacggcctcgggcagcaccagattgctgccgccgcccagcaccagcaacgaggcatggcccgcggccaactcggacaaggacggcaattgcgcgacatcatccagcgtcacgcaggcctgggccatggacaccaggccgagggtattgagcccggaaagatcctgcggcgcagcggtcaacacgggcgccgtagcggagggatttga

SEQ ID NO: 46904 - DNA, 1299 bp, Glycine max
  Peptide Sequence Number=SeqID_163682
gttccagtgcagcttgcggcgcagggtggaaaagaagctgtagccttccggatgcacgaagcggatggtgtagggcgcgcgctgcaccacgatgcggtcgccgggctgcaggtcggaccaggtctgcatgtcgaaatgcacgctggccccgacttcgacgcggcccatggcggtgagcgtcatgttcagcacgccgctgtcgggaatgacgatgggacggttggacagggtctgcggcgccaccggcaccagcaccatggcgttcatgccggggtgcaggatcgggccgttggccgacagcgcataggcggtcgagccggtgggcgtggcgatgatcaggccgtcggcgcgttgcgtgtacatgaaggcgccgtcgagttcgacgcgcacctcgatcatgccgccgcgcccggcgcggttcaacaccacgtcgttcagggccgaggccgcgtacatctgctggtcgccgcgccacgcgctgccttcgagcagcatgcgctcttcgatctggaagttgccctccagcacgcgcgtcagcgcgccgtgcgcgtcctgcacgggaatgtcggtgatgaaacccaggtggccgtggttgatgccgaccaccggcacgccgtagggcgcgaggtggcgcgcggcgcccagcaccgtgccgtcgccgcccatgaccaccgccagcgacgcatccttgccgatctcttcgtaagtggcgaccgggtattccgtgaggccggtgttgcgggccgtgccggtgtcctggtatctgccgatcagcgcgacggtaggaaagtgcatggtggcgaggcgaatcagaaaaacgaaatcggtccggaatcgggcctgttagccgattatatggggccgcatatcggcttgcgggacaaaaatcgccttaattggaaaagattccctaaaatacccgctatggatgaccgcgcacgcgcattactgaaagcgttgatcgaacgctacatcgccgatgggcaaccagtcggctcgcggacgctatcgaaggttttcgatctgtcgcccgcgaccatccgcaacgtcatggcggacctggaagaactgggcctgatccacagtccgcacacgtccgcggggcgcattcccacgccccgtggctaccgcatgttcgtcgattcgctgctggcggtgcagtcctaccagctcgaaccccacaacatgggcgacatgctggcggcggccgagcccacccgcgcggtcaacgccgccgcggcgctgctgtcgaacctgacccagttcgccggcgtggtgctgactcccaagcgggcccag

SEQ ID NO: 46905 - DNA, 360 bp, Glycine max
  Peptide Sequence Number=SeqID_163683
atggagctaattggagacactaccacagtcatggaaacgtcgtccggtgaggctgtggcggcgcatgacggtggcgaggtgattatgatggatgcaaattccggtgaagaagagaataataataagggagaagaaggagaagaagaagaagaaggtgacaataagatcaacagtaacaacaactcattatgcggtggaaacagatggccccgccaagaaactttggctctcttgaagataaggtccgatatggatgctgtgtttcgagattcaagtcttaagggtccactctgggaagaagttgcaagcttctcctcctcctttgtctatgctgcttttcttttctctttgtcttgctag

SEQ ID NO: 46906 - DNA, 1369 bp, Glycine max
  Peptide Sequence Number=SeqID_163684
gaaactatcagaactgggttaccaccgaagcgcaaagaagtgcaaggagaaattcgagaatgtatacaagtaccacaaaagaaccaaagagagcagaagtgggaaacacgagggaaaaacctacaagttttttgatcaattacaagccctcgagaaccaattcacagtctcttactctccaaaaccacaacccactttggcaacaacaacaaacataataacattaccacccccaacaaggcctagtgacacaacagcaatctcttatgtcaccaccactgttccatccacaaaccctacaatcatatcaccttcaccacaaccaccaacccatgccaccaccacaactaccatcacttctccaacagtagcaaccaaccctaaaaaccctccacaatccaacaacaacagcaacatccccaattactctttgctcaacatgaacaacctcttctccaccacttcaacctcttcgtccacggcctcggatgaggacttggaagagaagtaccgtaagaagagaaagtggaaggactacttcaggaggctcacgaggcaagtcttggccaagcaagaggaaatgcagaagaggttcctcgaagccattgacaatagggagagagaacaagtggcgcaacaagaggcttggaggatccaagaaatggcaaggatcaatagagaacacgaacttcttgtccaagaaagatcaaccgcagcagcaaaaaatgcagcagttattgcttttttgcaacagttatctggtcaacaccaaaattccaccacaacaaaagctggtgccaatttccttcaacaaccacttccacaacaagtacaaccaccaccacaacaagctccacaaccactgatgatgtcaaataataacaacattgaaattcagaaaatgaataatggtcacagtgttgttgctgctgctactcctactactgtcgttgctgctactgctattgctactacagctgttactactactccttcttcattgagctctttatcttcttctaggtggccaaagacagaagttcatgctttgataagattgaggacgagtcttgaagcaaagtaccaagaaaatgggccaaaggctccattctgggaggatatatcagcaggaatgctgagactagggtacaacagaagtgccaagaggtgcaaagagaaatgggagaacatcaacaagtacttcaagaaggtcaaagagagcaacaagcaaaggcgcgaggatagtaagacatgtccttattttcatgaacttgaagctctatacaaagaaaagagcaagactactcagaacccctttggcgcttcgttccacaacatgaagccacatgagatgatggagccattgatg

SEQ ID NO: 46907 - DNA, 336 bp, Glycine max
  Peptide Sequence Number=SeqID_163685
atgcccaatgtccctttgggcaatgatatgatgaaggtgggtgttaaggaagttcgagacgttgatgctcacgtccctgtacccactgaagaggataaacaaagaccagagggaccaacgaagcctgctgataggccgaaacctgatgacgatccaatatgccagaggacattgatgatcccacaacttttcctcaagcttatgtcatgggatgcaactgtgtttagggtgtacaatgataatgtccccttgtacataaagcatgaagatcttggggaaatagcacatgatggtcaacatctaaacatcgttgttatacaattgtggatcatttaa

SEQ ID NO: 46908 - DNA, 411 bp, Glycine max
  Peptide Sequence Number=SeqID_163686
atgaaaaccggtccagttcaaatagatcgttcaagcaatattgaggtgtcgcaacctacccttttacgggtgagcgaggcgaggctcacgggtgcgtcttccaaagaggaaaatgcacggagtcgccaccaacgtttatttgtggaaaacgtcggaaaaaccgaaggaaaccggtcaaaaagaatattccaagttcgggagttgtatttacgtttgaggaaggtcgacaaaagcggggctcttgctcctacgtaccctccatcgaagaggaaatcagacctgcgtagttcttttttaagggtgaatcaagcgattctttttacttggaaggtgatcattttaaggcgttggaccttaaaaatgatccatttacttgtgatttttgtggacgagcttgactttgcgagttga

SEQ ID NO: 46909 - DNA, 1323 bp, Glycine max
  Peptide Sequence Number=SeqID_163687
atgaacaagaactataaattatcagaatatacattcaggctttccactgctgttaacaagttgacaatgcatcttacgaaagtcaaagagcaaatagccaatgtacgagattacattaccatcaggaacatctttgacaggccgaaagatattgtggaccttttgaaggctctgatctacccccaacaaaagggagctgagaatcccaagatatttgaagggaccaacctagtaacaaagggcattgaagtgttcaggcagaaacatgtgttgctcttcatctcgggtctcgacagcattgaagatgagatttcgctattgaattcaatatatgaaagattgcaagaggatccaagagaagcaaaaggtttcaagaaagaagatttcaagattttatggatccccattgtggtgaagtggagccaaagcagtagggaacaattcaaagctttgaagagtggcaccaaattttacgcagtggaatacttctttgagttaccagggctcaagataataaaagacacagaaagattgaattatgagattcagcctattgccccgttgttcagctctaaaggtaccctattgaatggaaatgccctggaagtgatctttgaatggggcatagaggccttccctttcaggaaaattgatggtgatgaacttactcagaaatggaagtggctttgggatttaatcctaaaagcaacaccaggattgcaggtaaaggagaacagatacatttttatctatggaggtgccaacaatacgtgggtgcagaacttcacacaagagttgtcaaagataaaaatgaaccagagtatccagcgtgcagatatcataatagagaactatcaactggggaaggggaagggtgaactcaacaacagtgttccaagtttctggattggcgtggaaaggaagaagcagaacaagaagcaccaagaggcagtggactgcgagattcagaagattgtaaagtgcttattctgcctcaaaagggacccacaagggtgggccattctcagcaaaggacacaacattaagcatctttgtcatggccaggctgtttatcagactgtggcagagtttcaaaactggaaagagaaagtgttcgagagagaagggtttgacattgccttcaaagagtactatgatgccaaggagaaagagatatctgatactcaaccatgtgaggactacacttcagcttcaagtgtcattgctaccatagcatgcccaaatcccacgtgtggtcgtgtcatggaggtgtcttctgttaactacaagtgctgccatcgtgatgatgctttgaactgttga

SEQ ID NO: 46910 - DNA, 2070 bp, Glycine max
  Peptide Sequence Number=SeqID_163688
atgggaagcaataccatctacttcacaacaaggcaaggtctcctctgctctcaacacaaacctcataagataccagtcatcatggcgtgggtactgtccaacacagctacaagtgccaccactccagagcataaagatcagctccccaacccttttgagcttcaagactctcaaatccgccacaaagtttatctcacccatgtcaatgatgacaaggagttcgatagggatatccttttcacccttgtgtccaacactgtcaactcgacctcagctcaactttcagcagctactacttctgttacaagtttaaaaccagacttccctacactgaagcggctttcttgtcagatgataaccacacgtggcactccagaatgtgcacaccagacagcactaaggattcttcagcaactgagtggcttctcgtgggatgcgaaagcactgatagcagtagctggtttctctttagaatatggggagttttggaggcttgatcgggttcaagccgcagatcaatttgggaactcactgaagcagctgaaccaagtccaaatcagcagaagggtccctgcagatatgattgatctggtcacagttttaggagaagtgcttagttacatcaatctgtgggcaaaatggtctgccatggattacgacacagaggctgtgcattccttgcaagctgccatgcaagagatccctcttgttgtgtactggacaattgcttccactgttgcttctattggcaaccttgtcggtatatcggagcataaattatcagcatataaagaaaggcttgaattcatttttaaaaagttgcagtttcacctggagaattgcagagtggaaataggaaggattcaagattaccacatccgtttcaacattagatatcctaaaattaaagatgttgtagagctgttggatattctgattattccgggttctgacaatgggacttcgatacccaaaatatttgaaggcggcgtcctaattaaaaatggtattgaagtgttcaagcaaaaatatgtgatgctgttcttttcgagcctagacagcattggagatgagatcttgcttttgaattccatcaataacgggttgcaagagaacccaggagaagaaataaaaggtttcaaaaaaggggatttcaagattttgtggatccccattgtggatgactggaagagtaagagggagcagtttactaatttgaaggaaaagatcaaattctaccttgtggagtactttgaagagttaccaggatatgatataataatggacaaatttaaatacgaaggcttgcctattgtgtctgtggtcaaccctcaaggtcagataatgaatgagaatgcattgcagattatttttgaatgggggatcgacgcctttccttttaggcgaagtgacgtttatgatctcaacaaaaaatggaaatggttttggaatttgttggagcaaaccgatgataatgcaaagcgcttggggaaggataatactagttacgccttcatctatggaggtaacgacagtagttgggtgcagaacttcaagatcgcaattggaaaaattgagaagcatgtgatcaacaatgtggacataaacatagagccctatcagttgggggagagtaaccctgacaatgttccttcattttggatcggccttgatgggaagaagaagaacaaagggtgcaaggacaaagtggactgcgaaattcaagaagttgtgaggaccttgctttgcctcaaacaagacccttcaggatgggttgttcttagtagagggcgtaacttgaagattctgggtcatgctgagcctatgtatcaaactgtgcttgattttgagaagtggaaaaacaaagtgcttgagaaagaaacctttgatgtggccttcaaagaatattatgatgtggttaaggagaaatatgctagtctcccatatgatcatacttcaagtgtcctagcaacaataacttgcccaaatcccttgtgtgggcgcgtgatggaggttacatcaattaattacaggtgctgccatggtagtgcaaacagctgcaatctctga

SEQ ID NO: 46911 - DNA, 1767 bp, Glycine max
  Peptide Sequence Number=SeqID_163689
atggctcttgtacccacttgccacctccacccattcttcgattcatttcacgcttctcccagcttccactctcttctcttccgccactctcccaattccactttcctccgtcccaaaccacccttcatctttcgctgcaaccccgccaagagtttctccaccgataaacactggttgaagcgttggaacgaccccacaaacaaccacgcccgtccgaagccgccacgtgcggttttgggctattccgaaaatggggacgcgtcaaaatccggtcttgcgagctctgacgaggaggggggcgatggaaataccggcggaatcacgttggataggattgtggaaaaattgaagaaatttgggtacgttgaagatgggattcagaataaagagagagtgatagaaaaagggtcagtggaggatatattttatgtggaggaaggaatgttgcctaattcacgaggtgggttttcatcagaatctccattagggtttggaagctttggaagtgatgatggggaagtgaggtttccgtgggagaagccagtggttgaagagttagaagagaggaaatccatgaggagtaggagtaagacctctctggcggaattgactcttcctgagtcagaattgaggaggcttctcaaattgacttttgagaagaagcacaagaccagaattgggaggagtggggtcactcaggctgctgtggacaagatttatgagaggtggaagacttcagagattgtgaggctaaagttcgaaggcgaggccgcacttaatatgaagaggatgcatgagatacttgagagaaaaactggtggtctggtgatttggaggtctggcaactctgtttccttatacaggggtgtgagctacgaggctccttcggtacaacagaataaaaaaatatataggaaaagcaagaactcttctaagcttttaccaacaccttcttactctgtggggaattctcccaacgctgcttctacttctgggacaagtgcaccattggcaaatttagaatctacaaatgacaataaagaaaaagattatctgcccaaagtcaattatgaacatgaagtagacaagttattggacggtctaggccccagatacacagattggcctggatgtaatccattgcctgtcgatgcagatatgcttcctgcaactgttcctggttaccaacctcccttcagagttcttccttttggagtgagagcgacacttggtttaagggaggcaacttctctacgaaggatgcaaggaccctcctccacattttgcattagaaaccgacaggttcaaggattagctgtagccatgactaaattatgggaaataagttctattgcaaaggttgcactcaaacgtggtgtgcagctaactaccagtgagagaatggcagaggagatcaagctttgttttcttgagcaccttttcattatttcagagtcaaaattgacaggtgctattctactctccagaaataaagacttcttggtcttctttaggggcaagaattttttatcagcagatgtcacccaagccttgctggagagggaaagaatggcaaaagtaatgcaagatgaggaggagcaagcaagattgagagcatcatcattgctcatacagactaataatacatcagacctgtcggcagaggcagggactcttggtgaaactttggaggccgatgcaaagtggggggaaacattggatgagcgtcacaagcaaaaaataatgagagaagtagaacaactatga

SEQ ID NO: 46912 - DNA, 435 bp, Glycine max
  Peptide Sequence Number=SeqID_163690
atggctgtagagatggggacaatattggtggaggttgcagaagctgaaagaaagctaaggagagctgaaaaggccttaatgaagttggagtcgtttttgaagccatcagaatacaaaacagatcctgaaagtagatgtggagtttttgatggtactattgaaaacatgcacttgcactggaagtactgggaactggtcaagaaaattgtgaaggctaaaacctttgaacgagtaaaaaaaattgcactagcacttgaagctgagagtggaggtgttctggtctcagttgacaaagtttcaaaaggatattctgtaattgtttatcggggtaaggattaccaacgtccttcaacattgagacccaaaaatcttttgacaaagagaaaggctttagcacgttcaatcgagcttcaacgacatgagaaacccatgtaa

SEQ ID NO: 46913 - DNA, 1971 bp, Glycine max
  Peptide Sequence Number=SeqID_163691
atgtcactgtccaatggagctgattcaactgccacttccaagcagcaaaaacctcagctcccgaacccctttgatctcactgactctgagatccttgagaaagtttatctgacccacctccatgatgaagacaagtgcgatgtagaagtccttttggacattgtgtccagtattgtacttaagacaaggttagctgaaggcaaagcttctcagaccattttccagccagaatttcgtacaatgaagctgatttcttgtcagatgataaccacacctcatggtgaacgctacgtgcaccaaacaacaatgtgcattcttcagcacctgagaagctactcgtgggaggcaaaagcactagtaactctagcagctttcgctttggagtatgggaaccttttgcacctgagtgatgtagaaacaccagagaaccaactcacaaactcgttgaaacaactgaaccaagttcaagctagaaagaaccctggcactactttggtggagttggtgatggaagtgcttcatggcattcaagagtggtcaagactgtctggtcttgattatgacatagtggaagtgccttccttgacagatgcccagcaagaggtccctgttgttgtgtattggatgattgcttccctcgtggctgccactgccaacctcgttgctctatcggagtataaattagcagattttctcgataggctttcttcagcagctgataaattcaaggaacatctgaaatcgagcgtagtgcaaaaaggttatgcagatgaaaactacaagcgcaggaaggcattttctaatcccaaagatattgttgaattcttgaagcttctgatccaacacaatggatctaaggtccaaatatatgacggcagcatcaaaaccaaaacggatattgaagtcttcaatcagaaatatgtcttgttgttcatttcaagcctcgacaagattgaagatgagatttcacttttgaatacaatccatgatagattgcaggagaatccaaatgaagtagtaaaaaattacaagaaaggggatttcaagattttgtggatccccattgtggatacctgggacgacaagcaaaaacacaaattcaatattttgaagaataccatcaaatggtatgcagtggagttcttcactgagttaccaggcacggacctaataaaagagaaattcaattacttgggaaaacctattgccccagtgctcacccctcttggtgacagaatgaatgaagatgcaatggacttgattttccaatgggggatcgacgcgtttccttttaggaaaattgatggtattgatcttactctaaaatggaagtggttttgggacgctacaaagaaagcaaatcttggaatacaacaggtcactggggacaggtacattttcatctctggaggtgctgacaaaaagtggatccaagacttcgcagtggcagtggagaaaacaagagggcatgcaattatcttgaacactgacaccatcatagatcactatcagttggggaaggatgaccccacggatgttcgtcgtttctggattgaaatagaaaggaagagactgaagaagcacaaggatgcggtggactgtgagattcaaaaagttgtgaagaccttgctttgcctcaaacaagatcaacaaggatgggctattcttaccaaaggctctaacgtgaggattcttggtcacggtgagcctatgcgccaaactttggctgagtttgacacatggaaagataaagtgttccaaaaagaagggtttgacgtagcctttgatgagtactataagaccaagcttgatgagttatatgctcgtcaacaatgtgcttttgttaagaacaatgcagatgtgcttgtaactataacatgcccaaatcccacatgtggacgtgtgatggaggtgacatctgttaattacaagtgctgccatcgtgatgcttcaaacaatggcaacatctga

SEQ ID NO: 46914 - DNA, 138 bp, Glycine max
  Peptide Sequence Number=SeqID_163692
atgaatgcaaggagaagagaatatatgcttggtgtgcttccaaagagaagaatactgatgcggcatgtgaagtcgcaagggaaatcaggatacggcggcgtataccaccacacccgaccacagcattcagtcaacggc

SEQ ID NO: 46915 - DNA, 210 bp, Glycine max
  Peptide Sequence Number=SeqID_163693
atggtcgtcccaggcgacaatggtgaaaaagaggaagaggaaggtggcgggatgtgggtgacacagatgcggtcaagaacaagcctaggatgcgacgtaatgatcatattattaatgcgaaacaattttattgggaaagtaatcaagttcacacatgttccgatggccggtggccggtggtacgagaacagaagtcttagcatagattaa

SEQ ID NO: 46916 - DNA, 255 bp, Glycine max
  Peptide Sequence Number=SeqID_163694
atggagaatgtaaaggataaaggagatgaagcattgtatgacaaattggattctgcctatcctagtgatgatgagaactatgaggtggaggatggtgaggatggtgaggagggagatgaggcctatctcgagacccataacagtgaaaatgatagtgaaattgaaagtgaagttgagagtgataatatgtatcctccaatctttttgcctcaccaagttgaaggtcaaggatcatttgattttggggatacctaa

SEQ ID NO: 46917 - DNA, 1353 bp, Glycine max
  Peptide Sequence Number=SeqID_163695
atggagagcgaggttccagctgagctgtgtagattggcagatgagtatttgataaaacccaaggagtgtttggaaagcatccttgaatatcttgctgatcagaaggaccctactactttatgccagaaatttattaatgagtttgatcgatgcatcctcagttatttcgcatttaattggaaccaagcttcttatattattagtcaggtattgagtgttgagtcacctccgaaaatacgactaaaaaagattctattggaagctacaagggaacagaggtttgagagagtaacgaagaatctgaaggtggcaagagtgttctctacattggtggaagagatgaaagcaataaagcttgactcacaaagaacgaacgacatggtccacaatgtccacagtgagaggagtccagtgcttctgcttatgggaggaggcatgggagctggaaaaagcactgttcttaaagacattcttaaagaatcattttggtctggagcagcttcaaatgctgtggtggttgagccggatgcttttaaggaaaatgacgtcatatatagagcccttagctccagaggtcaccatgatgacatgctccaaactgctgaattggtgcatcaatcttccactgatgctgcatcatctctgctagtgacagctttaaatgagggtcgagatgtgatcatggatggtaccttatcatgggaaccatttgtggagcagactattactatggcaagaaatgttcacaaacacaggtaccgaatgggggtaggatataaagtatctgaagatggtacaataattacagaagattactgggagcaagtagatgacgcagaagaacatcttcaatcagaggaaaattgtaatggagaatcacgcacgcgaaaaccttacagaattgagctagttggtgtggtttgtgatggctatcttgctgttgttagaggcattaggagagctattatgacagggagggcagtaagggtgaattcacagttgaaatctcacaaaagatttgctaatgcatttccaagattttgcaaacttgttgatgatgccaggctctattgcacaaatgatgtcggtggtccaccacagctcaaatggcggaaggatggtgatcagaatcagaatctgcctgatcccaaagatatcaaatgcttggaaaggataggcagtgtaaatgttgaagctgattccatctacgaactttacaaggatcccagccctataatggaacctggttctgtttggaaagacattgttctttcaccttcaaggtataataatgatcagaaggaattgaaggaattcattcagaaaatagaaacatccatcagaaaacggtaa

SEQ ID NO: 46918 - DNA, 381 bp, Glycine max
  Peptide Sequence Number=SeqID_163696
atgataagggaagctgaacatagccctacaaatcaagggaaaaataaactagctttgcggaagtgtcgtgcggaattgattaccagcttacagttattgggtgattatgagtccttactgacaccacctcaacttgttcttgtggaagccaatcaagctgctgccaaagctattatgttcttatcaggaaaccctgttggtagtggatgcttcaaatatatgagcacgaatgacatgccgatgaaatgttgggaggaaaggggtaatggccagggtggctctggagcaaatgggactataactgggaaggcttgccccaaagggttgtacggtacccttagtgatcctactacccaacttgagcaggattgcatccattag

SEQ ID NO: 46919 - DNA, 309 bp, Glycine max
  Peptide Sequence Number=SeqID_163697
atgttgccacgtggtttgaatctccaccgagaccttggaagtctcgtcgccgcctccgcctccgggtttcaacttccgccccttccaacaactacaccaacctgcgctggcttctttcgcgatgttccaccaaggaaggtcgtcttgtcgatcgaggatttcggtggcggcggagacgggaaaacatccaacaccaaatcgtttcggagggcgattcggacaaagtgggatagtgaatggtcaaggaaggatgtggtgggaactttggtggaacagaacattggagcacacgagagggcacctccttga

SEQ ID NO: 46920 - DNA, 1065 bp, Glycine max
  Peptide Sequence Number=SeqID_163698
atggctgactttgtagttggtgttatggtatcactggtcgacatcactgtgctgaaaaggaagcatgtttacttgttgatttcttccctagacattacggaggaagagatttcagtattccaaacagtttatgattcaattaaaactagtgatcagtatgagattgtatggattcccattgtggaggaatggaccgttgagtacgacaacaaatttgaggattttaaatgcaagatgccttggtatgcggtgcagcattctggacccatagcagggtaccagtacattaaggaagaatggcactataaaagcaagcctatggttgtggtgttgagtcctcaagggaaggtgcaacactcaaacgcattccatttgatccaggctcatggaaccagagctttccccttcacaactgtcaaacaagaacaaatcaacaatgagaccgactgggttggctccgtaataggcaatatttaccccatcataaacacttggatcaaagagaaaaagtacattttcttgtacggaggcaaggacaaagagtggatccaacagttcaccaagaatgttagtgcccttgcaagtgatgccgctataacggaggcaaatatttccatagagtggctttgtgtggaaaaggaagacagaagcgtgatgaggcgcttttggggtggcattgagagtttgtttgtgactaaggttcataaggcagttgatgcagtgactctagaagtgcaaaagatgctctcttacaagaatgaagctggatggtctctccttattagcgaagggtcttctgtggtggtgtgtggtcatggaaagacaatcacggatacagtggaagggtttcagaattggaaaggaagtttgaccaaaaagggctttgggttatccttccaaggataccatcagaagattgtggacatcactcaccgttgctcataccttgaaatttctaatgtttcaggaaggttaccagagaccatcaaatgcccagattgtccacggattatggagattttcgtcagctataaatgctgccacaacaataccattcactactag

SEQ ID NO: 46921 - DNA, 171 bp, Glycine max
  Peptide Sequence Number=SeqID_163699
atggcaatggagaagaggaagcatttaggatttccattggtcacaaaatccttcaagttgattcataatattcctatgcccatccgaaaacactttgtccacaaggtgttgggacctcaaatccagacctcgaaacagcttggtggcacagttcaaaaacaaaatagctaa

SEQ ID NO: 46922 - DNA, 186 bp, Glycine max
  Peptide Sequence Number=SeqID_163700
atgtcagtgaaaaacctcattggacgcctaagagtacatgacaagacaaaccacacactagtaagtcaggtcactctcactaggcttaaaggagcattcaaaccaggtgtatttaccctcaaggcctatacttcgaagagtccgtcagggcctctcctgttagacaagtggcctcatatatcttaa

SEQ ID NO: 46923 - DNA, 174 bp, Glycine max
  Peptide Sequence Number=SeqID_163701
atgtttactacacaagtgaagtacggtattgatagggtaattgacacttttccacgcatgtatcagcttgcccagggtggtacagctgtagggactcgattgaataccaagaaggggctgcccatgatgcttttgttgaaactagtggagtatatattaataagggagaattaa

SEQ ID NO: 46924 - DNA, 948 bp, Glycine max
  Peptide Sequence Number=SeqID_163702
atgtcgtctaccaagtgtctcctccaagatgctgagaatgagcaaaacccactaaccatgactgatgatcagattttggaggaaatttactcaaaccatgtcggcagtgacacaaaatttgatgtggactctcttttcacccttgttgagaacactcttagacgttcaacccacattgttgacaattttgtgcagggatcccatgcaagcttggagcacacagatgacaagatcccccaattcgattccccactttgtaccctgaagcagatttcttttgagatgtcatgcaaacctccaagtgatgtaattgctcacaaaactacactggccatactgaacaatctcaaaaactatgagtggaatgcaaaggcagtgctgacactggcagcttttgcactcgaatatagcgagttttggctgctagcacagtaccaacaatcagaccctcttgcaaaatctgtggctattctgaagagagtgccagtgctcacaaggcaagcagcacttcaaaagtatcgccaagccatcgttgagttggagaagcttactaatgatttgggggttgcaatagagcaaatctctgttgatgtttactgggcgatcatcactattgtttccttaaccactcggattgattgtctcaccactgaatcagagcaaaaacaagaactgtctcactatggacaaaagatcaacatcatactcagcaaactcaagaagcagatcactctttgcagacaacagatagatgcggcagaatattatcgcaagctgaggaagcttttccaaactcccactgaaataatggaggtgtttaagattctgattttcaacaaggatgttcctcagccactttattgtggtgctactaagaccatggtttgtgattccctgttaaaatcctactttcatgttcgaaatttgttctcttcggagagaaaatga

SEQ ID NO: 46925 - DNA, 1707 bp, Glycine max
  Peptide Sequence Number=SeqID_163703
atgtcatgcaagcctcaaggagaggaaatagctcatataactacaatggccatacttgtgaagctctcaaactatgagtgggatgcaaaagcagtgctgacactggctgcttttgcaatggaatatggcgagttctggctgctagctcagaaccaaccaacagaccctattgccaaatccgtggctgctctgaagggagtgccagtgctcacaagacctgcagcactgcaaaagcatcgccaagccatcactgagctcaacaatctggtcaaaacaacgttgctagtcattgaattaatctttgagttggagaagcttacaacgtttgacacaaaggatgtgcctgctttgttgcccgcaatagaacaaattcctgttgatgtctactgggctatcatcaccattgcggctattgttactcagactgattacctcactactgaattagggaacaagcaagacctgtcccactatggtcaaaagatgaacatcatacttagcaaactaaggaagcaaatcatgctgtgcagacaacagattgaggaggcagagtatcaccaaaggctcaggaaattttttcaaacgcctactgaaattatggaagtttttaagtttctagtttattccaaggatgccccacagctactgtttcatggtgccactaagaccacggtcgaaatcactgagctcaagaagaagcatgtttacttgttaatctccactctagacatcacggaggaagagatttcagtactccaaccagtttatgattcaattaaaactggtgatcaatataagattgtgtggattccgattgtagaggaatggaacgaaatgctgcacaagagatttgagtttttgaaaagcaagatgccttggtatgtggtgcagcactttggagccatagcaggatacaagtacattaaggaggaatggcacttcaaaaagatgcctatggttgtggtgttgaatcctcaaggcaaagtgcagcatgcaaacgcattccatcttattcatgtttatggaatgaaggcctttccctttactattgcggatcaagagagaattgatagagaaattcactggattggttcagtagtaggggataatcacccccacataagcacatggattagagagcaaaagtacattctcatctatggaggcagtgacaaagagtggatccaccagttcacaaagtatgcaactgcctttgcaaacgacgccgctttgaaggatgcgaagattcatattgagttgttctgtgtggaaaaggaagacaaaagcttcctgaggcggttttggagtggcatagagagcttgtttgtgacaaaggctcacaacacagttgatgcagtgactcaagaagtgcaaaagatgctttcttacaagaatgaaactgggtgggctgttctatgcaaagggtcatctgtggtgatgagtggtcatggaacaacaatcttgaagacactggcagagtttgagaaatggaaagaggatgtggtgaaaaaggggtttgagccttccttcaaagagcaccatgaaaggattaggcgcacgcatcatcgctgcatacaccttgaaattcctaatgctgcagggaagttaccagagaccataagatgcccagagtgtggtaggataatggagattttcatcagttataaatgcaaccacagggataatacttcaattgccataaactag

SEQ ID NO: 46926 - DNA, 201 bp, Glycine max
  Peptide Sequence Number=SeqID_163704
atgaattcgtggggctccagactcgatggtggaggatggatgaatgagaagctattcatggggctcgggataagatttgagggatgcatgaatgataagcatttcatgggtctccggataagatttgagggtggaggatacacaaacagcgcaaggcaatcaactcctggggctcaagactcgatggcggaggatgcatga

SEQ ID NO: 46927 - DNA, 276 bp, Glycine max
  Peptide Sequence Number=SeqID_163705
atggcacaactgtccaatggaacttcaagtaccactttgatctcaaagagtggcactacttcaatcccacatcgagcaagtttgcccaacccatttgatcttaccgatgatcagatccttgacattgtttatctggctcacctcaatgatgatgaaacttgcgacaccgataaactttacaaccttgtctccaacattgtcctgcggagtcaatccccgatttccgcagccagtttcaaaccagatttccttacactgaagctgatttcttgccag

SEQ ID NO: 46928 - DNA, 2367 bp, Glycine max
  Peptide Sequence Number=SeqID_163706
catctgcgccagcacgtcagcgtaccggttatcgctaccaaccgtatcaatcatcctcaggtagcggaggagattgtgcgcgacggtattgccgacatggtgtcgatggcgcggccatttcttgccgatgccgcgtttgtcagcaaagcgcaggcgggccagcccgacgccatcaatacctgcatcgcctgtaatcaggcctgtctcgatcaaatctttgccggcaaggtcacttcctgcctggtcaatccgcgcgcctgtcatgaaacgctgatgccggtcatcgccgccgcgcagccaaaacgcctggcggtggtaggtgccggtccggccggtatggcgttcgcgctgcaggcggcgcagcgcggccatcacgtcaccctgtacgaagccgatgcgcagattggcggccagtttaatatcgcccgccagatccccggcaaggcggagttcagcgaaacgctgcgctatttccgccatcagctggtagccgcaggcgttgagctgtgcctgaatcatcgcgtcagcgccgacgaactggaacaggcggatgaagttatcatcgcgaccggcatcacaccgcgccagcttgcgattccgggcatcgatcaccccagcgtagtgagctatctcgaggtgatacgcgacaagaaaccggttggccggcgcgtggcgattatcggtgccggcggcattggtttcgacaccgcggagtttctgctgcagcacgccgatcgcgaggaagacttctaccaaagctggggcatcgatcgcagcctgcaggcgcgcggcggtttagtgcgtccacagccggctcctgccgaccgccagatctggctgctgcagcgtaaatccggcaaaccgggcgccggactggcgaaaaccaccggctggatccatcgcgccagcctgcaggcgcacggcgtgcagatgtggggtgatgtggagtatctgaagattgatgatgacgggctgcacctgcgccatcagggggaagcgctgacgctggcggtagataacatcgtgatttgcgccggtcaggaaccgctgcgtacgctggcgcaggcgctggccgcacgcggcaaagccgtgcggctgatcggcggtgccgacgtcgcgcaggagctggatgcacggcgcgccatcgcccaggccactgagctggcgctcagcctaggccaccagttcgcagttgccaaacagcttcttcattttctgatgatagccaaggtggcggttgccgacgatgcgcagctcgccgccatactgcaggcagcgtttggcgtcacgcagcatctgccacgccaggtggtcggtgaccgcgtgctgctgatggaacggcggattgcacagcaccgcatgcagtcggtccgacggaaaaccgctcagcacgttgttaacccgaaactggcagcgcgccagatcctgcggtcggttgagctcaacgttgagctggctggaggccaccgccatgtaagattcatcgacgaacagcacctcggcctgcggattctgttccagcgcctgcaggccaatcacgccgttaccgcagccgagatcgacgatttcgccctcaatatcgtgcggcaggtgttgcagaaagaagcgcgcgccaatatccagcgccgcgcgggcgaacacattggcgtgattgtggatatgatacggcgtctcgtcgagcggccacacggtggtcgccggcacgtccgccagcgccggcgcgctgaaatggctcgtggaattatggatgtctttggctttaccggccgccagaatcagggtatccggcgtgacgaccgtccgcagcgcgcgcagctggtgctcaagcagcgccagcgctttgggcagcttaatcagtaccgccgccggggcagccggcaacggcgccaggctatcaagaaagtgtaccgacgcttcatccagaccgttgagacgcagattctgccgggccgcctgctggctgagccacgagtcgctgacgtgccagatttcccgatcgttcagcccgcaggtcagcgcgccaaagctcgggctctcttcgcgcatcggcgggaagcgctgaagcgtcagcgtgcgatcggtcagttcaagttggctcatggaatctccggcgtgggttaccctgaaaacatcctcgaacaggtgcaagtgctgattgataatcagcgattagccgcctttttgcagcagcgctatcccgatacacacgacgtcgtcagcgaccgcgcgctctatgactacacgcaggcgctgaaaaaccgctatatgcgcagcgcgccgccgggcggtaacctgaaagccaaggccgaaattcgcatctcgacctttttccgcctcgcgccggaaccctttctgcgcatgatcgtg

SEQ ID NO: 46929 - DNA, 495 bp, Glycine max
  Peptide Sequence Number=SeqID_163707
atgattatgaggggccaagacatttatagtagccaagacgaggctactacttcaccttcctctagtgaaagtgaagaagcaaaagaggaaaaatctagtgaagaaatctacccccaagaagaaggacaaccattagtggttaaagagaagtgtaaggaggtaagtgtctcctccaagagtttagctaagaaggaaactcattttacaataaagacaaacattaaagaaactttccctcttagacaacctccacattttctcttttgtaaaaagacacttgctagcattgccacacctcttgggcttgagtttattcctcaagtaaagaagtttttggatgaggatttggtttgcaagagcttaaatccttgtgctttgttggggcccaaaataggtattattaggcaccaagtccctaaaataggtggtatgatgaatgttttgaatggtgcaaccctcttttgtaaaatcactcgtgcacccaacatcttcatg

SEQ ID NO: 46930 - DNA, 596 bp, Glycine max
  misc_feature (17)..(17): n is a, c, g, or t
  Peptide Sequence Number=SeqID_163708
tgtatgatggtgttttngaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccacagaatcgcttacggaagcgttacggaagcacctcggctaggattttcttcacagaaacaatttttttcaccaaaacagctgaaatgcacaaccaagggggttagggaccctttagaacagcctcccttagcctatttatcggaaaagggggaggaggttgccgcccagctcgcccaggcgagttgggttgcttcctccataagcaaccccgcttccaaaatgttctggaaggcccaaatttga

SEQ ID NO: 46931 - DNA, 810 bp, Glycine max
  Peptide Sequence Number=SeqID_163709
atgaggatcagaattgctttggatgcctctcgaggaatagaatatcttcataattatgcagattcatttattattcacggagatatcaagtcttccaacattcttcttgatgccagctggacggcaagagtatctgattttggatggaagtttatgagaaacagacaacgtataattgagaacactgatcctaagtacgttattcgaggtgcattgtcagcagagagtgatgtgcatgggcttggagttgtactgtttgaacttctaacaggaaagagacctacattcgtgtacggggaagatggaggcaccctattaagtagaaaacatttggtagactttgctgtgactgctatttcaaatggatttttggagaaatttttggatcaaagggctggacaacccgatgtgaatgaagcagaagcagtaaagttagtggctgataccgctatccgttgtgtgaatttgaaactgaaagatagaccaaccatggctgacattgtagtcagattagagcgggctttggctatttgtgattatgatagcattttcagggctttggaatctatgaggtggaagcgggtggtcggtcccctagcagcctctccagcatctcacttcatccacttctgtgaaggctttggagctgggaggaatgaaatcagatggcccagatggtggattgctttaacaagctcaatttggaagcataggaatctattcattttccaaggcaacagatttgaaccaccaaaagtcatggaagatgcattggtcatttatcatttttttagttctaagacatgttaa

SEQ ID NO: 46932 - DNA, 261 bp, Glycine max
  Peptide Sequence Number=SeqID_163710
atggctcaaggattgtgctgttatttgtccttaaaagagatgaaacaagcgaccaacaattttgatgagccaaatgtgataggggtaggagggtttggaaaggtttacaagggtgttattgataatgggttcaaagtggctatcaaaagatcgaatccgcaatcaaggaggcatcaattgaccaagaaatcagatgtgtactcatttggggttgttttatctgaggcactttatttgaggaaggtagctttggatacttga

SEQ ID NO: 46933 - DNA, 444 bp, Glycine max
  Peptide Sequence Number=SeqID_163711
atgtctaacgatcgattttcatgtgttggaccgattgagttgttatgcaccgttggtagaacaccagatgaaattttaaacttacttgaacgcagtatgacccctactcatgatgcggttctgtattacaacggaaggtggaacatgccacgccaaaacaactttgtaggttacgcgttcacaggaaaaaatccccaaaaatttgatatttcaaaaggatgtaccatagatgaactgaaggatttgatcaagcaactagcacctaaagggaatcctcctcatgggattcatgaatcccaacttctgaaaactgacgacgacgtgctgaaggtgatggtagagtccaattactggaaacaatttgtgccaatagaaattttggctttctttagtaaaccgattatggaaaatgaggacgaggtggttacgtcgttgcaggattga

SEQ ID NO: 46934 - DNA, 409 bp, Glycine max
  Peptide Sequence Number=SeqID_163712
gaatcacacctacaaagacacccagtggacccggagaagtccaatagggccctggggtttccagctctggttacgggcctctgtagtcctacagggtgcccgttccccccagcaaggtcacgtcatcataggatcgcgcctgcaagacacccagtggacccgaagaagtccaacagggtcttggagttgtcaagctctaattacgggtctctgtcagttctacggagtacctgtcacctctagcaagggcatcaggccccctactaatcgagctttcatcaagaagtactgcgtctccaggcaggcgcagggcgaaacaccacagcagcctagggatggccagcagcgggcaacagacgcaccgccatcacctctagagttcacctcagctcatccacaaaaaggttag

SEQ ID NO: 46935 - DNA, 402 bp, Glycine max
  Peptide Sequence Number=SeqID_163713
atgtcgcgggggtcaggagaccttggggacgtcaagtggggtgctattgcccaaaaccaagcttggctaatcccgacccaacccgggcatagtcagtcagtaagaacctgcgacgtacctaagcagaacaaagtccacgaagcaaggaggcttgtgtggcggctggccagctatgtatcttgggtggtatctgagaattactctctggtaatcgattaccattcatggtgttgcaacgtgccctcttgcgagcgagtgagagcgaggctcacgggtgtgttttccaaaggaggaaagatgcgcggagtcgccaccaacgtttatttgtggaaaacgtcggaaaaaccgaaggaaaccggtcaaaatgaaaattctaagttcgggagttgtatttacgcttga

SEQ ID NO: 46936 - DNA, 291 bp, Glycine max
  Peptide Sequence Number=SeqID_163714
atgaccaagagggctcgtagggaagagcacggccggaacaagttcagaggggctctatggggcagcaacagggaccaatcaggagtagacagtttgatcttgaaagatgagttgaatgtttgctcaaggtccaaaagaaacttgtctcagcgattatgtgaaacagagaccaacatgttagctatcatcagcaagtaccaagaagaactaaatctagctacggcccacgagcatagagtggcggacgagatgcccaaatgtacgcggagaaggaggctagaggaagggtga

SEQ ID NO: 46937 - DNA, 369 bp, Glycine max
  Peptide Sequence Number=SeqID_163715
atgtttgctctccctctcactcgccgtaagcgagagccacagagacctctcactctttccctctttccctttcagatccctttttcactggttgtggtttttggtgctgcacaaccaaaaccagatcttcagatccctctttccctttcagatctgaacgcgtattgtccctcccatggcgtcaaagtgcatcctcaaggagctcaaggacttgtagaaagacccaccaacttcttgcagagttgcattctctacaaccatggagtttatccagaagaaagctttgtgaaagttaagaaatatggcctccctatgttgctaacggaagatgaaggtgtcaaatcttttctagcagatctaacctcttag

SEQ ID NO: 46938 - DNA, 495 bp, Glycine max
  Peptide Sequence Number=SeqID_163716
atggtggtgcccattagagtgcacggtgcagccgcgaggtcgaaccggaaggagtgggacttagtcataaagttactgactgaactgatggatgctgactcggatgaagtgggaacacgatgggcgattctcatggttggttcaaacggctatggaaactacaggcatcaattgctgataaaaggtggactaaaagaagagaacatagtggtgtttatgtacaatgacatagcttccaaccagtcgaatcctagacatggagtcatcatcaaccacccagagggagaatatctgtatgctggtgttcctaagggagaccagtcagggtcacgatgttttgcgagaatgctccaaccatatgggatcaacatagacttaaaggagcactcaaacccgatgacccccaaggcctacactccgaagagtccgttagggcctctccctcctgattcaggtccaacccctaaaatcattttagcacacagacgctgctag

SEQ ID NO: 46939 - DNA, 1254 bp, Glycine max
  Peptide Sequence Number=SeqID_163717
atgggcctcatcggcgatcgccagattgtcctgctagtggatggtggaagcacccacaatttcattcaacttcaattggtctctcaattgggtttgcccactcgcaccactaatcccttacaagtcatggtcgacaatggtaagcaattggagtgtaattgcctatttgaggctgtgacgatggtcatccaagctacaccgttcaccgttgacctgcatgtcttacccatcgcatgcgccaatgtcgtccttggagtccaatggatgaagtctctcagcctcgtactcactgactacaacactttatgcatgaagtttttccatgaggggagctttgtggaacataaaggagacacagagtccacctggaattcactctcgtcctcgaaatttcatcacctatgccgcaaacaccccaatagcttgtacctccatgtgatagtgctttatgaggcttcctttacaaaagctagctctagctccgatacttctcctctcgtccaagctctacttgataaattccagtccctgttccaacctccacacgctctgcccccaccacgagacacagaccaccgcattcacctcctaccccaagccacttcggtgaatgtgcacccctatcgttacccccactatcagaagcaggagattgaaaaccaggatggatcgtggcggttttgtatggactatcaagccttgaatgcacttaccatcaaggaccgatttcccatacccaccgtcgatgagcttttggatgaattggggggagcttgttgcttctcaaagttggacttgctacagggttatcaccaaatacgtatgtactccagtgacatctcgaaaacagctttccgcactcaccatggttattacaagtttcacgttgaataccttagacatgtcgtctcgtacgaaggggtgcaaccagttgcttctaagttggaagccatactccactggctaatttcacaatcgaccaaacccgtccgcagcttcttgggacttgtaggattctatcggtgcttcatcaaaggctatgccactattgcagcatctttagtgaaactcaccatgctcgatcgcttccaatggacggaccaagctcaagtagcctttgagcatttgaaacatgctttgtcctctgcaccagtgttagctctgccggactttgagctctcgttcagtgtggaaatatatgcctccggcacgtgggtatgggagtcgttctttcacagcaaggccatcccatag

SEQ ID NO: 46940 - DNA, 1866 bp, Glycine max
  Peptide Sequence Number=SeqID_163718
atgactctaacatgcataaagtctgaagaagttttggcgcaaaattctgttgagaaggatggacacgtgtcagacgatccacatcacatgggagttaggaaaagcacacagttgaggagagagaacatattgctaaaggacttcacacattttcgcacattagggttggaagaagaggatgttgaggattcttctagcttgattgcaccttcggatgttcaggaagttgaaactatagaacctgatgatcatcacttgtctctaaatgctttgaagggcggtgtaggagttagtactatcagattaatggcctatattgataaacttcctgtgactgtgctaattgatggaggaagttcagacaatttcttacagcctagagtggctaagtttctaaaattactagttgaaccaactactcaatttagagtaatggttggtaatggtaattatatgactgcagaaggattagttaaacaacttaagaaaacaattggaccccatattgcagattatgatgcattgcaattgaaatttctaatgaatggaaaattcactattctacaaggaggtcataatttgatgcctgagcaggctcaattacaccatatcaggaggatgataactactaactctattgttgcggtttatagcatgcagttgctggaggagaatgtctcacctaagtccttcttggacctgcctacaagcatgaagcttgaagctttgaatgctatcacaattaaggattcttttcctatacctatggtggaagagctcgttgatgaactgtttggagcaacatttttctctaaactagatctcaggaaatttgtcgtagtattttttgatgacatattggtttatagtgctaattggaaagatcatttgtaccatttggaggttgttttaaatattctgcgaaagcataagctatttgcaagattctctaagtgttgttttggggttcaacaaattgattatttgggacatacctcatcaggatcaagcatagctatggatgcaaacaaattaaaggcagttcagaattggctaaagcctatgaatctaaagcaattaaggggcttcctaggacttacaggttattatagaagatttgttaagtcctatgctaccattgtagcacctctagatctattgaagaaggactctttcaaatggtttcaagctactgctcaggctttccaacaacttaagatagccatgacttttgcacctgtcttggctattcctaacttcaatgaactttttgtattagaaactgatgcttcaaggaggggatcgagatatgactttactattcagtacaagcctgggaaagagaacatgttggtagatgcattggctaggagttttatgatggccatttccagcccaattcattcatggataaatcaacctcttccaattcctcaacaaatttgggtggatattgcaatgaatttcattgttcagctaccaacttctcaggggttttccactatccttgtggttatggatagactttcaaaatttggttatttcatccctttaaaagctaattacaatgctaaagtggttgctgagaagattcaaaatgttgcatacaagcttaaacttccagaatcggcaattattcatcctatttttcatgttgctctgcttaaaccattccatggcatggtttctcaaccttatgttcccttgccccttaattccagtgatatgggtccagtcctcaatcctttgaagttgttggacgtgtgtgttgttaggagattggagaaggaaatctcacaagtattgattcaatgggaagctactaagctaaagatgctacttgggaagatttgcaagacaacatga

SEQ ID NO: 46941 - DNA, 501 bp, Glycine max
  Peptide Sequence Number=SeqID_163719
atgatcctgaagacagtttatgcattgttagcatttatattggaattggctggtgtttatggcgatggggaattcaagtggtactacgggtatccatatatagcagtggtattgaacttcagccagatgtgggcattatactaccttgttcagttctataatgttactcatgagagacttcaaccaataaagccacttgcaaagttcatcagcttcaaggctattgtgtttgctacttggtggcaaggtgtaggtattgcggtattgtgtacatttggagtgctacccaatgaaggaaaattccaaactggattgcaagatttcttaatttcaatagagactactttcatgtccatggcaatgcagatggccattgcagctgttgctcatgtgtttgtattttctgcaaaaccatatcattttcttcctcctgctgcatatggaaaaatcacaaaggaaacaataggagcagccttggagatagatgaagggagcaagtag

SEQ ID NO: 46942 - DNA, 999 bp, Glycine max
  Peptide Sequence Number=SeqID_163720
atgggtgatcaagtcataagcattttctgccaacttcagtattttaaaggctacttggacattttagcttctgaaggcttgcttagtgagactagctcgctaagcaagaagcactgcaatgctattttacaatcaccggcagcacaccccgaattcataattgtcaacaatctcattcttcaccagaagcgcatttggctaccacgggatttccagatgatccccaccttgctcaccgagtttcacttgactccgacagggggtcacatgggcatagccaagacccttgcccagatatcagagaactttagttggccaggtctccataatgatgtgagaaaattcattgcccaatgcgttgattgtcaacacaccaagtataaaactaagaaaagtgtcgggttgttgtgcccgttgccagtgccgcatcggccatgggaagaactttccctggattttatcatgggccttcccctctatcatggcaactcagtcattcttgttgtcgtggaccgattttctaagggcatccctttgggaatgttacctgcagatcatacggctcatacaatagcttctttgttcatggagattgtcggcaacttctggcgagagttattccagtttagtgggacacagttacgggtaagttctgcttatcaccctcaaagtgatggtcaaacggaagttatgaacagaattattgagcaataccttcgggcttttgtgcaccgcaaaccgcaaacatggggcaaacttcttctctgggttgaatggtcccataatacttcttggaatgtggcaacagggactaccccatacgatattactttcgagctcaaaccgtttaatttcctagattatatcacgaggtcatcgaaattagatgcggtggaggagatgctcaaggatagggatgaaactttccaaatcattcagaagaagctcctcaaggctcaaaccacgatgaagcactttgcagatgccaaaagaaaatag

SEQ ID NO: 46943 - DNA, 402 bp, Glycine max
  Peptide Sequence Number=SeqID_163721
atgtcggccaaagcttcctcggaggtgcagggattagcccattatctctcccttggctatcctggattatcgcaggaggactatcaccttgaggacaaggtgattttgcaagggccaccggatgatagcatagcagttacaaaggtgcaattagcagaaagtggtgcaaaacaagcagagatgagggcgacgaggcgtccggctgccgcagacgcagtggagtctccacgaaccagagacgttgacgaacgcggcggcattaacgtaacaatgcgcttgaagtatatgcgcttggtgagccgcagcccctcctccaccggtttggagaattcttctgccattgttgctaagagagatgaagaaggaggaggttgggattggagaagggagacatggaaatga

SEQ ID NO: 46944 - DNA, 540 bp, Glycine max
  Peptide Sequence Number=SeqID_163722
atggaggcagaggtggccacagatgttgttacaaggatggctacatcagaagagggcactagtcatgaaaacccaactgaccttaccatcctcactcgtttccacccaataaaagaacaaagacttattgacctcaggctggcctttgctagcggtgagataaaccctctcactgggaagacaatgatcaacaacaacctagtcgaagttgttgtggtagcttcatcctcttgcctaaaacgttcaaagacatcaaccccctcatcagggttggatggagcaacattaaccccatcacccacggtgttgcctgcgaggacgtttgcattaacagaaacctctcggcccatcatcaaagcttggaagacatcattattagagagaggaaaggagatagtgaagtcagaaaaagattctgacttctccctcacactagacacctccttcacaagtatagacttgcaaagaacaagtggagaatcatcccaccagaatcagaacaagaaatacaaaaatggagaagatagaaactcaaactag

SEQ ID NO: 46945 - DNA, 279 bp, Glycine max
  Peptide Sequence Number=SeqID_163723
atggcgactgaacttcaaaggaaacaagacaaattgaatcgccaactaatggagatgcagaaagagttgttcaacaatcttcatgctcatcttgaacctcaagtcaatgctattgaacctccactgattgaagttacttcccaacctccacaaattgttgaaaatgccttagcaactatcatcactttcactactcctcatgagataactcttttgaccacctttgctctaactggtgtgtctgaagagagcattcaagatctattgtgccttcaatag

SEQ ID NO: 46946 - DNA, 210 bp, Glycine max
  Peptide Sequence Number=SeqID_163724
atgtcacaaaacttcacgtattgtgcaacaaagggtgccaagtacctcaaagcggtcaaacaaaggttgcatgccatcaaacaatggtccccagacgaaattagggcatgttactgtgcagagagagagagtgtggggatcacaaacatcttctgcagcaaatctttagagaagtacaacttgccagtgtctctttgtgctcagaactga

SEQ ID NO: 46947 - DNA, 597 bp, Glycine max
  Peptide Sequence Number=SeqID_163725
atgcccaacattaaccaagcttttcggccctcgacagaaacccctctagtccagcgcccgtccagcaaagggcaccccctcaaccacaaagggcccccactcaaactcagctcctacacaacctcgccccgctggcaactccaatccgagcacaagcgccaatccaggaaggaatttcccggttggttgatattccaagaggacagtccaaatgtaaagacaaacccttttgccagttatggaggaccagcggttaatgcggtggaggagtgtggacctcagaggccgaagcaaatgaaagatgtggtaacctttaggaggtttatattgaaggtgttgtgcgaggcgggcatcattttctttgacgggggtgagggggatacctgcttggtacacccaggggcggcgcccgatgtagaggtatgccctgtggcagaggatttgctgcaagggataatggatcaaggttggtttgaagttggtggtggaagcaagggggagcaacatttgtgcatgcaattggctgacaaaagcccgagcaagcctaaaccattggtgatccacttcaccagagatgctgccacccaaaagccctga

SEQ ID NO: 46948 - DNA, 147 bp, Glycine max
  Peptide Sequence Number=SeqID_163726
atgaatctggggatcccacggtcatgtggctccgcatgcccccggactcttgggtcacgcatttcgtttctaaatgaccatttagaggaaacactgggtccaacaaagataggagaaaatcactccaagtgtatcattctcacacag

SEQ ID NO: 46949 - DNA, 240 bp, Glycine max
  Peptide Sequence Number=SeqID_163727
atggttcgagagttttttacgcaaagggaaggaaaaggctatttggtgcaggggaagctcacccaggcaagccagttgattgggcttgaaggtatcagctcacttaggcgaatggcttgcttagggctgaagaaatttcatgactcaggcgagccagatgctagcctagaactgacaaacaaccatcaaaaccctgtgcgaccccttggccttcactgtaaccgatgccaaacaccgtaa

SEQ ID NO: 46950 - DNA, 579 bp, Glycine max
  Peptide Sequence Number=SeqID_163728
atgatggaagcaatgatgaacatgaggaagatgatggaagcaatgacaactgctacagttgttgctacgaatattgctactgagatggacccaattcacccggccggttcaatcaagggagaggggccttccacagtacttgagaaggaaaggattgagcatatggaggagaggctacacgccattgaaggaggaggaacttacgtcttggctaatatgacagagttgtgctttgtacctgaagtggttattcctccaaagttcaagtccctaagcgacctgcggtccttgagatttcttttcaaccttgtaaaatcctttacaagcaaagatccacaaggaatgtaccctcccttgttctctttgaacaacctagtggatgtaccctccactagaactgatccacaagagatgtaccctctcttgttctcagtcacaacaacccaagtagatgtaccctctacttgtaccacaaaggatgtaccctccaatgtgttaagacaaagttctcaggcggttagtccttcgaaactttgtgcaaggggaaacaaaagaattctcaggcggttagtcctttga

SEQ ID NO: 46951 - DNA, 165 bp, Glycine max
  Peptide Sequence Number=SeqID_163729
atgttgagtcctatgaatcataaagacgaggactttgagtcctatgcaaacataaagacaaaggagataaaggcgagcacattgagtcctatgaaagataaaggcaagaacattgagtcctatggaaacataaaggtggggatattgagtcctatgaaagcataa

SEQ ID NO: 46952 - DNA, 291 bp, Glycine max
  Peptide Sequence Number=SeqID_163730
atgtgtatggattcctcgagctacagtccatacaaaaatctgggcaatcacaatttgaatcagaaagttatattaagaactggatgcagaattcaaggagggatgtgtaccataggagcctacctgaatggactagacaactaccttaaaggaataattaacagtgctttgaaaggacttgacaatactccacaaagtaaatccaaggctgctactagatggattgttgttaaatatttcaatgatgctagaccattggaaccagagagattgaaggcgcttcgcatctag

SEQ ID NO: 46953 - DNA, 266 bp, Glycine max
  Peptide Sequence Number=SeqID_163731
atgctcaatcaaagtctatctcctatcatcagggcacccaccaagatcggaaactgtgtaccctacaacctccaagttgtcaactctcatatacacaagcatagactccttagtcttctacaagtacctcatcaccttcttagcaactatccatcgatcattcctagggttcaaatggtatctaccaagaatgccaactatgaaagcaatatcgattctagtgcatatctgagcatatatgaggctgcccagagcacttccaaaag

SEQ ID NO: 46954 - DNA, 543 bp, Glycine max
  Peptide Sequence Number=SeqID_163732
atggagagcataataagcaagctccgcaacctagacgcctaccctaaaatcaacgaggatttctacagccgcacgctctccggcggtgtcatcactctcgcttcctccattctcatgctcttgctcttctactccgagctccgtacgacacctttctctcgtcgttttcattcttttaaaacttctaatcgaaactcattgtcgtttttgccactgcctccagggttgtatcttcacgctgtcaccgagaccaagcttgtcgtcgacacttccagagccgaaacgctgcgtatcaattttgatgttacgtttcctgcgcttccatgttccatactcagtcttgatgccatggacatcagcggagagcagcgtctagatgttaaacacgatataatcaagaagagattagactctcgtggcaatgtgatagaaacaaggcaagaaggaattggtgctcccaagattgaaaagccattgcagaggcatggaggcaggctcgagcacaatgagacttattgtggttcctgttatggttctgaagtg

SEQ ID NO: 46955 - DNA, 417 bp, Glycine max
  Peptide Sequence Number=SeqID_163733
atggtggttcactattttcagtacagtgtaaaatgttccaaaagtgatggacaagttacaagacacaagattaaaaattgtcaaaagagagaagataatgatgggttgttcacctcagttggagatgggtctgttcaccttgttggaactgggttcaccaagtctgcatattggcttcattgtaggcttgtaacaatgacttcattagagcagagttcaccactttgttgcagctgggttgagtcattgcaggcttgcatcttcatttgccacatccattgtaaatgggttcagtccatgatgttggatgcagctctggagttaagtttgtgtcactatgaggttgaagccatacattcaaatttcatgatgctgctttttgggggttctaaaagcagtaaaacagtgttgttttga

SEQ ID NO: 46956 - DNA, 351 bp, Glycine max
  Peptide Sequence Number=SeqID_163734
atgttgcaccaaaaattctatttgaagacttatcaaattttgccacttgtttttgttgtttttcaggttgtgcctacagtatacactgatgtgagtgggcatactatccagtcaaaccagttctctgttacagaacacttcaggactggagacatgggccgtctgcagtcccttcccggagttttctttttctatgacctctctccaattaagattcattcatctatcacggtcaaagggctatcaagaagaagatggaacttggtaaatttaactgatgggtgctatttgagtaatttcgagcgaatggctctccagagacaatctattcaagagaaggtcgactactga

SEQ ID NO: 46957 - DNA, 162 bp, Glycine max
  Peptide Sequence Number=SeqID_163735
atggatctaggacctgaggtggaaatggtgaagattcgtcccaatgaagttgcacttcaccataaagaatctacaaagctggagaccttggaattaaaaaaaactcaccacaacgagatgtctaaagtccaaaggcaagaagatcaagtgcagagtccctag

SEQ ID NO: 46958 - DNA, 192 bp, Glycine max
  Peptide Sequence Number=SeqID_163736
atgcatgggccaattgtcaccggtaaccggcagaacatagccatgaatcatgagaagcattgcatacagcatacaggttgcaaacacgagacggatatttgtgagttgccggtggacgccggtccacgtgtttcgaatcatattaaacaggaggcagctacttcgggtccctttgtaggggatgatggttaa

SEQ ID NO: 46959 - DNA, 147 bp, Glycine max
  Peptide Sequence Number=SeqID_163737
atgacgcaagacagcttcggtctgattaaggttaaagccaatgagagaaggacacgcgccgctgctttggttgcagaagacacgtgcccactcccgtcggtgtttttaacgttgctgcgaagcctgtttgaccatgttagtggataa

SEQ ID NO: 46960 - DNA, 519 bp, Glycine max
  Peptide Sequence Number=SeqID_163738
atgttccatttgttgctacttgctacttgttgttgctacttgttgctaattttgttccattttagtatatctgggattgagagtgggaatggattagattcatcaaattccaatataggcacatccacaggtgcagcaagcagaagcaaaaatgctccaggaaataggactaatattgggtggaagcatgagacagatgttttagggaatggtaaaaaagttaagtacaactactgctcaaagatcaacaatgggggaattttcatattcaagcatcatcttgctgggactagatgggattctgaaccttgtgcttcagtgcttgaagaagttaagatgcttatgatgaacgttgttgcagaggttgctaatgcatcagagaagagaaaaaagttgaacagtattcatgaagaaggtactgagggagtggaagtggagtcaaatagtagtcaaagtggaatacaacggaaatggatgcttggtttcaaaggaagaggaaagcaaatttgtttaggctag

SEQ ID NO: 46961 - DNA, 225 bp, Glycine max
  Peptide Sequence Number=SeqID_163739
ggatttgcttcgagcttgctcgtgcattttttctttctccctcaaagcctcacactgtcacacaatcaccccataggagagttggaggagttgttcagagcctcagaggatgaccttattctgcggtggtccacgacagtagcagacaaccatgttcatttggaagctgcgagtcctaactcccatgaggtccacgacgagcacaacccatgtaagaatttctga

SEQ ID NO: 46962 - DNA, 324 bp, Glycine max
  Peptide Sequence Number=SeqID_163740
atgatagacacaaaggcaaggtactatgctagcctcaagaaggaggtatatgttgagaggaaaagggatctcaaagataatgagtttactttgactcaagagacctttgaagacaaagggtggaataaattgatagagcaagttgtctacagtgaaccctttgttagggagttctatgctaacaccatcattcaagatggtcacaaagaaatgaaatctagggtcagaggtatagttgtcaaatatgactcaatggccataaacaaccttcttggctccacattgaaattgaggaagggccaacaatctggatatgaggagtga

SEQ ID NO: 46963 - DNA, 876 bp, Glycine max
  Peptide Sequence Number=SeqID_163741
atgaatacagagattcaagcattggaggttaataatacttggatccttacagatcttccacaacataagactgctattggatatgtcaataatgcatttttacatggtgatttgaataaggaagtgtatatggttcttcctccaggtatgcagttagataaatcaggaaaagctaataggcaatggtatgccaaattgtcttcctttcttatctctcatgggtacactcaatgtgtatctaattgttctatgtttattaagcatggtcctcaatctattactgccttattggtgtatgtggatgatattgttctctctggtaatgatttgattgagatccaaaatattacaaagttattggactatgccttcaaggtaaaggatttgggtgatttgaagttctttctaggctttgaaatagccaaaacacctgcagggatcaatttatgtcaaaggaagtatgctttagatattcttaatgacactggtgtgcttggatctaaaccagtttccactccttttgattatactacaaggattcatcaacactcaagttctcctctttcaactgagggtgcttcttcctatagaaaactaattggaagactgatttatttggccaacacaagagcatatatcacttatgttgtgcagcatttaagtcagtatgttgctgaacctacctcagctcatcaacaagctacttttaggattctcaaatacatcaaagggtctccaagtgcaaagatttttctttctgttgatagtcaaattcatttgaaaggatttagtgattcagattgggttgattgtattgatacaaggagatctattactggttatgccattcatcttggtaattctttgattttatga

SEQ ID NO: 46964 - DNA, 2112 bp, Glycine max
  Peptide Sequence Number=SeqID_163742
atggaaatgaaggcaaagaacaacaacaacaagaacaaggttgggagtgaattgggttgtggtctcatggggagaattctccacctcaaaagccacaagatgagaaaagcatctgttcactccctacccttgaagaatgcacacagtgatgatgatgatgtcaaaactgaagaatcaaaggttgcaagaaaaagcttcactcacactgagccaccacacaaactgagtggtgcagagcagaaacctgccagaatgagtgtctctattattcaccaccaacaacaacaaccttgtacaaatcgaaacaaccaacatctgaggcattcagatgttgctgcaagaagctcaacatcatcgttcactagtacttcaatttcatctcacactaagtttcaacaaaaccaggacaaggatcatgagaggaagccacgtggagaccccactggaaattctcttgcacttgctaggataagcactagcaaagagaacaatgagaacaagaagtctcaattgaaactcaccgggaatttgcttgtgaataacacaccaagaaggaagagtgtggaatacatgcccaagagtgcagagctgaactctgttcgcagttcttacaccaatgcaagcaaagtcttgatggggaacatcatgaggaggaacagcaacagcaacgaggttgcacagtttttgagtccaaggctgaaaaaaatggaccctgaggtgttgaaatccatgggaaatgaagcatacaagcagggaagatttgaagaggccttggctttgtatgatcaagcaattgcactcgatttgaataaggcggtatatcattgcaacaagagtgcagctttaattggcttaggaaggcttcaggaagcaattgttgagtgtgaggaatctatcaagctggacccttcttatgtcagagcctacaatcgtttggccacaatatatgtcaggttgggagaagcagaaaaagcactagattgcaatcagtcaatcccatatgttgattcaatacttgctttccaagctcaggctcttcaaaatcaccttaacaaatgcatagaagcacggaaagtcaatgcgtggagtgatatactaaaggaaacacagtttgcaatatccttaggtgctgattcagctccacaggtctatgctttacaaactgaagccttgctgaagctcttaagatatcaagaggcctatgtcatctacgataaaatgccaaaattttcaattgattggtgtaccaagatgtttggcccagctcgcagcgcttacctgttggtgataggctcaatggtttacttggcatctggcaggtttgaggaagctgtggcatcaactcagcaagcagctaaagttgatccaggcaatagagaggtgaatgcaatggtaaggaaggccagagctgcaacatcagctagaatgagcggaaacttgctcttcaaggcatcgaaattcaccgaagcatctggcgcgtacaacgaaggactagagcatgatccacacaactcagttctactatgcaacagagctgcatgtcgttccaaacttggtcaaaatgagaaagcaattgaagattgtaacgcggcacttatggttcagccaggttatagcaaagcaaggctaaggagggcagattgcaacgccaagttggaaaggtgggaagctgctattcaagactacgaaatgctattaagggaaaggccaggggatgaggaagtggcaagggctttgttcgaagctcagctccaactcaaggtgcttcatggtgaagatattaaggacttgaaatttggttcaaacttggtttccatctcaagtaatgatcggttcagacattatgtaacctcacctggtatggctgtggtgctctttagcaacaagacaacccacaagaaagtgttgctagtgttggagcaaatcagcaagagattcccatcagttaatttcctcaaggtggaaatcgaagaccacccctacttagcaaagtcagaaggtgtgagctctatcccagccttcaaaatatacaagaacggatcaagggttaaagaaatctcaggcaacaaccacgagttgttagaaagatcagttaaattgtatagcagctga

SEQ ID NO: 46965 - DNA, 586 bp, Glycine max
  Peptide Sequence Number=SeqID_163743
atggatcccgaggatgaaaaacgaatcaatcggacgacgtcatttggcaagttttgtaagcgaagggagaggggtctcaagccctcgcaccatcatcgcagtgtccctgccacacgaccgttgtcatccccgtggcaaccccgcaccgctagaccttgcaccagtggtggcgggggcaaggcgccaccctatttgatggtttaccctttggtggcgctgttttttgtgagaggcaacaaggaattgtgcttggtactcgacgtggttattcctccaaagttcaaggtgccagactttgataaatacaaggggaccacttgcccaaagaatcacctgaagatgtatggtaggaagatggaggcatatgcgaaagatgaaaagttgttgatgcatttttttccaagaaagcctaatctagtgtttgctagcgagagaacagaagcaggtccgaggaaaggaaaatttaattatgttgcttctgcaaatcttggtagtgggggacccaagaggaagaaggtgggaaaaccttatgttgtggctgcacttcccgcatggccaaactttccactagccgcttataatccct

SEQ ID NO: 46966 - DNA, 441 bp, Glycine max
  Peptide Sequence Number=SeqID_163744
atgagccagcactccatacatccaaattccaaagtggttgtcacgtatcgccaatttgaatgcaaaaattggaagagtggcactctagagtctagagaagtaaaacatgatgttccttgtttccaattctgttctgactttaacgggctgaaatccgcaagtgttggtccgaatggaccggacagttgcacagatatatcccatgggcgaggtggtattacttgtgaaggaggagcaggttttctatgggatgcaggaagcaaagccttaggtgcaggaagcaaaggcctaacttctagccgaataaatttcgtaaccatatatgatcttaataaactccaaagcccaaaatcacagcacacactcattggctgcaacacaaatcacttcacttgcgcaactgaagttaattccctccctaaacagaccatacatgtttag

SEQ ID NO: 46967 - DNA, 500 bp, Glycine max
  Peptide Sequence Number=SeqID_163745
agagacaagaggcaaacaaggagagtgagaatgaggtactaagacctcctcagatttatattaatatcgcctttgctgaggcaattgttcaaatgccaaagtatgccaaatatttacaagaaaattttccaaataaaggaaagttggcagacttcgctacaactgatctctacaaagaatgcactccaatatttttaaggaagttgtcacctaagcttattgatccaaggagttttttagtcccttatactattggccacttacaaatcgatagagctttatgtgattcggccaccaacaagatgaagactattgtggctaagtctcacccaagtgtggggaaggaagaccctccaagaaatagagccatttcaacagactttggatggagtaagaaaaaaggagatagcatcaccattcaagctcttagctatatagtgaatgattgtactggaggatcaatgcaaaaagggaaaatcaccttgttcaagggtggttga

SEQ ID NO: 46968 - DNA, 684 bp, Glycine max
  Peptide Sequence Number=SeqID_163746
atggacatactcaacacggcccttggccgacctgagcatccaggccgtgttcgcgtcacagggacatgtgtcacaataagccaatactttggccaagcctcacgtgcttctaacacatcatcaccatcgatcaaccaacaacaattggttgatatcattggtggaattaaggatgacataagaaagcagctacaagatgagataagaaaggaggtacaggatgagataagaaaggaggtacaacaagaacacaagcagcaacaagaggcttggatgagggcagttgaagaaaaacagtggcaaaatttggagatgatgaagcaagagttaaaaaaatcactgaaagtagagctatctcatattgcatcacatcagtcagcccccattgaggcgccagaaatacaagctctacttatgcgtgttagcacaaagggtagctgcgctggacctgaaggaagcagattacttaaagagcttttgaatggtgatgacgatctgatgggcttgttcgtagttgtagggcaaaatattgtgcttgcgggcttgggaaaagtgtttgagaattcattcaccatacgtaatattcgttatgaaaatgatgttgttaaggttcaggttgtcagaacatacatgcctcacgctgaggtccctattcctacatcagaggttcattatcttgagtag

SEQ ID NO: 46969 - DNA, 750 bp, Glycine max
  Peptide Sequence Number=SeqID_163747
atgggtgtaggacacaatgatcagaaagttcttgttctagcagctacaaatacaccttatgctctagaccaggtgcacctaggagatactccccataacttggctgaaagtgattttgaacatttggctcgcaagacagaggggttttcaggttcagatatatctgtctgtagtgcagtacaaactacaattcaggatcttgcggcgaaaggacttgcttctaagatcctgccgcctcctatatcgagaacagattttgacaaagtacttgctagacaaagacccaccttactcatgttggtcggctttttgaatgtagatgtcacaaattttatgatagttataggtttgagttttttcagattccaagttggggtgagggttgacaatttcagctgctatgcttcacccagccgcaagagacaaactaatttcatcactaaactgtgtcaaatgatcgccttcctctcctctcttcttgaaagggtggctgagtcaaatgatcacaaccaacagcaccagaagatctcagtgttccatggcttgacaaggccaaacatctcaattcagagctaccttgagagaatcttcaagtacgccaactgcaacccctcgtgcttcgtcgttgcctacgtctacctcgatcgattcactcagagacaaccctcccttcccatcaacaccttcaacgtgcaccgtttgctgatcactagtgtcatggtagctgccaagttcatggatgacatgtaa

SEQ ID NO: 46970 - DNA, 153 bp, Glycine max
  Peptide Sequence Number=SeqID_163748
atggctttactggagactggaagcaaaaatggaaacagtaaacaaacataccttgagttaattcaacagaaggtctctgttcctttacccactgataactgtgtacaagtctccatcctttggcctaaaacaggttcaagtcataacaactga

SEQ ID NO: 46971 - DNA, 756 bp, Glycine max
  Peptide Sequence Number=SeqID_163749
atgcaaatagggggatgccacatctgcgatggagcacacgagccagggcaatgcatagcccaagaagattcttccagggaggtgaactacatgggagctcagaatcgccatggattccaaggttacaaccaagtaagaccaccaggattcaaccaagggagaaatttcacacagggctcaagctggaggaatcattcagggaaccagttcaacaaggagcaaagaagtcaacctgtccagaatttcaaccaaaaggttgatctttataggaagaccagcaagcttgaggagacactgaatcaattcatgcaaatgtccatgtctaactataggagcacagagtcatccatcaagaacctggagatacagatgggacaattagccaaacaagtggctgaaagacccactagcagctttggagccaacacagagacgaacctgaaggaggaatgcagggcagtgttaactagaagccagaggagagctcagctagcccgagaggctaggaaagaagagccaccaacccctctaaaggagccctcataccctttagtgttgtcaaagaagaataaggagcgctatttcaagcgttacatggagatatttaaggggctggagataaccatgccatttggggaagctttgcagcagatgccgctctacaccaaattcatgaaggacatcctcaccaaaaaggggaagtacattgataatgagagcattgtagtgggaggcaactacagtgcggtgatatag

SEQ ID NO: 46972 - DNA, 204 bp, Glycine max
  Peptide Sequence Number=SeqID_163750
atgccccaaccacatgggattaacatgggcttaaaggaacactcaaaccgagtacctttacccccaaggcctagactccgaagaatccgtttggacctcacattcctgattcagccagttcaattatccaacaatccctacacatatgaatttcatgacaatccctacacatatgaatttcatgacgagaaatcacccacatga

SEQ ID NO: 46973 - DNA, 150 bp, Glycine max
  Peptide Sequence Number=SeqID_163751
atggcgatggttttgtttgactttggtgcagaaagtggtgactggttgaaggatacatctgaatcttgttctgtggtggctgcacttgttgctggcgtttcctttgctacagccagcagcatccctggtggaaccaacgacgaaggttag

SEQ ID NO: 46974 - DNA, 165 bp, Glycine max
  Peptide Sequence Number=SeqID_163752
atgaatcctggaattgcaatttggacgaagaaggtgtacatggttcaagagcttgtgaaggcaattatcacgcgcaagcagcaaagtgtgaagaataatgagtcaaaaaaaacaaacatggggagacgcctgtctttaatagaaggagaagaaagaagacaatag

SEQ ID NO: 46975 - DNA, 366 bp, Glycine max
  Peptide Sequence Number=SeqID_163753
atgaaggccgagggtttggaggaaggagaagttggcgggttcggggaagccggagcggaaaatgccattatcaaccatggcgaagttgaggggcggaatgaagagatcctcgccgtcgtcgtctccggcggtggtgtgatcggagatagtgagctggatttggcggcacatgggagtgtcttgtttgtgcctttggtggtggtgatgggcgcgttggagttctgccgccacttgcatatttgtttgttcgtttgttttaagagagagagagaggggggggtaagggaagtatttagagggggtgccctcaagctggaacggcttttgagagagaatggatggatggcacttaaagggctgaagtga

SEQ ID NO: 46976 - DNA, 871 bp, Glycine max
  Peptide Sequence Number=SeqID_163754
atgggatcaagtcaaacgccttcacttaaaaagaggttctatcaagtcaatgtcaagagcctaggaatcaccagtctaaaagagctagggaagttgatgggtcagctccagcggcaagcttttcgcaaagcttacggtaaaatctgggacctagccatggtgcttcactttttgggacttccagctatcacccatggtggaagaattcaaagagatcctaggatgtcctctagggggaaggaaaccatacctcttctcaaggcgaatggccccattcataaacattcttgcactgtggatcttaggaggagtccttttccaaatgtggatgggttggtgaacttagcagcgatcgacgcttttcttgcctatcatgaccacaaggaaagcccggtcgtcgctatgctagccggcctatatgacacctttgaccaaagatatgagaagagcagtacgagaattgtctgttgtactcccgctctttatgtatgtttggtttcacacctttttcgccaagagctgaggcatgcttgcccgttagaaagccaccgttcatgcacagagaaaggaagggcaaattgggaccaactcttagcaaacaaagaaggagcgtctgtcaactggttcattcgatggaaagaaggaagaaccggagttcttatttcgtgcggaggattcccaaaggttcccttgatagggacgaggggttgcatcagttacaatcccgttcttgctataaggcaacttggctaccctatgagaggggcaccactagaggaagagctcacgcctgtccgcaaggcatgggagatagtgcaaaagaaggacaaagaactcagaggcagtaacaacgggcccatcggcggctacc

SEQ ID NO: 46977 - DNA, 639 bp, Glycine max
  Peptide Sequence Number=SeqID_163755
atggtggtccaacaacaccaccaccatatccggcaacaccatctcggtgacgatgtgcaagggtgttttcttggcaaggttagtggggaagttgacttccgtgaagagctacaacaccaccagatgacatcttcctgtcatttgaggaggaatgctaaagtcgtcgatggcgtcttagtgggaatcttcctaacattgttaacgagtgaccacgaagtccttcacagatttgtcacagtggagtgcaaatctatggcgtggagtgcagatttgtcacgatcaagtgcggatctacggagtggagtgttgatctgtcattgcgtcgcgattttgaagtctatagagagattagagggagaaaaagtaaagagagaagaagaggagggagaagatagagagattagagggagaaaaagtaaagagagaagaagaggagggagaaggattagtccttataagaaagagcaccatgtgtctgctagaaggtttgatgcccttaatgatagagctagtagtgatgatgtcacgtccatggaggtggtgcaggactctcaagagcccataaaattgacatgggcgagtggaaatcagtttggctcattaggggataatgagaaccctaatatgtttaaaatctga

SEQ ID NO: 46978 - DNA, 309 bp, Glycine max
  Peptide Sequence Number=SeqID_163756
atggccaatgttcgcactgtggagagcatgacccctttggacatcctcgaacttacacttggacaatcctactcacaccgaaccctgggccacattgagaagaagaagaaggggaaagataggaagagaaattacatcaagagtagttggctatcaagtttccaacaaaggaggtttagcctctcatcgtcatggaagttttacaattgcaaaagagaaatatttagtaaaggaggaaaagataagaaagggaatggaaggaaggaactcctaatgcttgcttccccttctagcttttgtcttctataa

SEQ ID NO: 46979 - DNA, 1056 bp, Glycine max
  Peptide Sequence Number=SeqID_163757
atgtctaaagaagttattgctactcaatcacctactccttttgagtatgagatcttggatagtgatgctgaagtccttagaactgttagagcctcatccaattgtgctaatccatggattgaacctgaaaggttgaaacttagacatagaattggccgaggcccctttggtgatgtctggctagcaactcatcatcagtcaactgaagattttgatgagtaccatgaagttgctgctaagatgttgcatccaatcagagaggatcatgtgaagattgtattagagaagttcaatgaattgtattttaagtgccaaggagttgctagcgtttcctggctacatggaatttcagtcttaaatgggaggatatgcatcattatgaatttgtgtgagggttcaattggtgacaagatggcaggactcaaagaaggaaggatttcattgaatgatgtcttaaggtatggaatcaatctagctcaaggtgttcaggaacttcactctaaaggcagcttcatcctgaaccttaaaccttttaatgttcttctcaatgataatgatcaagcaattttgggagatgttggtattcctagccttttgcttggctcatcattcctgagctcagacatggctaagaggcttggaactccaaattacatggctccagagcaatgggaaccagaggtcagaggtcctatatcctttgaaacagattcttggggatttgggtgcaccattgtcgaaatgttgactggtaaccaaccttggtatggatgtcctgttcgcagaatataccagtcagttgttgaaaaacatgaaaaaccaaatattccaagtggccttccttcttcagttgagaatatcctcagtggatgctttgagtatgatttgaggaatcgcccgttaatggtagatattctgagtgtctttcaaagatatggggttgctaatatacttccatttgctggggagtgtgttagtaagctacaacttggatttattaaataccttcaaaggtgtagcttgataatgtaccctattagcagctggcccaggtag

SEQ ID NO: 46980 - DNA, 135 bp, Glycine max
  Peptide Sequence Number=SeqID_163758
atgacatcatgtgttatgaacaactctgatgctgatccacctggcggtagcagtggcaattacatagtaattgacaattccttgcaacaaactagacaagtactttttccatcgagtaaccaagagatgagatag

SEQ ID NO: 46981 - DNA, 1830 bp, Glycine max
  Peptide Sequence Number=SeqID_163759
atggagtattggagaccgtggttttgggggcacgccgacaagtactacgttgttaagttgagccaattgaggttgaagtttgggccaacgttggatgctgcaaatgacaagataatagcaattcagattaagggaacagctacaaagaaagggaaagtttcttcttcttcttcaacttccaaaagctttcttattccttttcatcgtacccagaaactaggatccactcacaccaccaccttcccccataggttcaccaattctaaggcaccaacaatcgtgtgggacgcacgtgacctctgcgactttcatctcgtcctcaaacacggcacgtgctacatgacacttcatgtcttacatgcggagggtgatataggagaatataaatctgaaatggtggtggttggagaagtttccatgagcgttactatggctgagtttatggaaggggaggagatgaagaatgagtcaaattcttgtcaggttcaaagaacacttccaatccaattgaaggtgcatggtttgttcatggaagaagctacactttcggtttcattgagcttattgaaactgagaaactttcatgacgacttgccaagagcatttgtaaacaaagtgacaagccttgaggacaaaaataatgggaaagttgttgatcaagttgaggaaccaagcccttatgaatgggacgagttatctgtgtatgactcagatgactcatctgataagtccaccactacaaccacaagcagcagcagcagcagcagcactagcactgcaattcactgtgaagggtcaagtgttacaaatgggtcagagaggtttgtggcctcagattcagagacccttttggacacaatgcagaggagttggtccatgttgccatggaatagaagcttcaagggatggagttttaaaagaacctcctcaaggaaacaagagcctttgacctcacattcaagtcattccatgggaccatactttgatcacaataaatgcagcgcaagtgggtgggaaactagggaacttaggagtagagatgcgcaagcaatgctcaaaactaatgtgttctttgcttcctttgaccaaaggagcaaacaagcatgtggtgagagtgcatgtacagcactagcagtgtgcatagctcactggcttcattccaaccataacatgccaacaaggtcccaatttgacagcctcatcaaaaggggttcctctgaatggagaaggctaagccacagtgatcactacctaaagcttttcccagataagcattttgatctagagacagtcttggaagccaacattaggcctctagttgttacccctcaaaactcctacacaggatttttctcccctgagaagtttcagtgcttggaaggagccatgtcctttgatgacatttgggatgagataactagaaatgatgatgtggttgatcatgagccaagaatttacatagtgagttggaatgaccatttctttgttctgaaggtggaagttgatgcttgttatgtgattgacaccttgggggagaggctttttgagggatgcagaaaggctttcatattgaagtttgatggttcaagtttgatgcatgcaaagggaagtaagaaagaaagaggtgagatagtttgcaaaggaaaagagtgttgtaaagagttcatcaaacgctttcttgctgccataccacttaggcaactagaagaggaagagcgaaataaagggactgtttataatccttattttcacaggaaattgcagattgacctccattatagtttgttatcatccttgtcttcagcttcttctattggtgaacctttataa

SEQ ID NO: 46982 - DNA, 597 bp, Glycine max
  Peptide Sequence Number=SeqID_163760
atgtcaaattctgtgttcgtgctaatctctccctcttgcatccctctccactcgctcaagttcacctaccacgtgcttctccgtcagggcaaaagctttgtagagattcttgcgaatgaagaaacggcttatgatcgctgggcggcgcgtggaccacacgcgatgctcccggaggtgaggcttgaggagttccgcgtggggtcacagttttgggcactgacgcgtcggcacgcacggcttgttgtgagtgaccgcgtgctgtggtcaaagttcgacgcgccgtgcgtgcggtttgattcgtgctatcccgaggagaattactttcctacccttttgagcatgtgggacccgcaggggtgcgtgccagccacgctcacgcatgttaattggacggggcgcgtggacgggcatccccgcacgtacgaagcgtgggaagtggggcccgaactgattcggaggatgagggaagatagaccaaggtacggtgacggtaacagtgacggacggagtgatccgtttttgtttgcgaggaagttcgccccagatgcgttgcaaccgttgatgagaattgctaacggcgtcatcttcagggactaa

SEQ ID NO: 46983 - DNA, 174 bp, Glycine max
  Peptide Sequence Number=SeqID_163761
atggctacaaaggaagcatttgtttcaagtttgaaggtggcattgaagtctcgaagagcaaggactagtgttaatgttatggaggacaagtggtgtggtgggttgtggatcgaggtgtttggaggtaagtgcgttgtagatgaggagagggaggactttactctccgagagtaa

SEQ ID NO: 46984 - DNA, 297 bp, Glycine max
  Peptide Sequence Number=SeqID_163762
atggcggaacctttgaagagcttgttgtcggcgtcttgggtcttgggaggatcggacaccgggagcatcagattctccgacgaattcgacagtcttagagacatggagaaggcgaaatttaagagagggaaagggttcggagaattcgaggaagtaaaaaccaaagaaggggaaagagagaggttagagtcaatcagacacagacgagacgccgccacttgcgaatccgaactcctcaacttgacaactcgtcaactccgatgtctcaaactggctccaccaatatatataatctga

SEQ ID NO: 46985 - DNA, 198 bp, Glycine max
  Peptide Sequence Number=SeqID_163763
atggagtctgttcgtggagtaaatgttccaatgtacacaactcttaggaggaccacagtggtatttacaatgcttgtagagtttgttctggtggggcaaagatatacaccttctgttattttcagacttattgggacatgttgtgcattacacttagacttagtatatgctatctgtatttggtacattggaaattaa

SEQ ID NO: 46986 - DNA, 186 bp, Glycine max
  Peptide Sequence Number=SeqID_163764
atggcttggccaagagaccagccttcttctagaggggtgaacccttttctatggaaattgtggttgaagcatcaaaatgcaagagagaaaggtgttgagggtggtaatgatgctggaacaaagaaggaaggatctggatgcactaatgctttttgggaccatctaactgtggagtgtggggagtag

SEQ ID NO: 46987 - DNA, 375 bp, Glycine max
  Peptide Sequence Number=SeqID_163765
atgggaaatcccaaaggcttgtcaattgaatcctcctccccagaatttttggatgaagcaagtagaggagcatggaagagggttagtcgcgatggggttgcgcgtgtggaggaggaggaagggggttggttcgtacatggacaagggggagggctagaggtcacacacggaggagggagagtgccggagtggcgcgcgtggatgaggaggctgagaagggaagaagagtgttgggttcgctcgcagaggagagagggtgaggggaggtcatgcacgcagaggagaaggaaggggctatgggtcaccgtgaagaaaggaaaaagaagaagaagatatggtgtttggctaaggagagagaagaaggaatgcacgtga

SEQ ID NO: 46988 - DNA, 2592 bp, Glycine max
  Peptide Sequence Number=SeqID_163766
atggttggaagcaagaagtcgattcctccaatagaccgccacctcatggtaatcaagctcaacaagaatatggatgcttctataaaaaaaaccttgaggtgcaaatgggacaaatttccaaggaaatggaggagctcaaaaagtggatcatttttcaccaacactcaacctaatcccaaggaacaatgcaaggccatcaccacaaggagaggagcattggtaggtgacttgactagagagaaaagtgagcaagagggtgtagttgaagaaatcattgaggatgacgagagtaagtttgatgaagagagtgaaaaaaagaataaggatagcaaaaacaataagatgaatcctccctccaaggatcttccatatccacatgctcctacaaaggaggacaaggaaaagaaatatgcaaggtttctagagattttcaaacaattagaagtcaatgttccttttttggaagctatagagcaaatgcccacctatgccaagtttatgaaagagattttcaccaagaagagattcattgagcaagatacaattcaattgtcggcttggtatcccacggtggggaaaactctacttgaccttggagttagcattaatctcatgcctctctccttattggcaaagattggtcatcttgatcttaagcctactcgaataaccctccaattagcatattgctccattaagcgtccacatggtgttcttgaggatgtacttgtcaaggtggataaattcatttttcccgctgacttcgtagtgatggacatcgaagaagacttcgaattgccccttattctgggaagaactttcatgaacatggccaagattttggttaatgtgcatgatggtcaaataaagcttcaagatgttatcgatgaagttgttatccactccaaggagaaattatctaatgcttcacctcttgagaaaaccatcatagatgtgtttgaaactcttgatgaggaagaggaaaaggaaattggagaatgcttgaaacagcttgacactttgaaggaaattccttcggaagaagaaattattgaagaattgaagaaagatgagaaagcagaggaagccaagcttgagttgaaaatcctaactctacatttgaattatgagtttcttgaattaaatggtagaaaatttgtcatcattaatagttctttatctactttggaggaggagaaattgattgaaatcttaaaggatcataaaggagctataggttggcttaatcatgtgatgaaggaggagggtggtatgacaattattcgtaatgaaaagaatgagttgatacccacaagaacagttgtcagatggagaatgtgcatagattaccgaaagctctacaaagtaataaggaagaatcattttcctcttcctttcatagaccaaatgttagagcgtctagccgatcaagccttctattgctttttaaatggttattcgggctacaatgaaattgttgtggatcctaagaccaagagaaaactgctttcacatgcctctttgaaatgcatagaggttttcatggatgacttctccatctttgatagttcttttgatttgtgcttgtccaacttggaaatagtgttgaagaggtgcgttaagacaaatctcatccttaattgggagaaatgccatttcatggtgaccgaaggaatttttcttggccacaaaatttcatcaaaagggattgaagttgacaaagccaaagtggatgtcattgagagacttcatctaccaacaaatgctagtttagtctctgctcccatactcattgcccctaattggaaaaaatattttgaattcgtgtgtgatgcaagtgattatgtagtaagggttgttctaggccaaaggaaggacaaaattttccatcctatgcactatgctagcaaggaatttgatcttgagattcaagacaaaaagggtagtgagaatcaagtagcaaatcacttgtcaagactagtgaatgaagaggtggccacacttgaaattgagattcttgaagagttttctgatgaaaaactattgttagtgtatgaaagaccatggtttgcggatttggcaaacttcaaggatgcccatgagcatgtgaaaagctgtgacaagtgccaaagaatgggaggaatttcgagaaggaatgagatgccacttcagaacatccttgtggtggaagtatcaaatagagaaatcaagaagatccttgagaagaccgttgcttcttcaagaaaggattgggctatgaagcttgatgatgccttgtgggcctatagaactgcattcaagacactaattgtcttatctcctttccaaatggtgtacaaaaaatcttgtcatcttccggtggaattggagcataaagcctattgggctctcaagcttaaactgttccatggaaaattaaagtctaagtggtctagcccctttgtgatcaaagaagtcagactttatgctacaactgagttggaagatccctcatccaagagaaattgggtagtgaatggacaaaggcttaaaccttacttagggggtgaagttgagaggctcactacaattcttcatctcaatgacccttga

SEQ ID NO: 46989 - DNA, 327 bp, Glycine max
  Peptide Sequence Number=SeqID_163767
atggccaccgttgcggaactgaaggacgcggtggaggccgtgtttagtcacgtgcctcacaaggggccagcaaaaatttcatgggcgcatgtttgggggcaattttgtttatgctatgatggacagaagctagttacggagaaggattatcttcgaaattatggcatcaaggatggtgaccagctccgtttcatccgccatgtcacaaacaattgctgtgttcaaagaaagcggttgaagaaaagagttgtctatttgaaacaacacaggaggaaccaacatgctatttgccaggctacactagatgattcttggcctgtgccatag

SEQ ID NO: 46990 - DNA, 747 bp, Glycine max
  Peptide Sequence Number=SeqID_163768
atggcgctcatgatccttttccctcaagctttggtggaggttctttaccagcataactcagaccataatcctttgcttttgagttgtagcaaattggtggttgatgcttggctctctcgcccagagtatccaaatttggtggttgatgcttggcagggcaggactctccaagtaatgtcattcataagcttaaggaaagttaaggaggaaactaccatctttaatagtcaagtttttggaaacatttttaaaagaaagcgtcagttgcaggcttggattcaaggtgttcatagagtgcttgatgttagagtatatgcttcacttgtctctttagagaaagagcttgagaaattgtataatgatgttttgtatcaaaaggaggtcttgtggtatcagaaatcaagagagaggtgggtgaagcttggtaacaaaaataccaaattttttcacactcaaattactatcaaaaggaggaggaatagaatttatgggctcatgattaatggtaattggcgtacagagaaggagaattgtcaaccttccggtttatccatgcaaaatattcttgtcttgagtcaacaagctatggagactcttctagctacagttagtatgaaggaggaaaaagtctctaacaatgagtggcatccagttaagattactaggcaatgcctttccatctcccacctctttttcgcagatgattgccttcttagtaggaagagagttatgactagccagccataa

SEQ ID NO: 46991 - DNA, 348 bp, Glycine max
  Peptide Sequence Number=SeqID_163769
atggtgagcaacccttcaagagctcagaagaaagaaaaaacttccaagaggaagcaaggcgaatgctctcaggctgctctcaacaggttggacacatggtttactgatgaaagcaagaagaatgactacaagatgatctataagaaaggaaccttctatccagagctagtcaaggttttctacatctgtgcacgtgtttaccttgaaggagtctgcaagttcgatgaaatgcctgatgggtatagcaagatgcagacctatagaggaattctttttgacccagcaaggaacttgaggaatcacttaggagttggtggactatttttcaagaggaggatgaagacatga

SEQ ID NO: 46992 - DNA, 669 bp, Glycine max
  Peptide Sequence Number=SeqID_163770
ctttggttgttgagcttaccatgcagagagagtgtgtgcatcccaagtgagcgtgagacacttttgaagtttaagaataatctgaatgatccttcaaataggctttggtcatggaatcataataattccaactgttgccactggtatggagtcctctgccacaaccttacttcccatcttcttcagcttcacctcaacacttcagattctgattatgcaaattgggaagcttatcggagatggagctttggtggagagataagtccttgtttggctgatttaaagcatttgaattacttggacttgagcggcaattatttacttggagaaggtatgtcaattccttctttccttgggacaatgacttccttgactcacctcaacctctcttatactggattctatgggaagattcctcctcagattgggaatctctctaagcttcgatatcttgacttgagcgacaatgattttgaaggtatggcaattccttctttccttgggacaatgacctccttgactcacctcgacctctcttatactggattcatggggaagattccatctcagattgggaatctctccaatttggtctatctttatttgagttatacaaacctatccaaagcatttcattggctacacactctcaatctcttccttctttga

SEQ ID NO: 46993 - DNA, 782 bp, Glycine max
  Peptide Sequence Number=SeqID_163771
ctgagaggaaagtagagctatatcacactgagctagatgactttaaggccgagctggagaggcataatttccataaacacctcaccaatttagccgatgggagcatagatctggctttggtgaaagagttctatgcaaatttatacagttttgaggaccatccaccaaagcagtccagagtcagagaccatttggtgaaaattgatgctgacagtctcaacacatttttagagacacctgtgattactgaaagccatcctgggaagattctcaggaaggatctgactacactagctcaggtgtggagtgtcctctcatactccaacttggcccccatatcacatacttctaacttgaaagtggatggagctaggctcatttttggcctagtttctcacttggatatgaacataggagcgctgatctctgaccaaatgacctctatagcccagtctaacacctctagacttggcttccctgctctaatcaccgcattatgtagagccagagaggttgtctctgacagcctcacctttgagcgcctgagcccggtcattaacctggcctacatcaggaagaactgttggaaccctgaggatctaacagtctctatccgaggggctaggagggcgagggaaaggcaagctgagcttccttctacttctgcagctcctactctagcatccacttcagcagccccttctgtcccagctcaaacaaattatcagcgctttgaagccatgctacaaagcattcatcagggacaaatcattttactatag

SEQ ID NO: 46994 - DNA, 351 bp, Glycine max
  Peptide Sequence Number=SeqID_163772
atgtgtgctgcacctttcgagtttggtgctatgtttcatgattgcctaagtgcggaccctcaaggcaatcttccattctcccccctttttcggagccccatgaatgttattgccctagcgttgttcatgtgtcctccaccttcgagtatggagctatgtttcatgattgccctaagtgcggaccctcaaggcaatcctgcattgtcacactttttcggagccccatgcttgttattgcccagcgctgttcatgtgtgctccaccttcgagtttggagctatgcttcatgattgcctaagtgcggaccctcaaggcaatcctccattctccccctttttcggagccccatga

SEQ ID NO: 46995 - DNA, 426 bp, Glycine max
  Peptide Sequence Number=SeqID_163773
atgacaatccagaatatgcaatttcagcaagagacaagagcctctattcagagtctgacaaatcagatggggcagatagctactcatttgaaccaagctcaatccccaaattatgacaaattgccttcacaaactgtgcctccaccagtagcagcatctgcacttgaacctgtcaagcttcatgctacacctgaaaatgaagatgagatagttgcacaaaagaggaagtttactcatcagggagctaacaaaaattttcatgcaggtggaccttcttctagctactcatttggaaaaggagatcttggagaccttcaggaaagtagaggtgaacatacctctgctggatgccatcaagcagattccaagatatgccaagtttctaaaggatctatgcacccacaaaaggaagctcaaaggcaatga

SEQ ID NO: 46996 - DNA, 1391 bp, Glycine max
  Peptide Sequence Number=SeqID_163774
caattattgagctgagtgaactacagcctcaggacctgattgtctccagcccaacttatatcgattttacggcagagacaaggacgtcagggattgatttcgaagatacccgtatccgaaaaggagcttacgatacgattaaaaaattaactgaaaaagcaggaaatatctttcctcaggaaactcaggatgcaaccactaaaatttctgaaaacggaggaactccgttggtggtgtcggttaacgagaaagtatggggagtaattgaactacaggatatcattaaaacaggaatccaggaacgttttcagcgtttaagaaaaatgggtgtaaaaaccgtaatggtaaccggagataatcctttaacggccaagtttattgcagaaaaggcaggtgttgatgattttatcgctgaagctaaacctgaggataaaatgaactacatcaaaaaagaacagcagtccggaaaactggttgcaatgatgggagatggaacaaatgatgcaccggctttagctcaggcagatgtaggtgttgccatgaacagtgggacacaagcagcgaaagaagccggaaacatggtagatcttgataatgaccctacgaagctgattgaaattgtagagatcggaaaacaattattaatgacccgtggaacccttaccactttcagtattgcgaacgatgtggctaaatattttgctattatccctgcattattcatcacttttattccagctcttcagaaactgaatatcatgaatcttcacagcccggaatcagccatattatcggcaatcatttttaatgccgtaatcatcccggcccttattccactggcactgaaaggagtagcttataaacccattggtgcgagtgcattgctcagaagaaatcttttgatctacggtttaggaggttcaaaattacttcctacacagggaaatgcagaaaccattacttatcgggaccagaagttctacgctaatatcggacaggagttcaagtcgccaaaatattttcacagccgtccatccgcagctaattataatgccgcggggagtgccggaagcaacaaaggcccaagtaacaaggagtatctggaaacagttcaaaagagaatcgatactttaaaaatgcagaatcctgaaatgaaagatacagaagtacctgtagagcttgttaccgccagtggaagcgggttggatcctgatatttcagaggcaggagctctataccagataaaaagagtggcaaaagaaagaaatctttctgaggaccgaattgaaagtcttgttaaaacaaatactgaaaaacccctattgggactttttggaccttcaaaagtcaacgtactgaagctcaacattgctttagataaattacaatag

SEQ ID NO: 46997 - DNA, 612 bp, Glycine max
  Peptide Sequence Number=SeqID_163775
atgggggttcagcttttagggaatcagaaattcggagaacttaatgatcaacaacaggaattattgaaaagcatcaacgatgacgggcaaaggctcctggatattacaggtgagcttttaaatctgtcgcaggtggaaaccggaaatatccgtctgaatattaaaagctgctcaccgaaagaaattgttgctaccgctattaaaaatgttgaaaaactagcggagcaaaagaatatttcgatcagcaccgactttctcacaagtgaagaagatcttgtttccgcagattttgataaaaccgtttgggtgatgaataacttcctgagtaacgccattaaacattcttttcaggacgaaaacatccggatactggtagagaagtctgaagcaatgatcttgtttagcatcacagacacaggaagcggaattgatgaaaaataccaccgccagattttcgaccgctactttcaggtaccgggagaacatcagaacggaaccggcctagggctggccatttcgaaaaactttatcgaaaaacaacatggagaaatcggtgtaaaaagtgcacccaatcagggaagtacattctattttgggttgccggtggcttaa

SEQ ID NO: 46998 - DNA, 210 bp, Glycine max
  Peptide Sequence Number=SeqID_163776
atgttttgcaacctacccctcgacgggagggcgaggcaagatggaaatgtgcgccttccaaaaaggagaacacgtgggagtcgccaccaacgtttattcgaggaaaatgttagaaaaaccaaaaagaagcaaaaaagggcacttgatagacttgcagcgcgcccaggcgagctgatgcttcactctgaagtaaatggctcgcccaggtga

SEQ ID NO: 46999 - DNA, 315 bp, Glycine max
  Peptide Sequence Number=SeqID_163777
atggttgccatacacgtgaaagcatctcgagttggtatcaaagctcaacctcttcaatggttgagctccaaaaagagcaaaggaaaattgatcctaaggaagatggaaagcataggacaaactatgaatagatcgacactcttcaatgagaatggaaactacattccagatgatgacaacctcaaagagcttccaagaaagagatggacggatgagcaaatagagatacttactgaagtcaaaagcaaggaatgtcatcatcaatgcactatcaaaaaaggagtatgcaaaggggcactgtatcaaaagtgctaa

SEQ ID NO: 47000 - DNA, 627 bp, Glycine max
  Peptide Sequence Number=SeqID_163778
atggcaagctcggcttcctcgcgaggcattgcagccatcgtcggtgtgggccccaaccttggcctctccatcgctcgcaagttcgctcacgaaggctacacagttgccatcctcgcgcgtgacttggggaggttgtcaagatttgctgacgaaatagcgagggaagagaaggcgcaggtttttgctataagaatagactgttccgattcaagaagcgtgagagaggcatttgaaggagttctctctctggggttcgtggaaattctcgtctacaatgcttaccagccattaccttggtaccccacctccttccaagaccttcgcgttgattccttcgaaaaatccctcgccatttcttccgtcggtgccttccactgcgctcaacaggcattgacggatatgaatttgcatgctgtggggcacagaggaccaatgttgacgacgacgtcatcatcgtcgcagaggagaaattcattgggggagcaaagcagtggagtagtgggaggaggtgagggtactatggacccggactcactcgctcaaaccttctggcacttgcacgttcaggaccgaaacgcttggacccaggagatggatcttcgctcaccctctgctagattcttctag

SEQ ID NO: 47001 - DNA, 369 bp, Glycine max
  Peptide Sequence Number=SeqID_163779
atgcgccatccattagagaataagccatggaacgagaagctttaccaccaagagagtgccttggatatgaagcttagagaggaagcttcaatggaggaaaagaatgagagaaagagagaggggggcgtggaaattgaaggaaaagaaggagagaagttgaactttgaagtgtgtctcacaacccatgggccaaaaatctaccctaagactcatgagaaccctaaagccttctcctacacctctggcctaatcttcttggagttttctatccaatgcccttggggggtaggattgcatcatcccctcccccttgaaaagcatctgacctcaaatccagaggttcttgaaactctggacttcttcccttaa

SEQ ID NO: 47002 - DNA, 882 bp, Glycine max
  Peptide Sequence Number=SeqID_163780
atggttctttccaagaaagctacagacaaaggaaatgtcatagctaaggccattgaggttacttcctcttctttctcaaagaagactattttaaggactcctccacatgctaatggtgtgatgatagggtcaccaaagaagaaggtgatctcccaaaaggagaagcaagggcagaaaagaaggagacttgaaatgattaaaaatgtggtaaggatattctctgcattgttaagaagcaaaaaatcgacaagtttcattgatgtcgaagaacctatttatctaaggtgggttaaagccttctatgctatcgttgttgttgatcagagtaacttcaccattaaggctactctaaagggtattgatattttgatcttagaacatattctagaaatcattttgaagattccaagtcttagaagagacaaggtgatcaagaagttaaaagagttgaaggacaatgagcttaagtccaaggctcttaactcatttggaagattggtttactggatttgcatgcattatgtgcttccgaaagtaggaacatttcaagagatgctaagcaagaacacgtgctttttgaagagaaagaagtttttggagacctttctagagaaagttagaaagatgtttctgaaggtgttcaaaataaagaagagaaggaagaatcctctaagagtgaggaagatgaggatgttcaccattcggagtctttatttgaggttgttcagagtgatgaaggctatcaatatgcttaaagtgaagatagttgctgctgaagaaccagggaaagtttccattgaaaaagagaatactggtgagaagattcatgttggatcagtgaaggactcattgtttaacattgagaatatgcagagatattga

SEQ ID NO: 47003 - DNA, 192 bp, Glycine max
  Peptide Sequence Number=SeqID_163781
atggatgttagttggacaggaagcatagaagtagtcacatgggaagttctacttatgttaagtgtgaatgatgagaggagtcgagggcaaggcctcaagcttatattttgttttccaaccaccaccaagtacatgtcattgaagaatcccaagaagatgaataaagataatcctagtgaggagagttgttaa

SEQ ID NO: 47004 - DNA, 1540 bp, Glycine max
  Peptide Sequence Number=SeqID_163782
atggaaggatttgaagtcgaggtattcacaaggggatttgctgggaatttcagaattgtagcaggacatggcatctatcagacaagtgtgtgtgtgtatgatgctcttactagtgttatggagagaaagaaacaagatcaggctatgcaatttcttagagagagacaacttgcaagtaatgatataatgggaaacaccagcctgattaacgcagtcaacaccaactcatctaatttaggaaattcaagcacctactatggaaactcaagaggaagaagaagcaagctatgtacatattgtggttttactgaccacactgtagatgaatgctacaaaaagcatggctatcctcttgcagaaaatttttacaagtctcaaggttcaaacattaacaatatcagtgcagaaaaggaggaaggggatagcttagcccaagaaaggaaacaagaaacacaaaatgacaatgtgaagctaacctttcaacaatataaagctttgatggcactgctacaacaacaaaacacagttcacaacaattcacatgtgaatcaaattggtacaattagcaacaaaggtagtgtactattcattacttgtagcataagcaagaccagtcaagatgagaggagccttgactcaagtgccacagccatgaatgctgagatcaaagcactagagcttaatgatgtcagggttctcactaatcttcctcagcacaaaactacaattggttgtaaatgggcatataagatcaagaacaaatttcatggttccatagagaggtataaagccaggctagtggcaaaatggtatactcaggtggaaggacaagactacccagacactttctctccaatagctaaactaaccatagtgagacttctaccgactttagatgctattaatcaatggcatctccagcagctagatgtgaacaatgttttcttacatggcgatttaaatggagaagtatacatggtcatccctcatggtatgcaagtagctagaccagggcaacatggtagcaacataattgttgttttactggtttatgttgatgacattattcaaagaattacaaatctacttgacagtgctttcaaaatcaaggacttaggagacttaaggtactttctagggtttgaggtagctagaagctctattggtataaatctctataaaagaaagtatgcactggacattcttaatgatgctggcatgcttggttccaagtcaatttctacaccttgtgattacaccaccaagttgcatcaacactcagggtcacctctttcaataaaagatgcttcctcccataggagattaataaggagattgatctatctgaccaactcaagtaacattcacttaaaaggttttagtgattcagattgggctggctaccttgatactaggagatttattactggttatgttgtgtatcttggtgattcattgatttcatggaaatctaagaagcatgctatcatgtccaaaagttcctctgaagctgaatatcgggctttagctagtgccattt

SEQ ID NO: 47005 - DNA, 1101 bp, Glycine max
  Peptide Sequence Number=SeqID_163783
atgggtctctgcacttcaaagcctcgtgcaaaaaacgcaaaccccactaactcttcttctctaaattcccacacccacttcacagaccccaatgccgatgaaaatttacgaaaaaaccacactcccactcccaaaaaatcaccccttttcccgttctacactccgagcccggcccaccaccttttctccggcaagtctccggcgccggcgaatccccgacggttcttcaggccgccgtcgccggcgaagcacatccgggccgtgctggcccggcgccacggctcggtgaagcccaacgaggccaccatcccggaagatgaagtggttactctggacaagaacttcggattctcgaaacagttcgagcacaagtttgaggttggggacgaggttggaagaggacactttggttatacttgtgctgcaaagttgcttaagggtaatctcaaaggccaacacgtcgctgtcaaagtcatccccaaagccaagcttattactcgtcttggtaaatctcctattttggtagactcgccttttctgacatgcatttgtggagggaggtgttgggaagttccacattgccggcctcaagagatgaccactgcaattgcgattgaggatgtgaggagggaggtgaagatattgagggctttgactggacataagaatctgattcagttccatgatgcatatgaggatagtgacaatgtctacatagtaatggagttgtgcgaaggaggagagcttttggacagaatattgtcgagaagtgggaaatacacggaggaagatgcaaaagctgtcatgatacagatattgaatgttgttgcattttgccatctacaaggtgttgtgcatcgtgatcttaaacctgagaatttcttattcacatccaaagatgagaactctttgctgaaggccattgactttggattgtcagattttgttaaaccagatgaaaggcttaatgatatcgttggtagcgcatactatgtggctcctgaagttctgcatagagcttacagcacagaggctgatgtgtggagtgttgccgtccattttgggcgcggactgaatccgggatctttcgtgctgtgttga

SEQ ID NO: 47006 - DNA, 756 bp, Glycine max
  Peptide Sequence Number=SeqID_163784
atgacggaagggtgtggtgaagggttttgccttgcaaaccttcccggtgatgcttttagtctatgggggaacttctttgaggcaaagaaacaaatgatggctgatgccaaggtcggcggtgctgggttatggccccgtgctaagtttcggattggttggccccctcctccccccaaaaaaacagttttgttgccaggattttgccaactttggcttcccccccgttggctaagtctgtgcctcggtggtggatcatcatgtcataacatggcaagacacaaggcacaagggggaggaggggcttggtcgtccgtccgcccgggcacacacctagttagcaccaggcaggcaaaacgagagagagccgacgaacgggggagggacgaatcaaagcgacaagggctgaaatctcagtggatcgtggcagcaaggccactctgccacttacaaataccccgtcgcgtatttaagtcgtctgcaaaaggattctacccgccgctcgatgggaattgcgcttcaaggcgtctcgtagggctaaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 47007 - DNA, 153 bp, Glycine max
  Peptide Sequence Number=SeqID_163785
atgggtcatggagagggggacgaaccactcgatgttggtgatctctatgttgacgtaatcccacgggtaatccaaagagatggaaggagcacacttagcaatgatgaattcatcctctctcccacaaaaggtaaaaatgaagcacatagatga

SEQ ID NO: 47008 - DNA, 402 bp, Glycine max
  Peptide Sequence Number=SeqID_163786
atggctggtttcttctctcttctaagacgcctctatctctccctttacaattggaccgttttgtttggatggtgtcaagttctgtattttgttctcaagacattgaacgaatcgggtcatcaatatgtttacaatgcagcagaaaagcctttgctttatgctcaaaccgctgctgtgttagaggtgagtaatcctttgctcaatatgtcatgcttaatgaagatgaaaattgatgttggagttggattggtgaggtctccagtaacagcaacattgccacagataagttcaaggcttttcctggtttggggcatcttatggagttttcctgagactcggtcccatgtgcttgttacctccctactaatcagctggtccatcacagaggcaagtctttcatga

SEQ ID NO: 47009 - DNA, 3093 bp, Glycine max
  Peptide Sequence Number=SeqID_163787
atggagaaggtttatgaagagctcgatgaagcaaaagcagaaattgaggaactcaaggcacaactaagagccaaaacagattcccttgagaacttgaagaaatcccataatgcacaggtcaatcagatacaggaagcaaggttcaaagctgagaatctgaaccaaaaacttcttcaacaagctgatgaaatctctgaggcaaagctggtttgtgaagatctcaaagggaatctgaataaaaaggagtccatcatcaaacatctcagtgccgcaaatgatagacttctagtggattgtgatgacaagttcaaaaagtgggaagacgaaaaaagagggttggtgttggccttagaagaggcaaatgagaagacacagaaccaggaacaacagattcatcaatacaaacaagagattgaaagaatgaaaggctgtctttcagtttcagagaagaagtgtttggaaacaaagaaaaatttaaaagcatccaaagaactaagagaaagagatgacatgttccaaaagttagaggaggaatgcatgaaggtggaagatcaattaaaatggaagaaggaacagtttaagcatcttgaagaagcacatgaaaaagtccaaaaccagtttaaggctagtaagaaagaatgggagatggaaaaatctacattgcttgatgggatttcttcacttcagaataggttagactctcagatcagaatatcagaggatttacagcatcagttacacacttgccaccaagttcttgctcatgtagaaagccagaaaaagcgtctggaatttgaagtttcaaatcttaaggtgcagcttgataatgctagcaatgagtaccaggatgctaggttacagctagattgcttaaatactcaccgcgacaaagatattgcagatttgagatatttgctaaaaacaaaagaggcatatcataaagaatcaaagtacaggatggagaagctagagcaagaaaatcaagagctgtggatgtccctcaaagaactccaggaagctcaaattcaagaagcaggaacctcatattcacagtcaaagttgcggtccaagctcagaaatttggaacaaactcataaagagtgtgcctctactttaaaggctaaagaagctgaatggaactttaagctaaaacagttgacagcagacctgaatagatgtcggtctgatttggaaattaaaactgaatcagtggaagacctccagatggagttagaaagctctcaatctttagccatagagatgaagttattgaatgaggagatgtctgtgatgttgattgtgttgaaacagggaatttctgaggctcaattgaagcttgcaagccataaagatgagatgaatcttatcaacaaagctagtgaagagaagacttttcaactgatgtggcagttggagatgaaggacgctgctttgatcaatgcccagaaaagcataaatgaagaacgtgagatagcagcacgtttgatgaggcaggttgagtcttctgtatccaacaatgaactgcagcatgcactgcaaaatgaacttgataggcacaaggaaatgctggaggaatcaacaatgagtcagctgatcctcaaagagaaggtttggcagatggaatgtaactttaaagaacagttggagatgaaagatgctgctttgaccagtgcacagaaaagcataaaggaagaacgtgagatagcagcatgtttaaggaggcaggttgagtcttatgcatccaacattgaactgcagcattcactgcaaaatgaagttgatgataggcagaaggaaatgctggaggagtcaacaacgagtcagctgatcctcaaagagaaggttttgcagatggaatgtaactttaaagaacagcttaaagaaatccatgatgctttagacagtgtaatcattgaattggatgaaacaatatgtgaaagaaatgaaaaggaatttgaattgcaaatatggaagtcaattgttgagcgcttgaagaatgatcttgaagaaaatcatgtactgcgtagagaactggaaacttcacttcttgcacaagtagattttggtgaaagcctcaagcaagaaaaagttagcttggtttataagttggaagagaaagagaggagcctagattatctgcagcgacatgttgagctattggaacgtgagctaagagaaaggggagaatcagaggtgtcctctgagtctgataatgtcaggtatctccagatcatagcggagaaggacaagattctagaagagctccagaaagaggttgtttggctggaacaagaatcattcaaaaaagaatttgaaagtgctgtgattgagaaaggcacaatggaaagaacctttgagcatgagaaagattatcttatccagattatgaaaggaaaagacaggagaatggatgaactcatgcagcaggtgacttcactggagcaacagttcactaactcattgaccaccttttcttcacaacttgctgagaaacaggctgaaattaacctcatccgtgatgcttctgacaagatcacagcatctcagattctagctgctcttgaaattaaagagaagaagttgatggtagtggaacttgaggatgatattcatgctatacagcagaaactgaaattgcaggaggaaaagtggagccgatcagagcaacttgcattggatactgaagtagaattggctgcaaaacaggtaaaggcaatggagttgaatgatcaaatggagactactaagctaagaaaaccagatgctttgcttcagaaactacagatggagaatagaaatttacttgatagtgccacgagactgtcatcagaaagggaaaacttgttggcttctgttcaggaattcagtgataaaatctgtgagttctctactgcagacacgatactaatggacaagttgagaagcatggtgcagtcttttgagaatggttgtccagtaatgattttgaaaaaggatgatggtttccttgtaaaagagaatatgttggttcagtctcccacgaggataaagaaacttgaagccaattctgaaactagatcaccattcaaggagctaaatttgctagaagaatag

SEQ ID NO: 47010 - DNA, 897 bp, Glycine max
  Peptide Sequence Number=SeqID_163788
atgtgggcttttaaggcccatgatccagcacttctacaaattagggttttgtcatcaacctcccaccttaagtgccgcagcaactctttttgtttcttcagtttggctaggggattgaagaagcatctcaagaggctcaatgctcctaagcattggatgcttgacaaactgggtggtgcatttgcgcccaaaccctcatctggaccacacaaatctagggagtgccttcccctcatactcatcctacgaaaccggctaaagtatgctctgacttaccgtgaagtcatcgctattctgatgcagagacatgttcttgttgatggaaaagtcaggactgacaagacttaccctgctggtttcatggatgttgtttcaatcccaaaaaccaatgagaacttccgcctgctctatgacactaaaggccgattccgtctccattctgtcagggatgatgaggcaaagttcaagctctgcaaggttaggtcagtgcagtttggccagaaaggtatcccatacctgaacacctatgatggtcgcaccatccgttacccagaccctctcatcagggccaacgacaccattaagctggatctggaggaaaacaagattgttgattttatcaaatttgatgttgggaatgtagttatggtaacaggtgggagaaacagggggcgtgttggagtgatcaagaacagggagaagcataagggtagctttgagacaattcacgtgcaggattccactggacatgaatttgctactcgcatgggcaatgtgttcactattggcaagggcacaaagccatggatatcactgcccaagggtaagggtattaagctatcaatcattgaagaagctaggaaaaggattgccgcccagcaagcaactgctgcttaa

SEQ ID NO: 47011 - DNA, 141 bp, Glycine max
  Peptide Sequence Number=SeqID_163789
atgacggcgaccgatgacggacgacggcggacagcggacaaaacccgctttgataccaacttgaagattgagataaatacaagatacaagagagagagaaggacaactggcagtgacaacacactgttgccttctgaataa

SEQ ID NO: 47012 - DNA, 978 bp, Glycine max
  Peptide Sequence Number=SeqID_163790
atgcagttctgttggtgcttttggtgttgttctctcattagaattgaagcttcactctgggggtacaagcggtttttcagacggtctttgcttgaaacctctgaattcctcaagaatgattgtttgaaaatcaactgtacagttggagttgtggtttcagcaattgattgtccacaacttcactctattaacatcccggaatctgacattggatcacactttggtgcactattggataatatggaaggttcagatattacttttgatgtagctggggataagttccctgctcataagttggtgttggctgccagatccccagaatttcgatctaaattttttaatggtttagatgaagaaaagaatgagattattgtaacagatttagaaccaaaggtttttaagattttcttgttaggtttctttttcttgatagaaaaaggatcttacaggagttcaagtcttcaagaggccatgctgcactttatctacaaagatactcttacagaagaggtggacacggtttcatcaaccacaactagtgactttccggtttctgagatattgacagcaaaattgttagcagcagcagacaagtatgacttggccaatattttaaccttggctgatcattgccatgccacggagttgaaagctgtttgcctaaaatttgctgctcaaaatctagcagctgtcatgagatcagatggatttgagcatatgaaagaaaaaggcccatggctacaatcagagatcctgaagacaattgctgggtgtgagggtgatggttgcagcgcagtggaaaagtctcagagtgtatggggccaactttcagatggcggtgacatgaatggtagaagggtgataatgccgaaaaattggggggtaaaaaagaaaaaggcaaagaagacgaaaaacccttttctcttctgtccaacttttccatattccaatggaaagtttagaaaaagcgggtag

SEQ ID NO: 47013 - DNA, 1194 bp, Glycine max
  Peptide Sequence Number=SeqID_163791
atggaaatccactcagaggaggagaatggcgtagcgaacgagtcacaagcacttgagcagaaggagaagcgaaaggggaagcacgacaagcccaagccatgggacgacgacccaaacatcgaccactggaagatcgagaagttcgacccttcatggaacgacggcggcatgctcgaagtgagctccttctccactctctttcctcagtaccgcgaaaagtacctccaagaagcttggcccatggtcaaatccgctctcaaggaattcggcgttgcttgcgaactcaacctcgttgagggttctatgacagtttcaacaaccagaaagactagggatccctatattatcatcaaagccagggatcttatcaagcttctatcacgaagtcttcctgctcctcaggcgataaaaatacttgacgatgaaatgcaatgtgacatcattaaaatcagtggcatggttcgcaataaggagcgatttgtaaaaagaagacaacatcttgtgggtcccaattcttccaccttgaaggctcttgaaatactcactggctgctacattctcgtccagggaaacacagttgctgctatgggttcattcaaaggcttgaagcaagtcagaagaattgttgaagaatgcatgctgaataaaatgcatcctgtatacaacattaagattttgggtgtagaaatatctcagttctccttttcacattgtcaggttcttatgatgaagaaggaacttgaaaaggacccagcacttgcccaggagaactgggacaggaaaaatgttaagcaaaagaaggttaacactaaacagaagaaaccatacactcctttccctccacctcaacagcccagtaagattgatatacaattagagactggagaatactttttaagtaacaagaggaaatcagcaaagatatggcaagagaagcaggagaagcaggctgaaaaaactgctgaaaacaaaaggaaaagagaagaggcctttatcccacccaaggagcctgcaaacctggtggataaatctgaggatgctaacagtaatgtagctgacatggcaatgtccttaaagaaaaaaacaaagaagtttgggaagcgtaaatctgaagaaaatataaatgccgagacatatattataggatcatcagaacaagcatcgggaaagaaatccaagaagcaaaggtcttaa

SEQ ID NO: 47014 - DNA, 195 bp, Glycine max
  Peptide Sequence Number=SeqID_163792
atgtcttttctaatggcagtggtcctagatgcagggaagaatttctccaagaacaccctcttaaggtcatcccagctggagatggatctgggagcaagggggcttcatgccggaacaaacaatatagaactccttaagatgcttatgaggatcttcacctgcaagaccatgaaacttgggcagcaaatgtattag

SEQ ID NO: 47015 - DNA, 250 bp, Glycine max
  Peptide Sequence Number=SeqID_163793
ccaagaaactgttgggttacaagtgtggggtgaagttccacatcaggcaaaagtgaaaaggtctccttatatggtggctcgtggtccacaggtgtacccctcgaatctccccaacaattggtatcagagccgatggttcaaattggtgaccagctcaaacgaatatgcaagtaccgcaggtagaagtgaaaaggttgagtaccatataagtgaggagaagacccataaacctaagcctcctgagccttaa

SEQ ID NO: 47016 - DNA, 703 bp, Glycine max
  Peptide Sequence Number=SeqID_163794
cccggaggagaaaggaaagagggaggtggaggaggacgatgatgactcatccgagttacacgacttagtggctcacttgggtgaggaagggacaagggagagaagcaaggtgcaaaccttagtgagcttgatgcggaagaggaagacgcgacggaggaagaaggtttcagtgggaactgttgtttggtggaacagacctgcccgcaatgatgaagtgtttctcggtgtccttagcctctttatgggttttccttgctctcttttctctgaggaatggagccaccctgttcactgggaatttgatcaagcaaggaccaatccacatgtgccacgtgctcaacaagtgctgaaggttggagcccaagaacgaagggagcttgtgtttgtgcaagtgcaattagctcagtatgttccagcactggaaagactggctaccatgaggttgctgcagcaggtgtctaatgtgtaccaatctatgaagattgaaaccttatcggggatgatccccttctttgatttctctcaagtggaaaagagtcttgagtctgatggcttaagggatcacttggccaattttgctgaagaattaaataaagcaagacagatgatttatcctcctgataagagatcatcaaaacttggagctttacttccctctttgtcagaggttgtggccaaagaacacaagaggcttcttgcttga

SEQ ID NO: 47017 - DNA, 222 bp, Glycine max
  Peptide Sequence Number=SeqID_163795
atggaaaaagcgttaacgaagaagaaaagagtgagaagcaaaaaaatgggagcagagcctttgtccaagaacgatgttgcacttgcacaaacacaagctcccttcgttcttgggctccaaccttcagcacttgttgagcacgtggcacatgtggattggtccttgcttgatcaaattcccagtgaacagggtggctccattcctatactcgcctccaaataa

SEQ ID NO: 47018 - DNA, 1455 bp, Glycine max
  Peptide Sequence Number=SeqID_163796
atggcgagggcatgtagccctctgaaggcgaggacgtgcaatcctctgatggcgaggacgtgtagtcctctgaaggtaagtatgtgtattcctctgatggcgaggacgtgtagttttctgaagctgaggacgtgtagtcttctgaaggcgagggcgtgtagccctctgaaggcgaggacgtgtgctcttctgatggcatgggtgtgtagtcctatgagggcgagggtgtgtagtcctcttaaggtaaggacgtgtagttctctaaaggcaaggatgtgcagtcctgtgaaggcgaggacgtgtgctccactgatggcgagggcgtgtagtcctatgaaggtgagcacgtctcgtcctatgaaggcgaggccgtgtagccctctaaaggcgaggccgtgtagccctctgaaggtgaggacgtgtagtcctctaaaggcgaggacgtgcaagaggacatgtagtcctctaaaggcgacgacatgcagcactctgaaggcgaggacgtgtagccctctgaaggcgaggacgtgtagtcctctaaaggcgagggcatgcaaccctctgaaggcgaggacgtgtagtcctcaaaaggttaggacgtgtagtcctctgaaggcaaggacgtgcgatggggtgttgccctctgaaagaagggttagggcatgtagacctctaaaggctagggcgtgtatccctctgaaggcgaggacgttcagtcctctgaaggcgaggtcgtgttaccctctaaaggcgaggacgtgcaagaggacatgtagtcctctaaaagcgagggtatgcagccctccgaaggcaaggacgtgtagtcctcttaaggcgagggcatgtagccctctgaaggcgacgacgtgcactcctcagatgacgagggtgtgtagtcctctgaagttgagggcgtgtactcctctgaaggcgagggcgtgtagccctctgaaggcgaggacgtgcaagaggacatgtagtcctctaaaggcgacggcttgcagcactctgaaggcaaggacgtgtagtcctcttaaggtaaggacgtctagtcctctgaaggcaagggcgtttagtcctctgaaggcgaggacgtctagcccacttatggcgagcaggtgcaagatctcatgtagtcctctaaaggcgagggcatgcagccctcttaacgtgaggacgtgtagtcctctgaagttaaggacgtgtagtcctctgaagtcctctgaaggcgagggcgtgttgccctctgaaggaaaggtttgggcgtgtagccctctaaaggctagggcgtgtagcgctctgaaggtgaggatgtgtagtcctctaaaggcgagggcgtgtagccctgtaaaggcgagggcgtatagccctctaaaggcgagggcatattgcccgcagaaggcgagcatgtctagtcctatgaaggcgagggagtctaaccctatgaaggcgagg

SEQ ID NO: 47019 - DNA, 222 bp, Glycine max
  Peptide Sequence Number=SeqID_163797
atgaatccagcagcagaatacgtacaacggctcaaaattgaacgacaggcggtagagacgctctatcaggccttcagcgacaacaaccccgatctggtcgatagcgtgctggcaccgtcatgggaagacattccgctggcgccaggacaagttgccggaccggaaggcatcaagccgatcattcgcatgctggcgcaggcttttccggacgtgcagatcgtg

SEQ ID NO: 47020 - DNA, 915 bp, Glycine max
  Peptide Sequence Number=SeqID_163798
atggattttcatggcatcgatctcaatctgttagtggcttttgacgcgctgatgaacgagcgcaacgtcacgcgggcggcaacccaggtgggcgtcagccagccggcgaatgagtgccgctttgtcgcgattacgcaccctgtttcggtgacccgctgttcatgcgcagcgcggagggttttactgccaaccgcgcgtgcgcgcgatctgtccggccccatcgccggggcgttgcgccagctcgaagcgacgctggtggcaaagcccgcgtttgcagcggaaaaagcgcaaataaatttcaagctgggcgtgtcggaatatccggctttcgtgttgctgccttcgttaatgcaggcgctacaggacgtcgcacccggcgtgtcattgaatgtgcaggcgtttaccaaccgcgatcatgcggtcgatttgttagatgccggcgcgattgatgtcgccatcggcgtcattcctacgcacagcgatagccgcatcatctcccggccggtattgcgcgacgaattcgtcaccatcgtcgccagcaaccatccggcggccagacgcggcatggacatggagagctacctggcgctgccacatattctggtctcgccggaaggtgaactgtacggcctggttgatcaggtgctggcgcagcagggtaaaaagcgccggctggggctgacggtccagcagatgtttacggtgccgtctatcgtggcgcaaacccacatgacggcgaccgtgatgaagcgcgtggcgctgcatgcgcaggccagtcgccagctggtgctgttccctccaccgctgtcgttgcccgaaatggtgttcaacctgatctggcaccggcgcagcgacgcgcatcccgcccagcagtggttcagagaatttattgaacaacaggcggcgcggctgtag

SEQ ID NO: 47021 - DNA, 243 bp, Glycine max
  Peptide Sequence Number=SeqID_163799
atgctgacatcttcgaaaagggtgcagatgaccacattggcctctgcttgtcaatcgaacttggggtctccgaatgacgaggtgcggataaccgaaaggtgtctccgcatgctaccagactcttgggtcatgatagcaaaaggtggggtggtcgacaaaagcgagacttttgctcctacgtatcctccatttgtgatgaagaactcagacctacgtagttctttcttttgtgagactaaatag

SEQ ID NO: 47022 - DNA, 107 bp, Glycine max
  Peptide Sequence Number=SeqID_163800
gtgttgattttaagatcaaaacgctcaaagtcggtgccaagagattgaaattgacgatttgggatactggtaatatagagtcaaaatcttgtgctttcagttcttaa

SEQ ID NO: 47023 - DNA, 339 bp, Glycine max
  Peptide Sequence Number=SeqID_163801
atgtcgagttctcctttacacaatagtaaagggcaaaaaaaagagttatttggaagaagtgctaaagttgatgtctcgctaagtgagctcaatgcacttagcgagtgtcatccgctaagcgaggcatcaacgcgcttaggaaataggaggaatctggaagggaatctgtcacgcaggcacgcgctcagcacgtcatcagctcactcagcgagtcatttgtcaccttctaggcttaacgcgagtttggcattgagcgaaaattcacttactcgcgctaagcacaagaatggcgctaaacgcgacgtcgaggtcagtgagccctttttaagcatggaatag

SEQ ID NO: 47024 - DNA, 339 bp, Glycine max
  Peptide Sequence Number=SeqID_163802
atggcaggcaaggagtcgacgctccatcttgaggttaagtgtgcctgggggatgtggatacccaacatggtaagaggcatggatcactttataggcatcagaccccgagctttgtccttgactggggttgaggctagagtggaggccttaccattagtagacttcgaggaggaccccgagatcatcaaggaggactccaagatggaggaggatctaaaggaggacgcaaaaccaatggaggaatctatggttcttcctagggatccaacttatgggatttcccttgtggcgacttcggacttatactttgtgtatctttcacatatggttgggcgttag

SEQ ID NO: 47025 - DNA, 696 bp, Glycine max
  Peptide Sequence Number=SeqID_163803
atggaacgtgtattggctgatgtacttagagatcaaaggaagttgggcaacaagggtgacgaaggttggaaaaggtcagcattgaatgttgcagccgcagtgttatctacaagcttcaatgttaatgtcacatcagataatgtcaaaaaccgtatcaaattatggatatcgtggtatggtattgtaagtgacatccttggccaaagtggatttgattgggatggcactaagcacatgatcacagttgagaatgaaaatgcttggaatgaatattgcacttcgcataaatcggctaaaccgtttcgatacaaggtgcttcaaaattgggatgatatagtggatttgtgtgctaaagatagagccaccggtcatggagctgaaactgctatggatgctgatgaagcgatgagtagagaaacaaatgaagtggaattcatggggttaggtgctactgccatagatttagaagaaccaaactctaatacaaaaggaaaaagacaaggttcgacttcttctggcacacatcctcacaagagaaagatgggagaaaaagaaggaataacaacttctttggataaaatggcgaactcttttaaccgaatggtggaaaaaatggatggtaaagttgatgatgaagatattcaagaagtattacgtgaggcagctttgataccagatcttaatagacaacaatga

SEQ ID NO: 47026 - DNA, 321 bp, Glycine max
  Peptide Sequence Number=SeqID_163804
atgaaagactgcaaaaacacaagtggtgaggatgtctccttcacctctaggatctcacaatcactcacaaactcatctcaagttctcagaatggcttccgcttcgaattcgcatctctgcagatcttcacacaataaaatctctcagaactctttggaacttggacctttctctctctataacttcctaaacatgcaaaagcttcaagccagggctagactcttgtgcatgcagaggctttttcaagaaaaattccaaactccatttgcaaatctgatttcaggcttaaataggtggccttgttcgtgctcgtgcgcttag

SEQ ID NO: 47027 - DNA, 382 bp, Glycine max
  Peptide Sequence Number=SeqID_163805
ggccctagggtttccagcattgatcacgggcctcaaccagtcattcggggttcccgtcacacctagtaaggtgatccgaccgccgatcacccgggccttcattgagaagtattgcacgcctaggcaggcgcagggtgatgcacctcaggccgcaaacgcaccgccaccaccccatcaggttgatcccgctgggcggccaaccaccgggggcaggtgcagatacatgagtgtctctaccagcttagcctcagtcagtagggacagagtttcgctccttttgcgtgctctgctccagatcaatttagggctgaggtcgcatggcccgaggattggcccgaggcctaggcagaggaggtgcctacaaaagctcccagcgatgtag

SEQ ID NO: 47028 - DNA, 360 bp, Glycine max
  Peptide Sequence Number=SeqID_163806
atgatgaaggatgcgatccacggtcacaactttgtagcgcccgggctctactttctcactccttccttgttgtgtgcttcttctggtttccccactgcttctatacttcttgagccttcctttgcatggctttttatagaaaaaggaaagaaagtcccagacaaactcgttcaggcgagttgcactcacccacatgctaacattttaatcccaaaaataactaaaatatggcacttatcatgtatgtgtccattgatgcacatgacacgaaggctacacatgcaatgtaacaacaacactcaagagaattggatagagattaaggaaccattggttctattgccttctatgagaagatga

SEQ ID NO: 47029 - DNA, 198 bp, Glycine max
  Peptide Sequence Number=SeqID_163807
atggaacctttgatggaggacattgaggctaggaacgtcgaaaccaaaagagcggatgccagaagaggagacatcaagccatcgaggctgagaggagacatcgaaagaggacaacgagttttcgaggtgattgggaagggatctgagtctgagaggtcagagagtagagtgagatgcagcacaagcaatgcagtgtga

SEQ ID NO: 47030 - DNA, 891 bp, Glycine max
  Peptide Sequence Number=SeqID_163808
atgtcaataagatttgtgttgagtaacctgattgcaaaagcagtgtggacagcaaggtcaatgtctggagctaacaagaagatgattgaggcactaattgctaggaagaaggaagagtatctgaaggaagagttctactcaggggttgttgccggagctagggaagcgttgttatgtggtgtaccggcattatcaatatcattaaatttgaagaaggatgaaagtcaggaaaacgatttcaaggatgatgtatcagtctgtttaccattaataaacacagctattagggatgttgaaaagggaacttttcccaaaagctgccttttaaatgtagaatttccgacatctcttttgagtaacaagggcttcaaattaaccaagcaaagtatgtggagatccactccaaactggctagctgtttccaccagccgttatccaactggtcatttcttggccaatcaaggtggccttggtcttcagtttgcacagcttggcccagatgcttctgcagctaagaagaatttggagattattgaatcaatgggagctgcagggaaatctgatcccaacaaggtgaataagtatttcaaactagaggaggaagaagtagacgaagatctggattacagagcacttgaaagtggatatgtcgcagtgactccgctgtctatttctcctcatattgagactgttattcaaatgacaagtaaatttgaaagcatgaataagctgcaaaaccaattggagaaagtggagtctcttactcaagatcttgaagaagggcttgagtttctatttaggcatttaataaacactaggggcattgttagatcttgtggttgtcctataaattctagtgcagatcctgtggcaacaacagaaggagagtaa

SEQ ID NO: 47031 - DNA, 132 bp, Glycine max
  Peptide Sequence Number=SeqID_163809
atggagttgaacatctctcatagaagcaaacaagaaattttatcaacttccagcctcacacgccctgatctcttccataatgcacttaatgaaatcattcagcggatgaaaacatatacaagaaccctatga

SEQ ID NO: 47032 - DNA, 426 bp, Glycine max
  Peptide Sequence Number=SeqID_163810
atggcaaagagagacagaaagacagagagagagcagcatattcatcaattgactacaactctaatatacacaattgaccaaaagactcaagcaattgaccacaggaacaaaagcagcaaagtaggtagccttactgaagttattgctatcctagcaattacatcaaaacattcaaacattgcagcaacaccagcaatcaatgcattgcagttcacacactacctagcggaggagtgtatagggttttcttcgagccacagttccaagagcagtgtagggggttccgtgggttcgagcgaggggtttccggcagtattgaaaacaatgtgggacaatgtgagtgtcgagggagcggtttccggcagatttcaggcgggaggagaaagagaagagcaatttcaagcaggaggagaaagagaagagtga

SEQ ID NO: 47033 - DNA, 945 bp, Glycine max
  Peptide Sequence Number=SeqID_163811
atgacatgcagagacaaatttatggtcattccgcacacctttttgccattcagacacagttgtgtccgatggcacgcagagacaaattatggtcattctgcgcccttttgtcatccagaggcagcgggcccgatgacatgtggagacaaattatggtcattccgcacaccttttttccattcagacaaagttgtgtccgatggcacgcagagacaaattatggtcattttgcgcccttttatcatccagaggcggcgggcccgattacatgcggagacaaattatggtcattccgcgcacccttttgccattcagacacagttgtgtccgatggcacgtagagaaaaattatggtcattctgcacccttttgtcctccagaggtggcgggcccgatgacgtgcggagacaaattatggtcaatccgcgcaccctttttgcctttcagacacagttgtgtccgatggcacgcagagacaaattatggtcattctgcacccttttgtcatccagaggcggcgggcccgatgacatgcggagacaaattatggtcattccgcgcaccctttttgtcattcagacaaagttgtgtccgatggcacgcagagacaaattatggtcattctgcacccttttgtcatccagaggcggcgggcccgatgacgtgcggagacaaattatggtcattccgcgcaccctttttgccattcagacacagttgtgtctgatggcacgcagagacaaattatggtcattctgcacccttttgtcatccagaggcggcgggcccgatgacatgcggagacaaattatggtcattccgcgcaccctttttgccattcagacacagttgtgtccgatggcacgcagagacaaattatggtcattctgcacccttttgtcatccagaggcggcgggcccgatgacgtgcggagacaaattatg

SEQ ID NO: 47034 - DNA, 174 bp, Glycine max
  Peptide Sequence Number=SeqID_163812
atggcggaaatcaaccaaggtaagaggatgaccggtcacgattgcccgcgtattgtttgtctcctacttgcaggctttaggcctatggtgtattctgaagcaatggggcatgccacattgccctcattctcttgcaatttatgtctaaacatgcgcccaccaagtgctcggtga

SEQ ID NO: 47035 - DNA, 1344 bp, Glycine max
  Peptide Sequence Number=SeqID_163813
atgccttgtgcattccctagtggcagtggatttggacgtctccaacaactcctttatgacattttaagattagaaagagtggagctccaaaacttgtgcagaataaccattcacaattgcggaaaaaccattcggattgtgccagatgttactgatcaagtagaaggcctacatgttgctcaagaggaaggccaacaaaataactccttcgtaggaaggttctgtgatatggctttgaattttccgcctgtaaagctcttgggtcgattgctcatattcctttatctgttatttcaaaattatatacttttgaagttctcttctggaataagcgaaatatatgaacagaaaaagacccaccgtctagttcttgaaatactgaattgcttgtgccaaagaatttcggaatataaggaatcgcagctgcgagaggcttcagcgtacgacgcgatgttgcaggcagcgaagcttggaatcattgagttcatagatgaaatgaggaagacaactcctgatctcttatgggccattgataaaaacaagagaggcatattcgcgcatgcaattctcaatcgtagaaaagatgtcttccgactcttaaaccgtgtcaatggacggaaggagatcatcagatgtagcgcagacgtctttggcaatacccttttgcacttggcaggatatttagggccttcctctgatcttgatcgaagatccggtgctgctctccaaatgcaaagagaactccaatggttcaaggttgttgagaaaattgtgcatcccaagtgtaaggaagagaaaaattcagatggtaagaagccccgcgagctgttcagtgaaagccacctggagatggtgaaagctggtgagaaatgggcaaaagacacagctggttctttcactcttgtgggtactctcatcactaccatcatgttcgctgcggctttcactgtccccggtggaaaccatcaagaaactggagcacccatcttcttacacgatcacatattcactttgtttatcatagcagatgcaatatctctctttacttcttccacttcagttctgatcttcattgggatcctcacgtcgcgttatgctgagaaggatttcctcaagacactgccgttgaagttactttgtggccttgtgacccttttcttgtcagtggtggcaatgatggtagcattttgtgcttcgcttgctatgatgctgaagggatatcaacgactcataatagcagccatgtcacttgcgagtattccagttattgtactagtgccgtcacagcttcgcctcttccttgagattttcaattctacaatgaatgcaacatatatcaagtga

SEQ ID NO: 47036 - DNA, 246 bp, Glycine max
  Peptide Sequence Number=SeqID_163814
atgcgccggtacagggcgcgtcccattcgccattcaggctgcgcaagtgttgggaagggcgatcggtgcgggcctgttcgctattacgccagctggctaaagggggatgtgctgcacggtcgtggtaaactcgcaaccagtgaattgtgctacgagcgaattcagggcgaaataactatttactgggatgtcggagggtgtccagttagatgttggcacgtgggaaacggaatcgataagctctga

SEQ ID NO: 47037 - DNA, 306 bp, Glycine max
  Peptide Sequence Number=SeqID_163815
atgtcgcaacctacccttcggcgagagagcgacgcgaggctcacgggagcgtcttccaaggaaggaaaatgcgcgaagtcgccaccaatggtgttgaacccttcccttcagcctcccacgcccttttatagccaaaataggggaggaggttgcgcccggctctcccaggcaagctattgcttcctccagaaggttcctgatgggcccaggtggaatgatgcaatcttacccccccaagggcattggatagaagactccaagaagattgggccaaagatgcaagagaaggccctagggttctcatga

SEQ ID NO: 47038 - DNA, 243 bp, Glycine max
  Peptide Sequence Number=SeqID_163816
atgaagaataaaaaggttgttgtggctggtgtctcgctaagcgaggcttgtgcgcttggcgagaatcattcgctaagtgagacactcagcccgcttagggagttgggagaatctaccaagcatctacgtgctcagcgaatcatcagctcgctcagggagtcgtttgtcttctctcgtgctaagtgcgcccagctcgctcaacagattttcactaactcgtgcttagtgcgaaaatggtgctaa

SEQ ID NO: 47039 - DNA, 699 bp, Glycine max
  Peptide Sequence Number=SeqID_163817
gttgtgatgaagaataagcaaaaaactcggtcactgttaccctggtcccgacgtgagaaaactgaggcactgccaagctctaaatcagataacttggctgaagcttgtggatcatccgagacaagttgtggagtggttgaagagataaaaatctcagactctacgagtgatgagtacgatgaatctaaatcatctagtgaggaatctgataatgatgatgatatagatgaagaggaacaaatcatatctgccgctcagaacgttactactcacactgcctgtgatatctctgaaaatgatctgttgaatgaattgaaggagcttgaactagaggcacaggatgataaccctaaaattaatgctcaggaaaaagaaggagccaagaccaaagacatcactgaagaagagatcaatgatcaggttgttgataccaaagacaaattggatacacatctttatcctccgggaaggatcatgcatattatcccttcaccttcgtctgaaaataattctaattcatcaaaccataatagttctgaagagaaagaggtctacttatatgaaacgcctagacagctatatggcaagctaagactttcaagagggatgataattgatcatctcacgaggaactatctgaaggtgttacaacaattaatcaatcaactagagaaagagaagtcccattatggtggatga

SEQ ID NO: 47040 - DNA, 3276 bp, Glycine max
  Peptide Sequence Number=SeqID_163818
atggcacaaccagagcgcaaatcaatggatgcagctattcttgtggattccatatctgacatcttaaaatgctcactggcaccaccagcaacacgcctctcggcaaaggaccttcaacagtttcaaaaccatctcgaagggatccgtgacatggttcaaaaggcgaacaacaacattaactcccaagattcctatgttcttgcttggttactcgaggtcaaggaagtggtcaacgatttggaggatttgattgaggttctacgtcacaaggagagtgccactgccaatgccacaagatctctcatcaaagccagccaaaacatggcgcatcgcctcaaagtcacgcaccatgtcaagaaagcctctgaggagctcaaacgcttcttaaccgaggcacaaaacttgtccttctccaaagaagcaaggaacatcgagagaaagttgttggatacggtcgccaaatttgagaatactcttgtagctgttggcagagaaaatgttaagaaggagatcataaatcaactcaagcagtttgtgaatagtggaggagacggtgttgttcctgtggttaccattgtgggggttcctggaatagggaaaactaaacttgctcgtctcgtttgtgaggatgagcaagttaaagcccattttggggaacaaatttgggttcatggaaaccgtgaaaccttggacgtggaatccatcgcaacacctgtcgctggaacagttaagaagggaaaccgcttccttcttgtgctggatgatctgagagatgagaacgttgaggaatgtctccacaagttgcggaagagattaacggaagctgttggggcaatactcataaccacacgtagcaatttcgttgccaattacaagattcctggcacggttaagctgtacgctttgcgggggcttaaccaagaggaatcatggtcactgtttcagcagattcgtgaacaaggttcgagcaatcacatcaatgaaagcgttgaaagggagaaagtgaaggaatattgcggtggaggagtccctatgaagataataaccatagcaaggttactaaattgtagtgaatcaccactttccgaagcagtgttgaaggaggagtttctacaagagctgaagtttacctactaccaccaacttcccatgcatcagaagctatgctatgtttattgttcattgtttcctcaagattatgtgatagacgcggagaaattaattcatctctggatggcggaagggtttctttctcggaacctttgttccgatccgcaagagtttggctgggcgtgtttcaacgactttgttcctttcgttttcgaggagacggggagagacgaatttggtgttgtgaagagctacaagatgaaccgtttaatgcatgaactggcgaggattgttgcatgggacgagaatatcgtagtggattcagatgggaaaagagttcacgagagagtggtgcgagcttcctttgattttgcgttggatgttcagtgcggaattcctgaggctttgttcgagaaagcgaagaaactgaggaccattcttttgctgggaaaaacaaacaaatctcggcttccacatgaggtgaagatggccacgtcaacttgcgataaaatctttgacacgttcaagtgttttcgcgtgttggatctccatgatttggggattaagatggtaccgagctctattggggaactaaagcacttaaggtatctcgatctttcccataatagcatagagaagcttcctagttcaatcaccaagcttgtccacttgcaaacgttgaaactttctcaatgtcatgttctcaaagagttgccgaaggacttggaggatctaagttgcctcatgcatctttacttggaggggtgccttgatctcactcacatgccacgtgggatagggaagctgagttctctacaaacattgtcactttttgtgcctagcaagaaccatcacatgggagaccttaaggatctcaatagcctaagagggaacttggaaattttgcatctggagcgattgaagttgtctgcatctgacgaaaaagataagtatgtgagagataaaaagcaccttaattgtttgactttaagatgggatcacgaggaggaagaggaggaggaggaggagaaagacaaaggcaatgatgttgatcacaaagacggaaaatcactggaatgtcttgagccaaatccaaatctcaaagtgttgtgcgttttggggtattacggtaacatgttttcagattggctttcttcaatgcaatgccttgttaagtttagcttgaatgattgtcccaaatgcgtatttatcccaccacttgatcacctcccacaccttagggttcttgaactaagaaggttggactctcttgaattcattagtgctgatgctaaaggctcctcttcctctacattttttccatcattgaaggaacttacaatctctgattgccctaacctcaaaagctggtggaaaactccaaagtgggaagacgatagaccattctttaattgcatttctaaactgcatgttcaatgctgccctaatctgcattgcatgcctttgtatccttttcttgatgaagagttggtgcttgtggattccagcgtaaagtcaatgagggatacagtgcatgctaaaacatcaaaagacttccttcctctgtctaagttgaagtccatggtaattgagcgcattacacagtctccgccaaagagttggcttaaaaacttcatttcccttgagaaccttctaattcgagattgctctgaattagagtgtctacccgaaggtttcaagtctttgagctcgctgcagcgtctcaccattgaaggatgtccgaaactcgatcttgacgtatccaagactgaatgggagggtctgaaacacctcaaatgtctgacaataagggaaattccaaagctcaagtcccttccatggggtgttgaggatgttacctctttggaagagctcgagctttacgaatgccccgccttaacttttctaccggagagcatggccaagctcacctcgctgtgtaagctagtgatttctgaatgcaaaaacttgggttcacttcccaaaggactagaaatgctcaagtctttgaataccttgaccattacggattgtcccttgttattgccaaggtgtcagcctgaaacgggagatgattggccacaaattggtcatgtcagaaatatcctgctgaagcagaattctcaagcattgagggacttgtggagtcaaggaaggactggttga

SEQ ID NO: 47041 - DNA, 681 bp, Glycine max
  Peptide Sequence Number=SeqID_163819
atgataacgtcgatagtggttaggaaggccgccggaaagcttgaaaagaggccagccgaggcgcccaaaacattgatggacacagttcttacgttagcagaagccataaggttcggttacgccgagacactgggcaaatggcacctcttggacttgccaagagccatcctttactctgtcatggacaagggtaagaaaacagttgcagttgaatgcgctgaaagaagtgactgtgtacaactgaaagaccccgaattattaaaggagttatatgagctcaaaaaatgcttgacacagaccatgcttttcagcaaaaaacgttttcgtgcctttttatttgctgctggatttgtcaaggaggatgtcctcctaaggaagagaagagctcggattctgaagcccgctttcacagttatacttaataaagaatcaaaatgtttgcttgtgttcatccgaggaactcgtagcataaaagacacgctgacagatgcaatcggtgctcccgtttccttcagtcacttcatttgcagtgatggtgagctgaagaagagagacacggtttcaggacatggacaccgtggtatggttgctgcagctcgttggattaaaaagcactgcaccactatattacttgatgctcttcgtcaataccccgatttccaaatcaaggtatggtcatag

SEQ ID NO: 47042 - DNA, 1864 bp, Glycine max
  Peptide Sequence Number=SeqID_163820
gccaccggatatcgacatcgatttcgagcacgagcgccgcgaagaagtgctgcagtacgtgttcaagcgctatggccgcgaacgcgccgccttgactgcggtggcgatcagttaccgtggccgcagcgcgatccgcgacgtggcccgtgcactcggcctgccgatggaccaggtcaacgaactgggcgcggcgatggaccactggggcggccacgtaccactgccggagaccctgcgcgagcgcggctttgatccggaaacaccgctgatgcgacggctgctggcactgaccaccgagctgatcgatttcccgcgccacctgtcgcagcacccgggcggcttcgtgatttcagagcacccgctgtcgacgctggtaccggtggaaaacgcagcgatggccgaccgcaccgtcgtccagtgggacaaggacgatctggatgccaccggcctgatgaaggtcgactgcctggcgctgggcatgctcaccgccatccgtaaatgcctggcgatgctgcagcagcacggcctgcacagtggacgcatggatgcgatccctgccaaggatacgaagacctacgacatgatctgcgccgccgacaccatcggcgtgttccagatcgaatcgcgtgcgcagatggcgatgctgccacgcctgcagccgcgctgcttctacgatctggtgatcgaagtggcgatcgtgcgccccggcccgatccagggtgacatggtgcacccctatctggaacggcggaggatcctgcgcgagcaaggcccggaggcactgaacgacccggacaatccgctctacccaccgcagctggaacgcgtgttcgcgcgtacgctgggcgtgccattgttccaggaacaggtgatgcagctggcagtggaagcagcaggttacacacctggccaagccgatgccctgcgccgctcgatggcggcatggaagcgtcgtggcggcctggaaccgcatcgggagaagttgctggccggcatgttgaagaatggcttcagccgcgactacggcgagcacctgttcgagcagatcaagggcttcggtgattacggtttcccggaaagccatgctgccagcttcgccctgctgacctataacagctgctggctgaagtgccatcatcccgccgcgttcaccgccagcctgatcaacagccagccgctggggttctacagccccgaccagctgctgcaggatgcacgccgccatggcatcggcgtgctgccggtggacgtgcgccacagcgactgggactgcacgctggatttcagcaagggaccggcggcgatccggctcggcctgcgcctgatcgatggctgcaacgaacccgtcgtgcaggccatcatgcgcgaacgtgcgcagcgcccgttcgacgatgtgggcgacctgtgccagcgcaccgcactggatcgccgccagcagggcctgctggccgatgccggtgcactgcgtgggctcagtggccatcgccatcgtgcacgctgggatatctccggcgtggaaaaccggctgccactgttcgaccaggcccgcgccactgccgaagcccgcgtgccgttgcccctgcccagcgcctgggaggacatgcaggccgattatcgcagcaccggcaccacacttggccgccacccgatctcgttcctgcgcgcgcagctgcgcagccgtggctgtctggacgctgcacaactggccgggcatggccatggccgtcgcgtgcgcatcgccggcctggtacgcatgcgccagcgcccgcagaccgccagcggcgtcaccttcctcacgctcgaagatgagaccggcatggtcaacgccgtggtctggcgacacctggccgatcgccagcaccgg

SEQ ID NO: 47043 - DNA, 588 bp, Glycine max
  Peptide Sequence Number=SeqID_163821
atgctcaccttcagagggctacatgccctcaccttcatacgactagacgtcctcgctttcagggggctatatgccctcgcctttagaggactacacgtcctcgccttcagaggactacacatcctcgccatcagagggctacacgccctcgccttccgagggttacacgcctttgccttcaaagggatacacgccctctcctttagaagactacacgtcctcgccttcagagggctacacaccctctccttcagagtgctacacgctctctccttcagaggactaaacgtcctcggcttcagaggactacacgcctcaccttcagagggctgcacgccctcgccttcagaggactacatgtcctcgccctcagaggactatacatccacgccttcgaagggctacatgctctcaccttcacacgactacacgtcctccctttcagatggctacacgccatcgcctttagaggactacacgtcctcgcctttgaaaggctgcacgccctcaccatctgaggactacgcgtcctccctttcagagggctacatgccctcgcctttagaggactacacgtcctcgccttga

SEQ ID NO: 47044 - DNA, 576 bp, Glycine max
  Peptide Sequence Number=SeqID_163822
atgatggccacgcgccgccagtgtcagcagctggctaatggctggcgcggtcagctcagtatcgcggtagattgcatcgtcaaaccgcagcgcacccgccagctggtaaaggatttttaccgccatttccccgatatggagctgatcatcagctacgaagtatttaacggcgtgtgggacgcgctggctgatggtcgtgtcgatgtggcgattggcgccacccaggccattccggtcggcggccgcttcgcctttcaggatatgggcgcgctcaactggcgctgcgtggtgagtccgcagcatgcgctggcccacagtccgcagctggacgacgaaaccctgcgcgcctggccgtcgctggtgctggaagatacgtcgcgcgcgctgccgcgccgcatgacgtggacgctggataaccagcggcggctggtggtgccggagtgggaaaccgggctggattgcctgcaggccggagtccatttccggacagcccgtgttgcgtcagctggtctgagcagcgcgcgtcaccggcgctggcgtggttactggaatatctgggcgatgcggagacgctga

SEQ ID NO: 47045 - DNA, 817 bp, Glycine max
  Peptide Sequence Number=SeqID_163823
atggccaagtttgaccctgagatagtccaagagttctatgctaatgcttggcccacggaggagggagtgcgagacatgcgttcatgggagaggggtcagtggattccctttgacgcagatgccctcagccaattcctgggtgacccgctagtttttgaggaaggccagcagtgtgagttcagccagaggaggaacagggttgacgggttcgatgaggaagccattgcccagctgttgtgcacaccggggcaggattttgcccgaaccgctgcagggaggcgggtgcagatcatgcgcaccatcatgaccactttgacccagacatggatgacactgctgctcagcaatttcttgcctagcgatcacaacttcgatctccctctgcctaagtgccagttggtgtatgccatactgacacggatgagcgcccacgtggcccagtcctacggagttcccgtcactcccagtaaagtaatccgaccgatcacccggcccttcatcgagaagtactgcacgcctaggcaggcgcagggtgatgcacatcaggccgcagacgcactgccaccacctcggcaaaccgatccagctgggtcactgggcgtggagcattatctacagcatttggttcaccagcaggccgccaaccaccgtgggcaggtgcagatacatgagtgtctctaccgattcagcctcagtcagcaggggcagggttccgccttttttgcatgccctactccagagcagtttggggctgaggtcgcatggcctggagactggctcgatgcccaggcaggggaggagcctgcaggatcccccg

SEQ ID NO: 47046 - DNA, 228 bp, Glycine max
  Peptide Sequence Number=SeqID_163824
atgactaaaaatatgaaggcatgtactcagaaactaaagcatttacagagcctatgcgggctgatattagttgttaaggatctggtacaaattcccaccttttccatcagtgtggtttgcttggatggaacattgcctgcttatcatttgcatcggggatatggatcaggagcaaacagctggatcgttaatttagaggtatcacatgaatatgatctttcaaattga

SEQ ID NO: 47047 - DNA, 345 bp, Glycine max
  Peptide Sequence Number=SeqID_163825
atgatcaaccagggaaatgaaagcacaaaattcctgctttgggaccgtgaatgcagtgaattaattggccaatcagctgatgcagttaataagcttaaaattgaagatgatgatgttgatttgaatgcttcaccccaagcacttgataagctgctgggtcatgaacttgctttcaagataaatgtgcaacccaagttcaggaattctgctgttttgaagtgttcagctgactcgagcttgataaatgttgtgatggatatgctagctgatgctgagacatcttcaaaaatggatatcccgatttctgattcgaatcattctgttcaacatgaatctgagttttga

SEQ ID NO: 47048 - DNA, 1315 bp, Glycine max
  Peptide Sequence Number=SeqID_163826
aggactacacatcctcgccttcagagggctgcacgtcctcgccatcagagggctatacgtcttcaccttcagaggactacacgccctcggcatcagaggactacacgtccacgccttaagaggactacacgtcctcgccatcagaggtctacacgtcctcgcctttagaggacttgacgtcatcaccttcagagggctacacgccttctccttcataggtctacacatcctcacctttagagggctacacgccctcaccttcagaggactacacgtcctgaccttcagaggactacatgtcctcgccatcagaggactatatgtcctcacctttagagggctacacgccctcaccttcagaggacttcacgtcctcaccttcaaagggctaaacgccctctcctttaaaagactacacatcttctccattagaggactaaacgtcgtcaccattataggactacacgtcctcaccttgagagggctacacgccctcgccatcagaggactacacgtcctcgccttcagaggacttcacgtcctcgccttcagaggactacacgcccttgccatcagagggcaacacgtcctaacatttagagtattacacgtcctcgcctttagaggacgacacgtcatcgccatcagagggctacacacccttacctttagaggactacacgtcctcgccatcagaggactacacgttctcgccatcagagggctacatgcactcacctttggaggactacatgtcctcgccatcaaaggactacaaatcctcacctttagagggctgcacgccctcaccttcaaaggacttcacaggacttcacatcctcgccttcataggactccacatcctcacctccagagcacttcacttcctcacattcagaggactacacatcctcgccttcagagggctgcacgactacacgccctcggcatcagaggactacacgtccacgccttaagaggactacacgtcctcgccatcagaggtctacacgtcctcgcctttagaggacttgacgtcgtcaccttcagagggctacacgccttctccttcataggtctacacatcctcacctttagagggctacacgccctcaccttcagaggactacacgtcctgaccttcagaggactacacgtcctcaccatcagaggactatatgtcctcgcctttagagggctacacgccctcaccttcagaggactacacgtcctcaccttcgaagggctgcacaccctcgccttcagagggctacacgccctcgccttcagaaggctggacgccctcacttattga

SEQ ID NO: 47049 - DNA, 192 bp, Glycine max
  Peptide Sequence Number=SeqID_163827
atgggaggatattcagccgacaaggacagtgtggatgacactgtttgtgaaaaatatgacattagcaaggagaaatgggccccagttttgttagacccacagagacccctcttgggaggatgtgcggaaaaaggcacaggccatctagaagcaaagcaccgccccccacgtgttgtctcgtgggggttatga

SEQ ID NO: 47050 - DNA, 173 bp, Glycine max
  Peptide Sequence Number=SeqID_163828
ctcatatacctctatatttgtatcccttccttaatacaaccagtaagtccagattatttgagtatttgaggcttaccactcttggagtcattggcgccttagtgaaggtacaacctccttgcacaaacaaattcacttcttcttcccaagaaattgttgatgcctatgggtaa

SEQ ID NO: 47051 - DNA, 243 bp, Glycine max
  Peptide Sequence Number=SeqID_163829
atgaagaagagaacgaaaatgcttggcaacaacaccaccaaaaagatgctgatgcaagtgctccttgttctcaaatcaaaagtgaaggattatattgcaacccctaaaccaaatggctaccagagtcttctgaccactgtgattccatttttgtatgagagaatatttaggctagaagtccagtttctcatgcctgctctatgcaagtttgaagttgagccagttttatttttggggatgtaa

SEQ ID NO: 47052 - DNA, 324 bp, Glycine max
  Peptide Sequence Number=SeqID_163830
atggtggtcatcgtgcccaaggaacacctagttgtctggttttgttcattgcataacaggccatacaactaccttaaggggataattaacagtgctttaaaaggtcttgatgatgctccacaacctaaatcaaaggctccaactaggtggattgttgtcaagtgtaatagacaaaaaggaaccagctattatgtcatgcactggatgaccaccatcattttaggaagtttcaggaataactgggaagcatattttaacgatcctagaccattggagccagagagattaaaggtgcttcggatccagtgggcacagtatctctga

SEQ ID NO: 47053 - DNA, 201 bp, Glycine max
  Peptide Sequence Number=SeqID_163831
atggtccgaactaagaaaacttggcagatgacgtctgagaagatcgattctttggaggagcaggcatcacagggatcgttgatccctcatggacgtcaggatgtcttgactactgccattgggcgaccagaccaccctggtcgtgtccatgctcctggagccggtgtcaccatcaagcaatattttggatcggctccatga

SEQ ID NO: 47054 - DNA, 876 bp, Glycine max
  Peptide Sequence Number=SeqID_163832
atgaaagtctcacaggatacgggaaagaagtgcaaggttagggggtttttggggcagcagcagcttgaggatgcacttataggcatggacttggtgatcatccctgctggtgttccccgcaaacctggaatgacaagagacgatctattcaatataaatgctggaattgttaaaacgttgtgtgaagcaattgcaaagtgctgtcctaaagccattgtcaacttcataagcaatccagttaactccacggtcccaattgaagccgaagttttcaaaagtgctggtacttatgatcccaagagacttttgggagtcactatgcttagtgttgttagagccaatacgtttgtggcagaagttctaggtgttgatccaagggatgtggatgtcccagttgttggaggacatgctggaatcacaattttacctcttctttctcagattaaacctccttgctctttcaccccaaaagaaattgagtacctgactgatcgcatacaaaatggtggaactgaagttgttgaggccaaagctggagctggttctgcaacactatcaatggcatatgctgctgttaaatttgcagatgcatgccttcatgccctgagaggagatgctggcatcattgaatgtgcatatgttgcttcacaggtggctgaactcccgttctttgcatcaaaagtacggcttggccgaggtggggttgaggaaattcttcctcttggtcccctgaatgattgtgagagagtttatctagtgcttttatttcaacagggagagtttggaaaagccaagaaagagttagcagcaagcattgagaagggtatttctttcatcagaaaatcagtagttgatgacagttcgtcccgaaaataa

SEQ ID NO: 47055 - DNA, 153 bp, Glycine max
  Peptide Sequence Number=SeqID_163833
atgagtgaggttgtgctgaggcaatgtgttgggtgccggccccttgacggggatcggggggcggtaatccataagggtaagctacccggttgtatcccaaatgggggttgctgttgtgccccagtgtgctcctttctcgtcctaccgcgttag

SEQ ID NO: 47056 - DNA, 396 bp, Glycine max
  Peptide Sequence Number=SeqID_163834
atggggctaaagtcagaaatcaatcaaggtaaaacggtagtgcggccacagtttgttgcacgatgtcgtttcctactttcagtaaatattggatgccagatctaccctaagggggttcgagtaagtgaacgccgacccgtgggaagccgtacttatttcttccctaaaaaaatgcaggttagctcgcctgggcgagctgagctcgccggggtgagcaacccctgcacgagggtggttaaaaagggggagggggaagttttctgcacccaaaaactctcccccccccccctcattcaaaaaacgaaagctacgggattcacgagttttgcagccctaagtcaccatttttgtgtttttgcttccatttttgcactcttgctcactctctacaagtaa

SEQ ID NO: 47057 - DNA, 916 bp, Glycine max
  Peptide Sequence Number=SeqID_163835
atggatatcatgtgtaaacaccatggtttcccgaaaagcatcgtctccgatagagacccccttttcttaagttccttctggcgcgaccttttccggttgagtgggacacgcctccgcatgagcaccgcgtatcacccacaaaccgacggccagacggaagtcatgaaccgtgtcttagaacaatacttaagagcttttattcataatcaaccggccgactggtaccgctaccttgcattagtcgaatggagctacaatacctcccttcactccagctccggtctcacccccttcgagatcgtatacggtaaaccacccccatccttgattcactaccttcaaggatcctcaccgaacgaggccgtagattcattgctcacgaaccgccaagagatccatcacaagctacaaagtcgcctcaccaaagctcaagctaacatgaagaaattagctgacacaaaacggcgcgatctcgagtttgctatcggccaatgggtctacatcaaactacgacctttccgtcaacgctccatcaccggggttctgcatccgaagctatccaaaaggtattttggaccttttcaaatagaagaacgcattggcaaagtctcatatcgtctccggctaccggacgaggcccgtatacacccagtcttccacgtttcacttttacgggagcatcacggccctcctccgccacccaccgacgtttccccactgacttttatttcccagaaacccgttcctcgacccctctgcgtcctaagctcaaaatgggaccactctacatcccctcccacacgcttggttttaatccaatgggaaggtcaaccacccgaagacacgacgtgggaagagtggccacaggtttgcgacctttaccaccttgaggacaaggtggtgttcgggggcggag

SEQ ID NO: 47058 - DNA, 351 bp, Glycine max
  Peptide Sequence Number=SeqID_163836
atgctggcaatgatactcagcgaattagaaaagctttacttcattgtccagagtagcagctttttgcccttcggcaatagcaaaactgatgtcactattattgctcagatgaacaaggaaaactgcatgacagcaaaggatctcctaggaaggttgcgacaggctttggatgttgatatatatgaagcattaaagctgcatagtttggcgggtcatatcgtgatgatgttgggtagttgtgccagcaatgtttgggttcacagggttgacagtgatattgggtggatgatagcaatagaagtgacagcagtagtcatcaaacgaacccaagcaccagacccaaatgcgtag

SEQ ID NO: 47059 - DNA, 1032 bp, Glycine max
  Peptide Sequence Number=SeqID_163837
atggccctacgccgcgagaaagggctatgttataattgcgatgagaaatggagttcttctcatcgctgtaaagggcgcgtacttctattcatagccgatgaatccgacgagcttacaccagaaccttctccactagacatggaatctcctacatccctgaccatagaccctgacaccaaccaaccccatataagcctccacgccctctccggccttccctcctcagaaaccttccgcctaaccggcaccattaaccactctaacctcaccattctcatagatagtgggagtacccacaatttccttcagccccgcatagcccaattcctgcgtttacaccctcaatctacaagcccacttcacgttttggttggtaacggctcagtcttagactgtaaccagatgtgcccagatactccactcaccctccaagatcaccagttcacggtgacatttcacctacttccaatcagtggcgcggacgcagtcttaggaattgactggttacggcaacttgggccgataaccactgactacacctcgctttctatgaagttcacctacatgggccgtccagtcgagctccacgcagatatttcaaatgggcctcattcggtttcagcaacccaggtaaaacggttaatccataccgggtcagcttcggccctattccacttaagcattttacccactcaaccggacccacaaacctttcttcctcacccgatacctgcaatagagggccttctaacccagttccagaaactgttccaaaacccatcatcccttccgccaccgcgccatacagtccaccgtatcaacctcatcccaaacacaacccccataaacgtacgcccctaccgatatccacacttccaaaaatccgaaatagaaaagcaagtcacggagctcttatcatccggtctaatccagcctagcaccagcccatattcttcaccagttcttttagtgaagaaaaaagacggaacctggagaatgtgtgtggattaccgtgcgctcaacacggccact

SEQ ID NO: 47060 - DNA, 629 bp, Glycine max
  Peptide Sequence Number=SeqID_163838
atggaaattgcgtacaactactacttgcctgaacttgaaattgaggatccaaccttctttgatcaataccagatggattcatttgcttgtccacttgatgactttgactttgagtctttctccggttcccctgagagcaactcctcatatcatttcaactccgaaagcacaccaaattgtttcccagctgaaagtcatgatcagtcttttacccctgcaagaccaaccaagaggctcaagaacacttgtgccagtgacttcatttcccacaaggtttctgctttttcatcctcccaacttatttcctttgggcacttcaatgccccgtcaccatcacatgcttcccagcaatttcaaaacctggacttcgatgagaaagcgtctagtgagaacatggattttgcagctttcgtttctcagggttcgtatgaggacaaaagtttcctaagttctgataatagaacgaaccaggttggcataaccactaggaacccaatccaagctcaagagcacataatagctgaaagaaaacgaagggaaaatatcagcaagaggttcatcgctctttccgctatcctccctggcctcaagaagatggacaaggcttctgtgttgggagatgctgtcaa

SEQ ID NO: 47061 - DNA, 201 bp, Glycine max
  Peptide Sequence Number=SeqID_163839
atgggtgcagaaacagaatttaatgatggtgatgagggggggcggtgtaaatatctaaaacctctgatttttcttctaggcccatacgtgctccaggttaatcccttgaatggaatcacttacactgttgagacgctgagacgggcttggactcaccggtgtccaatgggtattgttacgtgcacccagagaaattactga

SEQ ID NO: 47062 - DNA, 123 bp, Glycine max
  Peptide Sequence Number=SeqID_163840
atggccattgacccgttgtggttgatgctgacagtgataattgtcgcatatcctattatccttagctcgttcccactcccatcaaactggaaaatgcagctcccacaccttttgatggggtga

SEQ ID NO: 47063 - DNA, 682 bp, Glycine max
  Peptide Sequence Number=SeqID_163841
caaagactcttcttcagcttctcaaacggaacactctagcaccgtgagcaattcctcggaagatgataaagtctttggtgagagaccagccaaaacactcaagattggcacttcaaactcttctaacacggagtttctctcacagaagaaggattcttctccctcctacattattttctctgacaatgtgaatcaattgcaagcaccaacgttgaagccaaaaggcaaggttgcgtgtcacgggagaaaggggtccttggaaaaccagaactttggctctgtgtccagatctccccaccacgctaaagatcacataattgctgagagaatgaggagagaaaagattagccagcagttcgtagctctttcagcccttattccagacctcaagaagggtgcagatggacaaagcctcggtgcttggggatgctataaagcacgtgaaacagctccaggagcaagtgaagctactggaagagaagaacaaaaggaagcgggtagtggaatccgtgttgaggcaagagtgttagagaagcacgtgctgattcgaatccactgcgggaaacaaaagggtctgttcatcaacatactcaaagatatagagaatcttcacctatcggtgatcaatagcagtattttgcttttcggaacctccaaattggacataactatcgtagcagag

SEQ ID NO: 47064 - DNA, 171 bp, Glycine max
  Peptide Sequence Number=SeqID_163842
atggcacatgagtgggttgggtggagtagaaatcttcaattgccattgttgtgcgttgaagcgaaggaccatcaagaagagtctaggatgcaagggaaaagcctttgcgtctcgcttggtttgggatatggaaagtcatgcatggctcttgtgcaaggtgcacccgggtaa

SEQ ID NO: 47065 - DNA, 492 bp, Glycine max
  Peptide Sequence Number=SeqID_163843
atgaacaatgagaatgtgaacttggatttcaacttgaatgtagtcctagaaatagagaacgaaaatgaaggtccattattgaatagtgatgccaataatgtacaatcaaaatccttaaattctattgatttgaatattatacccataagtggtgatggagcaaattctcaacaacctatcagtggtgcgggaaatcaatctcagctgccgaacttaaatgatcttccaagtgttgaaatggactttgatatgagtgttgacaaggaagaagatggtatggctgacgacactgaagatgcagcttacacgggggaaaccggagaaacattgcccaagaagaccaaaaattatggaaggaaaaggattggattggatattgaaagaattcgtgagattcctctttcaaagcggactactttaaggtttctatcgcatgcattggagattaacaaaacatcactcattagattccataaggatggaattatatga

SEQ ID NO: 47066 - DNA, 1134 bp, Glycine max
  Peptide Sequence Number=SeqID_163844
atggagaataataacacatcgatggacgcatcagaagccagctggttatctgatttggaaacggaggatggttgcaacttgttccgacaatgtcaccttgagacgttgctcgacgatgatgaagagttgctttcgcatgagatagcaagtgcctttgagaacttgcagcaacctttgtcttcggagagtaacacttcgtattcggaggctccgatgaactcattcacggaagaaacaagttttgagaagcccatcaagcagcccaaaacgaatgcctctagttggaactcatcgttcactaagcatttttcgttatcttcatccccttcttctccaacctccaagatcctgtctttcgagaactcaaactcgtcccctcccaatcccaacaacaccgatcagtttcatggtattgttgtttcttctgccttaagcccaaagcagatcaagaccaaaggtgcttcagtttcactcccacatacccggaaacgtttatcagaaaaccagaactttgaagctgaaagccccaaaggccatagaagctacaagtccccatctcacgttcgggatcacatcatcgccgagagaaaacgaagagagaagctcagccagagcttaatcgctctagcagctcttattcctggcttaaagaagatggacaaggcatcagtgctgggagatgctataaagtacgtgaaagagctccaagagcgtatgagaatgcttgaagaagaggacaagaatagagatgtggagtctgtggtgatggtgaagaaacaacggctgagctgctgcgacgatggttcagcttcacatgaagatgaagaaaacagtgaaagactcccccgcgtggaagcgagagtgttagagaaggacgtgctccttcggatccactgccaaaagcaaaaggggcttttgctcaacatacttgtcgagattcaaaaccttcatctcttcgttgtcaatagcagtgtcctacctttcggggattccgtacttgacataaccattgttgctcagatgggaaccggctacaatttgaccataaatgatcttgatggtctggtggtgggtggtaatattaataatgatattttcatgttttgtggtgtgcagatacccaaaaatgattga

SEQ ID NO: 47067 - DNA, 1047 bp, Glycine max
  Peptide Sequence Number=SeqID_163845
atgcatcctgatgagcagtcagaactagaagcaaactggaagttcgtgaagattggacatgtcaagagtgcatgccgagggaaggaaagatctaatggtgaaacttcatttcctggacatagattactggtaagcaatgacaacactcacaaagacccaaactttccaaatggaacgaagaaaaatgagagccagcaaggtgaacagcatagaaaagctggtacatccaccagcatgtttgaattatggacggatcctgattttgatggaatggcctacttccaaatggaaagaagaaaaatgagagccagcaagatacacaacattgagggtattgcaaggacttgggatgcgattcaagctcacttatcgaatcgtgcatcagccgaagttcttgaagtggcgaatacgaataggctttctgagattattatactggaggaactacctcgattgaggacttggccatctcaatttatgagaagtcaagtcactgaagataatattgctcagtacttttttgcacatgactctgatagctatatatattatgaacaattggtgaattacatgatgaataatgacttggctctgaaaggacatttggatggggttgagcttttaatttttccatctaacattctgcctgagaatttccagtgtaaagatggaatggcatgtttttcctttggggtgtattcagaggacaaaaggcgaataactcagcaagtacacccagtgtcaaattctctcaagctaaaaaatggagatgacatggcaatagttgatgaaattcctgaatttgaatcttcaggagacacagttttggcggttggagagaattccgatagtaaaggaggagtggcaaatgcagagcatgcagttgtagatattaataatgtttcactttggcctaaaagtgaaacccaagaaaatggttctgttgggattgaggagtctcttgtaccaccttcaactccagattcagaccggttgcaagctgtggctgctttgtttttgctcgctgagggtcacatggagttttga

SEQ ID NO: 47068 - DNA, 225 bp, Glycine max
  Peptide Sequence Number=SeqID_163846
atgcctactcaccatccaaaggccaagaatctcctcaccttctttggctcttcccaaccttcatccaaaccagcttctccccccataggcaagaaagaagttgttgtcttgactaaggcaaagaagaagtcattggcagaatctaggaagaagaccaagattgacaagactcttgagagaaaggatgctagacaagaagaagttgacatcatttcctttgtgtaa

SEQ ID NO: 47069 - DNA, 192 bp, Glycine max
  Peptide Sequence Number=SeqID_163847
atgtttatatataaagagaaggagaaaggggagagagaaataacctcgagaaggagagagagaactttggagtctggaaggtttcaaaaagatgggatgggttttgtgatcataaacctcgtgcatggtgcaagtagtgggaccaaaggtgaaagaaaggttgaagtgaacaaacctagctcatttcgttga

SEQ ID NO: 47070 - DNA, 219 bp, Glycine max
  Peptide Sequence Number=SeqID_163848
atggagacttggacgaataaggataatactagcaacggtgatagctgggaacctccacaaccaggaacattaaagtgcaatgtagatgctagttcagagaggttctcaacattactggaatgggcacttgcatatatgagagatgagaaggccagagttattgtggtaaggacaaatttcatgaagccttgtcagtcagttattcaaggtgaggcttag

SEQ ID NO: 47071 - DNA, 225 bp, Glycine max
  Peptide Sequence Number=SeqID_163849
atgtatggcgccaccaccagtgacgctttcgctagggacgtgccacgtggcgctagtgtcgccattcccaccagcgttgtgccttttgtctacgtggcgttggaaacgccaacactaatggcgagttggtcatggctcagtcaaatgcgaggccctagggttgcagcgttgcagagagcagcaggtcagggttgcagcgacgcaggggcagtaggtcaggggtga

SEQ ID NO: 47072 - DNA, 210 bp, Glycine max
  Peptide Sequence Number=SeqID_163850
atgatgtggcctgatggatttggagtcttgcagttctttaatcaaggttggatccttcccaatcataactcaaacatggtggttttgatccccaagattcctggtatagagatcattaaagatttccgtctcatagcattggaaaatttccaatttaagatcatcactaaggtattgggagatagattggcagagatagctcctaattaa

SEQ ID NO: 47073 - DNA, 636 bp, Glycine max
  Peptide Sequence Number=SeqID_163851
atggcaaccccgactccgatcgtcccatggagttttctggttgatgatgtcgacctgggaaagaaggctcatgttgttgcagcgcctgcccccaaatcgcctaagaaggacacattcgtacaagccctaggacatgcgtgcacgatccctcttagtcagttacctgttccctatttgaaattaaaggagatattgcgatcccataagaggagtataaagcagggcttgaggcttgcgaaaacaaccttcatgaaaggattcttttggcaaaaggtgttcctccccccaaggtttctgggttacgtgcaaaacttggaaaactttggcaacccttggggcgttggcacatggttgatggtcatgaggctttttctgcagctaacagaaattcatgcaaattgctgtaacagaattatcactaccaacaaactagtggaatgctgtaacaaactcaggaagattctacaagcacttggagccttcgcgcaattggaactcaaacgaagtcctgcaaatgtcaatcaacaagtacaggttgccaatgctaaggttgatgaaattcaacaaaaaattcaggtgcaaggtctctcagatgagctacatttgttggaaaccaatgctcaagttgaactttaa

SEQ ID NO: 47074 - DNA, 699 bp, Glycine max
  Peptide Sequence Number=SeqID_163852
atggcggcgaacttgttagcaactctgggggatctggagagggactccttcgtgcctcttctctcgaagctgattggtgaatcgaagcacccgccggagcttattccgcaagaggacagagtggtgaagcacgtcttggacattctgttaccgttcagcaccacctccagcggtggccccttgctcgtcaaccacgtcacataccacgccggcagagggaacctcatcatcgagtaccccggcaccgttcccggcaaaatcctctccttcgtcggatgccacatggacgtcgtcaccgtcaatcccaacgactgggatttcgatcccctttcgttgaccgttgacggggataagcttcggggtcgtggaactaccgattgtttgggacacgtggcacttgtcaccgaactcgtgaggaaactcggggaaaccaagtccaatttgaagtcaactattgttgctgtttttatagccaatgaagaaaattctgcgataactggtgttggtgtggatgcactcgtcaaagatggcctcctcaataagctcaaggatggtcctctgtattggattgacacggcggataaacaaccaggcgtagggactggtggtatgataccctggaaacttcacgtcaccgggaggctctttcacagtggattagctcataaagtatgctcttacgttcttcactacaagtag

SEQ ID NO: 47075 - DNA, 322 bp, Glycine max
  Peptide Sequence Number=SeqID_163853
atgattgcggagacagagccctttggcagcaatgaaaatggcgaagaggaggaggaaggggtgattgagatttgtgtccctgaccgtggcagcacacacaacaaaaagggagaagtggatgtcagacggaaggatgccacgactagaggactttgtgtgggaccgatgactggcggccgggagggattcggaggagagtgcgaggtgcttgttaacgggaaggtgggaagttgccatgggaaggggaggcaacgtggtttttgctgttggtggaggcggcgtggtttctgctgttggtggtggcttaacaaggaaaagttgg

SEQ ID NO: 47076 - DNA, 783 bp, Glycine max
  Peptide Sequence Number=SeqID_163854
atggctgcagagattggcctagtctccatgacccagatccaaaacctatcgcaaccccaacaccccaaaacccaacaacaacaacaacctcaaccaaaaaaccctaacagcaccaccaccacctcctcttctacttggatgtggaaccctaggaagcaacaacatcagcagcagcaggtagaagatgatgatgactcttgggaggtcagagcttttgcagaagacacaaggaacatcatgggcaccacatggcctcctaggtcctacacctgcaccttctgcagaagggagtttcgctccgcccaagccctcggcggccacatgaacgtccaccgccgcgaccgcgctcgcctccaccaagctccagtaccctcctcctcctccaaccccatgacctcttctcttcccacttcacccttcatcaatatccctcctcaagaccttgttgcaaatgctggcttgtgcctcctctaccacttgcccaaaagccctagtagtactgcaccacccttcccaccttcccccactactccttctccttccactcttctctctatctcttcttatcctacaaccaactttctgatgcaaacttcctttaattttcccggtgcacccgcaactgggatcaatactactactactactactgtttcctctttgtgctataactctagcaaagtggaacaatccgcaacttcctcctctattgatcataatggccacctcgaagagcttgatctagagctccgcctaggccacaaaccaacaccaacctcataa

SEQ ID NO: 47077 - DNA, 1161 bp, Glycine max
  Peptide Sequence Number=SeqID_163855
atggttacttactctatcttgctacaggtaggtgcaacatctgatctgatgctagcatatctggatttcttccttggtggagatgagaaaagacctgatctgcctcctcgtctttatcaaagatttcccatgtctataatttttgggggagatggaagttacatgagtccattctctcttcatagtgataatattcttactagcatcatgagtcagtctgttccaccaactatatggtatcgattagtggctggtcttaacgctcaactacgattggttcgccgtggacatctaaaaataacttttggccctgttatcagctggcttgatgtatatgcaaaccctaagttggctacgtatggtgtatgtgttgatcttgcatggtttcagcctacagcctctggatattgccaatttggacttgtggtatatgctactgagaatgaaagcatgtcctcatcatgcgaaggttatgatgattcaagaataactgaaaagcagacatgtttactttcaagtcccagaaatccagtgcatcacattagaagcaatgaacacctgatgatgcctagaaggatgtctggtgggatattacatgccaaaagccttagaacacttaaagagaagaaaacttcatactatccgtttgcttttatcatttataatacaaagcccatcggtcatcaggatctagttggtctggttatctctataatactcctgggagattttatcttagtattgctcaccttgcttcagatgtactctctgtcactgttgagcttcttcttagttttatttgtccttcctcttggtgtcctttttccatttccatctggaatcagcgccttgtttagtcaaggacccaggagatcagctgggcttgctcgactgtatgctttgtggaatctaatgtccctagtcaacgttgtagttgccttcttttgtggatttatacattatacagctcgttcacataagctttccaactttcaatcctggaattttagtatggatgaaagtgaatggtggatacttccttctggtctggccctctgcaaaatcattcaagcgcgtcttgttgattgtcatgtggctaaccaggaaatacaagatccctcattgtatagcagtgacactaacgtcttctggaattcttga

SEQ ID NO: 47078 - DNA, 432 bp, Glycine max
  Peptide Sequence Number=SeqID_163856
atggggatgagattgatgttaatggtgaacaagcaaggtcagactcgacttgcacagtattatgagcacctcatcatccaagaaagccaagcccttgaaggcaaaatccttcataaatgcctcgcccgtaatgacaaccagtgttcatttgttgagcaccgcaactacgggattgtgtatagacgctatgcatctgtgtttttcttggttggagttgatgttgacgagagcgagcttgctattttggaatttatccatcttttagtcgaaacaatggatcgacaccctggcaatgtgtgtgtagctagatatgatgtttcatttagaaaaagtacattttatgctggaggaaatggtcatgaatggttgcattgtggagacaagcaaagcaaatattctgtctccaatcagctgctggataaaacttcttaa

SEQ ID NO: 47079 - DNA, 1734 bp, Glycine max
  Peptide Sequence Number=SeqID_163857
gttggacctggatctgttctaagaggaccgttagaggcttctggtgatgatatgactccacaactctactgtgaagttgaaaattgtcctgtggaattgcttcatccacctgaagattgtaatgtgaattcatcactggctttcactcttcagatatgtcgggttgaagatgttattgttgaaggcaccataactggctctgttgtgcactttcactggattagaaatatagacgtctcttattcaggagtaatcagtgtgtctgggctgggttgtactggtgggttaggtagggcaaggtattttgaaaatggtattggtggtggaggaggacatggaggatatggtggggatggatattacaatggcaatttcattgaaggtggttccacatatggggatgttgatttgccgtgtgaacttggtagtggcagtggaaataatagcctagctggtgcaactgcaggtggtggcatcattgtgatgggttcactggagcactcactgtcaagtttgactttgaatggctcacttagagctgatggagaaagctttggggatgacccaagagggaaggatggtgggattacttcaagcattggtcctggtggtggttccggcggaactgttcttttgtttattcagactttggcacttggtgactcttctataatctcaactgctggaggacaaggtagtcctagcggtggtgggggtggaggtggcggaagggttcacttgcattggtctaatattccagttggagatgaatatgtccctttggcaagtgtaaagggaagcattatcactgggttgttgctccttaaattgacttacaagctagtaggaggatttggtggaggtcagggtcttcctggaaaaaatggatctatcagtggaactgcttgtcccagagggctttatggtatcttttgtgaggaatgccctgttggtacttataaaaatgtcagtgggtctgatagagctctttgtcatgattgcccatctgacaagcttccgcatcgtgccatatatatttctgttcgaggtggtgtggcagagactccttgtccatacaagtgcatatctgatagatatcacatgccaaactgtcatacagcttttgaagagttggtgtacacttttggtgggccatggctctttggtcttctactcttaggtcttcttgtcctgcttgctctagttctcagtgttgcacgaatgaaatatgtggctggcgatgatttaccagctgttacgcctgctcgaaatgacactcgactgaatcactcttttccttttcttgaatcactgaatgagattatggaaacaaacagaagtgaggaatctccgagtcatgtgcacaggttgtatttccagggcccaaatacattcagtgaaccttggcatctacctcattgtcctccagagcaagtaaaagatattgtatatgaagatgccttcaatagatttgtggatgacatcaatagtttagctacttatcactggtgggaagggtctatttacagtatcctttgcatcattgcatatcccctagcttggtcatggcttcaaatgtgtcggagaaagaaattacagaaacttagagaatttgttcgatcagagtatgaccatgcatgcttgcgttcttgccgttcacgagcactttatgaagggctgaagtggcccggtgatagaactggattagaatataggaaagtgcagagtttatag

SEQ ID NO: 47080 - DNA, 561 bp, Glycine max
  Peptide Sequence Number=SeqID_163858
atgcccttctcctcctctcgccgcggaacatcctggtcctcctcgatcctcccatcctcaaacccacacaaatcaaaagcacccagaaagggaagaaaacgcgcgttggtgaaagacttcatcttctccaacttcttcgccattggcctcgtcctctccctctccctcttcctcctcatcctcctccgatccggcgtccccaagccactctccacgcgctttcgcgccaccacgcgcccctcacgctcccgcaaaaccgtcatacgaaagccccttcctaccggagccaatctcagcaccctcgccggcgccgccgtggacgtcaccaccaaggcgctgtacgacaagattgagtttttggacgtcgacggcggcgcgtggaagcaagggtggagtgtgacgtacaggggaaacgagtgggactcggagaagctgaaggtgttcgtggtgccgcactcgcataacgatcctggatggaagctcactgtggacgagtactatgatagacaatcgaggcatatacttgataccattgtgcaaacactatccaaggtcaagtga

SEQ ID NO: 47081 - DNA, 234 bp, Glycine max
  Peptide Sequence Number=SeqID_163859
atgagtgacacacttgaatccttattaactcgttctccaaccaaatttggtctcgaattggaagagtttttttcaaggaatctagaggcccaaagaataaagcacgaaagcgagaaacaaagtaggacaacggaaaaatcattggcccaaaagttaaatttacctcagtcgggtattgacacttctaatgaacgcggacttgcccatatcacttcagaggatcttcttccctga

SEQ ID NO: 47082 - DNA, 753 bp, Glycine max
  Peptide Sequence Number=SeqID_163860
atggctggtttggatttaggcacggcttcacgcttcgtccaaagtctccacagaccagacttcaaccaacaacaagaatccgaggaagacgccaaaccccaagatgggccccagcagggcgacgtggtggggcgccgcccgcgggggcgtcctgcgggctccaagaacaagcccaagccgccggtcatcattacgcgggagagcgccaacgccctccgcgcccacatcctcgaagtcgccagcggctgcgacgtcttcgaaagcgtcgccagctacgcgcgccgccgccagcgcgggatctgtatcctcagcggcagcggaacggtcacgaatgtgagcctgcggcagccggcgtcggcgggcgcggtggccacgcttcacggcaggttcgagatactctccctgacgggatcgttccttcctccgccggctcctccgggggcgacgagtctcagcatatacctcgccggaggacaggggcaggtggtgggtgggagtgtggtaggagagttgacggcggcgggaccggtaattgtgatcgcggcgtcgttcacgaacgtggcttatgaaaggttaccgttggaggaagaagaagaacaggttcagatttctggtgctgctgccaataacaataataatagtaacccctatcatgatccttcttcgggacttcctttcttcaatttgccaatgaatgttcagttgcctgtggatgcctgggcgggaaactcaactacacgttcaccattttga

SEQ ID NO: 47083 - DNA, 1047 bp, Glycine max
  Peptide Sequence Number=SeqID_163861
atgggccgggctgatggtttgactgggagcccaaggcatttgaataacgtgagaaggaagaaaagagtcaaccgaagaagtagcgaaggagagatgtgcacgtgcccgctaagtttcctatttcctcattccaattcaccatttcacttcctctttcccaaaacccccaaaccctattctctttgcaatcaacaactcctctgtgatgactttgcctcctttttaatggctcacactcttcacagacccttttcattctcttttttcatactattattatacttcactttctccttcgcttcgcaccatggattctcgatcctcgattccgatttcgacgcgctctacgccgactacacgcctccgtctcctcctccgcctcctccgctgcctcacccgccctccctcacgtgccaggagggtctcaacgggaccggctccctggccaccacgtgcgatctcaattcgagcctaattttcagcagcgacgtgtacattgaagggagcggaagcttgaacatacttcccggcgtgaatttgagttgccccgtgtccggctgcgtgatttttattaacgtaagtatcgaattcagtttgcagagtggtgcggcgatagttgcagggacggtgctcgtggcttcgcggaatgccaccttgtttggcggttcggtgataaacgtgaccggattggccggggcgccaccggcgcagaccagtgggacgccgtcgggaacgcagggggcgggcggagggcacggcgggagaggtgccacgtgtgtttcggataatacaaagcttccggacgatgtgtggggtggggatgcgtattcttggtcgtcgttggatgagccgtggagttatgggagtaagggtgggacgactagtaaagaggagaagtatggtggggaaggaggtgggagaattaagtttgaagttttggattccattgatgtgtctggggatctcttggcaaatggaggggatggagggatgaagggtggaggaggttctggtggcagcatttttgttaaagctcatagaatgtaa

SEQ ID NO: 47084 - DNA, 312 bp, Glycine max
  Peptide Sequence Number=SeqID_163862
atggaggagaagaggaggcggtggagggggtgtttggagacggtgatgcatggtggagatggtctgcttcatggagtctctggcggcgggggacacgcctttggagatggcggagttgtcgaggggctcgatgcggcggagcatggcggcgatcacggtgaagccgcggtcgaagttgcgggtggagacggcgtcgtcggagaggcaggagggaaggaagccgccgcggcgacgcgtgagggggaggagaacggagggaggtggcgaagttggaagagggggaggcttgggtgggaggaactgaaagagtga

SEQ ID NO: 47085 - DNA, 2743 bp, Glycine max
  Peptide Sequence Number=SeqID_163863
atgcttaccacagggataatccaacccagccatagccccttttcttcacctatcctgctcgtgaagaagaaggacggcacatggcgatgctgcgttgactaccgggctcttaacgcggtgaccgtcaaagatagattccctatgccaactatagatgaactactggatgatctgggccgtgcttcgtggttctcaaagttggatttacgtcaaggctttcatcagatacgaatggctgaggaagatgcgcacaaaacggcattccgaacacaccagggccattacgagttcctcgtgatgcccttcggcttgtgtaacgcgccttccacatttcaagccgccatgaacgatgcccttcaaccttttctccgccgtttcgtcgccgtgttcttcgacgatattttagtatatagccccgatctatcgtcccatgtgtcccatttggaagctgttctatcagcccttgcagatcgtgaatttctattgaagcaatccaagtgttcctttgcacagcgtgagcttaattacctgggccacataatttcctctcagggtgtggccccagatcccgacaagatcgcagcaatgctcgaatggcctctgcccacgtgttccacctctctccgcggattcttgggtttgacgggattctaccgtaaattcgtcaagggctacgccgcaattgcagcccccctcaactctcttcttcgcaaggacaaattcgcatggtcccctgacgcgcaccaagctttccggcaactgcaacaagctatgaccgaaactccggtgctggccaatcccaatttcctcataccctttacgcttgagacggacgcctcgggcacagccatgggtgcagtccttctgcaagaaggtcacccaatcgcatactacagcaaagccctctgccccaggctacaacgagcctccgcctacgtccgggagctccacgccattacctctgcggtgcgtaaatggcgtcactacctgttggggaattcgttcataatcctaacggaccacaagagtttgaaagacctcatgtctcaaacaatccaaacaccggagcagcagacgtacctatgtaaacttctgggctttgattacaccatcaaatacaaaccaggcgcagccaatgtcgtcgccgacgcactctcacgcatcagtcctgcagaggccacatgccttactctaactgctccccatttcctctttttacaaaacctgcgtcaagctctgttactggacccccaatacgtggccctcctccaagatattcgtgatcaccctacgaatcatcccgacattaccactcatcaagacctccttttccgacacggccgcgtttggatcccattcgcaaccccattcactcgggttctattagaagagttccactcgttgcccctcgggggtcataccggagtcacgaagacccttcatcggctccgccagaatttcgattggccccaccttaaggaggacgtccgtcggtatgtggcccaatgcgccacgtgtcaacagacgaagtatgacacgaagaagagtgcagggcttcttcaacctcttcccatcccttctcaggtctgggaagacttatcgctggacttcgtcaccgggcttccgttatcccaggggtacaccgtgatcttggtcgttgttgaccgattttcgaaagcggcccatttcggcgctctacccacccatcacaccgcttacaaggtggcggttttattcctggacatggtatgtcggcaccacggatttccacgcagtttagtgtcggatagagatcctatcttcatcagcaacttctggcgcgagcttttccggttgagcggcaccaagctccggatgagcaccgcctaccacccgcagacggacgggcaaacggaggtgctcaatcgtaccctcgagcaataccttcgtgcttacgttcatgatcagccatcccgatggtaccgcttcctctcacttgccgaatggtcttataacacgactctgcattccagcaccgggatgactccgttcgaggtagtctatggcaaaccaccgcctacggtggcccactatctccaaggtcactcatcgaatgatgttgttgactcgttactcaccacgcgcgtgcaactccacgcccaattgacccgccgtctccaacgggcacaggaactcatgaagaccgccgccgatagacaccgccgcgatttatccttcgagatttcggcgcgcattggcccagtagcctataaactcgcgttaccggcatcctcgcgcatccacccggtcttccacgtatccctcttgaagctccaccaaggcccctccccagcctcaccagggacgctccctgagctctccaccgacaatcatcccattgttaatcctttcgcaattctagattggaaattggactcttcggtcacaccgccggtgaagcgtgtgctggtccagtgggatgatctccctccagaggaggcatcttgggaatcttgggatgagttaaacgttcttcacaaccttgcggacaaggtcgttttcgacgaagggggtgttgataacgcctcgccttgcggccccgtagctttcgtccttgaccttcgaaggattgcggaaccttccagaatccgttataggatgctgcatatccatggattgtttggtgatgccagtttcattgatccggcgtcgttcgacgggttgacgggtgggttacatggcacttccgaagagagtgtttctg

SEQ ID NO: 47086 - DNA, 1032 bp, Glycine max
  Peptide Sequence Number=SeqID_163864
atgtttatctctagatcaattctctttgtgtttgtgttctcagcttgcttgcttctatttccagccaatggaattcgatcatttgccacaacaaatggttatgaaactgaggttgaagaagttgatccttttgtgcaattcagagaggccccagaatacagaaaccagcaaaagtgcactctaattgacacaaccaatgttcaattagtatgtgatccttcacttgttcatgttgccatgaccattgattggcactacttaagagggtccattgctgcagtgcattctgttgtgaaacacacttcctgccctcagaacctgttctttcatttcattgcatcagatgcaagattggagagcaaggatgtgtttgaaaggattgttcacacttccttcccttcattgggattcaaagtttatgtgttcagggaaagtcttgttggcaatctcatatctccttcaattagggaggcacttgacaaccctcttaactatgcaagaagttaccttgctgatttgcttgatcaatgcattgaaagggtcatatacttggactcggatgttgtagtagttgatgatgtccaagagctttggaagtggaaaaggccttgttatttcaacactggggtgatggtgatggacttggtgaggtggagagagggtggctacacaaggaagattgagaagtggatggagattcaaaaggagagaaggatctataagttaggttcactccctccctttttgttggcttttggcggtgatgttgaagccattgaacatagatggaaccaacatggtcttggaggagataatgtgagaaatagttgtaggactttgcatcctggtccagttagtttgttacattggagtggtaaagggaaaccatggactaggcttgatgccaagatgccttgctcagtggactttctttgggcaccttatgatctctatataccccatcaccatacacatcatcaacaccaccaccatcagagaattgctattggctcaacacattcatcattttag

SEQ ID NO: 47087 - DNA, 810 bp, Glycine max
  Peptide Sequence Number=SeqID_163865
atggtgatgtacactctatggaatgcggagtacaggatgtctctgacaaggaacttggatatatcaggttccagggatgaggggtcagattgtgaaacgcgttcagaggttttggaggttaaggatggagcaaaaacagtaggtgatgagaaaattgaggttgttaatgatttggaaagttgcagctgcagtggtaacctgaaagaatttggagatttgcctcctcaggctctgagttacattcagcagttgcagtctgagttgacaagtgtgacagagggtgttatgcaaggaggttccttagtttggattttgagtttttgtattgggtatttgtcgaaaaaagaaaagggaccttggcttaatgggtgtgttattcttagcgcttgtaaaatggttgcttcttatgtctgtgcttgggaactgaatgcccagaagcaggaaatgatgcaattagaatatgacaagggaaaatggaacaatttgttggaatatcttcggtctctggatcctaatatggtgactgaactgtcccggccttcatcattagaagtggaggatataattcaccaacttgttcagaacatattgagaagattctttgtggatgatggtagctctagttttatggaacaatcagtggaaggaaatgtagacaatcgcgcgggcagtggtgatgagcttagtaatacgatagccacttctcgtgattacctagcaaagttgcttttctggtgtatgttattgggtcatcacttgagagggttggaaaatagattgcatctgagctgtgttgttggactattgtag

SEQ ID NO: 47088 - DNA, 506 bp, Glycine max
  Peptide Sequence Number=SeqID_163866
cttacttgcgggatttcgtttagacgcctcgccttgcggccccgtagctttcgtccttgaccttcgaaggattgcggaacctttcagaatccgttataggatgctgaccgtatcaactggtccgacctgcctcccgtcctccgccatgccggagcaccacacacgccaggttaccaccgataaattggaagaagcggtgaaaaccctctcccaggacaactcagctctgaacaacaaaatcgataccattcacgcgtccctcaccgccaagattgacgcacttttcgatcgtttcgccgccatcgccgttaattcccctcagcccctaccgccaacaccagtacattcttcctcttcttcccatcgccatcacatgaaattggaagtaccacgcttcgacggccacgatcccctcggggcattccagagaacgaacggctcaccgtcgcatccttctacatggaaggacccgcgttatcctggtatcagtggatgtgtcgcaacgg

SEQ ID NO: 47089 - DNA, 3054 bp, Glycine max
  Peptide Sequence Number=SeqID_163867
atgtatagtcaagcattcagtttctgtgagaaagttaaggggaagttgagcagttcagatgattaccaaacattcttgaagtgccttcatattttcagcaatggaataattaaaaggaatgatttgcaaaatttggtaactgatttacttggaaagcattcggatcttatggatgaattcaatgatttcttggagcgttgtgaaaatattgatggattccttgctggtgtcatgagtaaaaagtcactgtctactgatgctcatttatcaagatcatcaaagttggaggaaaaagacaaagagcacaagcgtgatttggatggagctaaagagaaggaaagatacagggagaaatacatgggaaaatccattcaagaacttgaccttagtgactgtaaacgttgtactcccagctaccggcttctgcctgcagattatccaattcctacagctagtcagagatctgagcttggtgctcaagtcttgaatgaccattgggtatctgtgacttctggaagtgaggattactctttcaaacatatgcgcagaaatcagtatgaagaaagcttgttcagatgtgaagatgacagatatgagctggacatgttattggagtctgtgagctcagctgctaaaaaagcagaggaattgtataatagcatcaatgaaaataaaatcagtgtggagactctgaaccgtattgaagatcactttactgttctaaatttaaggtgtattgaacgtctatatggtgatcatggtctggacgttatagacatcttgcgtaaaaacccaacccatgccctgcctgtaatattgactcgactgaagcagaagcaagaggagtggagtaagtgtcgttcagatttcaataaagtatgggctgagatttatgctaaaaatcactacaaatcacttgatcatcgtagcttctacttcaaacagcaagattcaaagaacttgagcaccaaatctttggttactgagattaaagaaattaaagaaaagcagcagaaagaggacgatattattcagtctattgcagctggaaataaacagcctctaattccacatctggaatttgaatattctgatgttgggattcatgaagacctgtataaacttgttcgttattcatgtgaagagttattctctagtaaagagttgttaaataaaattatgaggctctggagtaccttcttggagcctatgcttggtgttccttcccaatctcatgggacagaaagggctgaggacagaaaaactggacataatgttcgcaattttggtgcaccaaatgtagggggtgatggaagtccccgggaagatactctttcgataaattcaagggtaccaaaatctgataagaatgaagctgatggtagagtaactgaagtgaagaatgttcactggactactgtggcggcatccaatgataaagaaaatgggtctgttggtggtgaaattgttagtagagatgatccattaatggataaaggacagaaaaatgtagaatgcaatgataaagcctctggatttagcaaacaatttgcctctggtgaagaaggagctaaaaacaatgtatcaattgcaattagaggagaaaacagcctgaacagaactaacttagatgcgtcttcaggctgtgctcttactccatcgcaacctactgatgttgatgactctgtatccaagtctcagggtgttaatgtaccttcggtggagggatgcgacatggcaactccagtaccagtggtcaatggtgttctaagtgagagcagtaaagttaaaactcatgatgaatcagctgggccctgcaaaattgaaaaggaagagggtgaattatcaccaattggtgactctgaggaggataactatgttgcttatggagattcaaatgtgcagtcaatggctaagtcaaagcacaacgttgaaaaaaggaaatatcagtctagaaatggagaggatgaatcttgtcccgaggctggaggtgacaatgatgcagatgctgatgatgaggacagtgaaaatgtttctgaagctggtgaagatgtctcaggcagtgaatctgctggtgatgaatgcttccgtgaagatcatgaagaggaggaagatatagaacatgacgatgttgatggtaaggctgagagtgaaggtgaagctgaggggatttgtgatgcacaggtcggaggagatggcacatctttgccattgtcagagaggttcctttcatccgtgaaacccctcacaaagcatgtatcagcagtttcatttgttgaagaaatgaaggattcaagggtgttctatggaaatgatgacttctatgtgctttttagacttcatcaagctctttatgagaggatcttatcagcaaaaacacattcaatgagtgcagaaatgaaatggaaagcaaaagatgctagttcaccagatccttattcaagatttatgaatgcattgtacaacttgcttgatggatctgccgaaaatgccaagtttgaagatgaatgccgagcaattattgggaaccagtcgtatgtgttattcacattggacaagttaatatacaaattggtcagacagcttcaaactgttgcaaccgatgaggtagacaataagcttctccaattatatgaatatgaaaagtctcggaagtctgggaagttaaatgattctgtatatcatgcaaatgctcatgtcatccttcatgaggataatatatatcgtttacaatgttcctctaccccctcgcgactattcatccagctcatggacaatatgaatgaaaagcctgagttgtttgctgtttctattgatccaaatttctctttttatctgcacagtgattttctgtctgtctttcctaacaaaaaggagccccatggcatcatactgcatagaaacaaacgccaatatggaaacttagatgagctttctgcaatatgctctgccatggaaggtgttaaagtagttaacggattggaatgtaagatagcttgcagctcatccaagtgtggttgtgctgcaattgtaaaatcaatggtgtggatttga

SEQ ID NO: 47090 - DNA, 591 bp, Glycine max
  Peptide Sequence Number=SeqID_163868
atgaagagggcgagggatgatatgtatcctgcctctcaattcaaacgcccctttgcttcgtcacgtgctgattcctatggacaaaaccaagtccctggaagtggaggaggagggggaggcggcggcggagggggaagtggcaatggaggtggtgttggcgggggagcaaatgcttcccagaagctgactaccaatgatgctttatcctatttgaaggaagtcaaagacatgtttcaggaccaaagagagaagtacgacatgtttcttgaggtcatgaaagatttcaaggcccaacggactgacactgctggtgtcataaaaagggtgaaggagttattcaaggggcacaacaatttgatttttggatttaatactttcctaccaaagggttatgagataacgcttgacgaggatgaggctcctccaaagaaaactgttgaatttgaagaagcaatcagctttgtgaacaagataaaggtttttcttctacagaaacgattcctaagtgatgagcatgtttacaaatcattcttggacattttaaatatgtaccgcaaagagcataaggacattggtgaggtttatagtgag

SEQ ID NO: 47091 - DNA, 327 bp, Glycine max
  Peptide Sequence Number=SeqID_163869
atgacattcgccttaataaaaataagtaacctcaaaatccattttttgacaaatgatcaagtagatctggtgcagtggtggtttgggcgagcgtatctgatgaaagtggtggtttggacaaacaaatatggtgaatgggaagttggtggtggcccgggggtggttttggagagtcgatttggtgaagaggaggctagtggtgctgcggtggtggtttgggtgagcaaatctgatgaacaagaggctggtggtggtgtagtggttggtggtggcacaatggtggttttggtgagtggatctaatgaagggaaaagtgtgagagtgtaa

SEQ ID NO: 47092 - DNA, 276 bp, Glycine max
  Peptide Sequence Number=SeqID_163870
atggcccagttagtttgtggaggctgtcacactttcctcatgtacatccgtggagccacaagtgtgcaatgctcttgctgtcacacggtcaatctagctttggaagcaaatctggtggcgcatgtcaactgtgggaactgtaagatgctactcaggcctcgacaagcaccactgagcagaaattcagcacctaaatcttactgtaaaattggtgacagacaccacgaccttggttttaatcaaatatcgcccttgaggaataacgagtgcatatga

SEQ ID NO: 47093 - DNA, 249 bp, Glycine max
  Peptide Sequence Number=SeqID_163871
atggtgctaagtttgtggtcgcgttttccactaagccgacttaaaaatcctgaaaaaaatgtgaggcatagtcggctaggtcagatggcaacacctgtgaagattatagagatctcattctccaagttcactagcctcatctttctcaccacccacgtcaaacacacctatagaggaccaccttatgccagggatggctctcctcagtacgtgccagggccaccttatgtcaggaatgactctccttag

SEQ ID NO: 47094 - DNA, 330 bp, Glycine max
  Peptide Sequence Number=SeqID_163872
atgttgaaagaaggagttcaacatcggttttcagaaactgactttgaaagcaacaagttttccttttcattctctttcgatggtaccctatctctaaatctccctcccaacagcttctccttcaaatctttgttcttctctcgcctcccaacatcacgaatctcacttccattctcgcctaccaacttccgtcaaagctctctgtcaaggcatttgaagcaagtcaggaacattaaaggtgcgaaacaaccaattgaagttggtgttcgtgacattggtcagatgtgcatgtttctcataacatcaacgtgcttttggaccgagatttag

SEQ ID NO: 47095 - DNA, 282 bp, Glycine max
  Peptide Sequence Number=SeqID_163873
atgtgctttgattttcttagaatccaatccttcacattagttttcaaatataattcaaaagtggtggtttggacaaaaaaatatggtgaatgggaagttggtggtggcctgggggtggttttggagagtcgatctggtgaagaagaggctagtggtgttgcggtggtggtttgggtgagcaaatctgatgaacaggaggctggtggtggtgtagtggttggtggtggcacaatggtggttttggtgagtggatctaatgaagggagaagtgtgagagtgtaa

SEQ ID NO: 47096 - DNA, 607 bp, Glycine max
  Peptide Sequence Number=SeqID_163874
atggttcccaaagtttatgctggtcaagaaatggcaatggttgagaatgagaattgcataatgaatgggaagtggaagaaacgtgtgcatgtttttggtgagagggtgatgagatttcctaacaaggcttggcagacaacgtggaaggtgggacgtgaagacccaagaaggttgatccatgcatttaaagtgggggcaactttatgcaaagggctcaacagaggattggggacactgttagcaggattattggcatttcttgttgggtatattgcaaatgcatctgaccgagtctctcaagctattatcatcggagctgcagttttttttataggagctctagctacttatatgaggtttattccctatataaagaagaattatgactatggtctagttatatttctcttgactttcaacctgattactgtgtcgagctaccggcttgaaaatgtcttaaaaattgcacatgatcgcgtatacaccattgccataggctgtgctgtttgccttctgatgagtctactggtatttccaaactggtcaggagaagatctgcataattccacggtttacaagctcgaaggccttgccaaatctatagaag

SEQ ID NO: 47097 - DNA, 429 bp, Glycine max
  Peptide Sequence Number=SeqID_163875
atgaatagaagaaggttgaaactggagaaaggaggtccatttgatgtgagcggaacggaaagactgagtttgaatataagaatgcgtaagctttgcaccttctccgatgactgcctcaaatgcgggcattactccaataagagtcattttcattatcttgagagcggaaaactcctcgatgatattcgcctgtgcgcctttctcgacgacgacgagaaacctaggattggagagttgcatggcgtcggtggtggtgttgggagggtgcatgtagtccaagtggatggggatgtcgacgtggcagccctcggggatatagacgagggtcaaatcgggagcggcgattccgttgatggaccagaagaggtcgccgttggggaaagtgcagaggagaaggagccgaccaaagaaatggcgatggcagattag

SEQ ID NO: 47098 - DNA, 375 bp, Glycine max
  Peptide Sequence Number=SeqID_163876
atgcaggaagattctatcacatatgagcttacagaggtaagcactggaggaaaactggggaggtgcaatcttcatattcagcaattgggcccagacactgtcacagagttatcaaccttgcacttgtctgttggtgatcaaacgcaggatctccacagtactcttgttttggaccatccacgcggctattcacgacaactccacaaatgcattgtcacacattcacagggacaagcagtttttgatggaaacattaaggttaacaggtatgctcagcagacagatgcaggacagttaacaagaagccttctgcttgaaccttgtgcgactgtaaatgttaaactgaatcttcaaatcgtggctgatgatgtttag

SEQ ID NO: 47099 - DNA, 2342 bp, Glycine max
  Peptide Sequence Number=SeqID_163877
cctcctccaaccacactcctaaccacaaccataaccaaaaccagctggtgtttgcggagacggagccattggacgaaaccctaggccactctttctgctacgttagatcttccgctcgctttctctctccctcccattccgatcgcatcctctctccctccaactccctccgcttctccccttctcacccccccgatttacccgaaaccgcattcaaggccatttccggcgcctccgtcagcgccaacagctccgtccccaaaaccgtcctccagaccgacgatgacgatggcgatgacaccgccgtcaatggcttcaaaggaacgtcttcgtttagcgccctcccgctccagcctgttccaagaggtggaggagctgaagatagagagaggcgggcgttcttcctctcggggccaattgagagcggcgcgctctccggacccctcgacgacgccgtttcgagctccgagggagtgcctttctctgctccgctaggtggttcagtctatgtgaagaagaagcggaagaagagcattgcggggttgagaaaagccttccagaggagtctctctgagaagaagcgcccctgggtggttccgatggaaaggaaggggaagacggaggcaaaagacgagagcgaaaccgagagcaatgtgcagtgggcgctgggaaaagcaggggaggatcgtgtgcatgtggttgtatcggaagaacagggttggttgttcgtggggatttacgacggtttcaatggtcctgacgcgcccgagtttctcatgggtaatctctaccgtgcacttcacaaagagctccagggtttgttttgggagcttgaggagtcagagccgcaggtgcagggaactaatcctgcacctgcggttgaggataatgaggctgaatcccacaatgacggggaggttgaaaaagagtctaattctaattctctccaaggatcggttaagagagtgacgtttcaagcggagggaactgagagtaggaggaggaggttgtgggagtttttggctgaggatgatgatgatgctgaggacgggcttgatctttcagggtctgataggtttgggtttacggtggatgatgctctcagtgttagcaaggagggttcggggggtagtaggcggtggttgattttgtctaagttgaagcatgggttgtcgaggcacagggagggtcatgggaggaggttgttcccgtggagcttgggcgtgggggcggaggagaagaaggttgaggaggaaaatccggtggcggggaaggaggaggagaaaaagggtcgtggtgggaggaagaggaaggtggggcctgtggatcatgagttggttttgagggcgttgtctcgggcgcttgagatgaccgagcttgcatatttggatatgacggataagcttattgataccaatccggagcttgctttgatgggttcgtgtctgttggttgtgttgatgagggatgaggatgtttatgtgatgaatgtcggggatagccgggccattgtggcacattatgagtgtgaagaggttcatgctagtaaggaatctggaggcggtgcagacgttgagtcaagtggggagtgcatagtggaggagaacttagctccggatgaaggtgctgttgtgttggggaatgagggtcctgctcaagaaaggaggttggttgcattgcagctctccactgaccacagcaccagcattgaagaggcaattgttaggattaagaatgaacatcctgatgataaccgatgtattgtaaatgatagagtaaaaggccgtcttaaggtcactagagcttttggagctggatttttgaaacagtgcatagctgttatgtctattgttgtccttggttttaaagtataccaaacttcctactctggctatggaagagatgtttcatgcaacctcactttttttagtgtctatggcactgctgcacatttccattatcatccactcagaaaatggaatcctgcttgtttatcatgcctcttgttcaaggccgcaatgcatagacttcttaaatattgtatgcaaatgtatgttgacttgatgttcttgatcctctcatctgatgggttgtatcaatatcttagcaatcaggaagtggtttctgaagttgagagtttcgtggaaaagtttccggatggagatcctgcccagcatttaatagaggagctgctccttcgtgcagctaaaaaagctggaatggatttccatgagttgctggatatccctcaaggagatcggaggaagtaccatgatgatgttaccgttatggtggtatcactcgaaggaagaatctggaaatcatcagggaagtatccgtga

SEQ ID NO: 47100 - DNA, 282 bp, Glycine max
  Peptide Sequence Number=SeqID_163878
atggatgatgacacaggggtacgaatgacacaggggtctccaggaagtaagcaccacaaggtccaagaggaaggatgcacctccagcttgcttaaggaagtacgtacatcatggttggcatcatgcatcatgcatgggtacaaagtaggcatcatgcaggaaaccaccaaatcgcgccatttagatagtgtagaatattatggatatcattctgttaggatattccctgattgtgcttatctttctgttattgctatcaggagtttgttccctagcagctag

SEQ ID NO: 47101 - DNA, 549 bp, Glycine max
  Peptide Sequence Number=SeqID_163879
atggcactcaggatgtgggcttcttccactgccaatgcactcaaagtctcttctacctccagacctcatctcttgcatcctttttctttctccagatgcttgtcttccgtcttggatggacttaagtatgcagattcacacgaatgggtcaagcacgaaggctcagtcgccaccattggtatcactgaccatgcccagaacttaaataatgttagcacacaagtgaaggctgaaggtgtccaattgcaggaccatcttggagaggttgtgtatgtggagctgccagaatcaggtggcacagttacccagaagtctggcttcggagccgttgaaagtgttaaagcaacaagtgacataaactctccaatctcgggggagattgttgaggttaacaaaaagctcacagagacacctggcctggtcaactcaagcccatacgaagatggatggatgatcaaagtaaagccaagtgatccatctgaattagattccttgatgggtccaaaagagtacacaaaattttgtgaagaagaagatgctagtcattaa

SEQ ID NO: 47102 - DNA, 1164 bp, Glycine max
  Peptide Sequence Number=SeqID_163880
atgacgttactaggttctttgtggctcatcctagttgcagccttgttgggttatgcatttctattagggcttcttaggagagtgaatgaatggtactatgtttctaggcttcagggaaagttgcaacaccctctcccaccaggtcatctgggttggcctttattggggaacatgcccaccttcctcagagcttttaagtctaaccctgattccttcatctatgaccttgtttccagatatggcaggacgggtatgtacagaacgtacttgtttgggagccccagcatcatagtttgcaccccagagacgtgccgtaaggttctcacagatgatgaaaatctcaagcttggataccctccttccaccacggccctcaccggaaagagatcactccatggcatctcaaatgctgaacacaagcgccttcgccgcctaatcacctctcccataaccggccacgaggcattgtccacgtacataggtctcatagaacatgcttctgtgaaacggttggaagagttgtctagcatgaacacgccttgtgagttcctcacagagttaaggaagttcgcttttaaggtcttcaccaccatcttcatgggctctgatgttgatcatgtagacctggccttgttcgaaaacttgtacaaagatttgaatcggggaatgaagtcactggctatcaatctcccaggctttccattctacaaagcactcaaggcacgaaagaagttgatgaagttgctgcaaggcttggtggaccaaaagagaaggaccaataatacaattacaaaaacaaagaggaggaaattagatatgatggatttattgatggaagtcaaagatgaagacggtaggcagctggaagatgaagacattatagacttacttctggttttcttgttagctggttacgaaagctctgctcatggaatattgtggaccatcatctacctcacggaacacccacttgtcttccaaagggctaagaaagaacaagaagagatcatggaaacaagacctttatcacagaaagggctcaaccttaaggaaattaagcaaatggaatatctttcaaaggttatcgacgagatgctgcgcagaacaagtatctcttttgcgaactttagacaggcaaaggttgatctcaacatcaatggttag

SEQ ID NO: 47103 - DNA, 168 bp, Glycine max
  Peptide Sequence Number=SeqID_163881
atgacgcaaagtggagtttatgaaagaggaggagggaagattctaactctgggatctttcaacaacaaggctttcatggcaacaatagcgcaaatttggaaggtgggtggggggtgtagaaatcaaagaagcaggaaggaacatttacaccttgaggttcctaaatga

SEQ ID NO: 47104 - DNA, 279 bp, Glycine max
  Peptide Sequence Number=SeqID_163882
atggtaaatcttaacgtcatcacatacccacagacaccaacacccttgccaacatcaaacaaagatgaaactcgtcaacaacatccttttcatgcctctaagaaaacattatcatcattcgttgataacaaccatcatgaagacaaagaaatcaacatcgaagagaagaacttagagggaatccaaagggatatagtggcaatcgccatggtcccccatgatagctgcaacaaagggagtaagattcactcggcaacgtcacaccagtcgtcatcatag

SEQ ID NO: 47105 - DNA, 567 bp, Glycine max
  Peptide Sequence Number=SeqID_163883
atgaggattaacacctatgaatcatccaagatttataagcataagataaagacgtatcatgataagaagctacagagacagaacttccaaccaggtcaacaagtcttgctcttcaattccaaactcaggctatttccaggaaagctgaagtcaaagtgttcagggtcgttcatgatcaaagaagtaagaccccatggagctgtggaattggtggaccatatggcaagcaccccggagaaaagatggatcgtcaatggacagcaattaaaaatttacaatggaggccagctagaaatattaacaaggtgcaggaagcaaaaaggtggttgggctgacaatgttatcgcgctaattgcgcatctacacgctcagtgcctagctggcgagagacgcgctaagcgagatatccttgctaagtgcgtaggtacaaactcgctaagcctcgcattaggcttagcgagaatgagcaatttggatgggaaacatgataatggcctcacagaaacgtcgagcagtgcccagttaaggcgaggaatccacctgggattcttcccgcttcacttctga

SEQ ID NO: 47106 - DNA, 402 bp, Glycine max
  Peptide Sequence Number=SeqID_163884
atggaaatatcctcattccatcaattccccaatgaattacttagcgaggtgctcaaccatttccatggactactcagaaaaacgcctacacatgggtatagtgagtcggtgcaattaaacatcttcctagatggcctgcaaccacagttaaaacaactccttgacacatccgcatggggaaaaaccaagatgaagacaccgaaggaggcaattgagctaatagagaacatgacggccagtgatcatgccatccttcgtgatcgagcatacacgtcaacaaagaggagccttttggaactcacagctcgagatgcgacattagcccgacagatagaggccatgacagagaccttcagcaagctccctcaacaactacaagcggtaaatccctctcactcttag

SEQ ID NO: 47107 - DNA, 459 bp, Glycine max
  Peptide Sequence Number=SeqID_163885
atgtgggatttccaacgagaagagaggagaaagactaacggcgacgcattcgggcggcgtttcgaagagggagagggggaagcgcttggaggcggcgccgacgtcgaagtagatgaggccggtgctggggacgtcgacgcggatgctcatgacctggaaccagaggaagagatcctgggcctcgaggccggagagggcgtcgatcatgccgtagctgaggtggccggagacgttgcgctcgtaatgcagctcgttctcgaacttggcgttgcaggcctcgtcaaggcgcacccagaagagcccgtcctcgcccaccgcgaactcccgcacgccctgggggaacaggcccatgggcagcccgtgctcgctcaggacctcgtagattgtcgtcgcattgctccgacccaacaaggaggcggagcagcaacaaataatgattggaaagacaaggatgggtag

SEQ ID NO: 47108 - DNA, 99 bp, Glycine max
  Peptide Sequence Number=SeqID_163886
atgacatacagattggtcaggttcaatctggaaggattcggcataagctcaatcagggaacctctggaagagatgttctatagagtatatgggcattga

SEQ ID NO: 47109 - DNA, 150 bp, Glycine max
  Peptide Sequence Number=SeqID_163887
atgactagtaccaaaccaggtgacttgcatccatatgatcctgagcctagttttattgtttctgagtgtgaaattagtgttgattcaatggttgataacaacaaaactcttaaggaattggctacacctgatgttgtgtataaaccttga

SEQ ID NO: 47110 - DNA, 1047 bp, Glycine max
  Peptide Sequence Number=SeqID_163888
gtgttttcttacaaggagcttcagttggccacgcgcgggttctcggagaaggttgggcatggagggtttgggacagtgtttcagggggagttgagtgatgcttcggttgtggcggtgaagaggttggagaggccagggggtggggagaaggagttcagggctgaggtgtcaacaattgggaatattcagcatgtgaatcttgtgaggctaagagggttttgctctgagaattctcataggcttttggtttatgagtatatgcagaatggtgctcttagtgtctatttgaggaaggaggggccttgtttgagttgggatgttaggtttagggtggctgtggggactgctaagggaattgcttatttacatgaggagtgtagatttcactgccaaggtttcagatttcgggctggcgaagctcatcgggagggacttcagcagggtgttggcgaccatgagggggacgtggggtatgttgcgccggagtggatttctggcgtggcgattaccaccaaggcggatgtttacagctatggaatgacattgctggagctggttggcggtcggaggaacgtggaggcaccgccatctgccggaggaggaggaggtggtagagagagtggcagtgagacgggaactaagtggttcttcccgccatgggcggcacagcagataattgaggggaatgtgagtgatgtggtggataagaggcttgggaatgggtataacattgacgaggctaggagggttgctttggttgcagtttggtgcattcaagatgatgaggcaatgagacctacaatgggtatggtagtgaaaatgttggaggggttggtggaggtgagtgttcctccaccacccaagttgcttcaagcgctggttactggggattcctttcatggggttaaagctgattcaggcaatggtgtgtctactggtggaagcttatctgatggcaacttggaagtgtcaactgctgattctgaatcatatacagggaatgttttttctcctttggatgtgaatgtccatgttagtgttcgataa

SEQ ID NO: 47111 - DNA, 597 bp, Glycine max
  Peptide Sequence Number=SeqID_163889
atgggctgtctcatcttcgagagaaaggaattggcttccaagtatgagcaagttaaggcttcgattgattcatccgagtttatgtgtaagcatgattcaaccatgactttgtctgcactaattgaagcaaggaaacgggaagaaagcttgaagaaggcagtaggagtcacagaggcatgtataatttcgcccttaaaacaaagatttctgcttgagagtaaagtttctgaagcacaccaattgatagatgaagcgcagaaaaaatcaactgaggctgaggctgaggccaagctgcttgctgcggcatcctttcaggcaaaggcttgtggatataacggtgtagcaggcaggaagcttcgggatgttgaagcacgtgaagatgaactcaagtggcaaatcatatctttcaaatcagagtatgtgtttgcactaagtaaacgggaatctgagctgaacaagaaagagcgagaattgcttgattttcaagtgaaacttgctagtcgagaatctgatgaaactcacaaagttacagctgttcaggaagctgaacttatagcaagaaagactaactttgaagctgagctacaaattggttga

SEQ ID NO: 47112 - DNA, 1269 bp, Glycine max
  Peptide Sequence Number=SeqID_163890
atgaaagcgcatgcgagttcatggaaaggtgtagaggatcgcaatcccatcgataacagtaacaatcaatattctacaagagaggaaaggagagattcagaatcagacaagaagccacgtgcacttcgaaagcagtttcctctcacttcgcagaatgttctggaagccgcctctcctctcaggccttccgccactctgtcttctgatccctacagtgagacgattgaattagctgatatagaatgggacaaccttgggtttgggcttcaacccactgattatatgtatatcatgaaatgcacacgaggtggaaccttttccaaaggtgaattgcagcgttttgggaacatcgagttgaacccctccgctggagttttaaactatggccagggattatttgagggtttgaaagcataccgcaaacaagatgggagtatactcctcttccgtccggaagaaaatggtttgcggatgcagataggtgcggagcggatgtgcatgccatcacctactatggagcagtttgtggaagctgtgaaggatactgttttagctaacaaacgttgggttccccctgcaggtaaaggttccttgtatattagacctttgttaatgggaagtggacctgtacttggtgttgcacctgcaccagagtacacatttctaatatatgtttcacctgttgggaactacttcaaggttagacatacttttctcccgtcaccacaggaaggtttggccccaatcaatttgattgtagaaaatgaattccatcgtgcaactcctggtggcactggaggtgtgaagaccattggaaactatgctgcagttctgaaggcacagtctgaagcaaaagctaaaggctactctgatgttttataccttgactgtgtgcacaaaagatatttggaggaggtttcttcatgcaacatttttgttgttaagggtaacattatttcaactccagctattaaagggacaatcctacctggcattactcgcaaaagtataattgatgtggctcgaagcgaagggtttcaggttgaggagcgattagtttcagtggatgaattgctagatgctgatgaggttttctgcacgggaacagctgtggttgtatcacctgttggcagtattacttatcttggcaagagggtaacatatggggatggtattggcgtggttgcacagcaactttatactgtccttaccagattacagatgggtcttacggaggatgagatgaattggactgttgagctgagataa

SEQ ID NO: 47113 - DNA, 252 bp, Glycine max
  Peptide Sequence Number=SeqID_163891
atgataactactcatacgtctacgaacctgagtcttgaaactgttttaggcataagcataaaagaaaagcatggcgatatgggcaacaagcgaggccttatctttgtgttgaatggaattctaatcgaagccagcttgtttaagacgcttccagatctcttcgtcttcgggaggaggggttctcgaagcaggcgttgcggaatcaggagtgatcggtatcgccatcgccgatcaccggcaccgcctcgctaa

SEQ ID NO: 47114 - DNA, 762 bp, Glycine max
  Peptide Sequence Number=SeqID_163892
atgcagcaagagcgtgcagatttcttgagggacgttgagatgcagaagaggaatatgaatacccttatcgagaagaggcacgaagaaatagaaagttgtttgaaggaaagagaaaaatcttttgaagaagaaaagaacaatgaactagaatatattaatgctcttaaggaaaaagcagcaaaagagtcccaacaggtttcctttgagatgagaagacttgaaactgagcgagcagagataagtttggaccgtgaacagagaaagaaggaatgggctgagctaaataagtgcattgaggaactcaagtctatgaagaaaaaattgaagctgcggactcttaagcatgatgatcatttaaattcccccaaggaaatagaggctaataagaacagcaacgggtttgacacaccatttgtgcaaaagtcatccgttgtttctcctcctagccccgttgtggttagcaatggtcaaaagcacttgacgaatgacaactctcttgataatgttggcaaaaggcagcaaaggagattttcttttggagaaccgaaagtaatacttgacgtaccatctccagccgaagatgtttacagagtaagtgattttgaatctgaaattaagaaacatgtgaaccgaactgttcccttggtttgggatggatgtaatgtgagcaaatggaaaagaggccgtgggaactttggaattggagatccacttcaagatacactgaaggataagaaactgcgatcagaagacaaccaatag

SEQ ID NO: 47115 - DNA, 783 bp, Glycine max
  Peptide Sequence Number=SeqID_163893
atgaagatccaagggtccaaaataaactggttggagagggctggagacgcggctgcaggagaggatccgcgtccagtatttggtggttgtgatgtgaatttgagaagcctggtgtttgcagagtctgaagagctgagattggatcacatatactatctgattctagggttaaattgtaattcactctactctcttactctctcgctcacgcctcacacgttttctgtctcttgctcactctactcagttcccttcccaatcgccgctcagccatcaccgtcgccactcacggggagactcgccctcctcgaccgacgttccctccacatccttcaacaaagtttccggcgtctgttcgaggaagaggaggcgaatttggtaatttgttgtgtgttcgaaatgggtgaaatttggtggtcccttttgggggcggcgatccccgtggtggtggcggggcaagcgtttcgcgtgaagaaacggcgtgcagaggagcagaggctgcagagtgctcgtgggagggaaaggagttccgatgaaatcttcgtttgtgagagggtctgcacttcaaagaggatgctcaagaaggttggttccttctccaaggaccccattcctgatacctgcgtcaccgtttgcggcgtttccgatttagatgcctgtgctgatgcctgtgcccgcactgtgtgtatcaaccaacatcaagtccctaattggaacgacatttgcctcaggaggtgccagagtgaatgcctcaaactctcttctcagagtcagtcctcgtag

SEQ ID NO: 47116 - DNA, 504 bp, Glycine max
  Peptide Sequence Number=SeqID_163894
atggaagaagaggactttgaatgctgcctgaaagcgttgaaaggaatgaggcttattgttgcggagtttctcagttattggatattccaagtactcccctccaagtcaaggaccacttggaatgcttgctcgaaaagtctatccttgctttatgcaatgattctctctttgggtctctattgtatatcttcaacacctgtctaccaaacttcaactaatcctaggtttcattcgtgcaaatcgtactctctgttcatcagtcatgaaatagcagaaagttatatggataacaaatcaccgagcaataaggcatctgaggagctggcacgtgagttgcttattgctatctctgattctttaccagataaaactctggattccgattttgtgcccgaaagcaaggacgcagacagctttgcaagaccaaacggtgattgggatgacaagtttaggtctgaattgatttcaatctcctatgttgaatctcccgatgtcaaaatctga

SEQ ID NO: 47117 - DNA, 213 bp, Glycine max
  Peptide Sequence Number=SeqID_163895
atgagcttttgtcttcaacgcacagggagatatcgtgttcaaatagcggccgcaaatgaagcaccatcgtttgacgttgcatcatcgtcattggccatcgataatgcaaataatgagaaggagaacagtcaagaatgtttaggttttggttcttctctttctcgcaatggtaaaatgaagaaaaacctgaatgatatgaaaaggagagattaa

SEQ ID NO: 47118 - DNA, 1374 bp, Glycine max
  Peptide Sequence Number=SeqID_163896
atgacctctaagctaattgcttccaatctccgtcaccaaatcacaaaatcagcccaaaacctccgccgccagctcctatccacggcggcggcggcggcagtgccggaacacgatgggaacaactccaactctttgggaatgacgatgaagggcgttcgaatctccggaagacccctttacctggacgtgcaggcaacatctccggtggacccgcgcgtacttgacgcgatgctccctttctacatctctcgctacggaaaccctcactctcgcacccacttctacggctgggaatccgacgaggccgtggagcacgcgcgcgctcaggtcgcttccctcatcggcgcttcccccaaggagatagtcttcacctccggcgccaccgagtccaacaacatctccgtcaagggcgtcatgcacttctacaaggacaagaagcgccacgtcataaccacgcaaacggagcacaagtgcgtcctcgactcctgccgccaccttcagcaggagggtttcgatgttacctatcttcccgttgaatctgacgggttgattgatttggataagcttagggctgcgattaggcctgataccggtctcgtttcggttatggcggtgaacaatgaaattggagtggttcaaccgatggagagaattgggaggatttgcaaggagtttaatgtgcctttccacactgatgcagctcaggctttggggaagattcccattgatgtggagaagtggaatgtgagtttgatgtcattgagtgggcataagatttatggccctaagggggttggggctttgtatatgcgtaggaggcccaggattagggttgagcctcagatgaatgggggtgggcaagagaggggaattaggagtgggactgttcccactcctttggttgtggggatgggttccgcgtgtgaggtggcgaagaacgagatggagtatgatgagaagaggatttctgctttgcagcagaggctgcttaatgggattagagagaagcttgatggggtggtggtgaatgggagcttggagaggcgctatgtggggaatttgaatttgtcatttgcttatgttgaaggggagagcttgctcatgggtttgaaggaggtggctgtgtccagtggcagtgcctgcactagtgctagtttggagccttcgtatgtgttgagggcgttgggagttgaggaggacatggctcacacttctattaggtttggaattgggaggttcactacagaggccgagattgatagggcggttgagctcaccgttcagcaggtggagaagttgagggaaatgagtccgctttatgaaatggtcaaggaagggatcaacatcaaggatattcaatgggcacaacactga

SEQ ID NO: 47119 - DNA, 414 bp, Glycine max
  Peptide Sequence Number=SeqID_163897
atgatccgtagaccgtgtagattacacagtactgttaaaaatatttgttctcttcaacattctcgtgagaaaaaaagatcctatggtgaagcgacaacagctgacaatgaggttgtgaagttagggaggaaagacccccatcctaacgtggagcaatcatctatcttagatgcaacaagggacaaggaggaaacggatgaagaacaaaacgagcatgaaaagcaaaagaagaccgataatgttactggtatggaaaatgagatcctaaagcaaaagaatgagcagaataacaacgaagaaaaatctgagcatagaaaggatccagtagatcaagacactgaagagaattcggtgaccaacaagaaggaaagtcagacaatgagcataaggcaatcaaggagagtgatagtgtaa

SEQ ID NO: 47120 - DNA, 2937 bp, Glycine max
  Peptide Sequence Number=SeqID_163898
atgccgcaaccattgtttctgtttttacttttatgtttattgtgctcaagtagtggtttatctcaagttttgtccctcgagagagagactcagattctacttggggtcaagaacactcagctcgaagacaaaaacaagagtctcaaaaactgggtgcccaacacagaccaccacccctgcaactggaccggcattacctgcgacgcacgaaaccactcacttgtctccattgacctctccgaaactggaatctacggcgacttccccttcggtttttgtcgcattcacaccctccaaagcctctctgtggcttccaattttctcaccaactccatctcccccaactctctgcttctctgttcccacctccgtctcttgaacctctccgacaattacttcgtcggagtcctgccggaattcccgccggacttcaccgaactaagagagctagacctctcaaagaacaacttcaccggcgacattccggcgagttttggacagtttccacatctgagaacgctcgttttatccggaaacctcctcagcggaacgatccctcccttcctaggaaacctcagtgagttaactcgtttggaattagcttacaaccccttcaaaccaggacctttaccttcccaactaggaaacctctctaatctcgaaacactgttcctcgccgatgtaaacctcgtaggggaaattccacacgccatcggtaacctcacctcgctcaagaactttgatttgtctcagaactccttgtcaggtacaatcccaaacagcatttcaggtctgagaaacgttgaacaaattgaactatttgaaaaccagcttttcggcgaattaccccaaggtttaggaaacctcagcagtttaatttgcttagacctctctcagaacgctctaacgggaaaactaccagacacaattgcttctttgcatctccaatctctcaacctgaacgacaactttctcaggggagaaattcccgaaagtctagcttcaaacccgaatctgaagcaactgaaactcttcaacaacagcttcaccgggaaactcccacgagatctggggcgaaactctgacatagaagatttcgatgtctcaaccaatgacttggtgggagagttgccaaagtacctctgccaggggaacaaactggagcatctcatcacgttcgcgaatcgcttctctggaacgctccctgaccaatacggcgagtgtcgttcacttcaatatgttagaatccagagcaaccagttctcgggcccggtgccgccatcgttttgggcccttgctgggcttcagtttctggaaatgtccaacaacaggttccaaggttctgtctctgcttccatctctaggggactcaccaaactcattttgtccggtaacagcttttctggccaattcccaatggaaatatgtgaacttcataatctcatggagattgacttcagcaagaaccgcttcaccggtgaagttcccacgtgcgtaactaagttgacaaaattacagaaacttagactgcaagagaacatgttcaccggcgaaattcccagtaacgtgacccactggactgacatgacagagttggatttgtcgtttaaccggttcaccggttcaatcccatcagaacttggaaatttaccggatttgacataccttgatctcgccgttaattctttaacgggggagattccggtggagttgacgaacctaagactcaaccagttcaacgtctctggtaacaagttgcacggagtggttcctttaggtttcaaccgccaggtgtacttaacgggtctaatgggaaaccctggtctctgtagccccgttatgaaaaccctgcctccttgttccaaacgcaggccgttttctctgcttgctattgtcgttttagtttgctgcgtttcgctccttgtggggtcgacgttgtggttcctgaagagcaagacgcggggttgtagtggcaaatccaagagctcctatatgtcaaccgcgtttcagagagtggggttcaatgaagaagacatagttccgaacttaatcagtaacaacgtgattgccacagggagttcgggtcgggtttacaaggtgaggctcaagacggggcagacggtggcggtgaagaaactgtttggtggcgcgcaaaagcctgacgtggaaatggtgttcagggcggagattgagactctgggaaggattcggcatgcgaatattgtgaaactgttgtttagttgcagtggtgatgagtttaggatattggtgtatgagtacatggagaatgggagcttaggggatgtgttgcatggtgaggacaagtgtggggagttaatggattggcctaggaggttcgcaattgctgtgggtgcggctcaggggttggcttatttgcaccatgattctgtgcctgctattgttcacagggacgtcaagagtaataacattttgttggaccatgagtttgtgccaagagtagcagattttggtcttgctaagacattgcaacgtgaggccacccagggtgctatgtccagggttgctggatcatatggttacattgctcctgagtatgcttatacaatgaaagtgactgagaagagcgatgtgtatagttttggggtggtgctgatggaattgatcacaggcaagaggcctaatgattcttcatttggtgagaacaaggatatagtgaagtggatcactgagactgttttatcaccatctcctgaaagaggaagtggcgatattggaggaggaaaagattatattatgagccagattgtggacccgagattgaacccagccacttgtgattatgaagagatagagaaggtcttaaatgtggccctactctgcacctcagcgtttcccattaatagaccctcaatgagaagggtggttgaattgctcaaggaccataaactgtcatga

SEQ ID NO: 47121 - DNA, 1476 bp, Glycine max
  Peptide Sequence Number=SeqID_163899
atggaagataaaaacaaggaacatgaatccggtttcgtttgtaatcaagaatctcagacaaataatgaacctcagcacaaccaagagaatgcacagccaaatgtgactgttggtcctattgccaaaattagtagtccctcaccttcacatgacagcatgcccaactcaaatcagcaacaacaacctccaattgttcaatggccttgtactcctcaaaatgccacagaacagttcttgacaatgcacttccccacccaagcatcaccacctggtgccttaaatcaatggcagcagtttcaatatcagcaggtatttgcacagacagcatcatccttttggcaaccgcaaccgccaggagcaaatgtcccttcattctttcagccctttactgatactggctttcaaggaggaccttcctcaacaatacagacactacttcccaatatgtcttgccattacacatttcctggctttccacattcttgggatccaccttcttacatggctcagttgtaccaaatgcagcatccttatgttttcagttttcctggtgcacctaacttttcttcagcaactcctaaggtgcctgatcgcttagcttctgtagagcattcttcccaaaatggaattatgagaccaccttcaaaactttctcagaagcatcaacaactttgggaagctcagtcagcggagaatgttaagctgtggagtgtgataaataaattgcaagctgaagtttctgattacaatgatcggctgaagaagcttgaagaagaagtatcctcgttcaaaaagaaagcagaagtgcccactaacaaagttattgggacaattcctgtattaacagtgcaaccaaaaaagagaggagggcctaagagatcattggcttcagtggatccatcatatgagtctcacctcccagctggcggtaaaaagcctgcactaagtaactatctgtatcagagtaaatcaccctttggagcagttaaatcacccatttttgaaaaagttatccttaaaaaagtggaaaataaagaaataactactcgttccactactacaatggtgcagcacgaaagcaatgtaaacatcttaaatgctgttaaagatgtgagctgcaatacccaaattaatcaaagcaacccaattatgtctgcatgtcaaggccaagttccatgtggaaatggagtaaatgttaattttggaaaggatcatgacttgaaagtagtctactctgaaccatcacaaccagataaagttttgaaaaatagtagcatgggtgtttcagctaagtctgttggaaatactggtaatgggaatgttgggttgacttcttgcgcaccttctcaagacactgcaaaggatatgctagatgttgctcgtcgaagtttcttccataatggcagtttcatccaacaaggaggaaacataactcctggatggagtttgagttttgcaaatgaagaggatgcttaa

SEQ ID NO: 47122 - DNA, 331 bp, Glycine max
  Peptide Sequence Number=SeqID_163900
atgacagccatcgctgttgttggtcttggtgatgacaatggagaggctgtcattggtgaagagggggttggaggggccgtgatgatgttaccagcgaaaagaagagtttcttccaccgcaaacaatgtcgttgaaggtccttctttgccttcctcgacatgtcgttgcaccgtgaacaagccgttttccgttgtttgttccctttttctcagcctccgaccctcccacaatgcctttgaaatcttaaaatgtggagatacaggagtcacaagcaagccgccaagatccttccccgtcctctgtccacgttacaacgttgattgcggtgaag

SEQ ID NO: 47123 - DNA, 375 bp, Glycine max
  Peptide Sequence Number=SeqID_163901
atgaggaggcaatcaccgactttgcatgatggcttcttgatcgcgaagacaacaggtttcaaatcagtgagtgcttccctccaaccccctcttcacgctggtaacatcatcacggcccctccaaccccctcttcaccaatgacagcctctccattgtcatcaccaagaccaacaacagcgatggctgtcatttggtgcaccacatatctaggttttcgtggtgcaatgacaacagcgtttgatgtgccgtggatctgggttttagtggtacagcagctatggcatttggtgtgccacaaatctgagttttgctatggcgtttggtgcaacacaattctggattttggtggtgctacaattcagtggcagcagtga

SEQ ID NO: 47124 - DNA, 309 bp, Glycine max
  Peptide Sequence Number=SeqID_163902
atgtcttttccggtttttccgacgttttcctcaaataaacattggtggcgactccgtgcgtattcctttcttggaagacgcttccggcgagtcccgcgtcgccctcccgccgaagggtgtcaaggaatcaagttgacagaaggtgcgaataaccataaggtgtgtctgcgtgctactggacccttgggtcacaatagcagaattgagacttttttgtggtctcgggcggaagacgctgaactctccgggaagggtgcaaatgaccaaattggcatctacgtgtcaataggctcacttgcctctggttga

SEQ ID NO: 47125 - DNA, 1269 bp, Glycine max
  Peptide Sequence Number=SeqID_163903
attgggaaagtggtccgcatacgtaaggctccaaggaatggatcgcagtcaaagagtgtgagtgtgaggaatagcatagctttgactccacatgaacgtgttctctggaaagatgtgcatcaacttatctcctcttcagacaaggaaatagttggtcaactatatgtgcagcatgttatgaagcctttgcttggttccaactctgttgatgctgggatgcacgtcctggtgaccagggaattccttgagttggttgagaagaatgtttctggtcaacgtcctgcgtggcgagttgaagctgccagggttgatgcacattgtgattttggccttctcatgtcagatcattctctctttgcttatggcagtcaaggatctagcctctgcttatctgttgagataaagcccaaatgcggatttcttcctctttcaagattcatatctgaagtaaatgctatcaaaaggagaataacccgatttgaaatgcaccaaactctgaaattgcttcaaggagagatatcgcaactaagtgagtacaatccacttgatctgttctctggatccaaggaaagaattctgaaagctattaaaggtctccttacaactcctcaaaacaattttcgtgtatttttgaatggctctctcatacttggaggactgggaggtgttgcaaaaaatacagatgtttgtattgctaaagcatttgaagatgaacttaagtcaatcattcgagctgatgatgatctatgtacaaataacttatctactcttgttactgaggctttgcaaaaatcaggagtccttgataagctcctgaaggtgcagaagcttgataatattgacatagaaggggtcatccatgcatattataacattacttctcaacagtgcatggtgtgtaaggaattgagtgaagaacaggcaaaaatatatacccctttgcattcagcttcactggatgaaagtttgagaattgtaaaggactacctgatagcaacaactgcaaaagactgcagtttgatgttgtgttttagaccaaggaatgaggaggattctggatctgtgtacgataatgtatatctggactcaacggagcaatcctttgattataaggtgtattttatcgaccttgatttaaagcgcttaagtaaagtggaagactactatgaattagataagaagatagtgaactgctacagacaaatcatcaaaatggatcaaggaagaaatgaagagacaggcttgaaggcatctaatgctgcatattga

SEQ ID NO: 47126 - DNA, 138 bp, Glycine max
  Peptide Sequence Number=SeqID_163904
atgaagttgattgcaactgttgaaggaatcgcttccattgtcctagacccagacaaaaacacagtgacagtgattggtgaggctgatccattaaggacagtaaagcctgttagaaagttcagaaaatcagcaaccatt

SEQ ID NO: 47127 - DNA, 1117 bp, Glycine max
  Peptide Sequence Number=SeqID_163905
atggctcatgcttgtgctgaagagagtaggagagaaaacgcgagagagaaagcgcgagagaggattcggattcgatatttcctctctcaaatgagcggaagtgcgaagaaattgacactgagcacgttgctcttcttctgcacgcagcaggtgatggtttgggatgaactaataaagactaaaccatcggctgtgaaatggagagcttctcaagtgaggcactatgatcttcttgaggaactttatggttcacatcgtgccacgggactcgtggaatgtattccgaggcaaattcatcaagctatggataggggcaatgtcaaggatctcgtccatcctaagataatggattttgattactttgtgactagtggtcttcaatgtcaggaattactttccgtccaaggacttgatacttttgtctcacttgaggctaatttgaagtacgaaggacacaagtttcagctttccaaactttctgacaacattgggtatcatcatggtcaggcattggatgcgatggttagacctgaattgcagggacataactgtaaaaatgctgaagacattttttttctttgggctatcaaccaacggattcgaatcaaattggccatacctcatctgtcaacatatgaagaagtgcaagagaatgggagtttacctggttggtctaatcgtttcaataaaaaaagcttgaagaaattcaaagtcatacaagttgatggagtgtggcaacatgccgatcaaaacatgtcaatgcctatggaacatagagaggagggtggtgactcagaaagtgctgaaaagcctcaaggtagtcaaccttgggcacctcaagtaactcctgatagtgatatggctgacaaaaggtttgatgattttgataaacattttgaagatcttcaatatctctaccagcaagatttgaagccagagaatgtgcttgcgagggaggatgggcatgttatgctttcagattgtgatctttcgatcaaatgtggcgttcccaagttattaaggagaagaaagaaagaagagaagaaagaggaagagaaaaaggatgctgtttctcatactccgaattgtggcagagatgtgatacgtggcatggctg

SEQ ID NO: 47128 - DNA, 207 bp, Glycine max
  Peptide Sequence Number=SeqID_163906
atgctacagtcaaaaccaaatgtgatgccatatgagaaagaggagctgctgaatgctgctgtttatcgtgtggacgcattggaagcggaactgatcgctacaaagaaggctttgtatgaagctttgattagacaagaagaacttctggcatacattgatagtcaggaaagaagcaaattcgagatgaatttaactactgaattatag

SEQ ID NO: 47129 - DNA, 1383 bp, Glycine max
  Peptide Sequence Number=SeqID_163907
atgtcagggcctcttgatcggtttgcacgtccctgctttgaagggttctctggtcatgatgaaaggagggagaggaaatcagattttgagaactcggaagacgataggcgaacaaggattggtagcttgaaaaagagagcaatcaatgcttcaagcaagttcaggcattctcttaggaagaagagcagcaggagaaagactgcaagccgaagcaattcggtttccattgaggatgttcgagatgttaaggagcttcaagcagtggatgaatttcgacaggcgcttatattggataacttgttgccaccgagacatgatgactatcacacgttactgagattcttgaaagcaaggaaatttgatattgagaaagcaaagcacatgtgggccaacatgatccactggaggaaagaatatggtactgatacaattatggaggattttgaattcggtgagttgaatgaagtcctgcagtactatccacatggttatcatggtgtggataaggaaggaagacctgtttatattgagaggttaggaaaagttgatcccaataagcttatgcaagtaactaccatggaaaggtatttgagataccatgtgcagggttttgagaaaacgtttgctgttaagtttcctgcatgttctattgccgcaaagagacatatagattcaagtacaaccattttggatgttcatggtgtgggtttcaaaaatctaaccaaatctgcacgggaactcatcatgcggctgcagaaaattgatggtgattactatccagaaacattatgtcgaatgtttataatcaatgctggtcccggttttaagctgctttggaacacggtgaaatcatttcttgatcccaaaactacttcaaagataaatgttcttggaaacaagttccataacagattacttgaaattattgatgcaagcgagctgcctgaatttctaggtggtaattgcacttgtatggatcgaggtggttgtatgagatctgataaagggccatggcaggatccaaacattttaaagatggttcttagtggtgaagtacaatgttctagacaaatagtaacagtttctaatgatgaggggaccgtgatcgaatgtgataaggcatgttatccaatgccaataagaagtagtgatacatcaacagcagaatcaggatctgaagtcgaagatattacttctcccaaagcaagtgggaattatacaaacccaaggttaactcctgtccacgaagaagcaagattgattggtagggctagtggtttctctgagtatgatgagtatgttcccatggttgacaaggctgttgacctcgggtggaaggagaaacaagtaacaactcaaaactcatatggctcaacaggttag

SEQ ID NO: 47130 - DNA, 270 bp, Glycine max
  Peptide Sequence Number=SeqID_163908
atggttttctcgacgttgtcgcgcttctttatgaaggagaggatggtggcgtttaagggggagtcgcgggtgaggggggagggcgcggagatcggatcaggagaggaaatggaggaggacgtggtaaggaaagatgtcggcgagggcaggcggggagaggtggtcgtaggtggcgaggtaagtgttggggatgacgagaatggagagggaggagcgatccaaaagatctacgacgaggggcgtggtagaggcgaggagggaggtgaataa

SEQ ID NO: 47131 - DNA, 285 bp, Glycine max
  Peptide Sequence Number=SeqID_163909
atggttcctatacaagtcaacaagtacttggcatacagtgatggtatgagagtaattgaatcaggcaaattgtcaacacagttccctggtatggatggccgactattcactgaaatggaccggccaagtggtcaaccttgtgccgagaccacggagtttaatcttttacacaatatgttgaaagctgttgttgaagaacgctataaagatgctgccaatcatgtcccttgtgaacaggtttggtattttttacccttgttagttggagtagtatcagcatgctaa

SEQ ID NO: 47132 - DNA, 4125 bp, Glycine max
  Peptide Sequence Number=SeqID_163910
atgacttctcaacatataaattcaggtagatacacaatattcaattccaaactaatagagcacatctcgcatgacactgatgacgaactcgatataacacagggagacattgttacagattattcatttgacgacatagcaactgaggattttgctcataccgattatgatgacaatcttgaagcaccatatgacaatgaaaataccggttacaaggatattggagatcctatttggcaatgcaagcaatgtaaagcgaagatgtgcagagactcacaagctaagaaattccagcaaaacatacgtttatacaacctaatgtttgcattcacatctcctggtgtcaaagtaggcacatcctatagtactggaagaggtcctcctacattgcgcatacatggtcaatcgcatcaccttattggaagcctcctacctatgccggataactcaccaaagtttgcacaactatatatttatgacacggagaacgaagtcaacaataggctttcacaataccctataaaaaataatgttgatgaagacattataattggtatcaagaatatgctagatacccacaatccatatgcacaaaaattcagaatggcaagggataaactagactcttctgcagtgtgtgacctgaaactaaaactcattagtgataggcaaactgatggcagattatataatttgccaaatgcttctgaagtggctgctttaattgttggtgacaagcatacagcaaataacaaagatatcatcattgagaagcaaataggcatgctgcaaagaataaatgaacttcatcctgcatatttacctttgcaatatcctcttttgtacccacacggtgaagatggctacagaccaaacattcttcataagcatcatccgcatagccatgttgcaaagaggaacaaagttaccatgcgtgagtatttttgttacaggatgcaatcaagggataatgaagcacaaacaatacttcattcaagaagattgcttcaccaatgggttgttgatgggtattgtatgattgagtctcaaaaactaaactatgttagacaacatcaacaagaactccgagttgacaagtacatcaatttaaatgactgtaataatcagcccttaacccaaggtaatgaaaaaggtaagagaattatactaccaagtttgttcgttggtagtctgagatatatgcaacaattgtattttgataggatggcaatttgtgcccatgttggatttcctgatctattcttgacattaacgtgtaatccagcatggctagaaatacaacgacaagttgcaaagtcaaatcttacagctcatgattgccctgatgttgtgtcacgggtattcaaaatgaaactaaaccagttgatgcatgatcttaagagtggacatgtatttggtcccattcttgcattggcaaaaagaggattgccttatgctcatatcttaatctttttgcatccttcaaataagtatccaaatccagaagacattgacaacataatttttgctgaaataccaaacaaggacacagatccagaattgtatcaaattgtcaacaaccacatgatgcatggtccatgtggactagctaataaaagggcaccatgtatggtcaatggcaagtgtttcaggtttttcccaaaaaagtttcagccagccacaattgttgaccaagatggttttcctgtttatagaagaagagacaccagacggactgtgcaaaagcagggatctgatcggattacaacagctattgtcaatgaccaaaaccaggatggcacacacaatcaggttcatgatgaaattaaacattatcttgactgtcggtatgtgtcggctcctgaagcatgttggaagatttttgcattcccaatgcatgggcatgcaccggcagttgaacgtctttatttccacctagaaaatcaacagcctgtttactggaaagatagtgaagaaattggcacagtactggctaagagtacaatcaaagaatcaatgttcacaacttggatggattctaataaaatataccatcatggacgagatcttacttatgctgaatatgtgtccaaatttgtttatgatgcacgaaaaagatgctggaaaccaaggaaacaaggaaatactattggcaggctgatttgggtgcccccttccagtggagagttggtctacatgaggatgatgctttcctctgctaaaggatcacaatgttacgaagatattagaacagtagaaaatgttgtctatcatacatttagagaagcatgctttgcaaaaggttttctaggaagtgatcaagaatttgttggtgccttacgagaagcaaacacttggggaactccacactatcttaggaagttatttgtgaagctgctatttatgaataccatggataggccagaatatgtgtggaaacaaacttggcaatggatggcaaatgatattgtatttaatcatagaagacaaggcatccaactaatagacaaagaaaaaatgcatctttgtttgacgacaattgaaaacctcttgcaagccaacaggaaaagcctacgagattttccttcaatgccatacccactaggatatgccgccaacacgcaccaaaataatctcatctacaatgaattggcttacgacggggacatattggccgccgaatttgacaaatgctaccagtggctaacagatgagcaggcttctatttttaataagattatgcatgtggttgcaactcaatcaggtggagtttattttctatatggatatggtggcacaggcaagacatttgtgtggaaaactttatcatctgctatacgctctactggcggcattgttttaacagtagcttcaagtgggattgcctcaatactattgcctggcggtagaacaacatattctaagtttgctattcctgtccctgcaacaaaaaattctacatgcaatatctatcaagggagtgatttggctaaattgttgcatatcacaaaactcatcatatgggatgaagctccaatgtgtcacagatacaatattgaggcccttgacaaaagtttacaggacatcatgcacaatggcaatccttttggaggaaaggtcattgtttttggtggtgatggtaaacttgcagaaccaaatgatggttatggtgaaatcaccatcccaaatgagtttcttatcaaggactttcaagatcctatccaggcaattgttgaagcaacatatccatacatattacacaactacagcaatggcgatttattgcaaaaaagagttgtccttgcctttacaaaagatgttgttgataaaataaatgactatgtcctgtctttgattcctggtgaggagaaagagtattgtagtgctgattctgttgacaaatcagatgaactactcagtcctgcatttggagtactaacagctgaatttctaaactcattgaagatatcaggcataccaaatcacaagctcataatcaaggttggtacgcctatcatcctactacgaaatctggaccaagctgatgggttatgcaacggaactaggcttattgttacaagacttggttcaagtgttgttgaagcggcgattattactgggcccaacataggtcatagaacatacataccaagaatgaatctttctccttctgattcaccaaggccattcaagctaattagaagacaatttccattcatggtttcatttgcaatgacaattaacaaatctcagggacaatcgttggcacatgttggattgtatttgccaaccccagtttttctcacggccatatacatcaacactatgttgtatagtctcccacttcgtagaagatgttaccatcataatctttccagcaccatcaaaaacattctatcatacaatcagaagaatgagcccgtgcatcggcatgggcgtctctctagtgtctacaaagaaactcttctcccatatgggattttgggtgcaccacaatcatccggattccaaagagtagccaaaccaaaaacacatgggtttgatttcaattccaccataaacaacaagaagggtagagtagatggcattcaactcgataatgcgactctactccagatttggtga

SEQ ID NO: 47133 - DNA, 726 bp, Glycine max
  Peptide Sequence Number=SeqID_163911
atgcatgtagtttatgagtttaatggctatatcaatagatcagaaatcacccttaatttgacttttaaggtttggagaatgagttctgtgcaaggaccagttgtgtgcccttctgtccgtgccaaacaagtagggttctgcagcattccaatgattggggcagtgaaaatgaacgttagacgcatccgaagtgaattttggggtctcaatggcgccaaggctaaacccggttttctttcttgccatataaacacgcgaaagtgcaagactgtgcattgtacttttaactcaccctccaatgacagtggaagtaccgctgacaatttcaatgaaaaagatgaagattatgttatttctagtgtaattgaagctgttgaggtgaagagtggagcagatggtttcataatcaaaatgagggacggaagacacttaagatgcgtccataacaatccccagggaggacatcttccagattatgcaccacatcctgctattgtattgaagatggaagatggcactggtctacttctccctataattgttttggagatgccaagtgttttgctaatggcagcaatacgcaatgttcccatagctagacctactttgtatcaagtagtgaaggagatgattgacaagatgggttacgaagttggaaatgacgcagaatatgtgagctttgatcttcgaccttcagatgctatcaatattgcagtaagatgcaag

SEQ ID NO: 47134 - DNA, 225 bp, Glycine max
  Peptide Sequence Number=SeqID_163912
atggcagctcgcccaagcgagctgagacttaaccatgaagcaactggcttgcccaggcgagctggttacttaacatggaagtcttttggtagcccaggcgagccagaggctagcttgggtgagctagggcccaggaaactcaatgaaaagatccttttgcccccttcttttgtaactggtgtcgaacagtgcaatttggctagcgagaatcaaaaacatcaatga

SEQ ID NO: 47135 - DNA, 243 bp, Glycine max
  Peptide Sequence Number=SeqID_163913
atgacaaggaaacatggcattattatattgacattcaacatagaaattgaaacttttaattgccatgctcggtccctcaaaagaactaaacacaagaaaagtaaactcaccattgaatggagtatttccttacaaaacctgcttcaccaagaaactgatcggcgatcgaggaacaagaagtcaggaaccatagctgtcgtgaacgagagaaagtgcacagtgcggggtgaaacgagtcactga

SEQ ID NO: 47136 - DNA, 240 bp, Glycine max
  Peptide Sequence Number=SeqID_163914
atggcaccggaggacatggaaaaaaagacgtttgtcaccctgtggggaacattctgttacaaggtgatgtcttttgggctcaagaacgtcggggcaacctatcaacgggctatggtagctttattccatgatatgatgaacaaagaaattgaagtctacgtcgttgatatgatcgccaattctaaaactgaggaggagcatctcgttaacttgcataaactattcaaaagactacgttag

SEQ ID NO: 47137 - DNA, 219 bp, Glycine max
  Peptide Sequence Number=SeqID_163915
atgaaggtggttttggcggtgaatgaggacatagatgggtttgtgagtgggactgagttagggaactcatggactcggacaagggaaaagagagagtggatggaagctcttaacttgttgcgttccaaagtttgtatagctcgacttcgcaccacagaaaacgggtccccagcaggtaggatttacatatgcttccaaggaggcgaaggacactattaa

SEQ ID NO: 47138 - DNA, 1118 bp, Glycine max
  Peptide Sequence Number=SeqID_163916
atggccctcaccttcgagctctgccgcgccaccggccaccacctccgccgcatcctcagctacatctcccaaacctcaaacctcaaagcaatagtcttggacttcatgaactacagcgccgcacgtgtcaccaacacgcttcaaatccccacttacttctactacacttccggcgcctccaccctcgccgctcttctttatcaaaccatctttcacgaaacctgcaccaagtccctcaaggacctcaacacgcacgttgtaatcccagggttaccgaaaattcacactgatgacatgccagacggagcgaaagatcgtgaaaacgaagcttacggggttttttttgacatagccacgtgcatgaggggcagttacgggattatagtaaacacgtgtgaagccatcgaagagagtgtgttggaagcgttcaacgaagggttgatggaaggaaccacgccgaaagtgttttgcattggacccgtgatttcttctgctccttgtagaaaggatgataacgggtgtctgagttggttaaactcgcaaccgagtcagagtgttgtgtttttgagttttggaagcatgggaagattctcgaggactcagttgagagagattgctattgggttggagaagagtgaacaaaggtttctgtgggtcgtgaggagcgagttcgaagagggtgagtcggcggagccaccgagtttggaggagttgttaccagaagggtttttggataggactaaggagaagggaatggtggtgagggactgggccccacaggcggcgattctgagtcatgactcggtgggtgggttcgtgactcactgcgggtggaactcggtgttggaagcgatttgtgaaggggttccaatggtggcgtggcctttgtacgcggagcagaagctgaatagggtgattttggtggaggaaatgaaggtggggttggcggtggagcagaacaataacgggttagtgagttccaccgagttgggtgaccgagtcaaggagctcatgaactcggataggggaaaagagattagacagaggattttcaaaatgaaaaacagtgccaccgaagcaatgactgaaggtggatcctcagtagttgcattgaatag

SEQ ID NO: 47139 - DNA, 177 bp, Glycine max
  Peptide Sequence Number=SeqID_163917
atggtttttgtgtgcggcaagagaaacgatgacaagcaaatgaaaaaagaaataacgtcattagtggcgagattattgccttatattgacatcaatagaacgcatgaagctatcgagaagcaaaacaatgaagagatgccatgtatcagtgcatacagggtatatggtacaaattaa

SEQ ID NO: 47140 - DNA, 1355 bp, Glycine max
  Peptide Sequence Number=SeqID_163918
atgaaagattccattgttctatattcagctttgggaagaggacaccttgtttcaatggtggaactaggtaaactcatactaagccaccacccttcactttccatcaccattcttttcctaaccccaccccccaaccaagacacccccacctcccccaccgccttcacctgcgacgccaccgccaaatacatcgccgccgtcaccgccgccactccctccattgcctttcaccgcatccctcagatctcaattcccaccgtcctccatccccatgccctcaacttcgagctctgccgcgccaccggccaccacctccgccgcatcctcaactccatctcccaaacctcaaacctcaaagcaatagtcttggacttcatgaactacagtgccgcacgtgtcaccaacacgcttcaaatccccacttacttctactacacttccggcgcctccaccctcgccgttttccttcagcaaatcatcattcacgaaaacaacaccaagtccatcaaggaactcatcataccagggttaccgaaaattcacaccgatgatttgccagagcaagggaaggaccaggtttttattgacattgccacgtgcatgagggacagttacggggttatagtaaacacctttgatgctatcgaaagtagggttatagaagcgttcaacgaagggttgatggaaggaactacgccaccagtgttttgcattggaccggtggtttcggctccttgtagaggcgatgataacgggtgtttgagttggctcgattcacaaccgagtcacagcgttgttttcttgagtttcggaagcatggggagattctcgaggactcagttgagagagattgctattgggttggagaagagtgagcaaaggttcttgtgggtcgtgaggagcgagttcgaagagggtgactcggcggagccaccgagcttggacgagttgttgccagaagggtttttggagaggaccaaggagaagggcttagtggtgagggactgggccccacaggcggcgatactgagtcatgactcggtgggagggtttgtgactcactgcgggtggaactcggtgttggaggcggtgtgtgaaggtgtgccaatggtggcgtggcctctctacgcggagcagaagctgaatagggtgatattggtggaggaaatgaaggtgggtttggcggtgaagcagaacaaagacgggttagtgagttccaccgagttgggggaccgagtgatggaactcatggactcggacagagggaaggagattagacagaggatttttaagatgaaaatcagtgccaccgaagcaatgtctgaaggtggatcttctgtcgttactttgaatcg

SEQ ID NO: 47141 - DNA, 564 bp, Glycine max
  Peptide Sequence Number=SeqID_163919
atgcacaactgccccaagtttggggtatcacggtataaagtcaaggatgatgacgagtgtagcagtgatgaaaacaccaagaaaggccccccagcgaaggtgttatggttcttgagcgggttaacgacattaatagtgtatttggaaagacccaaaagatggaaaaaagtaaaacttccatatggaagaagagatgttagacattgtattgatgttatacgtgttgagaaaaatgtatgtgatagtgtcatcggcatgctttttaacattcaaggcaagacaaatgatggtttgaatgcttgcaaagatctagttgagatgggtatacgagagcagttacatctaaggtctgatgttggagatgtattttcctccttcaaggttcacttaattgttcatcgagtgaggaaaattaaatgttgcagtcctgtttatttgcggtggatgtacccggttgagcgatacattaagatcttaaaagggtacacaaagaatctacactgtcctgaagcatctattattgaaaggtacattgcagaagaagctattgagttttttttctga

SEQ ID NO: 47142 - DNA, 235 bp, Glycine max
  Peptide Sequence Number=SeqID_163920
atgacgttagtctctgcgcgtcaacgagctcgtttgcccctggtgcagaagacgacgttagtctctgcgcgtcaacagctcatttgcccctggttgacgaaaggtgtggataaccatatggtgcggataaccatacggtaccgccgcatgtcacctgacttcacgggtcaggatgatagaaaccatttgtacggatacccgcttgggtatcttcgtacgtcacctgacttcacag

SEQ ID NO: 47143 - DNA, 510 bp, Glycine max
  Peptide Sequence Number=SeqID_163921
atggttaaggaagagtgtaaggaggtaagtgtctcctccaagaggttagctaagaaggaaaggcattttgaaataaagacaaatattaaagaaatttcccctcttagacaacctccacattttctcctttgtaaaaagacacttgttagcattgccacacctcttgggcttgagtttattcctcaagtaaaggagttgttggatgagggtattattatgcaccaaatccctaaaataggtggtatgatgaatgttttgagtggtgcaaccctcttttgtaaaattactcgagcacccaacatcttcatgatttttgtacatagggactcattagatagtgatcaaagggttctcatgaaccctaagagaataaaggtcattcttgagtggcccattccaccaagtgttgaggaaaaaagtccagagtttcaagaacctcgggatttgaggtcaaatccttttcaagggggagggaatgatgcaatcctaccccacaagggcattggatag

SEQ ID NO: 47144 - DNA, 384 bp, Glycine max
  Peptide Sequence Number=SeqID_163922
atgggctccagtgccgcctcagagtttgatagtcactgttttcggtgtgtcgagcaccagcagcgcttcgaggccatcaagggatggtctttccacagggagaggcgtgtccagctcagggaagacaactatcctgacttccagggagatatctctcgcagacattgggcacgactagtgacccctttggctaaatttgacccggagatagtcatagaattttatgctaatgcctggcctactgaggagggggttcgggacatgcgctcacgggtgaggggtcactgggtcccctttgatgcaaatgtcagtagccagttcttgggcgacccactgattttgaaggaagaccagcagtgtgaattcagccagaggaggagctag

SEQ ID NO: 47145 - DNA, 453 bp, Glycine max
  Peptide Sequence Number=SeqID_163923
atgggtcagctccagcgacaagcttttcgcaaagcttacggtaaaatctgggacttagccatggtagaagtctccacagaggccattgcctccctcgcccagtattatgatcagccgatgaggtgcttcacctttggggaattccagctatcacctatggaattagaccatggaaagcaagtcagaaatggggtggttggaataccgagaaaatgtttggaggcaaaagcaagagccttggcaggtagaggcgaatgggccccgttcatagacattctcgcactgttgatcttcggaggagtcctctttccaaatgtggatgggttggtggatctagcaacgatcgacgcttttctcgcctatcatgaccacaaggaaagcccggttgtcgctatgctagccgacctatatgacaccttcgaccgaagatgtgagaagagcagtacgaggatt

SEQ ID NO: 47146 - DNA, 237 bp, Glycine max
  Peptide Sequence Number=SeqID_163924
atggttgactcaaacatagaggactcttgtgttctatcagaggtattgcgttgcatccatgtctgtctcttgtgtgttcagcaacacgcagaggataggcctcttatgccttccgtggttctaatgttggggagtgaaagtgaattggctgagccaaaagaacctggtttctacataaagaatgatgaaggtgaaaaaatttccatctcagcaagtgcaccaattcttcccaagtag

SEQ ID NO: 47147 - DNA, 228 bp, Glycine max
  Peptide Sequence Number=SeqID_163925
atgtttcacgagctgagtcagtttcttaagcagcggctgaaaacgctggacagcacgccatcgccggcgctgctgcatgagcttgatgtgttgctgctacggctggaggcggcggcgcagcaggaaaatgcgctgtttgcgccgctgtttcatctgtttaatatccgtttgtcgctctttcctggcgcgcgctggccgcagccgctggcagagcaaaaccgcacatag

SEQ ID NO: 47148 - DNA, 225 bp, Glycine max
  Peptide Sequence Number=SeqID_163926
cacctattaggaagaacaacgtgttctctacttgtaccctctcttgttctcggtataacaatccccaagtagatgtaccctctacttgtaccacaaaggatgtaccttcaatgtgttgggacaaagaattctcaggcagggaaggaaagaatcaaaagaattctcaagcggggtcctttgaattctctcggaaagggagaagaaagacacaaaagaattcaggcg

SEQ ID NO: 47149 - DNA, 210 bp, Glycine max
  Peptide Sequence Number=SeqID_163927
atggatgggattctcatttctagtgtggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgagggtgcatga

SEQ ID NO: 47150 - DNA, 510 bp, Glycine max
  Peptide Sequence Number=SeqID_163928
atgtgtcacctaactgcatatgtttgtgtttactacgacggccaaatttgcaatactaatgagggcaccaccttcgttagtaacaacacaaaaactttcatggtcgacaaggtcataacctttacacaattgcttgaacttgttcaccaaaaactaaacattgacccagaacaacatatccaacatctccattttcggtgccctatatttgagtcaggacaacgttatatgtacacatcttttattctgcgagatgatgctgatgttcgacaaatgttcaacatttttgacaacaatccatcactaccatttgtggagttatttgccataatctgtcacaataatgacccaccgggcaaccaacatggctcaacctctaatcttgaggacttaggtgaatacgagacttgttggctcaaaaaccatgatagtgatacggactcctcttccgggcccgaaggaagtaacctgtctccatcccacgaacctatattcaaacgggattggtaa

SEQ ID NO: 47151 - DNA, 235 bp, Glycine max
  Peptide Sequence Number=SeqID_163929
tcccgaacccgtcggctgtcggtggactgctcgagctgcttcgcggcgagagcgggtcgtcgcgtgcggtcgggggacggattgggaacgggccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 47152 - DNA, 204 bp, Glycine max
  Peptide Sequence Number=SeqID_163930
atggagaattgcactaagcaatccctacgcatgactcctaactcgtgggtggaggacgcacgaacgaaaacacaattcatggggctccgaaaaaggggtagagaatggagaattgcaataagcaatcactacgcatggctccaaactcgtgggtggaggatgcatgaaggaaaacgcaattcatggtgctccgaaaaaaagtag

SEQ ID NO: 47153 - DNA, 433 bp, Glycine max
  Peptide Sequence Number=SeqID_163931
ggctgttcatgtgtcctccactttcgagtttggagctgagttttatgattgcctaagtgcggaccctcaaggcaatcctccatactccacctttgttccggagccacatgaatgttattgcctagcgctgttcatgtgtcctcccttgtcaagcgcgaagtctctggtgactgggaaacacgttattctgttgtttccggatcggttccttcgccaaaagaaaaaaaagaagaagaagaagaaggagtggagacgagagtcgtcatcacagaaagggcaggacggacgaaatcagtgtcctatctttgctttcctcttatctccgatgagaggaagcaggcttgcgcgatccgtgaaattccgtaatgtggcggaagtcaaaaagaggtgtttttgcgcaatccttaagttccgtaacttcttcgaaagctaa

SEQ ID NO: 47154 - DNA, 842 bp, Glycine max
  Peptide Sequence Number=SeqID_163932
gcttgcttgcccgctagaaagtcaccgttcatgcacagagaaaggaggggcaaattgggaccaactcttagcaaacaaagaaggagtgtctgtcaactggggttgcatcagttacgatcccgttcttgctataaggcaacttggctaccctatgagaggggcaccactagaggaagagattgcgcctgtcatttcaagaggtttcaataagacaagcgtggagacacttcagaaggtctacaaggcatgggaggtggtgcgaaagaaggacaaagaactcaggggcggtaacaatgggcccatcggtggctaccgtaaaaccgctaaaagggaggaagttgaggcaccggaggaagacgaagaggtgcaggcccttaggacagaactcaagcaagcccgaacagtcaaagaaaggttcaaatcagtagctcttaatatccgaaaggagaatgccgaactaagagatataaatatagctaccaccaaggccttggaacaagagaccaagagggctcgtagggaagagcacggccggaacaagttccgaggggctatgtggggcaagaccaacatgttagctatcgttagcaagtaccaagaagaactaaatctagccacggaccacgagcatatagtggaggacgagtatgcccaagtgtacgctgaaaaggaggctagaggatgggtgatcgactggttacatccagaggcaaggatgtggatggaccgatttgctcttaccttgaacgggagtcaagaacttcctcgattgctagccaaggccaaagagatggcggacacctactccgaccccgaggagatcctcagacttcttgactatt

SEQ ID NO: 47155 - DNA, 1188 bp, Glycine max
  Peptide Sequence Number=SeqID_163933
atggaaaaccagttctttctggcttctggggtgtcacaaacacaacaacaccctcttcactttgaaccttcaccaccaaatccttcttcagtgccctcttggcaatcactctcacccccaaacatgggaattcaactaacagttatgaattgtgcccctgagcaaacccaagattgcttttacaaccccaattgggacaagtcaacggcagatcatggccttcaccattttgattcctcagcactgagttcaatggtttcatcaccagcagcatcatccaaccccaacaacaagtccaatgagaatttcatcatcagggaattggtggggaaattgggacctattgggagctctgatgagatcccacaacactctcctcaccctttggttgtggcatcttcttgcatgaatagtaatggcaataacagcacctacacttcatgctacagcacccctttgagctcccctccaaaggtgaacattgtccacagtttggtgaatgagaggttggcaaatttgggaggagggaagtcaacaatggctttgaattccagtgtggctgaattctcagctgatcctggctttgctgagagggctgcaaagttttcttgctttggcagcaggagtttcaatgataggagtgtccaattgggggtgaacaatgctgaattggctcaaagatctgcaccagcaatggaacatggtgggaagttgcctagagtctcaagtagtccattgctcaaaacacttggatctcaaatgggtgcccaagagaacaagaattcagcaattcatcaggagcaggagaaaatggaaggggccaattctcaagaggaatctacaatttctgagcaagccccaaatggggaaattggggtgaaaacttcacaggatatgatgaattccaggaaaagaaaagcttcttcgaaaggcaaagccaaagaaacttcaaactcttttaatcctaccaagggtgttgaaggtagtgaggattcaaattcaaagcgcagcaagccaaatgagggcgacggaaatgaaaatggccaagtgaaggttgaggaagagtccaaagcagaggaagagaaacagaacaaaagtaactcaaaacctcccgagccaccaaaagattacattcatgtgagagcaagaagaggccaagccactgacagccatagtcttgcagaacgt

SEQ ID NO: 47156 - DNA, 204 bp, Glycine max
  Peptide Sequence Number=SeqID_163934
atgtgggaccttgtcgcgcgtgatagatgggtcatttttgctgcattctctactctcattgttgttgtagttttggagatttcgataccgcatttcttaacagcatccagcttcacagcacagagtgcaaaccttgctatttttcacaggaatgtgcagttgttgattctgctatgcgtggcttcgggaatatgcggttgttga

SEQ ID NO: 47157 - DNA, 597 bp, Glycine max
  Peptide Sequence Number=SeqID_163935
atgggaggatgtgtgcaaaactgcaaaagtaagaagttgggtggtttaggagtgaaaggtatttcgttgtttaatgaggctttattgggtaaatggaggtggaacctttttcatagtagtcctggggtttggtgtgttgttttatccaccaaatatgatggttggcatggtcttttgagggaggaaaggtcttctttggatagtttgtggtcaagagatttgaagagggtgtgtgacagtcttaatgattattcctcattttggagcacaagctggaggtggcgagggatatgggtttttggagaaatgatcgttggtgttgggactgacaacattcaatggatatgcataccattttctcaaaagtgtagattttcttctgattttgcttttcttacacccgagtcactacatagccacttttgggttttctcgagtgggcaaattaacctcaaggggtttcatttagaaactaattcccacatagggtctgttttgaaacattttgtggaggggggtgcagtggctttcgccaacccggttgacgaaataggtgtggaattggaatatttggtgattgctgctggacgagggtaa

SEQ ID NO: 47158 - DNA, 404 bp, Glycine max
  Peptide Sequence Number=SeqID_163936
atgcactttccggtaatccacttccgcgtaaaaagagtaattacaaattttggaaaaaggaactgtggaaaagggtcaacaagggccgaaagggacgagtcgagggtggaaggaatgatattagaggacaagttgaaggcttgtcaaaggtcgaagaggagcttaaccgaacagttgagtaggacggaagagaacatgtgggctatcattggccagtataaagaaaagctaaatctagctgctatccatgagcaaaggctagaagacgagcatgcaaaagtatcagtcttgcaagcggaaagggaagcaagggagagagtgatagattcattacatagaaaagctatgatgtggatggataggttcactttcactttgaatggaagtcaagaacttccaagact

SEQ ID NO: 47159 - DNA, 426 bp, Glycine max
  Peptide Sequence Number=SeqID_163937
atgtctccttatcgggttgtctttggaaaggcatgtcatcttccagtggagattgagcataaagaatactgggcagtgaagacctgcaacttctctatggatcaagctagtgaggaaagaaagttgcaattgagtgagttagatgagatcctcctagaagcctacgagaatgccaagttctacaaagaaaagaccaagaagttccatgatagcatgataattaagaaggacttcacagttgggcaaaaagtgttattgtataattctaggcttggactcatgagtgttgagatcaaaagcgactccacaaacaagagcttcaaggtcaacgaacaccgacttaagtcattcctcacaaacccttctttagtggacgtagtggtggaagagacttccttactccaccctactcttcctccaccatga

SEQ ID NO: 47160 - DNA, 564 bp, Glycine max
  Peptide Sequence Number=SeqID_163938
atgactgttcacgtggcccagataattgctgacgccatttatttgtttgcagggacggtgcccactaggcaccctttggacccggagaggtccaacagggccttgggattttcggccttgatcacgggcctctgccagttctacggtgtacttgtcatccccagcaaggtaatccggacgtcgatcactcaagctttcatcgagaaatattgcacccctaggcaagtgaagggtgacgcacaacaggctgcggatgcaccaccacctcagcagcccgatccggttataccactaagtgtggagcggtatctatggcatttggttcgccagcaaacggccaaccaccacgggcaggggcagggctcccctccttttgtatgccctaccccagagcagttcagggctgaggtcacatggcctggagattggccaactgaggagggaaccggacccgcagcatccccgggcgaagcggaggaagcccacatggatgaggatatgaccgacctgctcggttacctgggagggggcggagctacacgaccaaggtcgccgcacttgtga

SEQ ID NO: 47161 - DNA, 270 bp, Glycine max
  Peptide Sequence Number=SeqID_163939
atggcctttttccaaatctacttggactacaaggctcaaaacgcacaagtgactaatgctctcggaaacggaagcgtcgcgtacacttcagacgtcttctcaaagatcccaatggtcagatcatggacaaatttttttgaagctccaaaccaaatttcgggaagatccaacgtgactaggaggtggatctttcctatggaagcattgtggaaagacatgcatagacatgaagatgtattttcatgtgagaaaatcgcaagtgcacggtag

SEQ ID NO: 47162 - DNA, 537 bp, Glycine max
  Peptide Sequence Number=SeqID_163940
atgatagatgtccggtctcaagcaacttgccacacagaagtcgaggaggcaatggcaaggatgaaggccttagagaaaaatgagtcaagaggatatgatcacaacaaatataggagagaagaagaggtcattgacccgacaccactgatcgtgccaagagagcatattctaagggaagtttacagtgcaaacttgataatgtacccaacaaaaactgagtggcaacttggctcggatcaatccatgtggtgtgagttccaagagacatacaagcatgaaactaaaaagcatggtgatgcaatcctcactaggaagggaccagtcaccagagccatgagcaagaggctcacaaaggattgggctagagctgctgaagaaggccttagggttctcatgaacctcagggtcccaaaggattcaatgttgccacatctaggggtattggtcggctttgtaggggtcaagactgaggttcgaggttatgtggatctcgaaacaactttcagcgatgaaggattcaaaaccctcacaatttga

SEQ ID NO: 47163 - DNA, 357 bp, Glycine max
  Peptide Sequence Number=SeqID_163941
atgagggtaaagatcagcacaacccttatgcctcagcttgaaaatgacattttagaagtgctgaagcataactcgagtgctttcgcatggagtttgagtgacatgttagggatagacccgaatttcctatgccacaagttggctctagatccctcgacaaagcttgtgattcagaagaaaaggaagtccagaaaggataaaataagagcaattgttgaggagactcgtgttaactcattggcaaatgtaccaatttatcaaagtttttatgatgccaagataaaatcaacacaagttttatttcaagtccaaatcaagaccaagaaaacaaagatcaagaagaaagctaagtcttag

SEQ ID NO: 47164 - DNA, 318 bp, Glycine max
  Peptide Sequence Number=SeqID_163942
atgagggaggcacatgaaataccccaccataatctagccgacttcgagccttgcctcaaatacgccactgaaggacaagcagttggtggtgtacccctgccaaacactttggaggaccctcaatttctcctacaaccacaacccttgcatttcgtagtagggagagtccctactgctatggtggaaaagggaaagttggatcatatagaggaaaggctcaaggccattgaaggaggcggagattatgcttttgctgacatcgtagagttatgcctagtgcctgatgtagtcatccctctaaagttcaaggtgtcgtag

SEQ ID NO: 47165 - DNA, 237 bp, Glycine max
  Peptide Sequence Number=SeqID_163943
gccactgaagaccgctctccatcaccatattctcagagagatgactcttcatctcttatgcacgacattcttgaaaggtttggtggacttcaaacctatgttggtgggaggtttgatgctttggaacgacaagtggacacacgatttgacaaaatgaactcaaggatcacaaaggttgaagaagatgtcaccctcattcgcgactgccttgatttacctccaccaccatcagtttag

SEQ ID NO: 47166 - DNA, 354 bp, Glycine max
  Peptide Sequence Number=SeqID_163944
atggccgaaatgggaaagttggatcatctagaggaaaggctcagggccattgaaggaggtgaagattatgcctttgctaacctaggagagttgttcctagtacccaatatcatcacccctcccaagttcaaggtgctggactttgacaagtacaagggaactacttgccctaagaaccatctaaagatgtattgtcggaagatgggggcatatgcaaaagatgaggaattgttgatacattccttccaagaaagtcttactggggtagttgttacctggtacactaacttgaaaccttcccgagtccattcttgggaggacctagtggttgtttttgttcggcagtgtcagtag

SEQ ID NO: 47167 - DNA, 381 bp, Glycine max
  Peptide Sequence Number=SeqID_163945
atggccacaccttttaaaacaaaggatgtcaatgaagaaataaccccgaaggatattagaagcctaatggaacaagctaattacaccaacaaataccttcaggtgttaggagaatctattagtaaagaaaagatctttactaagcccaaggaccacaagttgtcaacatcacatgttccaatagaaaaacctttgttcaaaccttttaaggttagcgaaaaaacaaaacagaaatttagggaacttgggaaacaaaaatcccctacagaaaagataggtgatagcaatagtgaattattaagctcagcgcaacattggtgcttagcccaaatccacttactcgtgctaagcgcgacaactgcgctaagcatgacgatgtga

SEQ ID NO: 47168 - DNA, 195 bp, Glycine max
  Peptide Sequence Number=SeqID_163946
atgaaaaggaagagtttttacctgcactttgaagggtatgtgatggtggtgacaaagataatagcaaaaatgagatgcggtggcagagatgtggcaacaatagggtttcgagggatgagcgagggcaagattgagagggagttaggaaaggaaataagggagagtgagagggagttcaaatttgtaacgtcatag

SEQ ID NO: 47169 - DNA, 624 bp, Glycine max
  Peptide Sequence Number=SeqID_163947
atgtacaattatcatgagaaaggaagagctcctaatcttgaaagtgtattggcagacttcatgacatatcaagctagctctaaaggtgattgctattcaatgcaacagcagggaactcagtttgaaaaagactattcttttgcagattatcaatgggagtcagaatggcaaccttattatcacaatgaagcagaaggattgtctaatctagatgacctgttaatgcaattcaaaggtacagtagattcaatgcaacaagcatttaaaagagctgagactcagattggtaagttggtagacaaaatgactaaagttatggtcaaaagagaagaagagtatgcagagattgaaacacatcaagaaagcattcttcaagttaacacaatacataatcaattgatcaccaaagaagaaaaggatgaagtctccattattccagaatatccctgcatagcaactattggatatgttgtaggcaaagataaaggtcgattggaactcagtgtagaggatcagaaaatctcctttgacctctttgaagcaatgaaacacccaaatatgagtgatgcctgttttgaagaacaagaggtggagcaggagatagcattatcagcttcaaccatg

SEQ ID NO: 47170 - DNA, 255 bp, Glycine max
  Peptide Sequence Number=SeqID_163948
atgggagaagcttgccacccagctcgcccaagcgagctagcatgtcacggaacttcacggattgtgctacaatgccttcttttgccttccggcatgtcacggaacttcacgaattgcctaacgatgggtaccaagtacctcgaagtggtcaaaggagggtcgcatcccaacaacggatggtcccggacgaaattagggtatgacgagcctcataaaggtgcttggtgcattagtgagcccaaaaggcatcactag

SEQ ID NO: 47171 - DNA, 751 bp, Glycine max
  misc_feature (556)..(556): n is a, c, g, or t
  Peptide Sequence Number=SeqID_163949
tggtgaacaagtgccggaagtgtttgtggtcgatctgcctgaggcgctggcggactatgccagagccggcaatgcgccgctgcagggcacggcagagcaactgccggcaccgccggctggcgtgcagcagcggcgcatcacgtacggtaaagggctggcgctccagccgcgccactggttgcgcgctgcgccggatggcagcgcgatcgcctttttacaggctgacgagcagggcattgtgcagctgtggacggtctcacccaacggtggcgcggcgcgtcagatcacctcactgcgcagcagcattcagtctgctttcagctggcagccggacggcgcagccatcgcctttatctgtgataacagcgtgatgcgttgtgagatcgccagcggacagtgtacgcgccttaccgcgcgcagcgcgcaaccgccgggcggcgacgcggtggtatggtcgccggacgggaagcagatcgcctacatgcgcgaggctggcttgggtgccagccatcttctcgctctgcagcacgcgttcgcgcggcgaatctttggtttnatcgtcgtcggcgcggaagtaatcccacggcagcagcagcgtatccatcactgccgagaagggcagatcgatcagcgccagcggtttaatcgcccagctggtattgtcatcggtcagcatctctgcgctggcgcgcgtgccggggtagtaaccctggctggcaccggtatgcgacatcacgctggagcagcctga

SEQ ID NO: 47172 - DNA, 465 bp, Glycine max
  misc_feature (361)..(361): n is a, c, g, or t
  Peptide Sequence Number=SeqID_163950
atgggggacgcctcgcctgacgggaaggacataaccacagagttatgcggatgtcaggtgacacactccagccagggccatgccatgactgtagggatgatgatgatgaaaatgatgaaacgctttccactcaccggcctgctggtctgctgcgcctgtgccacatcaggctgctccagcgtgatgtcgcataccggtgccagccagggttactaccccggcacgcgcgccagcgcagagatgctgaccgatgacaataccagctgggcgattaaaccgctggcgctgatcgatctgcccttctcggcagtgatggatacgctgctgctgccgtgggattacttccgcgccgacgacgatnaaaccaaagattcgccgcgcgaacgcgtgctgcagagcgagaagatggctggcacccaagccagcctggccaccgcggcggctatgccggcggaatcgcactga

SEQ ID NO: 47173 - DNA, 390 bp, Glycine max
  Peptide Sequence Number=SeqID_163951
cactccttctaccttctcctatcaagggaaacatcccttagcactgccatacctcttgagcttgaggttattcctcaagtaaaggagtttttggatgagggtttggtttgtaagagcttaaatccttgtgctttcttggtgcccaaaataggtattatgagccaccaaatccctatgataggtggtatgatgaatgtattgagtggtgcaaccctcttttgtaaaatcacccatgcattcaacatcttcatgattcacatacataggaactcattaggggttcccatgaacccaaaaagaataaaagtcattcctgagtggtccactccaccaagtataaggaaaatttggggcttccatgacttaacaaactttcacaaaagatgttga

SEQ ID NO: 47174 - DNA, 611 bp, Glycine max
  Peptide Sequence Number=SeqID_163952
atggacttcattgaacaacatcacaagaaagagaaaccagaagctgcgtttccaagttggttttcgacgcatgagaggaaactgttacagtcttcaacgataaaggcacacattgctgtggcgaaagatggttcggggaatttcaagactgtgcaagatgctctcaatgctgcggcaaaggggaaagagaaaacaagatttgtgatacatgtcaagaaaggagtaaataccataatcaccagtgccagaagtgttcaagatggttataccacctatagctcagcaactgctgggatagatggccttcacttcatcgcacgcgacatcactttccaaaacactgccggtcctcacaaggcgtggcatgatgggttaccaagacaccctcatggctcatgcacagcgccaattttatggccaatgttacaccttcatatttgcccgagaactttccaaaatactgaaatttcgatccacaactctcaaatccgggccgcaccagacctcaggtccgttgttgacaaatacaacactttcttgggtaggccttggcaacaaaactctagagttgtggtcatgaaaattcatggacacattggtgaacactttgg

SEQ ID NO: 47175 - DNA, 582 bp, Glycine max
  Peptide Sequence Number=SeqID_163953
atggtgtgcgttttgacaaccataatctcccttacactgctcctcctcctctacatcaaacattgcaacgacaacatcacatatggcagaggtggaaactcgactccgtggatggtagcgttgtttgccggaaggaaaaacttcggcattgatcagtctgtggtggaatcattatcaatcttcatatttggagtgctgcaggggcaaaaggaaggactcgattgcgcggtgagcctgaacaagttcgaggccacggagtgtgtggacacatggctggatgcgaattccatgtgtcctctctatcgctaccgcgtggatctagaggacattctcctagtggaggacacaaagcctttccaccaaactcatcaacaacggaacaacaaacatgaatgcatgcgtttgacttcgaacctggagaagcaggagttaatggagtctcgacggaggcatttgcccgttggggtggaggaaggagaaaaaagggaggaggagcagcatagtcggaggtggatgacattgtttagaaggttgttggatagcattagtgccacattgagaaagaagaacgttttaagataa

SEQ ID NO: 47176 - DNA, 573 bp, Glycine max
  Peptide Sequence Number=SeqID_163954
atggatatccaagccgcatacagttgccttttgggtaggccatggatccatgaagctggggccgtgacatccaccttgcatcaaaagctgaagtttgtcagaaatgggaaattgatcactgtgaggggagaggaagccttgttggttagtcatttgtcagctttttcctttattggtgctgatgaaacagaaggaacctctttccaaggcctgactttagagggtaaaaagccggagaaaaatgaagtatcttttgctacttggaagagcgcacagaaagtggtgcaggaaggaacaggtgtaggatggggaaaagttgtgcagttgctggagagtaaaaaccgtgaagggctgggatttgcttcttctgcaggatccgcaacgaacagtgttggatcaagctccattactagcaccttttgtagcgccgggttcatcaacaactcgccagaagccaatgctgccttggaagatgctcctgaagagatagtgcttgcatttgtcacacctggaaaacttgttcgcaactgggacgcggttgacatcccttcagtggttcatgcatcaaagtaa

SEQ ID NO: 47177 - DNA, 826 bp, Glycine max
  Peptide Sequence Number=SeqID_163955
atgggaagaagtgtcattatagatggttcaattgtctacaccgattcgagcgaaatattgagcaatcctggtttcgaaaagttattaagggaatatatcgattttctgaaagagaaaaatagccccttgttaagaacattggaagcattcagaataggtgaagaatacaatgtaaggcattttattgagtatctccatttactcactctaagagatgtaaaagaaataacaacaatcataaattacgttaatcctgaagatttagcaaaatttatagaatctttctattctttttggagaaacaagcacaggtttatgataaaaagagaaagttacacaatcgataacgcacgaaaaacaagtatagtattcaccgcaactatgattgcagaagaattcaaaaaccttgtgagaaatctttacagaacaattatgaaaaatattgaaccagataattcaaacatagtaaggcaattaccaagtggtgctcaagtaacgtttttggtagattcttttgactgtaacgacgaaagattttgtaatttttcgaacattccaatggtttggggcgcgatttttgacccacctgtgatattttacacaagatcaaataaaagaaagggtgtattacctgttgttgagagaaatgttctaagtgatttgaaacttccaaataaggaaaaagattggtatttaatcccaattttagtcgctgatttacttatgtttgtttatgtaaacaaagaatttctatcacatgcagcaggtcttggtaatctcttccagtttgcaaatattatggatctaaaaaagaaagaagtatcag

SEQ ID NO: 47178 - DNA, 513 bp, Glycine max
  Peptide Sequence Number=SeqID_163956
atgttgttgaagtcattggtgaaaaggtcgttcaaatacaccaccaattcaggtgctggacgatccaagaggcatgtagtggaatacacagtatctaatatctccgagatgacccttaagacattgggtccagaggaacaacccaagtctgcaatgcccatcttctcaggccaattacttgagcaaagaatttgcacaatagctttctttgttgctggctctgcgcaagagattatcgtattctgcaaaattcacacaaaaacatttcaaagaaatgaattaaacatttactatgagaatggcaacctgaacggaagagttcacggcatagctagtttcgcccgtgcctttgttcatgtgaagtacttccgacgtttccatttgtttccttcgagctgtttgcatggtaacaagtgttactatgttggagttggacttgaagacgaaaccaaaagggaaaatgaaaagttgatgaatgattccttctatccggggaagtgccttaagaggtag

SEQ ID NO: 47179 - DNA, 681 bp, Glycine max
  Peptide Sequence Number=SeqID_163957
ggacagacgatcggcattgtcggcgaatccaggtcaggcaaatccacgctcggtcgcgctctgctgcgcctgatccaggccgatggccggattttcttcggaaaacaggaaatcaccgggcttgatcgaaaggccatgcgaccgctacgacggcatctccaactggtgttccaggacccctatggttcgctttcgccgcgacagacagtaggcgagatcatcaccgaggggctcttcgtccacgaccagaacctcaaccgtgcggaacgggacaggcgcgcaatcgaggcgctgaaggaagtcggcctcgatcccgccgcccgcaaccgctatccccatgaattttccggggggcaacgccaacgtatcgccattgcccgcgccattattctcaaaccagaggtcatcattcttgacgaacccacgtcggcgctggaccggtccgttcagggccaggttatcgacctcctgcgtgatctacagaaggcccacggcctttcctacatcttcatcagccacgacctgtccgtcatcaaggccatttcagattacgtcatcgtcatgagagacggaaagatcatcgaggagggagagacaaacgccatcttcaaccggccttcggctgagtacaccagagcactgatcaaatcagctttttcggcggcggtggaagataattaa

SEQ ID NO: 47180 - DNA, 285 bp, Glycine max
  Peptide Sequence Number=SeqID_163958
atgtcatcagactcgccgtctctggatgacaaaggtgcagaagacgacgttagtctctgcgtgtcaacgggctcgcttgcccctggttcacaaaaggtgcagatgacgacgttagtctctgcatgtcaacgggctcgcttgcctctggttgacaaaagggcgtctccgcgtaccaacggactcacaggtcacgtagcgaaaggtggggtggtcgacaaaagcgaggcttttgctcctacgtatcctcaatttgtgatgaggaactcagacctacgtagttcttga

SEQ ID NO: 47181 - DNA, 360 bp, Glycine max
  Peptide Sequence Number=SeqID_163959
atgtaccctcccttgttctctttgaacaacctagtggatgtaccctccactagaactgatccacaagagatgtaccttctcttgttctcagttacaacaacccaagtagatgtaccctctacttgtaccacaaaggatgtaccctccaatgtgttaagacaaagttctcaggcggcaagaatcaaaagaattctcagactgtgtcattttgaattctttaatgtcgcaacatgccctttcgggggcgagcgaggcgaggctcacgggtgcgctttccaaaggaggaaagatgcgcggagtcgccaccaacgtttatttgtaggaaacgtcggaaaaaccgaaggaaaccggtcaaaatga

SEQ ID NO: 47182 - DNA, 363 bp, Glycine max
  Peptide Sequence Number=SeqID_163960
atgacagatcttgtgagcgtggaagatgatgtaaatctccgcgtgtcaacgggcttgtcagtcgcgattgacgaagggcgcagaatgaccataatttgtctctgcgtgccatcggacacaattgtgtctgaatggcaaaagggtcagtatgacagagattgtggggcagccgacaaaagcaaggctcttgctcctacgtatcctccaatgaggaactcagacctacgcgcggataaccgtaaggtgtctctgcaggctaccagctcttgggtcatggtaacagaaagcggtgtggtcgacaaaagcgaggcttttgctcctacgtatcctccaatgaggaactcagacctacgtagttcttga

SEQ ID NO: 47183 - DNA, 342 bp, Glycine max
  Peptide Sequence Number=SeqID_163961
atgggtgtacccgggttccgatctctaaatggatctgctatagctactcgatctcgatcaaatggctttggatctgtctctacatctggaatatctgggtgctccatagcttcaactgatactgcttatagccaacatcggctatggatcacgcccatcatcataagggcttctcgaagacttaatctcgctctacctccattctcggagaggggagtcttacccgcggatactcttattcgagagatggaattgggaatctgtttcgagacttcgtcattgagagctactaactgccattattccgaggcttatggagaccctcctaagcttaaaggctga

SEQ ID NO: 47184 - DNA, 132 bp, Glycine max
  Peptide Sequence Number=SeqID_163962
atggcagaaatcaatcaaggtacttggggacggatgcaaatggaggatagggccacgaccgacagatcgtcgtcccttcctggcgctggacaagcggaaaacgtcactgcaaagcagcccagtattctttaa

SEQ ID NO: 47185 - DNA, 174 bp, Glycine max
  Peptide Sequence Number=SeqID_163963
atgcacgataactggccttctatcagccgctcccagattgagttagatgagctggaaagtgtttccattctgtccatgacccttgcatgggatgaattttccttctctacttttcaagaagcccattattcgcttcaagattctctagaccaggtgcctgacatgcctttttga

SEQ ID NO: 47186 - DNA, 774 bp, Glycine max
  Peptide Sequence Number=SeqID_163964
atggggtacgaaaagcaaaagcccaaggtacagatagcaaaagaaggggtgccaatagcagaagtcaagggcaaccaagggacgttttcccttggtgcgcttagcgccctcaggcgtgctaagcgcgaacgtcataaattctggggagttttcgaaactccccaacccctcagttgcccccaggggatgtcttctcgcaagcgccgtgccgtgcccacaccaggggaagcgtccaactgggacacttcccgcttcacatctgagatagcttggcacaggtaccaagacaacattcagctccggaacatccttccggagaggaatgttgaactgggacccgggatgtttgacgagttcctccaggaactcaggaggcgcagatgggaccaggtgctgactcaccttccggagaagcggatcgacgtggctctggtgaaagagttctattcgaacctttatgatccagaggaccacagtcccagattctgcagggtgcgaggacaggtcgttcgttttgatgctgacaccattaacgacttcctcgacaccccggtttttttggaggacggggaggagtatccagcatacaccagatacctcagcactcaccccgatcctgacaccatcgcggccacactgtgcactccaggggggcgctttgtccttaatgttgatggtctcccctggaagctcctggaaggacatgatgaaacttgctcagacatggagtgtcctttcttactacgatcttgcgcccacttctcacacttctga

SEQ ID NO: 47187 - DNA, 315 bp, Glycine max
  Peptide Sequence Number=SeqID_163965
atgcaacttggagggattatttctccaatcattggtaagctcagcagactacaaagattggcacttcatcagaacagcttgcatggaaccattcctaatgaacttaccaattatactgagctaagagcactggatttatcaagcaactcattgaaaggtgatatacctttctctattgaccgtctctcacatttgcaaattatgaacttgtctaccaatttcttctctggtgaaattctcgacattggagtattaagcacctttgacaagaactcgtatgtactctttcccgataaagcctcgtactttagctga

SEQ ID NO: 47188 - DNA, 630 bp, Glycine max
  Peptide Sequence Number=SeqID_163966
atgaagacaacaaacacagctgcgaatggtacaaataatcaaggaactcctaagtggattgaagtcaagagtcatgttcaaagcggagggtatgagtgtggctattacatgatgcattggatgtggaacatcgtcagtgggggtttaaagaatgattggaccatgtggtttcttgatggaacgacgttagacaaggaaacaattacaacgattcgccagaaatgggcagcatattttcttaaagaaagtcaactcaagtggggaatggtagcggctgctacaatagacagcagagatgaggaagaggttgtggagactctctatgccatggttggaatgttccctcacaatgcctccaatcataatagtacagatttagatggcaaatctttgcctgataattcatcagttttgcaagacttggaggataatgctagtgatgctcttcaagcctcagcaactgctcctgttgcaagtcctagttgtcatgaaagttcagctggagaagcttcaaaaaccagttggttgaatgaagttgttggtcaaaaacaacctgatttgcctgatagtgcaacgctcttgatgccatctcatagcaatggggtggtcattttttttgttgcattctga

SEQ ID NO: 47189 - DNA, 180 bp, Glycine max
  Peptide Sequence Number=SeqID_163967
atggctaccattgcattattgagcagatacaggagtaagttagcatatgacatcgggattcgggggtggtgtttggtcttggatatgcagcgggtggattttgtggctgatttaggggtggcctttgtggttgattgggtgttcttggttggtagggtgacgggtaatggacaggactga

SEQ ID NO: 47190 - DNA, 366 bp, Glycine max
  Peptide Sequence Number=SeqID_163968
atggctaaaccaagcagccccgcaaacttggcatcagccatcatttgtttctttgcctcaaagaagttcccccatagactaaaagcatcaccgggaaggtttgcaaggcaaaacccttcaccacacccttccgtcatggtccatgttcatggatttttcaaagcggtgttgtccttgcctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgagggtgcatga

SEQ ID NO: 47191 - DNA, 407 bp, Glycine max
  Peptide Sequence Number=SeqID_163969
ctcgcctgagcgagcaaggttacatcaagttgaagcaacaactgcctgggctaagtgaaggattccaaggtccagcattgagagaaatcagagagaagaagaagaagaaagaagagaaaaacgaggctgaggtgctacagaattacgaccataatcgacttctacttcgttcttcgttcgttatccagagcaagggtagttcctcattgcatattgaagtaaacaatgcccttgtaacggacgcgtggggtgctatcgcaacctacccttttgcaggagggcgacgcgagggctcacaggtcgacaaaaacggggctcttgctcttacgtaccctccatcgaagaggaaatcagacctatgtagttctttcaaaagggcgaatcaagcgattctttttacttggaag

SEQ ID NO: 47192 - DNA, 227 bp, Glycine max
  Peptide Sequence Number=SeqID_163970
atgccgcctctctggttccaattcctcgcgtttctctgcacccgttggggcccgtttttgaaagtaggcaatatatatcaaaacgctcagaatgagaccttgagcatggttcagagaaatagggtccaagtggaccctgagaaaatcaaggccatccaagaatggcccaccctaaaaagtgtgggagatattaggagcttccatgggttagcaagcttctatagaag

SEQ ID NO: 47193 - DNA, 832 bp, Glycine max
  Peptide Sequence Number=SeqID_163971
aggactacacgtcctcaccatcagagggttgcacgccctcgcctttagaggactacacattctcgccttcacaggactacccgtcctcgccatcagagggctgtatatcctcaccttcagagggctacacaccctcgccatcagaggactacatgtcctcaccttcagagggctacacgccctaaccttcagaggactacacgtccttgccttgaggacaacacgtcctcaccatcagaggactacccgtcctacccatcagaagactacatgtcctcgccttgagagggctacacctcctcgccttcagaggacttcacgtcttccccttcagagggctgcacgccctaaccttcagaggactacacgtcctcgccttgaggacaacacgtcctcaccttcagaggactacacgtcctcaccttcagaaggactacacgtcctcaccttcagagagctacacgccctcgtcttcaaaggactagatgtctttaccttcagaggactacacctcctcgccttcagaggactacacgtcttccccttcaaaggactacatgtcctcaccttcagagggctacaggcccttgccttgaggactacacgtcctcaccttcagaggactacacgtccacaccttcagagggctacacgccctcaccttcagaggactacacgtccacaccttcagaggactacacatcctcgccttgagaggactatgtcctcaccttcagaggactacacttcctccactttagaggactacacgtcctcaccttcagagggctacactctctcgccttcagtgagctccacatccgcaccttaa

SEQ ID NO: 47194 - DNA, 302 bp, Glycine max
  Peptide Sequence Number=SeqID_163972
atggcgggaaggcgtgccaattgctctttcatggcctccatgtcggccttcatctgctcttgcgcctcctctacttcacccattactctagctctagcacaggacatggggttgaatcaatttagatttttcaatatggttcatgacatcttggtcaaggtgaaactggaagtaacaaggacatcaacagtcctaaatgtgtttggcagtagacgaagcagtgataaatgggtttatgatcccagcatggttggctcatggaaaatgcaaggatcacgtatgagcgaacatgaaaacaaaag

SEQ ID NO: 47195 - DNA, 690 bp, Glycine max
  Peptide Sequence Number=SeqID_163973
gtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcattg

SEQ ID NO: 47196 - DNA, 581 bp, Glycine max
  Peptide Sequence Number=SeqID_163974
atggagtttaagcaacatgaggaaactgagttgaggatgcccacaccaacagcgagtcacgacgacttcggaataccgccctcaagtcaaggtgaagaggagctagtggcggcggtgataccagtggtgattccagtgacccctacaccacccaccctggctcaaaacaacgacaatgagaagtatcatgagtgccttaagaaccacaccatcaaaactggcgtccacacacttgatggatgcatcaagttcttgcctctaggcgaggagggaaccctggatgcgctaaaatgcctcgtgtgcaactgccaccgaaacttccatcgtaaggagacccctaatgacacctacctggtgccttactactaccaccactcgtcgttgccgttggcagcatactatggggagcaggtgggctacccccgtgtgcaagggcaacaatgcaccacactggcactcccctccaggtcaaggggtggtggtggggcccagtcctcgagggaggacatggaagcagtgtcagacccaacgagtggtgccactcctcatggcgggtccaacaagaagcgtttcaggactag

SEQ ID NO: 47197 - DNA, 498 bp, Glycine max
  Peptide Sequence Number=SeqID_163975
atggcatctacatcctccttatcagagtgtagggatacgacaaagcttcctggtgggagtttgaatctcaagttcttgtgcgtgagccatctttattttagtggtcctgaagcaaggtttgaaagattacctaagttggttagagccacgattgcgataggccatgttctattggaggacaaagaggaagcggacttgattcttgagtttcaaaatttaacccacctagaattgggctattcagattatactagggattggattgagaggttagaagtgatcaagcgtttccccaatcttcaaattcttgacattgatatggggagtattgacatgaatgctagaggcgatgaaggagcaaattggccattccctcgatctgtcccttcatgcatttcattacatcttaaaacatgcgaacaagaagaagaaacaaagaaacaaagaaaggtggtgctaggtgtggctattactctattctatggtgacacccaatga

SEQ ID NO: 47198 - DNA, 187 bp, Glycine max
  Peptide Sequence Number=SeqID_163976
gttcaaggaatggggatttgataaaggttggggcaacattgcaggaagggttaaagagacaatgaaattgctctatgaggtggtatatattcttgatcaagtaagggccttagaggaagagctactccataagattgagttgcaagtccttgacgtgaagcctcagattcttgtcgtaagctactaa

SEQ ID NO: 47199 - DNA, 240 bp, Glycine max
  Peptide Sequence Number=SeqID_163977
atggcctcactgccgactccttacactcgtgccgtcgactctgccttatggcaagaccaaagtagcgtgccactaagttcctccccaaccgcaccaccttacatccccccctgtggtagcgccgatcaatgtggtggaccactgcctcctctacgacaagcacaacctctacgaagtctccttcaacacaccatctacaccttcctcacctccgacccctccttcatcgacctgctctga

SEQ ID NO: 47200 - DNA, 169 bp, Glycine max
  Peptide Sequence Number=SeqID_163978
atcgcaaacgaccaagggcatttggatagccaagtgtgctgggattgagccaagcacaattgctatggatttagagggcactcatggaagagagagaggcgagtttggtgatttgttagtcattttagcctcctttagagcatctaataagaaagacctgatagtgtaa

SEQ ID NO: 47201 - DNA, 213 bp, Glycine max
  Peptide Sequence Number=SeqID_163979
atggctgatattcaccacactttcctttgcatgttgttgtctccactcacacttgttaatccttcactcattgggttggttgagactaaacataagaaggagtccggtgaagagaaaacgggaagacaaagagggaacgaagagactgggagaggttcgatgttgcaggggaggtctctgtgcttagcagaacatggatgggctattgcttaa

SEQ ID NO: 47202 - DNA, 1326 bp, Glycine max
  Peptide Sequence Number=SeqID_163980
atggaggagccgtcggaaatgcctacaatggcgacgtgcaagatagcgttgaggttcatagagaagggagctagaggaagaatgatacagtgtgggaattgcgaaaccgcgtggtttaattatggagaatatttttttccgataaccgcacagaatctaacaagttgttcaatcatgagaaaaatccacttcccaacacttgtgactggatgtgttgatcaaaatcctagggtttcagtcaatgactatcaacggattcattcttccaaagactatggttgtcctaaccttgttgatgtggtggttattctaaacttacgaaatcatgatgaggaacaattgttactttataggacctgttggactctttcaactaccattggaatcaatttcttcaaagatgactctgggtattccaaattcatgcttctcaacgctaagaagaatggcattttttaccatacctactacattccttccactaaccttggcatcaaattctccaaaaatgactttgggtatttcaaattcatgcttttcactaccaagaatagtggtgttgtttcacctgatgagcaccctactttccttttgatgtggttttgtaggtacttcatttgtacatgttcaatagacaaccatattgagtacaacactgtttctggtccaatttggtttctgatcctttgggcgcgactatattttataaacgccttttatcctggtgctagtttgctggcaatgactaagcagggtgataattgttacgggctagctctcatctgccttctgattagtttgtgcacctcttgtcaatcgaatgagatctctgcaattttggaggacattaaagacaaattgcactctttagtgttcaagtatttcacttttagcctcaacattgtatatttctttacaaaatggtgggaatttatattgtctaccttattttctggatcaatagtcaattgtctcactaggcatgttgatgatctatctgatgatgagccaccatcttccacccttgtcaagcatcatctctcttcagatactacaaggtttgacctagtggatgtggtttctttacttaaatctcctaagttcaaatcagttcccagatcgactggagagtctagcaaaagggacaaagagacaacagaggaactcttcaaggaagttcctcttactcctgacacttgtaggaccaaaatgactaagaaaataggtcactgcaatcgccaagatacccttagtagatcaaccgattccttccctatccttaagaagctttccataccagatgaggccttgcatgagtatttctag

SEQ ID NO: 47203 - DNA, 204 bp, Glycine max
  Peptide Sequence Number=SeqID_163981
atgctccaaaaatttagatctaaatcacattttttagaaattgaaatgctccaactttgctcgcagatctcacaaagtgccacgtccaggtttgatcttgttgaagtgaaactaggaggagttgaattgcaaaacagggagaaagcaagtgcactggatctcggtgtggtagcacttgcagaggggaggcaaaaaagacagtga

SEQ ID NO: 47204 - DNA, 204 bp, Glycine max
  Peptide Sequence Number=SeqID_163982
atggacaggtggcagaaagagaatgagccagaggagaattttgttgggaaggcagtacaaggggtagtggagtgtgagaaaggggaagagaaaaattccggagcttatatacagacagttataaggaaacaggaaccattggacaatataatgcatcaggggcatttagagaataggagtggaaaagttccattagttaaataa

SEQ ID NO: 47205 - DNA, 705 bp, Glycine max
  Peptide Sequence Number=SeqID_163983
atgatcattgatcaatctctgttcttttcattaactaaattacccagtcaaggtgcaccttttgagggcaccattgttgatgactggaagttcgactattctaatcatgatgctcgccgtatggtctgtaatgaccaggctgatatgaccggtagattgctggccggatcattgacctttgattgtcgcatcatgcactatattattgttagaattttgcttccttgttcttctaatctagctcaagcctctgaggaggacttgattttgatgtgggttttccttaccagtcgtcagatcgactgggctcacttggttaggtatcgaatgcataaggcattacgggccaatgcacctcttccgtatcctcaaatggtcactctttttctccatcattttcaaattcctcttgatgatgaaccttttgttcaagtcaagagatcttttgctataggtgttggtgcagtaacttcatttggttaccgtaaggatcgtgatggacaatggatgaagaaggacacgttacctccacaagacgagcgtactccttctcctcctcctcaacgagatgattcctcagcccttatgaatgaagttctttcagaattacggggcctctgcacctatgttggtgcacgattcgattccttggatggtcgctttgaaggcatggatacccgcatcaccagcttgaagaggatgtga

SEQ ID NO: 47206 - DNA, 312 bp, Glycine max
  Peptide Sequence Number=SeqID_163984
atggcatctacatcctccttatcagagtgtagggatacgccagagcttcctggtgggagtttgaatctcatgttcttgtgcgtgagccatctttattttagtggtcctgaagcaaggtttgaaagattgcctaagttggggagtattgacatgaatgctagaggcgatgaaggagcagattggccattccctcgatctatcccttcatgcatttcattaaatcttaaaacatgcgaagaagaagaaacaaagaaacaaagaaaggtggtgctaggtgtggctgttactctattctattgcgacacccaatga

SEQ ID NO: 47207 - DNA, 534 bp, Glycine max
  Peptide Sequence Number=SeqID_163985
atgtcttccaggaaaagaaagagtggcggttcaaggcccaccactcaatatgatacaagaagattccactcttttgaggcttggactagatatactaacaatgtattgggaagacacatattagctgagaggaaagtggaaatctatcacacagagctggatgaattcaagggcgagttggagaggcgtaactttcacaagcgcctcaccaacttagctgatactagcattgacctcacgttggtgaaggagatctatgccaacctctacagtcctggggggccttcacctaaacaagtcagaattcggggccacttaataaggattgatgcagacaacctcaatgactttctagaaacacctgtggtgcttgctgagggtgaatctttgcccgcttactcaagatactgcaggatgcctactgacactagagaaattgagactgcactgtgcatacccggccgaggttactcagttggacatgaatgtcggagccctcatttctgggcagattacttctatggcccagtctaa

SEQ ID NO: 47208 - DNA, 504 bp, Glycine max
  Peptide Sequence Number=SeqID_163986
atgatggataccttagagccctacactggggcaatgaaaggcaccatgcgtgagcctccggcgaacctagggtacctcgtctttagaggactacatgtcttcgccttcagaggactaaatgtcctcaccataagaggactacacgtcctcgcctccaaagggctgtacgtcctcaccttcagaggactacatgtccttgccttcagagggctgcacgtcctcgactttagaggacttcacgctctcacctttagaggactgcacgtcctcaccttcagagggctacacgccctcaccttcagaggactacacgccctcaccttcagaggactacacgtcctcaccttcagaggactacacgtccttgccttcagaagactacaccttatccccttcagaggactacacctcctcgtcttcagaggacttctcgtcctcgccttcagaggacttcacgtcctcgcctttagagggctacaagcccttaccttcagagaactacac

SEQ ID NO: 47209 - DNA, 1089 bp, Glycine max
  Peptide Sequence Number=SeqID_163987
atggcagaaccatcgaagaagagaaagggatcatcctccaccgccgctactgctgcccatcgccgccacggaccatccgaagcacccacagcacctattcatccctctttgtcatctccaagatcatccactttgttttcatccgatgatcagcgtctacggtacctttctcaattttcttctaggatcatcttagaccctaagtacctagacgtggatttctttaatgatgaaacgtttgattgctatcaagtgtttcaaaattctggcttggttgatttcatgtccttaaaattgccacattatcctgaacttgtaaaggtgcatggtattcctatgatcattgatcagtcattgttcttttctttaactcatttacccagtcaaggtgcaccttttgagggaaccattgttgatgactggaaatttgattattctagtcatgatgctcgtcgtatggtctgcaatgaccaggctgaaatgaccggtagattgctggccgggtcattaacatttgataatcgcatcatgcactatataattgttagaattttgcttccccgctcttcaaatttagcacaagcctctgaggaggatttgattctgatgtgggctttccttactggtcgtcagatcgactgggcccacttggttcggtaccgaatgcttaaggcattacgggccaatgcacttctcccttacccacaattgataactttgtttctgcgtcattttcaaattctgcttgatgatgaaccatttgttcaagtcaagcattcctttgcaattggtgctggtgcagtgacttcctttggataccgtaaggatcggaatggtcaatggctgaagaaagacgcactccctcctcaagatgagcgtactccttcacctcctcctcagcgagatgattcagcactcatgactgaagttctttctgaattacagggtcttcgttcttatgttggtgaacattttgactcactggatactcattttgccggaatggatatccgcctcacacagcttgaagaggatgtgggttacattcgtcagagtttcgatcttccaccaccacctccaccttcttag

SEQ ID NO: 47210 - DNA, 189 bp, Glycine max
  Peptide Sequence Number=SeqID_163988
atgaaaaggttcgagacttacttaaggctattgatgacaagttcatcacttcagataaggcttaaacaagaagaagaaaggcttgtaatggagatgggtgaaagtgcaatgctgacaactacttgtgggaagaacaaagcaaccaagtctcaagctaatcaaaagaggagtggtaaaatactaccttaa

SEQ ID NO: 47211 - DNA, 774 bp, Glycine max
  Peptide Sequence Number=SeqID_163989
atggctcctgaagacctggagcagctgacacaaaagattagggaccagctagaggagtcgatcacaaaaaaaatgcaatcacagggactcgcattgtctcctgagccaaaggtaggtccttcagttgcttgtgtcagcacaaaggagagttgtgatgatccctcagggaacgacccagacacaggtgactcagagaaatacgggttgtacgtcgaagaaaatcctcccagcctggttgccctaggaagactttatgaggggtccacaaccattcacaacatgcctttgcgccattatcaagtcaaggttggtgttgaggaagttagagatgtagatgctcccattcttgtacctactcaagagggagttgtgggaccggacaaacctgcagataggccggatcatgatgtcaatgatcccctatatctgatgacattgaccatcccacaactttttctaaagccgttgaaggttatgtgggatgctaccgtgtttgagctgtttaatgacgacttccccttgtacataaagcatgaacatctgtccaaaattgcacgcggtggtcaatgtctcaacatctctgttatacaattgtggattttgcatgtgactaaaacaagtatgcgagcggggaatttcgatgtttatggattcctcaagccacaatccatacagagatatggacaatcgcaatttgaatcagaaagttacattaagaactggatgcagaattcaaagaggggtgtgtacctaggagcctacttgaataggtaa

SEQ ID NO: 47212 - DNA, 767 bp, Glycine max
  Peptide Sequence Number=SeqID_163990
gtgctccagtggcttctgtttctatcagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatcttcagtggcaggcgatgccgacatcggtgggcgacatgccgcgcgccaggcgccgcccggtccgcagcagcgcctgttcgagcagcgccacggtcagcggatcgccgtcctgctcggccagttgataggcggcgagcagcgcgtcgccgagctcgccgagccggtccgtcgggtccgcatccgcgacgtcggcgtcccgcccggtgccggtgtcacgcccgtcggccagcgcgcacagttccgcgcggcgtctcgcgttcgcttcgtcctctggtgagccgttgcgcatcgtgttggtccctcaaccagctcgagggtgcacctacaggttgcgagccgtcaactccccccggcgtgcccggcgagcggtcgagcgtcgcatctctccggatgggtaaacatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 47213 - DNA, 374 bp, Glycine max
  Peptide Sequence Number=SeqID_163991
atggtgggatcaaagaggagtcgtggacggccaccaaaaatggtgtctccggttcctgttaatcctccatcgccggtggctccaccggaaatggaatcagaaatccatgaggaagacgaagatggtgatttggctaatagtaaacaaggacctgctaatggaagtgaaacggtggctcaagaaaccctaatcgaagaccaagatggaattgggcataaactctgggttgacgtgattagtggaaacagaaatccagctaagggtagagttatgcagtatgtggctcccaaggtggtagatggtgaaatagatgtgaaaattgaggatgaggatgttgccccagaattgaaattttgggaaactactttgatctt

SEQ ID NO: 47214 - DNA, 1167 bp, Glycine max
  Peptide Sequence Number=SeqID_163992
atggcgcgagatgcatcctgcaacgcccctcaggcaaagccgttaagcagtttatcagttaaccagtatagatggattaacatctggacgtctattttaggtcagggtttagccagattgccagcgttcgccgtgagcgccgccgcttcatcgaacggtcaccagtgccgtactggcgcacattcttctgctatttcccgtcttgtctctttgtcacttaccagggtgtcttacaattatatgagtgataaaccgatcgctgaccgcgaacggcggttctcttcgctgccgccagcgcggcttgttgggttgttctcgcgggtggtagctgcgatagtggctgacggtttcgtcagtgcggaatgtgaggcgaaccatgaggttgccatgaatgatcgtaatgccagcaagatgctgcgtacttataacgtcgcctactggggcaacaattactatgacgtcaacgagctgggccatatcagcgtgtgcccggacccggatgtcccgcaggcgcgcgtcgatctggcagaactggtgaaaacgcgccagcaagacggccaacgtttgcctgcgctgttctgcttcccgcagatccttcagcatcgcttgcgttcgatcaacgccgcgttcaaacgcgcgcgtgagtctttcggttaccagggcggctatttcctggtgtatccgatcaaggtgaaccaacatcgccgcgtgattgagtcgctggtgaactccggcgaaccgctggggctggaagccggctccaaggccgagctgatggcggtgctggcgcatgccggcatgacccgctcggtgatcgtctgtaacggctataaagatcgtgaatatattcgcctggcgctgatcggagaaaaactggggcacaaggtgtacctggtgatcgagaagatgtccgagatcaacctggtgctggaagaagccgaacggttgaacgtcataccacgcctgggcgtgcgtgcgcgcctggcgtcgcagggctccggcaaatggcagtcgagcggcggcgaaaaatccaagttcggtctggcggcggtgcaggtgctgaagctggtggagaccctgcgcgaagcgggccgtctcgacagcctgcaactgctgcatttccacttgggctcgcagctggccaacattcgcgatatcgccaccggc

SEQ ID NO: 47215 - DNA, 261 bp, Glycine max
  Peptide Sequence Number=SeqID_163993
atggtgactctgctcgttttctccctaggagacgaatgcactttggcttatttatcttgcttttgtcgtcccgtcgtgagggagtggaggttgatctatggtcatgctgggtctctgactcgcttgataacagtgaagcctcatttagagttttcctctattggtgatgcgttgtcgctgatagtccctatcgccataatgtattatctaaagaggatgatatctctagaagccagtgaagttatgtgtaaccacccttag

SEQ ID NO: 47216 - DNA, 1329 bp, Glycine max
  Peptide Sequence Number=SeqID_163994
atgaaagaagaagtgaagaaggaagtcctcaagttgcttgaggctagacttatctaccccatttctaacagtgcttgggtaagtctagtccaggtggtgcccaataaaggaggaatgacagtggtccggtataatcatatcacagtggatcccaaggaccaagagaagacggatttcacatgcccttttagtgtctttgcatatagaaggatgccatttgagttatgtaatgcaccaaccactttccagaggtcttcctttgactgttgcctaaccaatttggagcttgtgttgcgaagatgtttagaagaaaatatggtgctaaactgggagaagtgtcatttcatggtccaagaaggactagtgttaggccacaagatttcagcccgagggattgaggtggacaaagccaaaatagacgccattgagaagttactaccaccaataaatgctaaagatgaagaatgcttggcagccttccaaactcttaaagacaagcttatatctgccccaataatggttgcacctaattggagtaaagagtacgagctgatgtgtgatgccagcgactatgtgggagatgttgtccatcatctatgccttagagaaattctagtcttaactggtgggctccaagaattcgacatcatcatcaaagacaataagggattcaatagtgtagcagctgaccatctctcccagttggtgaatgaagaaccgaagaaatttcttcgtgatgtctgcttctacgtctgggatgatccacatctgttcaaaattggaacagataacttgctgagaaggtatgtgaccacagaggaagctcaaagcatactatggcactatcagagttcaccttatggaggccattactatggatatagtcatctaatatcctcatatgggaatgcatacatcctagtggcagttgattatgtgtctaaatgggtggaagccatagccactccaaaaaatgatgccatgatcctgatcaaatttctaaagagaaacatcttctcccgctttggagtccttagagtgctgattagtgatgggggtacgcacttctgcaatgcacaactacagaagtttctggggcattataatgtcagacataagaaaaccgccgtatcctcaaggaaagattgggcagcaaagctggataatgccttatgggcttacaggactatattcaagacttccataggcctctcaccatttcagatgttctatgggaaagcatgtcacttgccggtggagctggagcataaggcctattgggccctcaaattcctcaacttcgacaactcactatctggagagaagtag

SEQ ID NO: 47217 - DNA, 279 bp, Glycine max
  Peptide Sequence Number=SeqID_163995
atgctggctgctggtaatcgattactaccttatggtaatcgattaccagagagtaaaactctttgttcacgactaaggcttttccttggaaagctcaagtccaagtggtctagcccattcttggtcaaggaagtgaagccctccggagcagtggagttgataaatcctgctgcacatgaccctgagaaaatttatatcatcaacggtcagaggttgaagatctataatggtggcaacatggagagcttgaccattgtcatccatctccaggacctatga

SEQ ID NO: 47218 - DNA, 282 bp, Glycine max
  Peptide Sequence Number=SeqID_163996
atggctttccaatcctttgaggtagtaagcatcgcttccgtagattccctccctaggcagcccctcctgtccgatgcagcaatgatggtggcctgggtgatgttggggcacggctacgagctcggaatgggtttgggcaagaacaatggcggtagcaccggcctagtaagggtcagaggaaaccacgagaaatttgggttacgctataatcctacacatgctgacgtaaggaaaaacatctcgggaaggaagaacaaaggccaaggcccgcagtcgggatag

SEQ ID NO: 47219 - DNA, 738 bp, Glycine max
  Peptide Sequence Number=SeqID_163997
atgccctaccacaacttcatatttctggtctttcactccagacaagtgcatatatcaaagaacttacagaacaccaagccatctttcaggagtttcctccttagcttctcgatcagccatgatattctgggaagctggctccctgccagatacataagtaatgaatcagttgagctgaagactcacaatgatgtcatacggttctctctaggcaagtctgatgatattaataatgcaaagaagagccagctgaacaaaaaatttaaaatctctagaaaggctaaactaaatgagctgaagtgctatcgtttgaaggccaagaaaaagatgaattccccaaatccagaagttagaattagatataagcttgaaaaggccaagcgaaaggaaacttggttgattgagaagctacagaaatttgatgtaccaaaaccccctccagaaacatatgatcctgaaattttaactgaggaggagaggcattacatgaagcgcactgttcttaatatgcatcttcactggaaaaatcatgaaacggtaaaggttatctgcaagccttgcaaaccagggcaagttcatgaatatgctgaagagcttgctcgactaagcaaaggcattgtgattgacatcaagcccaataatactatcattttttaccgtggaaagaactatgtaaaaccagaagtaatgtcacctccaaatacattatcaaaagcgaaggggagagactcagaataa

SEQ ID NO: 47220 - DNA, 213 bp, Glycine max
  Peptide Sequence Number=SeqID_163998
atggcattagatgcaaatgggaggagactcttggtaacatccagttcatttagagcacccatataccaggttgatgattcgtgcttaagcatgtggcagccctccttgaattacagtcctagcttctctgtaggagactcctcactatacagagagccttggttgaaaccagggttatcctatcttgttgaaacatctagtgtcaaggattaa

SEQ ID NO: 47221 - DNA, 705 bp, Glycine max
  Peptide Sequence Number=SeqID_163999
atggatacaactgaaattgtatcattttatcagaattcaccagacgagctttatctgttgtttcagcagttctgtgaccacttccatgcaacatcaaggaattcaatgtatatgaatttcatatcttctcattcaaataatatccacgcactggaacagctccggagcattaaagataaggcaagcagctctgcacagtttgtgaagaatattttggaatcaagattcattaaaaaaattacagaacttatggatgacattcgtgagaatgtctctgtgttgacactgcttgctgaggtcttgtgcttgctggatatgattgtaaattcatttgctcatatgatatcaactaagcctgttgatcgatatacaagaccagaatttacagagaatgggccgttggcaattgattctaaacaggctattaatcatattaagaggaagtatgagttggagaatatggaaattgtgaacaaggaaaaagaaaaggttcgatatgatttcctggttgacaaagccattgcagaaattgaggcaaagtgtggccaaaaaattgaagaatgcaaagaagaacaaaggcagcagttgatgcgcattgaagatgaacacacgttgctcgttactcaaatgaagcaggagcatgacaagaggcaagcaagcctcatagctgaacacaacgaacagctaaagcgtacccaactgtaa

SEQ ID NO: 47222 - DNA, 454 bp, Glycine max
  Peptide Sequence Number=SeqID_164000
atggggaatggtgaaacacttctcgtcgctatttttttacgccttatttcttcttctattgatgaaaagattcgccagaaacacgacaaccacatcaggaaacagtggaggagagccttcgatgatggaataagtggacaagaatcaaatgtgacaacagaacctggagatgcaacaaaagaccgatcaagcctatacaactcttcaggattaggcggcaaacctcaagcatttggagggcaaggattacgagtagggtcgttcgatgagtcactagtctaccgacatccggatatgatgatagatgtttattctcatgcaacttgccatatagaggctaaggaatcgatggccaggaaaagggcgatggagaaaaaggagtttggattagcttctaagaatggagaggttaagtttaccgcagtggaacttgttgacaatgaagatgttaaag

SEQ ID NO: 47223 - DNA, 471 bp, Glycine max
  Peptide Sequence Number=SeqID_164001
atggggcttaccaactggtatggcctaataccagagcttttccccaatgttaagtatgttcaagggatcatgaccgggtcgatagtgatttccaaaggaacaaagtacctacctacctacctaatcacattaatggatttgatgaatccaatattggagaaagggcatagcagagttcctgtctattatgagcagcctacaaatattattggacttgttctggttaagaatttattgacaattgacccagaagaagaaatacccgtgaaaaatgtgaccatccaaagaattccaagggttccagaaacgttgccactttatgatattttgaatgagttccagaaaggccatagccacatggctgttgttgtcagacattgtgagaagacagggcaacaatcttccaacaataatgccgatgtgagagatgtaaaggtagatattgatggtggtgagagaactggaacgtaa

SEQ ID NO: 47224 - DNA, 201 bp, Glycine max
  Peptide Sequence Number=SeqID_164002
gattcaacaagcgattctcctcaaatttcagccagcccgtatcaattagacttcacactttatgcttcggggtcatacaatgctcaatggaatgccccggggctcctccatgataagcacacgttgcgttcgagtcgtatcctcagaaaaatggaggtggtcttcgtcattggaagtgcggtagacaggctttgtggttga

SEQ ID NO: 47225 - DNA, 570 bp, Glycine max
  Peptide Sequence Number=SeqID_164003
atgccatgcacgatttttggtgactatgtcgatatattgattgggataaatgggggtgccacttctgaactacccattgtgatatttcaatttgaaaagattaagacacacacaggttactcgaagtttttgatggttgacactgcagcctttttttttttgacttcgattgtgtcaatctacttgggaggtcttatgcctcaatggtggaagcttattaggaagtttctttttaaagttgaaaaggatgctgtctatggattccgttttaatgattcctttaaagtgaaaagaatatgtgaagatgatgcgatcatccatgaattcaaaaatgattcagtccctgtcacacccgagaagatgaaatttggtgtgaaatgcattgaaaccgatatggatgactcttctacatccaaaagtgcagaatttgatcaatgttcaattgaccaacaagaggatgcgattgttatcgatgacaatgcagttggttttactgtaaaagtgtcgaatacaacccttgatagaggcaaaatgccattgaaaatgtgtccaacgtttttgaacacgtga

SEQ ID NO: 47226 - DNA, 609 bp, Glycine max
  Peptide Sequence Number=SeqID_164004
atgacatacagtaggtacactggggatggtttgaacggttcaaaggaacttggggaaaatattgattgggactcacatgcctcacttgatattcttgacaagagtggagctatatccatgtttctcataagagatggagtactaactaccttattatcattttcaagaccagatgatgagcttggcgttgactccctattctacattgatgccatcgagactctatgggaacacgatgatgcgctccatgtggaccacttgtactggttcctatgctaccatcgtgtgctgtctacattgtcttactaccacttcgtgatgcccatgcctgaggtggtcattccttccgagtttcatttgttgcatgtggatgatgtgatatcctcctctggatctaactcctcatataaggataccgagaccatttcccctactctaatgtctccccaatcagtgttgcctgaatctcaggcaccacccagggtagatttggtgaatctcgtgttggaggatgagggagagaagttggaggaggacaaatcttttaaggaggacactgtcatggagctggagcctgtggaggaggattcctcgaaggagtcttactag

SEQ ID NO: 47227 - DNA, 234 bp, Glycine max
  Peptide Sequence Number=SeqID_164005
atggctttgactgaattgcattgcatttacttttcaatctcctgcagctcaatacttagtgaggatgaaaaggttgtagaaattgcttactttaaggctcaacatggaagcacaagtttgataacacaatgggtgtacttcacttcagtttcaaacaaagttggtggctgcagcactaataatattccctctcgtggcactagaagctcctgcaatacttcgttcctaaggtaa

SEQ ID NO: 47228 - DNA, 342 bp, Glycine max
  Peptide Sequence Number=SeqID_164006
atgattgcagttcgacttcaaggaaagaatgcaacgagcaatgcaaccaatgtgaaaataagcacggatagtcaaagtgccactggaaataaaacatggacatcaacagcccctaattttgtaaataatttagctcaatcatgtgttggcaatagccaaagaagctatgtaaactcgatccatatatcttctgccccaacttttgcaagctggaaaatgcatggcatgagcaactatgtgtcagcatcatgcatgagtgaacacaaatcaaccttcactccctatggctcacacagacccgggtatagggcccaacatctaaaggattgtgaaaaagtgtag

SEQ ID NO: 47229 - DNA, 471 bp, Glycine max
  Peptide Sequence Number=SeqID_164007
atggcttgggttatcgatcggtgtatggattccttgagcctcaatctatacacaatgcaaaggatagacgtgggcaatgtgaagaatatatcgaaaaatgacttaaggaatcgcaacgacaactcgcccattggcaaatggttgtgttgtgccctaaagacaatgtcgtggtctgttggacgctgcgattgtgaacattatattaacatcatattaatcttccaatgcagtgcatacaagaaattaaacacgactgctgatggcaaaactcacgttcaacgcggaggctatgagtgtgggtattatgtgatgcattggatgtggaacataattggcgcggagttgaagagtgattggactgtgtggttcggtgatggctcggcactagactcggaggcgatcacagcattacgtaaaaaatgggcagcttactttttgaaacttagaaccatccaatgtacaaagttgtaa

SEQ ID NO: 47230 - DNA, 270 bp, Glycine max
  Peptide Sequence Number=SeqID_164008
atggcttttgaaaatggttccaaaaaggagcttgagaaagttggtctaaaaatctcgaagagctttcctcttactaggactactctggcatctatggagtctttgtccctgccagtggaaattgttctttctgctgatatgcaatgtgagaagtgccagaagagggttgctgatattattactaaaatgaatgagaatccacaatgcaatgtgcataatcataacttggatagatacaccatttgtctccagcatgagggtgtggggtaa

SEQ ID NO: 47231 - DNA, 372 bp, Glycine max
  Peptide Sequence Number=SeqID_164009
atgggttggaaaccattcaagattacttacacaagtgattacttccaagaattgtacgaattagcagtggagctcataaaaaagggtcatgcttatgttgatcatcagacacctgatgagataaaggagcatagggagaagaaattgaacagtccttggagagacaggccaatttcaaagtcattgaagctctttgaggatatgaaaaatggcagtatagaagaaggaaaagccacacttagaatgaagcaagacatgcagagtgataactacaatatgtatgaccttattgcatatagaattaaggcaagtactcaactacatttttttattgctcaaatttctaggaagataatgattgatttcttatga

SEQ ID NO: 47232 - DNA, 249 bp, Glycine max
  Peptide Sequence Number=SeqID_164010
atggttcctcaaccgtcgttgtatctattgacctattttatgacactgcgttttacgacggttcaaaaccatcgtaaaatgtactgtagaaccgacttaaaaaatcctttttgtagtagtggtacatccacttggttgttcaaagagaacaagggagggtacatcccttgtggatctttggggttgaacctgaatcaggaagttgagtcagcttatgatgatgatcatgctggagatggaaaggcttag

SEQ ID NO: 47233 - DNA, 303 bp, Glycine max
  Peptide Sequence Number=SeqID_164011
atgggatggactaaacattttcaatggccctgcaggttggatcaatatgttatagcaaaatttgctaaaagttttcaaatgattcctagaactttggctgagaatgctgggttcaatgcaatggagatcatatcttctctgtatgcagaacatgcatctggaaatgccaaagttggcattgatttggaagaaggcgtatataaggatgtctcaaccttgtgcatttgggatctccatgtgactaagttatttgctcttaaatatgctacagatgctgcatgcactgtattacgtgtggactag

SEQ ID NO: 47234 - DNA, 2016 bp, Glycine max
  Peptide Sequence Number=SeqID_164012
atggctaaggttcaacctatatcttctcccatggtttctagatgtgagctcactaaaacaggaacaaatatattatcagatcctactctctatagatcaatggttggagcattacaatactccaccataaccagacctgagcgtagttttgttgtgaacaaagcatctaaccctgatgatagaaggtttacatcagaggttgctatttattttggtccaaatctcatatcttggcggtctaagaaacaacaaattgtagctaggtcaagtactaaagctgagtatagaagcctagttcaaggtacaactgaagctaaggagattaaccaatggaaggaggaacgtatagctgaggaagctactaagttgcctaaagaggcagctctagaactggcagaaaaggagaaagttaaagctcaagctgccttggaagcatatgaggaagccattaagatggttgaaaaggaagcacaaagaagaattcaggcagaggtgaaggctaggagagaggcgcaagaaaaggatcgagcattaaatctgttgattatcaacgatactcggtacagaaaatacagtataaaggatattgaagaggccactcagaagttttccccatcattgaaagtaggtgaaggtggatatggacctgtgtttagaggccaacttgatcacaccccggttgcaatcaaaattttaaaccctgatgcttcccatggaaggaggcagttccaacaagaggttgagatattatgcagcataaggcatcctaacatggtcctcctccttggtgcgtgtcccgagtacggatgcctagtgtatgagtacttggagaatggtagcttagaagatagattgttgatgaaaaatgacagccctccgattccatggtggaaacgttttgaaatagctgctgagattgcaactgcactccttttccttcaccaaacaaagccagagccaattgtgcaccgggaccttaaacccgcaaacattctcttggacaagaactttgtgagcaaaataagtgatgttggtcttgcaagactagtgccaccatctgtggctgactctgtcacacagtatcacttgactgcagctgctggaaccttttgttacattgatcctgagtaccaacaaacaggaaagttaacaaaaaaatcagatatctattccttggggataatgctactacaaatcatcactgccaagcctccaatggggcttgcacaccatgttaggatggcaattgagaaggaaacattttcagaaatgcttgatattatgatcagtgatgtgccactggaagaggctctagcatttgtcaaactctcattgagttgtacagagctcagcaaaaaggacaggcctgatcttgcaacagtggtggtgccagagcttaaccgtttaagggactttggattggcatttcagaaccgtagccaccctccacaccttcccacgcctacgcgaagtccacgatcaaggatttcgaaaattatgcacaaatgggaattcgtgaatgaacacttcaagcgagggcagaaggagcttctctcggagatcaaacgccttaagaccgtgcctcaatcgtcgacacatcccccagatgctggaaaacctggtgctgacgaaaactctctgtcaaaccccggtggcgacgacacgggctcaacctcaacctcgtcctccagtttcaagtaccagggatcggtggaaacaaacacaacaccttctcaccagttatcaagcgagaacaagaaactgaagaaggataacgaaacgctgagttgcgagctggcacgtgcgaggggtgagtggcagaaaatggaaaatcctaatttgcgaatggcaatgggcattaaacctgatcagaaaggtgtgcgcattagaagaattgatcctactgctccagaatctaaggttttgaagtcatcagatgttatccatagttttgatgggttgatattgccaatgatggaacagctactaaaaactaaaaaagtcttgagtatatga

SEQ ID NO: 47235 - DNA, 621 bp, Glycine max
  Peptide Sequence Number=SeqID_164013
gaagatcttcctgagaggaatgtaatgatatatcatacagaatttgatgaattcaagactgggttggaaagaaggaatgggcacaaggaattcacaaactttctagatgggagcatcgacgtggcaatagtgaaggagttctatgccaacttgtatgatccggaagacaagtcaccaaagcaagtacggaatttgaccacactggctcagacctggagcattttgtcattctctaacttggcccctacttcccacacttctgatattacattggatagggccaggctgatgtatggcataattcagaagatggatacaaacttggggtacattatctcaagtcagatttctatgatcgcacagcatgactcctcacggcttggttttcctgccctcatcactaccctgtgcaaggccagaggtgtcacttctgattcgctatcttttgagagcctcagcccagccattaatttggcttatgcgaagaagaatttttggaacctcgatgacctcgcaagttcgctgagccatcctcttctggctgaacacatgatccacagagtcaaactcgctaagcgcactgcttgcacctccaggttgagcgaagaagaggcacgctaa

SEQ ID NO: 47236 - DNA, 786 bp, Glycine max
  Peptide Sequence Number=SeqID_164014
atggaagaatcatccaagaagcgcaacggttcatccacctccgctgcggcacatagaacatcacgttccggagccaccggagcatccccgacaccaattccaccatccttgtcatcctctacactattttcatctaatgaacaacgtatccagtactcctctctctttaaatctcgtcaaattcttgatcccaaatatcttgacctagaattctttgatgggaaaacatttgattgctatcaagtgtttcaaaacactagtctgattccttttatgtcattaaaattaccatattatcctgagttagtacgagtcttttactcaaatttgaaaattcaagatggaactttaatttctgaggtgcatggtatccctatgattattgatgagtctcttttcttttctctgacacaactacccagtcagggtgcaccttttgcgagtacccttgttgatgaatggaagtttgattactttagtcatgatgcccgccgcatggtctgcattgaccaggcagatacggccggcagactgcttgtcgggtcattgacatttgattgtcgcatcatgcactatatcattgttagaattttgatgcctcgttcttctaatctcgctcaagcctctgaggaggacttcattctgatgtgggctttcttaaccggccgtccaatcgactgggcccatttgattcgttaccacatgcataatacattgcggtctggtgcacatctaccttaccctcagctagtgactttgttgcttcgacattttgaattccattga

SEQ ID NO: 47237 - DNA, 207 bp, Glycine max
  Peptide Sequence Number=SeqID_164015
atgagcgattccgtggaagttcttcaccgttcttcgtcgttcttcgttcgttcttcgatcttcaaccgtgaaactaaggctaaaattaactcacaaactaagctttgtctacaaaaatcacttgaagccgttttaaggtccaacaccttaaatggtcacgaagaactacataggtctgagttcctcatcgcaattgaggatacgtag

SEQ ID NO: 47238 - DNA, 168 bp, Glycine max
  Peptide Sequence Number=SeqID_164016
atgaatccttatttccctaacaagggaagtccaccaatagagtgcatacccttggaagttaatggagtgcttcttagtcaaatagctattaaggtgattggccccttgcttcttgactcaaattcttcaagggatggcaccaatcctcctttccaattccctatatga

SEQ ID NO: 47239 - DNA, 279 bp, Glycine max
  Peptide Sequence Number=SeqID_164017
atggcggaaaatcttcacgaaatcacccacggaaacgcctcggcttggattttcttcacagaaacgatttttctcactaatttcaaggaaaagagggagaagcttcccacccagctcgctcaggcgagctcagctcacacaggcgagctaggttgtttcctccagaaggtggtgccttctggaggaacttcccgaaagccccagatgggcccggttgctatttgcaccccttatttactaaatacacccctgcctttttttgctgattcatttccgtaa

SEQ ID NO: 47240 - DNA, 438 bp, Glycine max
  Peptide Sequence Number=SeqID_164018
atggcatttgggaccatggcagctcgcccaggagagctcatgcttactcctaaagtaactagctcgcccaggcgagttggttccttctgcctgaagcagtttgggggcccaggagagccagaggctagcctaggcaacaacaccgttcggctagcgagaatcaaaacatcagtgaatgataattcctggatgaaattaggggtattggatagaagattccaagaggattggactagagtggctaaagaaggccctaagattctaatgaacctcagggaagatttccaagcccatgggccaagccctagcttctcaaggaagcttctcaaggaagtgagcttagctattagaaggtggatggtacctcctctaacctcttctcctttatcttccgctgcatctccatggtggaaaatcaccattgaagaacctcattga

SEQ ID NO: 47241 - DNA, 666 bp, Glycine max
  Peptide Sequence Number=SeqID_164019
atggtgacatttaagggtggtggcgtagtggtggtcccaccatgggaagacattattgcgtcgtctgccacctcccgcgccacgctgcaccggccaccgcaagaaggaggaggaggagagaagctcttgagtagtggagatggaccttcatggcatgcggaggaagagactacagtccttggaagaaactttggcattcctacaaatttgattaataaggaaatgacagcttactcaatgcatgttacaggtagatcaataaattcattcactgagttttgcacatccacacgaatttccggctacaaggaagacatgtcctgtccatacaacataacttatggaaatgcaagtacgattattgggtcctatgcggaggattatcatacatttaaacaagtcaatggtgatccccatgctacaccagaaaatagcagcatgataggaaagttcaaacatacccaacatggcatgcttttgaaacaaaaaattcaacttgcaaagaataagaaaggtgcggatttaatgataagtttgatcacaaaagccactaacgtgatggataacctcaatttgagttcctgtgggaaaaggtatatatggcctggtgcaatggtagagatcttgcaaaataagtgtgcagatagtgtttttaaggcaaattag

SEQ ID NO: 47242 - DNA, 816 bp, Glycine max
  Peptide Sequence Number=SeqID_164020
atgccttccgttggacaattgaacacattgataacccagtcatcattgcagtccatgtcaagcacaaaaacattcctcatcgtagatgagggtaccaatgtttttcctcccgacgaagacgatatagcccatgttttcaagcccttacgtcacatgtgtcatggaaaagttgttatgttgaaagaagccgtaatcgatgatagtgatattgtgaaaggaattgtggaatatgcacagagaaatcgcgtcaatactatagtcgttggtgcaccccactcgtccaggaatactttggcacgaactctgaacctgaggagcggaagcaaaaaatttaaaggccatcacgatgtgtcaacaggcgtaatgaaatcagctccagattatagttcagtgtacgtaatttcaaaagggaagatagtgggagctcgaccagcaatacgcccaatgataaacgtggttccatcacaaaaggaaaatggagtaaggacatattcacatagaagagggagcaccaatggaagatcagaaagatcagctctacttgaaatgccaaggtgttcttcagctggtcagacaatgaatcagaggtcactatttagccatacctcaggttatagtgactcttcagggtcgcataagtttgagtcagcagatggaaataaacaagattgtgatttaggctctacatcagattcccaattcttaggagatatggaagctgagatgagaatgttgaggcttaaactgaagcaaactatggacatgtacaactcaacatgcaaagatgtaatcttagcacaaaccaaggtgatgtaa

SEQ ID NO: 47243 - DNA, 102 bp, Glycine max
  Peptide Sequence Number=SeqID_164021
atgagtagtgaagaggttcagtttagattttacgcaatcttcgcgctaagcgtgatttctgcgcttaacgagtatgacagtaatctcgtgctcaacaagtga

SEQ ID NO: 47244 - DNA, 195 bp, Glycine max
  Peptide Sequence Number=SeqID_164022
atgggtttaggacacatcccatttcttctgcctgcgccatattacacaaaattttcttcgcggtttcgcataaacggagaagatgcacttgtgacatcttggggtatccgtgccaataagccaagtgcagctaaatggcttgatcaactacccaaacaaaattgggtacaatgcttcgataagggaaaatgttaa

SEQ ID NO: 47245 - DNA, 420 bp, Glycine max
  Peptide Sequence Number=SeqID_164023
atgacagtagcaattgaatttaaaaacgttactaaacgctatcccctatatcatcacatcggttcaggaattaaggagctaatctttaatcccaagcgagcgttatcaatgctttcgggacgttcgtatctggccattaaagacatatgttttcaggttaataagggtgaatcggtagcattgattggacgtaatggcgctggaaaaagtacttcattatcgctcgtcgctggcgttattaagcccacaagtggaagcgttaaagtaagcggcagagttgcctcaatgcttgagcttggcggcgggtttcatcctgagttgaccggtcgtgaaaatattcggcttaatgcaacacttttgggattacgaagaaaagagcttaataaaagaatagataaaataattgagttttctgattag

SEQ ID NO: 47246 - DNA, 315 bp, Glycine max
  Peptide Sequence Number=SeqID_164024
atggctaccaaaggttggagctttgttggagcttcaatggtggaggaagaagagaatggcaactccctcgcgtttctctgcacccgtcggggccagttttcgaaagtaggcaatatatacatcaaaacgctcagaataaaaccccgagcgtggttcagagccattcaaaatgcaccgtttacaaaaattccgggtagaaatttccaggatgtcacacatgtcactcaatttggaattcccttgagactcaggttgatcaccaaggggggggagtttcctgtgcatgacagggtgacctcgacacttactgcctag

SEQ ID NO: 47247 - DNA, 1566 bp, Glycine max
  Peptide Sequence Number=SeqID_164025
atggatttccttccacaaccaacacttgtagtgatagttataactattgtgcttctctacaacatatggaggaaaaaaagcagtactattcacaaaatcaagggtctacaaccccctgaaccctcatttgccttacctttgattggtcacctccacttgctaggagcaaaaacaccccttgctagaatctttgcttctctggctgataagtatggccccatcttccaaatccatttaggagcataccctgcgcttgtgatttgcaaccaagaggctataaaagagtgcttcactactaatgacaaagtcttggcctcacgcccaaagtcaagtcatggtgtgcaccttagttacaattttgcagggtttggatttgccccttatggctcatattggataaagcttagaaagcttaccatgcttgaattgctctcggctcgccgcctcgaatttcttaggcctgtttatgaatctgaaattgatactttgatccgggatctttggatgtatcttggaggcaaaagtgatgttaaggtcacaataagtgaatggttggaacgcttaaccttcaatatgatcacaaagatgattgcagggaaaaggtatttcagttatttgcaagatgtggatgatgtagaggcacatggtatagtgaaactcataaaggagttcatgcatatatctggggaatttgttctctcggatttgattccacttcttggatggttaggtgtgcatggaacagtgcttaaaaatatgaaacgaattgcaaaagatttggacacccttgtgggaggttgggtcgaagagcatatgaagagtgataccctgaccaacaagtcatgggagaaacatgatttcattgatgtcatgctttctgttattgaggatgattctgtctctggtcatacccgtgatactatcattaaagcaaacgttatgaatcttatgctagcggggtcagacacaacatccacgacaatgacatggacactagccatgttgatgaagaacccgcacgctttgaagcgtgcacaagaggagattgaccatcaagtgggtagggaaagaagaagggtggaagcacgtgacatcaaagacctaatttacttgcaagcaattgtcaaagaaactttaagactatatcctccggggccagtattggtaccccacgaggcaagagaagattgcaacattcaaggctatcacgtgccaaaaggcacacgtgtgtttgcaaacgtgtggaaactccacagagaccctagcctttggtcagagcccgagaagttttcacccgagaggtttattagtgagaatggagaacttgatgaggttcaccattttgagtacttgccttttgggtcagggagaagggcttgccctggatccacttttgccacacaagtgtgtctcttgacactttctcggttgctccaagggtttgacttgcacgtgccaatggatgaacctgttgatttggaagaagggttgggcatcaccttgcctaagatgaatccattgcaaattgttctgagtccgcggttacccagtgagttttatcaatga

SEQ ID NO: 47248 - DNA, 171 bp, Glycine max
  Peptide Sequence Number=SeqID_164026
atggacagagatacattggggtatagtgtgcagaaaggttcaaggaacctaaaggaattagcgagtggtgactacccggtttatgcgataactcccgaatgtcatccacatggttttgtaagattatcaagacctgggatgattggtggcagtgattggaccctgttgtga

SEQ ID NO: 47249 - DNA, 336 bp, Glycine max
  Peptide Sequence Number=SeqID_164027
atgactttatcagagtttatgtctgggggaagcttatatgaatttctgcacaaacaaagaggtgtatttaagcttccatctttgctaaaagtagcaattgatgtttccaagggaatgaactatttgcaccaaaatgatataattcacaaggacctcaagactgccaatcttttgatggatgaaaatgaagttttccatgtaacaaaagaagcaagagccaaaggatttttcgacatcctcttcctagatgcagtggaacataaatatgttgaggaggtatcttcgtgcaatgctttcatggtcaaggtagttaacattttgttactttgggaataa

SEQ ID NO: 47250 - DNA, 183 bp, Glycine max
  Peptide Sequence Number=SeqID_164028
atggacaaagcacctgcaaatgcacctactgatgtagagcagcctcgacatgcagtggaggcttgtcaagcaatagctaaaaggtttgaaaggttgctcaacctaaggatagtcactgaaggaatagaagcatacactgccatcgaagactacctaaggatcacaagaggtgtgactgcataa

SEQ ID NO: 47251 - DNA, 414 bp, Glycine max
  Peptide Sequence Number=SeqID_164029
atggtgagggagcatttggtcttccaacagaaatccctaacgaaagggaagagaatttggtgcagacgcaggctaagggaagagaatttggtgcagacgcaggttcctagaatacttgaatgtgaagaacagaacaaggggctgcttccaagagttgtagaaggactttttgattccataaattctttggatatagaaaagacatattcagttaaattgtcaatggttgaaatctacatggaaaaagtaagggatctatttgatttatcaaaagataatatacaaattaaggagattaaatcacgaggaataattctacctggcgttacagagtttttgattgaaattcacataacagcaatgcatggggtttctaatcttattagtcgtaaacataccagcttgcctaaataa

SEQ ID NO: 47252 - DNA, 179 bp, Glycine max
  Peptide Sequence Number=SeqID_164030
atggaagatgttaagcctatgaaaactcctattcatgcttccgatcctttgagcaatggaaaattaggtaaaccgggaggtggaagtgcgaaatcgaagaaggcggtggttatcaacaatgagaagtacacattgggactaagctttgccaaggaaacaacatcggaagaaagggaatg

SEQ ID NO: 47253 - DNA, 171 bp, Glycine max
  Peptide Sequence Number=SeqID_164031
atggcatcgaagcgctcacccacaaaagctagaaggtcgcggagctctgtgagtacttcaatcagaagagaagtggaattagccctttacggtggaggagatgggaacattgaaatgatgaagaaaaagagtaacaaggtggggataagacataggtgcattggcccataa

SEQ ID NO: 47254 - DNA, 141 bp, Glycine max
  Peptide Sequence Number=SeqID_164032
atgccgtcgtggggggtggttgtcaaaggagatgccgtcgtggagggttttagaattgagagaagggagaaggaaggtgtaggattcaagaagggagatgcaggaatcaagtccctacatattaaccatccaaaatactag

SEQ ID NO: 47255 - DNA, 195 bp, Glycine max
  Peptide Sequence Number=SeqID_164033
atgacgaaggatgcgatccacgatcaaacctctgcagcacctaggctccactttccactttcttcttcttcttcctcagcttctcgtgcaaattcgcccaggcaaatttgtgacttagtgctaaagaaagatactagcctaggcaagctacagctcgcctcggcgagtgtattgcttatggctgaaggaagctga

SEQ ID NO: 47256 - DNA, 195 bp, Glycine max
  Peptide Sequence Number=SeqID_164034
atggttgaggttacgcactctgtgataagtattgatgatgaagtaaaggacagtgctttcaacgacgaagcagcgagtgtccgcgtacaagtacatacccaatatgagataactaggttttatgttccatacaacagaaggctaaagactttcaatactcatttgagtagtcatgtgatcacaccatcaacttaa

SEQ ID NO: 47257 - DNA, 291 bp, Glycine max
  Peptide Sequence Number=SeqID_164035
atgaaacttaagaatagtccaaaaggggcaaattgggggatcattaatcaaaagaaggaaaccctagggaaggagaaaagggcacactttggctgggctaagggttgcagtggggcctgtcaatttccggcccccactttgaaaacgcttcttgaggacgcaaaaaacttcttccaatcccaaacgctacctcgttcctctactggagagagacttaatgaagtcctaaataaactaaggaaaacagtcactgtttgccggtggagcatcatcaagattcacaagctttag

SEQ ID NO: 47258 - DNA, 246 bp, Glycine max
  Peptide Sequence Number=SeqID_164036
atgggaggagattacaactcctggcacaatcacacggtaaatagagatctcagtggctgtctatccctgaccccccaacatttaactacagcaatagtctctttgcaggaaaatttttggggaggaaaagtcttaactctcacgaagaagcacttggcggaacttggacagtcatgggtggtcccaaaatcttgcattgcaaggtttgattttggaagtggaagtggtattgagaatagtgagtga

SEQ ID NO: 47259 - DNA, 372 bp, Glycine max
  Peptide Sequence Number=SeqID_164037
atgatccaaccaagtgactatgatccattggttaaggatcaaatcaagccagtgttgttccagaggagattcgttatatacctctcatggaaaaagggtggccccaggtcgtcatttaccacagcatggtctactaatgttatggaaattttccaagcttgtggtttgacctctcatggagagggattggaagaaattattaatctggagatgggtttcgcctttgatgaccatgatttagaatactacaccaaacttgtcagagaagccattaagttcaacccaacaaatgtggaattacttgatattgtgcagtccaacattgaaacacctaattttccatgtgcattggcaccttatcctggtacatag

SEQ ID NO: 47260 - DNA, 243 bp, Glycine max
  Peptide Sequence Number=SeqID_164038
atggtgtttgcttcaacagtggtattgggtggaggtgggactttcttaggagaggtagaggccgagaagggtgtgaatctggaggttcactgtgttgcctgcaacaaaggcttctatggtgaggtttgcctgttgtggcgaagggcaacgacactgctagggcgcgatgcggagaggagtgacgatgctgctggggcacagtgtgtcgagggtagcaatgctgttagggctagggatgtttag

SEQ ID NO: 47261 - DNA, 183 bp, Glycine max
  Peptide Sequence Number=SeqID_164039
atggctgagcacgtgtggctagcttggatgaaattagcagttcctcctcttcatcatgcttttgtttgcaacgtgcgcttcttacaaaggaagctatctgttgagaagctagcttccactgtgctttggaaactctccactccatgcagctatactgaaacggaatcatggtattccttctaa

SEQ ID NO: 47262 - DNA, 1053 bp, Glycine max
  Peptide Sequence Number=SeqID_164040
atggctgaagaaaagaaccaatctatcattccttttaagccttctaatctatcaaattcgttcctaattcttggggttaaatactccaatgagacgctgagagaaataattgctactactatgatggttcatgaatacccttttagcattgttgaggatgaagctttattgaaaactgtcaacaaaattagcttaacaactgacatgtggaaatcatgtcaccaagtggttgagtatatggttgtcaccggtcatttcattgatgcgtgggggattaaagaaaatgtattttatgtgtcggttgacaatgcttcttacattgactcatatttgaagaatttgaaagagaacttatcacttagcacaaaattagttctgaatggagatttgtttcatgttagatgttgcgcacacatattgaacttgttggtacaagatggacttggtaagataaaagatatcattcaaaatgttcgtgaaagtgtgaagtacattaaccataatgatgcaagattgaaggccttcagtgatgttgttgaacaaaagcatctaaaagaaagaaagctcatccttgattctccaactaggtgcaagtttcgtataattggcgtttgcttccctttactgtacaagactgaagaaatttctaaggagaatgtggagaaggtacgaagtgctcttcaacaattatatgatgagtatgcggctttaagcaatgaagagtcatcctcaaatgaaatgagtgttggtggcataaactcctcaactatccatgtgcctaatacatctgttatgactgggttttatcaattaatgagccttgtgcatgaaaaggaagcagtcccaccaatgaaatcagaactagatgtttatcttaaggagaaaaatacttatattcctaataatggaaactcctcttttagtgccttggagtgtgttggaggtagagtaattgatgagtatcgttctagattgaacgaagaaactattgaagctctcatatgcggtggggattggattcaccataattacaatttgaagagcaaaacaaag

SEQ ID NO: 47263 - DNA, 126 bp, Glycine max
  Peptide Sequence Number=SeqID_164041
atgaagcttggaatttatgagtgtgaaccagaaaaaccgggtgagggagtgcagatgagtggatatttatggagagtccgatgggtgatgatcagaattgatttgaccatttctcagtggcagtaa

SEQ ID NO: 47264 - DNA, 366 bp, Glycine max
  Peptide Sequence Number=SeqID_164042
atggcgcatagtataatattattattcctaggtgatgaattttgggagaagtctttggagaaaagattgttgacatgctttggacaaagcttgaaagtcgtggatgatgaggaccaagttattcttcttcttaattctttgtcaagagcttatgaaaattttgttgacacaataatttttggtagaaattcactatcaatggaggaagtgaaaacaaccttacaatcttgggaattaaaaaggagaattactgattcgtatggtggtattagctcaagtgatcaaaggtttaatggtaagaggaagaatgaaggaaaggaagaagaatttccaaagaaggtgaccaaagtcatgcaacacaaataa

SEQ ID NO: 47265 - DNA, 804 bp, Glycine max
  Peptide Sequence Number=SeqID_164043
atgactatggatgctggtgatagtgatacagctgaagggaggaacgaaatcccagaggaagattttggaggccttgaaacgcaaactccagatgtgtttgttgccgcatgtgacataagcagagtcaaggagaagccatctgagattgacagaggatggaatttgagttctccatcatctggttttcgtgatgtaccaaaatgtccatccagtacaaaattagtctctgcatctagtacaaagcgccctgcatcttcctggaggcaaacccggtcccatcaaagtcgagcaggtcctgatccccatgatgattttcttgatactcctcttgagaatatcagagaaaatttcaataaggatttgaataaggaagaccaaccatgcctgattcagaaagacattagtgtggacagctcagatgatgaaacacaggatatgaatgccaaaagcagtcctcagaagaagcaaaagcaatcttctgttacagtggccaacacaagaagtttcaagtacgttgaaccagttaggaagaaagctgagcgcgaaaatttaaaaggagttgaatgcaaacaatgcaggaagttctatgatgctgttcttcctaatgctgctggcaaggatactgacagtaagcagaacttccgctgtgaacaccttgatggtgtttctcggcatcgatataggtatgttccgcccatgactcctgaaggattttggaatattgggtttgaatctgaaatgggatgggatgaggagcttgttgctggagattatcccttagtttcccgggtctatatcacatga

SEQ ID NO: 47266 - DNA, 258 bp, Glycine max
  Peptide Sequence Number=SeqID_164044
atggccgaaaacctgaatactctcccctcacccatgactacttgtttaaagatacctcaccactctcgggactctcgagtactatttggagaagaaaggaggtcattcgtaaaacttaatagagtaggagttttacagtctcagcacgtaatgagaaaaacagggcacgctcccatccctttcaccgaaatgggtaaagcacacgtgcgagtggcgagggacgaagttgactggggtagcaagcacacgtgtcagtga

SEQ ID NO: 47267 - DNA, 264 bp, Glycine max
  Peptide Sequence Number=SeqID_164045
atggcaccaacattcaaggccttcgctcttttcctcctcctcgctctcttctccgccgcctccgctcaagaattatcccccgcctcgtctccggcaccgtcgcctgaagcaggagccgcagactccgtgccttgctccgccatcatgatcggtgcctcgctcgttttgtctctcatggcggtcttcaagcgatggaaccgatcagaaaaagaaaagaatggagaggcttgtgagattgagaaatgtagaacattaacgatttga

SEQ ID NO: 47268 - DNA, 354 bp, Glycine max
  Peptide Sequence Number=SeqID_164046
atggtagcgcagttgatccatgatcgcgttgtgatggagtgcctagagggtgtttgggagaccctcgaaggcaatgagaggtgccgattccgtggcacaattagactcactgctacttcgctagtacatccggagcaacccgcacgtacacttcagcagcctgtggagtggatactacctacacctactccatatcgactagttgagtcggttcaagtgatagaggtgtcatcctctgaagaggatcttgaagaggacacagaggagttacctcctgaacctgctgtggatgcccctgactatgtgttatgtgcttatcatattctattgtgcactctgtgtggttacttatga

SEQ ID NO: 47269 - DNA, 1014 bp, Glycine max
  Peptide Sequence Number=SeqID_164047
atggccacttcaccatcatcaatgactaagattgaacacagtcacgccattttattcagtccctgtgaaacgcacgaacattctcgatctcaagaattcaaagattataatatatttaaagtagaacacaggaaagatgttagctttcttaccagcttacctggatcatcccaaaggctacaaattctcagtgctgatctcagcaatcccgaaagcattggagttttccatgttgctaccccagttgactttcaagtaaaggaacctgaggaagtagttgatagtgcactaagcgaagaagaccaagtgatggatgaaagcttttggagtgatgtagattatcttagatcttcaaagatattgaaatggtcttatgcagtctcaaagacatcgacagaaaagaatggattggatgttgtgacgatagctccacctttggttcttggacccttcatttgtcctaagcttccagactcaatttctgatgcactgaatcttagcatttggctgagtgcttgtgcttgtgcttgcttcaactcaaataatacgagaattgagaaatgccagaaggcaatattggttgaaatttatgtggaacgtgacaaagatccattagctttcaatgatcggattatggtgcatgtggaagatgtggttagagtgcatatatttctgcttgaacatcctgatccaaaagggaggtacatatgttcttcatataatacacctgttgaaagggtatatcaatttgtttctgccaaatacccagaggttcaacaacgaacaacagatgctttaaaacaaaataaaggtatcaggataccagatttatcggcaaagaagctgatagatgctggattcaagttcaagtatggacctgaggaaatgcttgatgatacagttcaatgctgcaaagaaaaggttacctgtgaggtagcagtgttccctttttatgtcagaacggttatccacattccttataataaggcaatgcttagactaaaaaaaccttga

SEQ ID NO: 47270 - DNA, 852 bp, Glycine max
  Peptide Sequence Number=SeqID_164048
atggaagaaagcaaaggaagagtgtgtgttacaggaggtgcagggtatattgcttcatggatcatcaagaggctccttcaagatggttactctgttaataccactgtaagacccgacccagcatctcaaaggctacaagttttcaacgctgatctcaacattccagaaagtttcagcgcagccattgaagggtgtattggagtttttcatgttgctacaccagttgactttgaatcaaaagaaccagaagaaatagtgagcaaaagatccattgatggtgcacttggcattttgaaggcatgcctcaattccaagtctgcgaagcgagttgtgtacacttctagttcctctgccgtgttttacaacggtaaagaagaggaagtaatggatgaaaacttttggagtgatgtggattatcttagatcttcaaagccatttggttggccatatgcggtttcaaagacattgacagaaatggcagtgcttgaatttggagaacaaaatggattggatgttgtcacactaattccaacttttgtttttggacccttcatttgtccaaagcttcctagctcagtcgatgctacactgaatttcgcatttggtgacaaaggaccatttggtttgcttcttcaggcaccaatggtgcatgtggatgacgtggctagagcttatatatttctgcttgaacattctaatctaaaagggagctcgttaaaacaaattgaaggaatcaagttatcagatttatcatcaaagaagctcatagatgctggattcgtgttcaagtgtggactagaggaaatggttgatgacgcaattcaatgttgccaagaaaagggttacatataa

SEQ ID NO: 47271 - DNA, 408 bp, Glycine max
  Peptide Sequence Number=SeqID_164049
atgccaccaccgcattctcgttgtgtgactctcgctctcactctcgccctctcattctcgctctcactcatagctctactcactttggttctcgctctcggtcacgaaaggtcatttgttgtaagatggaaggatgaactagagcatatttggcatctgctagatagtaatgacaacatgcactctgttacatacaaccaagatctggtgagcctaactctactagctgaatggacagaaccagagatttttatggactcgttgcaaatcatcagtgaccataacctatcttggacagtgttttcttcctcaccatcttcaaaagttgctctgaaccaaaagcttatcctaaatgacactccttgtaccaccaagttgctaactcaatcacttttagattcctactaa

SEQ ID NO: 47272 - DNA, 1052 bp, Glycine max
  Peptide Sequence Number=SeqID_164050
atcctcagtccaatttgttccatgaatggttcaacttcatgctcctccaccctcactactcctcttctcaatccaattacccttttgctaataattactcaaacaacaacaggtttggaattcaattacaacaaggagcagcctcatcttcatcttcatctttctatgcagctcctccttcttcccctcctctcagagaggcccttcctctaatcaacaagataagcctcaaaagtagtgagcagcaccaacaaaatgaaccctcctcaaatgttgtagaggagaaagaagaggacaagaacaaagtggacaacaacaaacatcatgagagtggtgaagatggtgatgaagaaactgtgactgttgccctacacatagggcttcctagaatggatacttcttcttctgatctggggccatcaagggtggtctcaacaacttgtatggaaattagtgaaaaagaggaagtgaacatgatttctaaacaccctttggataatagattgaacaagggtcagtattggattcccaccccttctcagattctcattggtcctacacagttcccatgtcctgtgtgctctaaaactttcaacagatacaataatcttcagatgcatatgtggggacatggatctcaatacagaaaggggcctgattctctaaaaggaacacaaccaacagctatgctaagacttccatgcttttgttgtgcgccaggttgcaagcacaacattgaccacccaagagcaaggcctctcaaggatttcagaactcttcaaacacattacaagaggaagcatggcataaagccctacatgtgcagaaaatgtggcaaagcatttgcagtgaaaggtgattggagaacacatgagaagaactgtggcaaaatatggtactgtttatgtgggtccgatttcaaacacaaaaggtccctgaaagaccacatcaaggcctttggctttggccatggatcttttggcattgattgcttgcaagaagaagatgaagcagcctctgatattgaacatgatggggagagttcaatgtga

SEQ ID NO: 47273 - DNA, 441 bp, Glycine max
  Peptide Sequence Number=SeqID_164051
atggtttttgctgttagtttctctcaaagcctccttctgtgcaagccatcatcatcatcatcatcatatcaggtcaagtgttgctcacggtcacagaacaaagaagccacgtcacatattcaaacaaagaaacggtgcttgaggtgcaacaccctttactcagatgaagataattccccacttgcttgctccttccatggccacaccaatggagataagggtctattttcatttgctccaccacaccaaggaattgatggggattggagtgataaatctggagtaatagtatacaaatggaatgagaagaatgacaggccaaacactggccgtgccaattggaagaaaagatggagttgttgtgctgagtatgatgagaatgccccaccctgtagacgtggctggcatgtttgttatgatgatggttttactttgtattag

SEQ ID NO: 47274 - DNA, 540 bp, Glycine max
  Peptide Sequence Number=SeqID_164052
atgaaagataagaggactgaggaagaaaatctagaaaaacaaaagaaaaagaaggatagtaaggccttgtcttcaaaggccaaggggaaggaaaaagaggaaaaggattcctccaagacagatgttaagaaggaaaaccattttgcaacaaaaggtcatatcaaaatagcactcattcttcaagggaaacatcccttagcactgccatacctcttaaggttgagcgggagggcgacgcgagactcacgagtgagtcttccaagggaggaaaacgcgcagagttgccaccaatgtttattcggggaaaacgtcgaaaaaactgaaatgtgtggtctacgaactttaagtgtgaaaggttcgggagttgtttttatgcacggggaaggttcggccacttcccgtgcctatgtccagtcctcgagcaagccacttgagattttccactctctttgtaaaactccttttacaaagtctagacagggacaacccttcccttatgttcaggaattcttacaacttaagagaccctcagtcccttaa

SEQ ID NO: 47275 - DNA, 213 bp, Glycine max
  Peptide Sequence Number=SeqID_164053
atgtttccaaagtctggccgttgggattttgacaataacaactgtcgatctctcgataagcgcaattccaacaaagagggaatggaactgagcacccaaaggtgcgctaagcccaattccaacagagaggaagttgcgctgagcacccagaggtgcgctaagcatgatttgcagggtgtttttaaacttcctttgaaaaaccctagagaataa

SEQ ID NO: 47276 - DNA, 327 bp, Glycine max
  Peptide Sequence Number=SeqID_164054
atggtgcagaaggagatgattaaaagaaggcatgcctgtttaaagaatagattccttgcttctcgatcccctattcagccttcacgatcatcgttgacgaaccctgctttcgcgacttgctcgacattactccgcagtcagtcaaactctcttgataacgacaaacttgaagccttcgctttcaacaccgacattcacacgctcatccctccgatgcgttacttcgtcgatgagatctcgattgtgcttcgcgctcgacaacgggaaggggaagagagggaggctgattggttgtttggggctaagttgggtttgattttggaataa

SEQ ID NO: 47277 - DNA, 1110 bp, Glycine max
  Peptide Sequence Number=SeqID_164055
atggaagatttgaacacgattggcgctgattgtgtggtcatatcatgctgctgccagtgcttgatgcttcaaattcttgtatttgtgttgctgaagcttcccgggaagttgataaggaaaacaagagaatatgctaaaaagcttcgtcataggaaggcaaataatgatagaaggatggggagagaaatgggttcttataaagatgttcttctgagaattcatgaacaatcttttagaattcaagtagagatggcactaacagatggtgcagatcacaattgtggtggttgtatggatgaagttgaaaaggtgatggaggagttttatcaaaagggagagtttgcatttgggagcttttgggggaggaaggggccatgtggggctcctacaatagtcaacgatcataatgatgggtgcaaagagaaggaaagtccaagagggcaatttcaaagccatcttacctcaaggattatgtctgaggatgaggggacaagcttaacaaactctgattttgtaatattccttgtgcacaaaaagataagaattatgttactaaggaatagccatggtcctcgaaaccagtttctaagttgcagactcgtatcatttggtgctcacattatctttgtcatgccagactccactaagccttcaggatcttccgataagctgcatgatgccttcattcgtctcacaaatcagcaactatccctgggagagtctatgaatttcatgacccacaaaattgatgagctctttcatcgtgtttcccctttgttgaccacttcaccaccaattccttcatccctatcccatagctcccctgcacctgcattaaaccacagaatgaaattagatgtcccacgtttcgacggtacagacccacttggttggatcttcaagatcaaccagttctttgaataccacagcacccgcgaacacgactgcttaacgattgcttcgttttacatggagggttgtgctctggcctggtttcaatggatgaccggcaacagtcaattcacttcatggtctttttcctccaggccctgcaaactcgattcgcaccgtggcagtacaaggatcctatcgggaccttattcaagttga

SEQ ID NO: 47278 - DNA, 1554 bp, Glycine max
  Peptide Sequence Number=SeqID_164056
atggtgcgaaggattcgtcgtgaggtacaggctcaccagcctctgaccctcgtccaagccactagtctcgcccgccttcaaaagaagaaactcctttatcaccaccaagcatcgtcacgaaaccgtgttccgctgcctccaccttctgggtctcctcgccctaatcctcttccactactcctccctcttcctccatggccaccaccgccaaccttgaagcgactgaccccggacgagatcgcctcccgttgtgagtgtgggctctacttcaactacgatgagaaataccataaagaagaagaccctcattttcctaatatagacacccacgacctgcctcctgacccgcccaataaccccaacccgtacccggcccaaatcagtttgaattccttggagggtcatctagccctggaaacgctccatttcttcgccactatctctgtccatgacatcatgcttctgggtgatagccattattaccacataactatgctctctaacacagattccttatgtgctaaggacctccctcttgaaattcaaactttaatcaccatgtttgatgccctgttccaaacaccacaaactttgccatcgaaggggcttatccaaccaagcaccagtcccttctcctcaccggttttgttggtgaagaagcataatggtttttggcggttctgtgtagattatcgcgcattaaatgccctcaccatgcgggataggttcccaatcccaaccattgatgaacttctggatgaattgggaggtgccaagtgtttctcgaagctggacctgttgcaggggtaccaccagattcgtatgcactctatcgatatctctaaaacaacttttcgatcacaccatggccattatgaattcaaggtaatgccattcaatctatgtaatgcgccatcatcatttcaagccaccatgaacatgattttctggccatatctccgccaattcatcatcgtcttcttcgatgacatcctcatttatagtggctcccttgaggatcatttgtggcatctggagaccacctttcaggtattacttgaaaaccaatttgttccgaaattctctaaatgtttctttgctaagcctcaggtggagtacttgggtcatttggtttcacataagggagtggaacctttagcttcgaaggtagcaaccattcatcaatggctgattccgtggacaaccaaagctttatggagcttcttgggccttgtgggtttttatcgcaggttcattaaaagctatgccaccatcgcagcacccttggtcaaggctactacggtggagccctttcagtggatggcggtgactcaggaagtctttgaccaactcaaacaagctttgtcgacggcgtcggtctttgccctatcgaactttcagctcccattcacagtgaagacaaatgcctcgggggtcggcatgggcgtgcggtcctatctcaacggggataccccattgctttcttcaacaaacctttcagtgcggaccttctccaagcatcgacatatgtgcgggaattatttgccatcatag

SEQ ID NO: 47279 - DNA, 414 bp, Glycine max
  Peptide Sequence Number=SeqID_164057
atggaggattggggaattttctccaccaaatccttggggaggattcagaggattccgctctggttaaagtgtttctcttggtgtgggggttcaatgggaaacaaagacgactcacgacggccaccggtggtcttgggacgtatatataacctgcaaatcacacttagcgcacctctaggtgctcagtgcaacttcctctctgttggaattgggcttagcgcacctctgggcactcagcaccattccctctctgttgaaattgcgcttagcgcaccattcgtgcttagcgagagatcgaaagttgttattgtcaaaatcccaatggtcaaactgtggaaacatgtcttaggaagctttagacaaaatttgaacacaatccaacagttaacgaatccaggatcacgattttactga

SEQ ID NO: 47280 - DNA, 648 bp, Glycine max
  Peptide Sequence Number=SeqID_164058
atgaagaagctcgcggggttgttgtgccctttgccggtcccacaccgcccatgggaagacctttccctggatttcatcatcaaactgtcgttgtaccatggcaacacaatcatccttgtggtggtggatcgcttctcgaagggcattcatctgggattgctaccacctgctcacaccgcacactacttgcatgcatttgtccaccgctggccaggagcatggggtaagcttctcccatgggcagagtggtcccataacacttcctggaatgcagccataggaaccactccatatgagatcacctttggccgcaaacccttcaattttccagagtatatcgcggggtcctctaatctcaatgtcgtggacgacatgttgactaacagagaggaaatctttcaggccattcacaagaaatttctgaaggggcaagcaaccatgaaagtgcacgctgatagcaagcggtgcgaagttcacaagaaatctctgacaagctggccaaatgattctatgggcctttcaaggtcattagacgtattggcaaggtggcttatcatttacaactaccggcaaaagcaaagatacattcggtttttcattgctctatgctcaaaccatttcgaggatctccagaggacactaaaatag

SEQ ID NO: 47281 - DNA, 171 bp, Glycine max
  Peptide Sequence Number=SeqID_164059
atgttgtcgcacgacttgcactgtcgcaccactgcaccagtttgtcgcaccgggttgaaccacgccgtcgcaactttcacagacgaaccaagtgtcttttttctttttccttttgtttctatgggaatatttgtgtcaagccttgattttgtgatgtttgttaatatatga

SEQ ID NO: 47282 - DNA, 336 bp, Glycine max
  Peptide Sequence Number=SeqID_164060
atgcaacatttctttgttactttgatgtatgaccgagtcctaagataccctgatcgtgttagaaatttgtatttcacttttctctttgtgcgacgagcagtaaccaaagcagagtatgatacttgtaaccccaatgagaaccttacaacacaatccttgataaaacaactaatttacaacctcaagcttcaagctgcatgtccaattccatttgatgaagctaatttgtggaaaggccgaagtggacttgagctaaaacaaaaaattcaacaacaattcagaaacatcaggtattacttcaaactagtggaagtggactgcgctctgtctagctaa

SEQ ID NO: 47283 - DNA, 612 bp, Glycine max
  Peptide Sequence Number=SeqID_164061
atggcagaagtgcttagctttaaggccccatctgagttttgtaagcttccttacaaatccttggtactcgctagaatttccaaatccaaacaaacaacacccccatcagcaattctcgtcacaagcaatttcacaaactttctagatattcctatgctatttagcacatcacagaagcacgtttctccttcaagaacttgctcaagaggctgcaagcctgagaaaaggtggctcaagaggccgcaatcttcgccgggagggaggcgaatggtgtcgagatcgagagtggagattgacgccgagacgcagcgccgtgtcctcgatctcctttgttaccatgacgtccgccatgattgtagcaagcatagtgttatcgttatggaggtagatggcaatgcgagaaagggtttggtttctagggttttctccagtttcaaaatgcaaaaaagatgtgccacagggtttgttgcaacctacccttcggcaggaggacgacgcgagactcacgggatcgtcttccaagaaaggaatatgcacggagttgccaccaacgtttatttgaggaaaacgtcagaaaaaccgaaaaagacgtggtctacgaactttaagtga

SEQ ID NO: 47284 - DNA, 390 bp, Glycine max
  Peptide Sequence Number=SeqID_164062
atgggtgccaagtacctcgaagtggtcaaacgagggtcgcatcccaacaaacggatggtccccggacgaaatttgggtatgacagttgccgctctttacttgtctttaattggagataaaagggaaacgcagaatgaccataatctgtctctgcgtgcccttggacacaatcgagcctgggtggcatgccgcaaaatgaccataattttctctgcgtgccaccagacacgatcgcctgtggatggcgaaaaggtgtggggaatgaccataatttccctccgcccacctctcgacttactgtccctgaatgacaaagggcgtagaatgaccataatttgtctctgcgcatttatcactcatcatgtcatcgggcccgccgcctctagatga

SEQ ID NO: 47285 - DNA, 774 bp, Glycine max
  Peptide Sequence Number=SeqID_164063
atgaagaagaagctgaaggaagctgcaaagtcaggaagcgtggatggcgtcattgaccctccatcccccgtcagacgccacgtgaagtgcaagatgacccgcaccaagaaaacaggggagatgacgactgaggccgcaaaggaaatcactgacaagatcataagtcattttcaactaaccattagaattatatctctttattttgagcaccctggacatcaggatcctctcaccgctgctattggacgtctagagtaccctggacgtgtctgtgctactgaagtcggtgtcaccatcagccaatacttcggattggctccacggacgtcccgcagctcttccttgctgcctcctaaagaattgcagcagctgacccaacaaatcagggaccagctagaggagtcgatcacagaaaaagtgactcaccagctcatggcatcgttcaaccagatgcagtcccagtttcaatcccagatgcaatctcagggacttgcactgcctccggagcctttggttggtccctcaggtcctcgagtaagcacaaaggagagttatgttgatccctcaagaaacgatcctgagacgggtgactcagagaggtgcggcttgtacatcgaagcaaattctgactgcctagttgccctgggaagagtttatgagggatccactgttgttcataacactcgtttgttacctggcaaagtaaaggtgagtgtggaggaggttaaagattcagatgctcccgttctgtacccactgatgaggtttccttag

SEQ ID NO: 47286 - DNA, 228 bp, Glycine max
  Peptide Sequence Number=SeqID_164064
atgagtcaagtccgggttggaaagacaatagagaacatcttactctatcacgtcctattttggattcaaatccatggactatctgttggtttcatgttagaaaccatagggaaacatctaggaaagcctagtgaagggaagaggcctgaagttaaaggcagaaaactgatggcaatggtggcatgggtggaagacagtggttacgtgaggagggaacaaagtgggtga

SEQ ID NO: 47287 - DNA, 189 bp, Glycine max
  Peptide Sequence Number=SeqID_164065
atggactatgatgtcgttgtgacgaatgatcagaatgaggcctctgctaagaaggtcctggcaaccaagtctaccaaggactatgagcaatttgagctggaattgtcatggactaggtcaccggagagtaatttccggcttaagagacttggtttggatgcacaagctggatttgttgttctagtgtga

SEQ ID NO: 47288 - DNA, 123 bp, Glycine max
  Peptide Sequence Number=SeqID_164066
atggcacactcaagctacatttcaagttcaagatttccaaattcttcaaatcataccagactcaagatgaagaaggttaattggtggtcactcaactattgcataatgggatattcaaagtaa

SEQ ID NO: 47289 - DNA, 636 bp, Glycine max
  Peptide Sequence Number=SeqID_164067
atggcggacctcatagtaatgaaggagatcgaggacacggtgctgtgtctcggcgtcgatctctccactctcaatctcgatgccatttgcctccctctcggcgaagattgcagcatcgtcagtgatgacgaggtggtttaccaggaggagaatctcgagtttgagtctgaatttggtaacatcattgtcgcagataacctccctgtggttccgagggagaagttcgagaagctcaaaggagtgctgttattacaagtacgttgtgctagaaatttgttgtgttacattagagttatgatggtgaacctgtacccattttatgataaagtcacatcagccgggggcattgaatttgaggatggaattgaaaatgttgacattggtggtccagccatgattagagctgctgtaaagaaccacaaggatgttttggtaatggttgatacagaagactaccttgtccttctggaatttcttaaaggaaaccaggatgatataaagtttaggctaaagcttgaaatttccaccttttttgttgcattcactggtcacacaacctcacccttgcttatttctggttgtgtgatcttctatagcctgattacacgagcatctttcactcaaaagaccaaatga

SEQ ID NO: 47290 - DNA, 342 bp, Glycine max
  Peptide Sequence Number=SeqID_164068
atgatagagttgtgcctagtgcctaacgtcgtcatccctctgaagttcaaggtgctgaatttcgataagtacaaggggactacttgccccaagaatcacctgaagatgtacaacaggaaaatgggggcatactcgaaaaatgaaaaatttttgatgcatttcttccaagaaagtcttactggggcaattgtcacctggtatactaatctagaaccttcccgagtccattcttggaaggacctaatggttgccttcattaggcaatatcaatacaattttgatatggctttggatagaatgcaactacaaaacatgtgtaagaaggagtatgaatctttgtaa

SEQ ID NO: 47291 - DNA, 318 bp, Glycine max
  Peptide Sequence Number=SeqID_164069
atgggctttgaaaaggctgttaggctggttgggttctttgtcaaggaccttgatttgggtctttttgacccattcaaggatgtgaagggtggtgttctgcttgacgaagaagaaattgttgcagaggaggatgctgttgatgaggagcatagtgctgaggagcgaggcaatgatacccaagccgccatgatgaaggttaaatctttaatggcgcaggaagcaagaccttatcgatgtggaggcaagactttagtggttgaaggtcttgccaaccagtctgggggtaggtcgtcttggcttgtggagcctgaaccttaa

SEQ ID NO: 47292 - DNA, 495 bp, Glycine max
  Peptide Sequence Number=SeqID_164070
atgagggaactccatgaaggaatttgcgaccaccatataggaggaccctcccttgcaacaaaggtggtgcacactggctactattggccaacactcagggtagacacccttgattttacaaaaagatgcagacaatgtcaagagtttacagacattccatgcacttttgctgacaatctccaaagtctaagctccccttggccttatgccatgtggggaatggacatattgggaccattaccaaaggccctaggagcagtcaaatacttacgagtcatcattgactacttcaccaagtggatagaaacaagaccattgtgggaaattacagctagtgagctagagaaattcacttggaaacacctcatttgcaggtacgacctcccatatgccattgtcacggacaacgacactcaattcaaagcccagacttacaaagacttcctgacacgactaggcttcaagcaccttatcacctctatcgaacatccttag

SEQ ID NO: 47293 - DNA, 417 bp, Glycine max
  Peptide Sequence Number=SeqID_164071
atgtctatgatgggagttcagagtgtctcctggatgatagtcttgaggtgcccattctttttagtgttggctagcttggagaacaggtctactctgggtgacattgtcagggcctttgaggatgatttctgccccacttcccttcatgttggatgcaccatcaacatagaggttccaccagtctggggtggtttggtcattcctagcaaattctaccaggaagtctaccatgaaccgtgtcttcatggggctgtggtttggaaagttctatggaccaggccaccatccttcatggctaggctaatggcttcgtcgattactaaaagatataggagtaagtgtacccctagcctgggccgacttacgactggtggtgtagccacgatcttcttgaaggctaagaaagcttgttcgtag

SEQ ID NO: 47294 - DNA, 756 bp, Glycine max
  Peptide Sequence Number=SeqID_164072
atgaacgatcctctccctgccttagacgatgaagtgcctaaccttgcccccgttttatgtctaagaaattatgggcaacttcacttggagccccttgtaaagcaggtcggacctgtaggtggaatcgtgccaccgtctactgttgcccctactactggagaagagggtcaccctactggtgaggttggccctattgctgctattgttgaggtcacccccgaacgccatggactccgccaaagtcttcctttagagaaatttggcaattatgaaggagaatggacattagcaccaagaggctctacgcaaggtgttgtccttagagatgaaggtttccaaatggagggcctattgctcgcacagtttggagaaaggagcgccctaaggtcgaaccaccaacgatcttccaaggttggaagtgtcttggccaagttgttgtgcacatggttggactatgatgaactgttcacacgctgcaaagctttgctagaagagaaaaaggactctgctgacagggtggaaggcattgtggcggagaaggacgagcttgccaaggtggttgctgatttagaggtccgactaaaggagttgaagtccaagctagaggcgtccgagttatgggcaaccaaggtgagggagaccagcaaagagtttgaaaaggagttgaccaacaacaattttcaccaaaaggggaagagttgtttacgcacggggaagggtgttgcccttgctcctatgtatcctcaggtgcgatga

SEQ ID NO: 47295 - DNA, 606 bp, Glycine max
  Peptide Sequence Number=SeqID_164073
atgacaggccctcccaatgagtcaacctcttgctttctcataaggacagaccctagggtactagaacctaacgcctttagaagactgcacgtcctcgccattagagggctgcacaccctcaccttcagaggactacacgtcctcgccatcagagggcggcgcaccctcaccttaagaggactccacgtccttgccatcagagggctgcacgccctcaccttcagaggactaaacgtcctcgcctttagaggactgcacgtcctcgtcttcagagggctacacgccctcgcctttagaggactagacatcctcgccatcagaggactagaagtcctcgccatcggagggttgcacgccctcacctttagaggactacacgtcctcgcctttagaggactgcatgtcctcgccatcagagggcggcatgctctcaccttaagaggactacacgtcctcgccatcacagggctgcacgccctcaccttcagaggactacacgtcctcgcctttagagaactgcacgtcctcgtcttcagagggctgcacgccctcaccttcagagggctcacgccctcgcctttagaggactacacgtcctcgtcttga

SEQ ID NO: 47296 - DNA, 270 bp, Glycine max
  Peptide Sequence Number=SeqID_164074
atgacgtgcgaccattctttggtcctcgtgaggtgcttggcacccatcattaggcaatttgtgaaattccaggacatgccgaaaaaccaaaaaaatattgatgcacaatcccacccaggcccacttgggccctccggaatattcctccagaaggcggttgcttctggaggaagcaaccctgctcgcctgggcgagctgggcggcaaccacctcccctattttgctataaataggggaggaaggcaagaaggaaggggttcagccccttag

SEQ ID NO: 47297 - DNA, 249 bp, Glycine max
  Peptide Sequence Number=SeqID_164075
atgaaggatggacactttaaatctgaatgtctagatcttgaaaagtccaaggacaacaagaaatactttaagtccaaggataagaaaatcctcatgagcgcttgggaggatttggacagtacctcatatgataaggaagaggaggaggaagccaacatttgtctgatggcggacacaacctttgaagaatttgaatcaggcgaagaagatgagatcaatggaaacagaatggagaaggacaataggtga

SEQ ID NO: 47298 - DNA, 702 bp, Glycine max
  Peptide Sequence Number=SeqID_164076
atggagggtcaatctagggaagagtatattggatcactaaggaggaaaagcagcggtttttctcgtggagtttctaaatacagaggtgttgcaagacaccatcataacggaagatgggaagctcggattggcagggttttcggcaacaaatatctttacctcggaacttatgcaacccaagaagaagctgccacagcatatgacatggcagctattgaatatcgaggactcaacgctgtgaccaattttgacctcagccgctatatcaagtggcttaagcccaataacaacaataacaaagtcaattctaataatcttattgtctctatccctaattgtgcgaccaactttaccccaaactctaaccaacaacaaggattcaattttttcaacagtcaagaatcattcaataataatgaagaagcggcaatgactcagcctcggccagctgctgccacgtcagccctaggacttttgcttcaatcatccaagtttaaggaaatgatggagatgacttctgccatagatttgtcaacaccgccatcagaatctgagttgccgccatgcacatttcccgatgacattcaaacatattttgagtgtgaagattcccatagatatggagaaggggatgacatcatgtttagcgagctcaacggctttgtgccccctatgttccattgtgatgactttgaggcttga

SEQ ID NO: 47299 - DNA, 439 bp, Glycine max
  Peptide Sequence Number=SeqID_164077
acagcaagtccgatgacatgcgagggtatcgtatggttatccgcacctttggtcatctagagacggcaagtccgatgacatgcggggatgacaagtccgatgacatgcgaggataccgtatggttatccgcaccttttgtcatcccgagacggtgagtccaatgacatgcggggatgacaagtctgatgacatgcggggggtaccgtatggttatccgcaccttttgtcatcccgagacgaagagtctgatgacatgtggggggtaccgtatggggtaccgtatggttatccacaccttttgtcatctagagacggcgagttcgatgacatgcgggagtatcgtatggttatcctcaccttttgtcatctagagatggcaagttcgatgacatgcgggggtaccatatggttatccgcaccttttgtcatcccgagaca

SEQ ID NO: 47300 - DNA, 195 bp, Glycine max
  Peptide Sequence Number=SeqID_164078
atggtcataacgcttcacgcggatgtccgattcaggtggatcacagatcgagacgctcgaaaaattatcaaaggaagctcactagaaattcaaatggtcataacttatctcacggatgtcagattcaggtggataacatatcgagacgctcgaaaattatcaaaggaagctcacgagaaattcaaatggtcataa

SEQ ID NO: 47301 - DNA, 570 bp, Glycine max
  Peptide Sequence Number=SeqID_164079
atggagacaagcctttacaccaatgacgaggcaattctatgtcgtgtcttccctatatccctcgagggagcaacattgacatggtatggtggactcccaccaagatccatagatagcttcgacaccctcatcgaacgattcagtgtgcagtacgccaccagtaggtctcattgcatgaccttggctgccttggccagtctacgacaagcagacgatgaatccctcagaaagttcattggcaaatttgggcgcacagtcgtccagatccgaaatctcaaccctgagataaagttgcattccatgcttctcgcactacaccctagcaagttcgtagatagtttgtgcaaaaaactacctggtagcatggatgagccgcacgaacgagccaagggttacatccagatagaagaaatgtccaaattctggaatgaagtctaccaagtcaaacaaaagtgtgaaaggtgcaaagcaaacaccaagaccgacttgcacaagtcggacaagaggcacaagctagacaagcgccaacctctctccaaaaggcccggtatgagcgttacataccattga

SEQ ID NO: 47302 - DNA, 445 bp, Glycine max
  Peptide Sequence Number=SeqID_164080
aaacaacaagttgggtggtaaacgcgcagagacagattctgtgccctttatcattcaggaacaacaagctgagtgggtaaacacgcagagacagattctgcaccctttatcattcaggaacaacaagttgggtggtaaacgcgcagagacagattttgtgccctttatcattcaggaacaacaagctgagtgggtaaacgcgcagagacagattctgcgccctttatcattcaggaatagcaagctgagtgggaacaacaagctgagtggaaacagcaagttgggtggtaaacgcgtagacacaaattttgtgccctttgtcattcaagaacagcaagttgagaggctcgattgtgtccaacaaaatgcagagacaaattatggtcattctgcgtcttgtatcaaccaagaggaacaaattcgacagtatcaggatgatgtgttg

SEQ ID NO: 47303 - DNA, 664 bp, Glycine max
  Peptide Sequence Number=SeqID_164081
aggactacatgttctcaccttcagagggctacacgccctcgccttcgtagggttacacaccctcaccttaagaggactacacgttctcaccttcatatggctacacgccctcacctttagaggactagaattcctcgccctcataggactagacgtcctcgccttcagagggctgcacgccctcgccttcagaggactacatgtgccccttttcagagggcgacacgccctcgcctttagaaggcgacacgtcctcgcctttggaggggccagtagtttccttttatcagttcctgggccaccccctgatattggagggcgaccaactgtgcaagcacaaccaaaggaggaggctatcgtgcagctactatgcataccggggcaacatttcaaccgtgctgctgcaaagagacaagtgcagatcatgcgcaccaacatgaccactattacacagatatggatgacgttgctacttagcaacattctggccagcgaccgtaatgtcgatctccccctgcagaagaatcaggatcgtacccacaagacacccagtgagcccagagaagtccaacagggccctggggtctccagctttggttacgggcctctgtcagtcctacagggtgcccattccccccagcaagttcatattgttctgacatag

SEQ ID NO: 47304 - DNA, 393 bp, Glycine max
  Peptide Sequence Number=SeqID_164082
atggtgggtttatacgtgatttgtggatgtggagaattattttgcaccatcgcccgaccgtcacctgctttatttgccctcttcaagtccacaaccaaaatccggattaagcccaatacttatcaaggtaatccttgtggcgtctaccctgacttatcttccttcactggaagtggcatcatccaaatccccgtagcctgtatcaaacgatctgctcctagtcaggcaatcaattcatggggctccggacctgatggtggaggatgcatgaacaacgctaggcaatcaattcgtggggcttcggacttgatgatggaggatgcacgaacagcgctaagcaatcaattcatggggctccggactcaatggtggaggatgaatgaacagtgctag

SEQ ID NO: 47305 - DNA, 438 bp, Glycine max
  Peptide Sequence Number=SeqID_164083
atgattcctttcacctcttcggagcttgagcttactattgctgcctataaagcccctcaaaactttgctggcacgtgttcttccttttgggccttcttggtttctcgttccaaggcatcagcggtggccatattgacgtcccttagttcatcatactcttttcagactttgatggctatggacttgaacttctcttcgactactcgggctctttcaaactctgcctttagggcttgtacctcatcactttcttccgaagctttaacctcatcgtccctcacaccacttatgatagccgccgatgatcccattactgcttcccctaagctctctgtcctttcttcacgccgcatcccatgccttgcgaactccttggagtaccctcgcgttgtggtcactaaaaccccgtgcgatgaaaggcgtgatgctttcgtctaa

SEQ ID NO: 47306 - DNA, 829 bp, Glycine max
  Peptide Sequence Number=SeqID_164084
atgggagttgctggtgtattgggcgcggcactactatgcgctattcatggtgccaccgtagaaaatactttatttgaagatgtaactggtttatggatgagtgctcttggggtagtcggtttggccctgaacctacgtgcctatgacttcgtttctcaagaaatccgcgcagcggaagatcctgaatttgagactttctacaccaaaaatattctcttaaacgaaggtattcgtgcgtggatggcggctcaagatcagcctcatgaaaaccttatattccctgaggaggttctaccacgtcctgggggggaagttatagacaccttgccatactttgtgtctggagtacttcacttaatttcctctgcagtattgggctttggcggtatttatcatgcacttttgggacctgagactcttgaagaatcttttccattcttcggtgcgtttcttctagtattcaaggctctttattttggagggtggattgttagtgtggacgatttggaagatataattggggggcatgtatggttgggttccatttgtatacttggtggaatctggcatatcttaaccaaaccttttgcatgggctcggcgtgcacttgtatggtctggagaagcttacttatcttatagtttaggtgctttatctgtttttggttttattgcttgttgctttgtctggtttaataataccgcttatcctagtgagttttacgggcccactgggccagaagcttctcaagctcaagcatttacttttctagttagagaccaacgtcttggggctaatgtaggatctgctcaaggacctacaggtttag

SEQ ID NO: 47307 - DNA, 335 bp, Glycine max
  misc_feature (99)..(99): n is a, c, g, or t
  Peptide Sequence Number=SeqID_164085
accttaataaggtgggttacaaggacaaaccgttcattatggtagaacaagacaggcaggtgttttacgtccaagaaccgtgtgattcaagattgttantggttctacgacaaagaccaattggtatcaatgaccacaatgattattcaacacttgacatttgtgagacacctacttttttcacaaaaatgccttctataattgaagaaaatgaggtggatgacatatgtgcaaatcacaatgatcatgatgaagggttgaatgtaaggtatttggttcaaagtttgaatgtgtttggatggaaaatgaagatgataacaatggtgttcaagtag

SEQ ID NO: 47308 - DNA, 609 bp, Glycine max
  Peptide Sequence Number=SeqID_164086
atgtccgaggcagcacaaggtggcggcgccacgtatgaaaccaaagtggagatgtatgactcgcggtttgacacgtggcggattgtggggtccacgcctgtcgagtttgccgttaggctcaccgtgtggacacccaatgagaacgtgtgcattggagaaacgttgtattgggtaacctcggccagagtctatagtgtcatgggatttgatgttggtagaaatagatggagggagttgggtgtgcctatggctgagaagctggaatttgccacgcttgttccgcggaatggggcattgggattggttggtggcacgtgtggtggaagtgcttgcatttgggagctaaatgaaggggacaaatggtgcttagtggataaggtgccacttgaattggggttgagattgttgggagagaagagaatttgggagagtgttaaggatattggatatgggatggtgatttgcaaaaaggtagtaggggaaataatgggtaggtgggaatgggtttgggttgatgggtgtggttacaccaaggggaaacaagtgcataattgtccaatcagaggggcacttgttcatccaagtcttgcctcctctcttatcttttaa

SEQ ID NO: 47309 - DNA, 381 bp, Glycine max
  Peptide Sequence Number=SeqID_164087
atgaagtgcttcaaatgtcttggaagaggacacattacttctcaatgccccaccaagaaaaccatgattatgaggggccaagacttttatagtagccaagatgaggctactacttctcctttctctagtgaaagtgaagaagaaaaaggggaagaatctagtgaagagatctacccccaagaagaagggcaacctttaatggttaaggaggagtgtaaggaggtaagtgtctcctccaagagtgatcaagggattcccatgaaccctaagagaataaaggtcattcctgagtggcccactccactaggtgttgaggaaaaaagcccaaattttcaagaacctcgggatttgaggtcaaatccttttcaaggggaggaatga

SEQ ID NO: 47310 - DNA, 231 bp, Glycine max
  Peptide Sequence Number=SeqID_164088
atggctacaggtaatgtaaagtggtttaacgactcaaaaggttttggatttattaccccagataatggtggtgccgatttgttcgcgcacttttctgcaattgcttcagatggtggctatagaagcctgagtgatggtcagcgcgtaacatttgatgtgatgctatcttcatacctagacagtcgtctactcgcaccttctctttccccagctattgggaatcaagtgatg

SEQ ID NO: 47311 - DNA, 180 bp, Glycine max
  Peptide Sequence Number=SeqID_164089
atgactgtgaaaaagaggctaagtcaagaagtgctaaaagtgacggttgagcttagctcatcagtggggctaagcatgcatccatcgctaagcgcagcttcagcgtgcttagcacgacagcagaatctggcagagcatcaatatcagggccgcacactaagcgcgagatcagttcgctaa

SEQ ID NO: 47312 - DNA, 591 bp, Glycine max
  Peptide Sequence Number=SeqID_164090
atgatttgggacctagctacgatagaagtctccgtggaagcgattgcatcccttacccagtattatgaccatcccctgaggtgcttcacatttgaggatttccagctagtgccgactgtggaagagtttgaagaaatcctaggatgcccgctgggaggaaggaagccatatcttttctcagggttctatccctccatggctagaatttccaaggtagtgaaaatcttggcacaagagttgaactgggtaaagaaaagccggaatggggtagtcggagtaccaagaaggtgtttggaggagaaggcaaaggccttggctaatcaagacgaatgggcttcttttattgaaatcttggcacttttgatcttcggagttgtcctctttccaaatgtggaagggttagtggacctagcagcgattggcgctttcctctcccttcaccatggcaaggagagcccgatcgtcaccattttatccaacatgcatgacgcgttcgatcagagatgtgaaaagagcggtgcaagaattgtttgttgtacaccggctctctatgtgtggctggtttcacacctttttcgccaagaaaggtag

SEQ ID NO: 47313 - DNA, 318 bp, Glycine max
  Peptide Sequence Number=SeqID_164091
atgaccggccctctcgatgagtcgatctcttgctttctcataagggtggacccttgggtacttgtacctatcacctttagaggactacacgtcctcgccttgagaggactacacgtcctcaccttcgtagggctacacgccctcacctttagaggactacacgtcctcgccaacagagggctgcacgccctcgccttgagaggactacacgtcctcaccatcagagggctggacgccctcacctccagaggactacatgtcctcgccttgagagggctacactccctcaccttgggtactagttaccctcaccgttga

SEQ ID NO: 47314 - DNA, 839 bp, Glycine max
  Peptide Sequence Number=SeqID_164092
atggcatatgataaagaaatgttagcagaacaatacaacacggcataccaattgctcacagatgagcaaaaaactattgtcgataccattatgtctgtggttaacactcaatcagctgcagtttactttctctatggatatggtggaactggcaaaacatttgtttggacaaccttatcatctagtatatgctccaatggtggaattgtttgtatagttgcttcaagtggaattgcttcattactatttcctggtggtcggatcgcacattccaaatttgctataccagtccctgcaacagaaaattcaacatgcaatattcatcaaggcagtgagttagctgaattattaatggttacaaaactaatagtatgggatgaagctccaatgtgtcacaaatttgcatttgaggcactagataaaagtcttaaagacatcatgcaaaacaatctgccttttggagggaaaattatggtttttggtggagatttccgacagatcttgccaattgttccaaaaggagatggaaaaattggacaatataatgacggattttcagaaatcactattccagatgagtttcttatcaaaaattatgatgatcctatccatgctattgttgaagccacctatcccagcttgatagataactacagtgacacagattacttgcaaaaaagagctgttctttcctctaaaaaagaaattgttgaccaaataaatgattatgtcctatcacttatacccaatcacgaaaaagagtattgcagcgcagatagtattgataaatcagatgaattgctcaatcctgcttttgcattattgccacctgaattcct

SEQ ID NO: 47315 - DNA, 312 bp, Glycine max
  Peptide Sequence Number=SeqID_164093
atgactagccttactaatggcgatgctggctccctcaacaaggtccccacgatcaagttcaccaagctcttcattaatggagacttcgttgactctctgtcaggaaagacatttgagacaatagatccaagaacaggagatgttatagcgaggataagcgagggagataaagaagacattgacattgctgttaaagcagcacgtcatgcatttgacaacggtccatggcctcgccttcccggctctattacggcggagtgcagtaacttcccttggctgaatgattttccaaagatatggggaatggattga

SEQ ID NO: 47316 - DNA, 1909 bp, Glycine max
  Peptide Sequence Number=SeqID_164094
atggctaaatttagtgcacaggaagttagtgcacttcaagaaggaggaaatcagcgtgcaaaggaaatctattttaaagaatgggatccacaacgtcattctttgcctgatagcaggctccgggactttattaagcatgtttatgtggatagaagattcagcggtgagaggacttatgacaaacctccaagagtaaagggtgacaaggatgatttccatgaaaacaagaggacagagacttatcacagaagcccttcatatgaggacacacatgaacgtcgttacagtgacaggtctagtcctggtggaagaagtcctgtatatgatcaagaaaataggcaatatggtgattacaagaaaagccctggtcgtcctccaataatcaatgattggcgtcgagaagatagattaggggatggatggaaatttgaagatcatagaatatctgatggaaatcataatgtggaaagtacttctcctgagcaaaccaaggatctggattcttccagcccacctgcagtccgacctgttagagagatcttgggagaaaatgtagtacctcttcgaataagtgaaccacccaaaacaaacagtggacaggctactaatggctcagcactcacacagagaacttcatcttccagtagcttagcatccagcaatggaacccctgcagaagttaagcttgagactattaagagccttattgattttgatgatgatcctgaaccacctgttgcttcagcaattcctcaagccccgcaaactactgtggctaaacatgggatgcctgcaaattccaatgataataattgggcctcttttgatgttgctcctgaggcaaaagcacctcagggtccttcgaatataaatccacttgaatccatgctgacacaattgtcagtaccagtatctttaccttctcatgtttcaagagcccaaggtgattcccatgttgcaacagctaattctgggagctgtgcgacaagattattaatattcaatgactcttctgtttctcgtgcaggacctttgacggggtcagctcttaccactactgctgcaggagctccaattgttagcagcttctcaacattcccagccagtggtgcttcagtaacatcttttggattaacaacagcatcaactctcaataatgcaggacagtgggctactttgcagtatcagcaacagcaacctttgctcactgctgctgctagtcagcctactattcaacaatccactccaccagttggtggagctttgaataatcagccctggactgtaccttctgtacaagggcacgcaaacacaccaatgcctcatgcatcgcaccttgtcccaaagcctgccaatgaggctaaatccagtgttgttttacatccttctacagtagacataaaaccaagtggaagaagtgagcttcctgaggatctattcactgtaaaatattcaccgttccctgctccagtcccaggttggcaaatgggtccaccacctagcatgggtatctcaattcaatacaataatgcagtgcccatgccaagttatgcacaaccatcaaaatcaacaaatccatttgatgtcagtagcgaaccaactccagttcaagccccaatgtttccttccatgtcatctttgcaaggtgctctgcctagtgtaacgccttcagctacaatgcacccatcaaacatgggtaatatatctcatgcctggaatccacactcatcatcaccatcttatgtatcgcctcctcaagcacaaactcttgcaccagcaatgggactgggggcatacatgggacaacaaatggcaactaacatgccaatgccaaggcatcaaggaattgggagttttgccaccgaggcaactgcttttggattctcaaatccagatcaacagctgactg

SEQ ID NO: 47317 - DNA, 213 bp, Glycine max
  Peptide Sequence Number=SeqID_164095
atgatgccatacttgggacatatccatctggaacgtactgttagaataattctcccatgcactgagccaccgactaaacctgtcactgctcagtgctcacttgctctcaacttcatatgtagcgacctcaaggagcaaaacccgtgcttcacgctagtaatggtttttccatttatagattttgctaaccccgaatatatctcgagcaattaa

SEQ ID NO: 47318 - DNA, 2037 bp, Glycine max
  Peptide Sequence Number=SeqID_164096
atgcacagacagtccaatggcaacctcgtatggtcggtgaagacgtttacttatgaatcgttgaacaatgttgccacagtgataaatggtgtgtcagctcttgtgttgacattgctgcctgggaaagtttctatacttgaaggtattcagggttgggagctcaggccaactcttcgtggaccacgctttccacgttggatggataaaggtgtgtcctctttcaaccactttattcatgagctttctgtggattccgatgtatcaagcctggaatattcatctgcagaagacagtgatgatggatatgaagaatatcctgaatcaccctcatctcaatgttctagagcctccaaacctaattggattttggctcctattcacttcttgctggggattccatttcgcctttttcagttagcttattctggctctgggctgtcagaaccgccggttatctctggcaatgaacatccttcacaaccacattttcctaatagagtgcaaagcctcaaggaccaaattatccatcgcactactgacaggagacgtgggatcattgaggatctccatttggccacggagatatttatagaagctgtttttgatgttgttcacaaggcaatccatcttcttctttccccatcagaagcttttggaacattgtccaggttgttttcatctcatgaaagacgcattttagttgataatgatgttgttgaggaagcctctacttcttcagatacacttggagagaatgagccaacacctacagacaggaataccagttatcgttcatctctgaacacagatgcccggacatgtcaagacgttataacagagctagggtatccatatgaagctattcatgtgatcactgccgatggatatgttcttcttttagaaagaattcctaggcgagatgcacgtaaagctgtttatcttcagcatggagtcttcgattcatcaatgggttgggtatctaatggtgttgttggctctcccgcttttgcagcctatgatcaagggtatgatgtatttctgggaaactttcgtggtttgatttctagggaacatgtcaacaagaatatctcctctcgtgaatactggaaatactccatcaatgaacatgggattgaggatattcctgctatgatagagaaaatccatcaagtaaaaactgctgagctgaggcttagtaagcctgatattgaggaggaaagcaatgatggtcagctttacaagctttgtgcaatttgccatagtttgggaggagcttctatgttaatgtatgttgttacgcgtaggatagaagccaagccccatagactttcaagattggttttgttatcacctgctggttttcatcatgactctaacctagtcttctctgtggcggagcatgtattgtttttgctggcccctatttggtctcgaattttcccagccttctatataccaaccagatttttccgtatgcttgttaacaagttagctcgggacctgcaaaacctacctgcagttggaggattggttcaaactttagtaggttatgttgttggtggggacagctcaaattgggttggagttttagggttaccacattacaacatgaatgatatgccaggcgtatcttttggtgttgctctccatcttgctcagataaagcgtgctagaaggtttagaatgtttgattatgggagtgcatatgctaatgtgaaagtgtatggttcccctgagcctgtggacttgggcgaacactatggactcatcgacattcctgttgatctggttgctggtcagaaagacacggtgatacgatcttcaatggtgaagagacactataaattgatgaaggatgctggtgtggatgtgtcatataatgagtttgaatatgctcatttggactttaccttctctcaccgtgaagaacttttgtcatatgttatgtcacgtttgctgcttgtggagcccaattcaaagaatcaagtaaatcaaagggctctaagatcgaggaaaaaaggacaaaagatgagataa

SEQ ID NO: 47319 - DNA, 642 bp, Glycine max
  Peptide Sequence Number=SeqID_164097
atggctatggaacggatatgggacaaaatccttcctttgcttcttcctcaaaattaccgtcttattacgtttgattggccttttgctggaactgtgaaggatcagaatctctatgaccctgtcaagtattcctctgtggaaggctttgctgatgacttgatcactctgctgaataaaatggacctcaaagctgtcacttttgttggtcactccatgtccggcatgattggttgcattgcttctgtcaaaagccctcaactcttcaagaccctcattctcgttggtgcttccccaaatgattatgagggaggctttaacagctcagatattgagcaattgctctcaaacagagagactaactatgaaaactttgcttctggcttcgcctcattaatagcggatccaactaatgaagtctctgtgaacaaatatgaaaaagagatacttgacaaggtcgagactccatgcactatcattcagaccaaaaaggatgcagctgttccacacaacgtagcactctacatggaaaacaaaattaaagggaaagttactttggagatcatagacacacttggccatttcccccagttaactgcacaccttaagtttgttgaagtgctcaagggtgctctagcttcataa

SEQ ID NO: 47320 - DNA, 2145 bp, Glycine max
  Peptide Sequence Number=SeqID_164098
atgggtgaaatttctggtgttcaaagcctttcttccagtgtgcaaagtactccagaaaaaaatggccattcagatggtgcttcaaaaagttcagaacttcttcagcagttcctaaaatgtggtccaaagaaggaacttcttcaaatgtgttttgacaaggacaaaaaaagcatttcatcaaaaggcagaatgtctgaaactaagtcaaccagtaagataactaagaaacaagacacgaaaaaagtttctagtttcagccatcagccccctagaaagcaacctcggaagggtgaaaaccctactcgaatcatacctcctcttgaccagtcttctgattttggccattcaaacacttggatttgtaaaaatgctgcttgtagggcggttctgtctatggatgacacgttttgtagaagatgctcttgctgtatttgtcacctttttgatgataacaaggatcctagtctttggttggtatgcacatctgaatctgctcaaggagactcctgtgggttgtcttgccatatcaaatgtgcccttcaacatgaaaaggtgggagttgttgatcatgggcaactgatgcaactagatggtggctattgttgtgcgtcctgtggtaaagttactgggatacttggatgctggaagaagcagctaaatatagctaaggatgcccggcgtgtagatgtactctgttacaggatatatttgagctacaggctcctggatggaacctcaaaattcaaagatttgcatcaaacagtacaagaggcaaaggctaaactggagacagaagttggtcctgtcaatggtgtttcttccaagatggctcgaggcattgtcagcagactccatattgccagtgatatacagaaactctgctctcttgctatcgagaaagctgatagctggcttgccactgttcccaatgtaaattcagattccacagagggttcttttcctgctgcttgcaagtttgtttttgaagaggtaacaacttcctcagccaaaatcattttaattgaaatgtcaagtatatgttctgaggaaattaagggatacaagctctggtattacaagagttgggatgaatcacccactaaagatcctgtttccgtgtttcccaaatctcagaggaggattttgatatccaacctcaagccttgcacagaatatacttttcggattatatcttacactgatacacgtgacttgggtcattctgaggctaagtgtttcaccaagagcattgagataattaaaaacaatccctcttcatctgttgctatgaataatgaaaaagagaaccttctaactaggggtaattcttcggcctccaagatagggcccaatgccacaatggaaggctatggattcaaggttcgagaccttggaaaatttttgcgtcttgcttgggctcaagaacaaggttacttggaagagttttgctgtgccaatgtgaaaaattgctgtggacaaagtgaaatggtggataagcttagaattccagaagcacagttgccttcagtttcacgaggccttgatttaaatgttgtttcagttcctgatttaaatgaagagctaacacctccttttgagtattctagggatgaagataacggttgctctttgctgcaagctgttgaggcagatgatgatgctgcttctcatgatctagagaaaaatggtttagcaagatcacatgggagtggggattcccagacctggacccatgggccaacaggagaagtgtctgctgttgattctcgcatagatatgtgcaagaaaaggatagcaagcacaaacgaagagactcatgattgtgacagcactttgataaatggttctcctttacgcatatctgatggttcttgttccttggatgagaactttgagtattgtgtgaaagtaattcgttggctagaatgtgagggtcacatcaaacatgaatttaggttgaaattgctaacatggtttagtttaagggcaacagagcaagaacgcagggtggttaataccttcattcaaactcttatcgatgatccaggtagtttggcaggacaacttgtagactctttttctgatattatatccaacaagaggctaagaagtggattctgtagtaaagctggggcatcaaattaa

SEQ ID NO: 47321 - DNA, 474 bp, Glycine max
  Peptide Sequence Number=SeqID_164099
atgattcgttttctctcatcaagagcacagtacctctcagagaaatggggtaatactcccgttgtgctagctggggattttaatagtactcctcagcttaatatcatgctatatgacagaaaggaattatctggacagaaacgctgtcgtcctgctcaagttttaggcgagaataaagaaacagttgttttatcccagtatgatgctctcaacctactgtttccagcttgtttaagtgctggacagatgaagaggtactcagatggtattgtacctacaagagttcttgatactgtttcaataagtgatctcctaagggcaggtggcctcccatgcaagaaagtgggaagcgaccatttggccttggtttctgaattttctttctcagttaccaacaatgaacctacagacatagtggcagcagcagcatcacctatagtagatattggagagcctaacaatcagcggtcataa

SEQ ID NO: 47322 - DNA, 300 bp, Glycine max
  Peptide Sequence Number=SeqID_164100
atgtatgtcacttacagagcgaaagacggccttgggagcatcttagccagtgtaaccggttttgcaagtgtgcgaacccagagaggccacagtgaacactcaccatcgccatacatgactaggggagagaatgtgagtttgaaatccaacgagcagagcagagagaagagaacgaaacgtgcgttgggaaggggtgaaaaagggctttttcgtttcgagtttcccgttgatgccgcgttttgggatttctgttgggcccttcagatctgtcggaaacaatcaaacatggcccatgtatga

SEQ ID NO: 47323 - DNA, 371 bp, Glycine max
  Peptide Sequence Number=SeqID_164101
gttttataggtgatgtaccagtcatacttgcaaaaccacagacttatatgaattcaagtggtgaatctgttggggccatagtttcatattacaagattccactgaagcaagtacttgtgatctttgacgacttggatttgccttttgctaaattgcggcttctaccaaagggtggacatggaggtcacaatggaatgaagagtgttattaatcacttcaaagggaattctggttttccccgtttaagaattggcattggacgacctcctgggaaaatggaccctgtagcttttgttcttcgcaccttcactaaacatgaaagggaagaggtgcaaactgacaaactggccctcggcacatggaagttctaa

SEQ ID NO: 47324 - DNA, 1299 bp, Glycine max
  Peptide Sequence Number=SeqID_164102
ataaagatcagagggttcttgtctcatatccagcaattacacaatggatactggggaatcacctcaatgaaggcacagtctgtgttattacttgcactgccatccccgcattctaaagataccaaagatgagaaccagcaaccctctgaggcaactggtgttggtagaaactgggtgcagagtatgttcagccgaaataaaacaactagatccagctcatttagtcacgttcatagatggacgtctgatggaggaaactcagctacaaatgagaatgggactcctcgcaaacaagatctgtcaagtggtggccagaaaaagcttcataccaatgtccgcatacttaggggtcataatggtgccattactgctctccattgtgttacaaaaagagaagtgtgggatttggtcggtgatcgtgaagatgctggtttctttattagtggaagcacagactgctcagttaagatctgggatcctagtcttcgtggttctgaactcagggcaactttaaaagggcatactagaaccatccgtgccataagttcagatagggggaaggtggtgtcaggatctgatgatcagtctgttttggtgtgggataagcaaacaactcaacttctagaagagcttaaaggccatgatggaccggtcagctgtgtgcgcatgctttctggggagcgtgtgttaactgcatcccatgatggcactgtgaagatgtgggatgtaagaacagatagatgtgttgcaactgttggtcgttgctctagtgctgttctatgcatggaatatgatgacaatgtgggagtcttggctgctgctggaagagatgtgtccataagaatggttggtgacactgtgattactggtagtgatgattggacggcaagagtatggtctgtttctcgaggaacatgtgatactgtcttagcatgccatgctggaccaatattatgtgttgagtattcttctttagatagaggaataattacaggaggtatacattgtgcaaaaaatgtaacaattcacaatgctgccatattatctatcaatgctggggagcactggttaggcattggagcagctgataattctttgtcactctttcaccggccccaagaaagacttggtggtttttctggcactgggtccaagatggctggttggcagctttacagaacaccacagaaaacagttgctatggttagatgtgttgcttcagacttggaaaggaaaaggatatgcagcggtggtcgcaatgggcttctaaggctgtgggatgcaactattaatatttga

SEQ ID NO: 47325 - DNA, 1731 bp, Glycine max
  Peptide Sequence Number=SeqID_164103
atgggtccgaaattggcgaaaacggggtcgttccgtcatggattggcggagaagaaggagaggcttctgtcggcgaagatgcggcaggaggaagaggaagaggaagaacgcaggtggtggtggtcgaagtggaacagtgtgaaacgcgtggctgagaaggcttgggagatgggtcggtctgatccaaggaagataatcttctctgcaaaaatgggacttgctttgacccttatttcctttctcatttttctcaaagaaccacccttcaaagatatgagccgctactccgtctgggccattctaactgtcgtcgttgtctttgaattcaccataggggcaactctgagcaaagggtttaacagaggattggggaccttgtcagctggaggacttgctctggggatggcagagttatcagaattggctggagaatgggaggaacttttaattattataagcatcttcactgtaggattttgtgccacctatgcaaagctctaccctactttgaagccttatgaatatgggttccgcgtgttcttgatcacgtattgcttcattactgtatctgggtatcgaacaggggaatttgttgatacagctataaatagatttttgctcattgcacttggtgctgctgtatctttgggaataaatatctgtatataccccatctgggctggtgaggatctgcataatcttgtcacaaaaaatttcatgggtgttgcaacatctttggaaggtgttgtcaatcattaccttcagtgtgttgaatataagaaggtgccatctaaaattcttacttaccaagcttctgatgacccagtttacaatggctacagatcggttgtagaatctacaagtaaagaggattcactgatgggatttgctgtctgggaaccaccacatggtcgttacaaaatgctcagatatccatggaagaattatgtgaaattaagtggggctctaaggcattgcgcatttatggtcatggccatgcatggatgcatactttctgaaatacaggccccagctgagaagagactagttttccgcagtgagcttcagagggtaggttgtgaaggggcaaaagtgctacgtgaacttggaaacaaagttaaaaagatggagaaactagatacgggagacttgctgtatgaagtgcacgaggcagcagaggaattgcaacagaagattgataaaaaatcttaccttcttgtcaactccgagaactgggaaattggaaaccgcccaagagaggatcaggagactgctcttcaacaacaaggcctctttaacatggatgaagaaagaaaatttcttgagtacaagtctcttagtgaagcagtacttgatctcagaacagttcaagttccaaatacttgggaaggaaatgtaagcctaggtgatagccctgctgagactgcaaccgatgcctctcaaaacatgtttaggaaacagatatcttggcctgctcatatttacaacaaatcaaatcccgtagccaaagagggtcaagaatcaaaaacttacgaaagtgctagttcgctatctctcacaacatttacgtcgcttcttattgaatttgtagcaaggcttcaaaacctggtggattcatttgaggaattaggtgaagtagcaaactttgttgatccacttgagcaacaagcaccagtagcatctcgtggattctgggccaggttgtgtaactgcttcaaattcaaggactga

SEQ ID NO: 47326 - DNA, 1557 bp, Glycine max
  Peptide Sequence Number=SeqID_164104
atgtatccttcaaccccccctctcctcctcctcctcctcctcctttcaaccttcataattttcattctctccatcatcttcctgcgtcgaaatcagagcaaagatggcccgccaggtccaccggccttgccggtgatcggtaacctgcacatgctggggaagctcccacaccgcaccctggaggccttggcccatcgatacggacccatcatgtccctacgcctcggacaggtcccacacgtggtggtctcctcctcagaggccgcagaagactttctcaaagcacacgacgccgttttcgcgagccgtccaaggctcgaagcctccaagtacttcggctacggctccaagggcttggcgttctcggagtatggtccctactggcgatacatgaggaaagtgtgcacgctccggcttctgaccgcctcaaaggtggactccttcgcgcccttgaggaagagggagctggagctggccgtgaagtcgctccaagaatccgccgcagcgaaagaaggcgaggtcgttgtggatcttagcgaggtggtgcacaacgttgtggaggaaattgtgtacaagatggtgttggggagtagcaagcatgacgagtttgatttgaaggggttgattcagaatgcaatgaatcttactggcgcgtttaatctatcagattatgtgccttggcttcgagctttcgatcttcagggattaaatcgaagttacaagagaattagtaaagcacttgacgaagttatggaaaagataatcaaggagcacgaacacggttcagatgtacaaaatgaacagcaccatagacatagggacttcatagacatattactctcgctgatgcaccagcctatcgatccctatgatgaacaaaatcacatcattgataaaactaacattaaagctatactcttggatatgattgctggggcatttgaaacttctgcaactgttgtagagtggacattttccgagctcctaaggcatccaagagtgatgaaaaaccttcaagatgagctggataatgtggttgggagggacaaaatggtggaggaaaatgatttggcaaagttaagttacttggatattgtgatcaaggagaccttgagattataccctcctggaccattagtcccccgagagtcaacagaggatgctatggttcagggttatttcttaaagaaaaaatcaagaatcatcataaacatatgggcaatgggaagagattccaagatatggtctgataatgctgaagtattttatccagagagattcatcaataaaaatttagactttcgaggacttgacctccaatatataccatttggttttggtcgaaggggatgccctggaatacacttaggcttagcaacagttaaaattgttgtcgctcaattagtacattgctttagttgggaacttccaggaggtatgaccccaggtgagttggacatgagtgagaagtttggcctctcaataccgagagtcaagcacttgattgctgtgcccaagtatcgtcttttcagggaagcttgtaatgaatcaaaatga

SEQ ID NO: 47327 - DNA, 360 bp, Glycine max
  Peptide Sequence Number=SeqID_164105
atgcttaaaacggctattaatcgtgcaacatcacggaatgacttgttgaccattagagatgctcttgaagtttcttctgatatgtataagaaagatagcaataatgtgccggactacatccaacgtcatcttatctctttatctatttgggaggaattacgattttgggaaggatattttgactatttaatggagcaatcttcaaacaagtctgccaactatgcatctttggtgacagctcagcttgttgtgttggcatcacacatggctgggctgggacttcctgataatgatgcttggtacatgatcgaaacaattgcagagaggaatagcatcggatccaagcaatttgtaagttaa

SEQ ID NO: 47328 - DNA, 660 bp, Glycine max
  Peptide Sequence Number=SeqID_164106
atggggaccatgttggctggaggacttgctgtgggcatggcagagttatcaacattgggtggaaaatgggaggaacttataatcattatgtgcaccttcattgtaggattttgtgccacctatacaaagctataccctactttgaagccttatgagtacgggttccgcatgttcttgatcacctattgtttcatcactgtatccgggtatcaaacaggggaatttgttgatacagctataaatagatttgttctcattgcacttggtgctgctgtatctttgggagtcaatatctgcatatatccaatctgggctggtgaggatctgcatgatcttgtcacaaaaaatttcatgggtgttgcaacatctttggaaggtgttgtcaatcactaccttcattgtgttgaatataagaaggtgccatctaaaattcttacttaccaagctgctgatgacccaatttacagtggctacagatcagctgttgaatctacaagtaaagaagattcattgatgggatttgctgtctgggaaccaccacatggtcattacaaaatgcttaagtatccatggaagaattatgtgaaattaagtggggctctaaggcactgtgcgtttatggtcatggctatgcatgggtgcatactttctgaaatacag

SEQ ID NO: 47329 - DNA, 255 bp, Glycine max
  Peptide Sequence Number=SeqID_164107
atggtggaagcctctggtaatcgattaccagcctgtgtaatcgattacacagaggaatggatcgtgatggcggcgcagctactccgtgatcgagtagagatggagtgcctagagggagcttgggagaccctcgaaggcaacacgaggtgccgatttcggggcaccattcgattcacggctacttctttggtgcatccagatgaacctgcacgggacgcttcagtgcacggtggagtggacagctccttggattag

SEQ ID NO: 47330 - DNA, 216 bp, Glycine max
  Peptide Sequence Number=SeqID_164108
gaatcaacgaaatctccattgatgaagagcttggtaaacttgatggggggcatctggaggaaggaattgccgtggctactactagagttattagagagggaactcatctgagttatgagttagagagaaaggagattgtcgtagagacgctggcggtggagaaatcagcgctctcgcaaaggcaaggaacgccaatgatacacctgctacctgctg

SEQ ID NO: 47331 - DNA, 240 bp, Glycine max
  Peptide Sequence Number=SeqID_164109
atggagttaaattgtgatttaggaaggacatttgagactatagaccccagaaaagaagaggtaattgcaagagttagtgagggagataaagaagacattgatattgctgttaaagcagcacgtcaggcatttgactcgggtccatggcctcgcttgccaggctctgttcaggtatgtccgaacatatgtggtactctttcattagtttcattgatgtttatgggagtgggtgattcctga

SEQ ID NO: 47332 - DNA, 744 bp, Glycine max
  Peptide Sequence Number=SeqID_164110
atggtgaatttgatggaggtggctttggagtacgtgaaggtggagaatgttgtggagggtgatggaggtgaaggtgttgtgggtgatggaggtgaaggtactggtgaaggagttacaggtggcgtaggtgaaggaaatgacggaggtgaaggaaatggcgaaggaggtgaaggtgttacaggtgtcgtaggtgaaggcgttacaggtgtcgtaggtgaaggaaatggtgaaggtgttgtaggtgaaggtgttgaaggggaaggaggtgaaggtgttacaggtggcgtaggtgaaggaaatggcgaaggaggtgaaggcgttacaggtgtcgtaggtgaaggaaacggtgaaggtgttgaaggggaaggaggtgaaggtgttacaggtgtcgtaggtgaaggaaatggtgaaggtgttgtaggtgaaggaaatggtgaaggtgttgaaggggaaggaggtgaaggtgttacaggtgtcgtaggtgaaggagttacaggggtagtaggtgaaggtgtagaaggtgatggaggtgaaggtgttaccggtgttgcaggtgaaggtgtaggtgaaggaacaaatggtttacacttaaaggagttacagtccacaggtttagagaagaacgacttacattgcggcggaggcctctgcgccggccttgccggtaagcagttgagcctgtcgtcaaacgctggcaatacgagacatgcgggaggctcactagtgaagaagttaaaggaataa

SEQ ID NO: 47333 - DNA, 942 bp, Glycine max
  Peptide Sequence Number=SeqID_164111
atgaagaagcccaagagtaatgacgtgggactcgatagagcgtcgattgctctcttcttcctcgttcagatcacagttcagactctctttctatcgaagaagaagatgatgatggtgatgaagaaggaagcaacatactcctccattctcacactcctcattgccacactctccctagccctctccgacgagttcggcgacagaggagagaatgtcaccgttgacccttctcttgtcttccaaaatgaccgtctcagaaacgcttatatagccttgcaagcttggaagcaagccattttgtctgatccccgcaaccagacaaccgattgggttggatcccaagtgtgcagctacaccggagtgtactgtgctcccgcgctggacaaccccaatatccgtaccgtagccggcattgatctcaaccatggtgacattgccggttatttaccccaagagctcggtttgctggtggatcttgcactcttccacatcaactcaaatagattctgcggcaccgtgccgcacaagttcgataggttgaaactgctctacgaactggatctcagtaacaacaggttcgcaggaaagttccctgaggtggttctgcgtcttccgtcactcaagttcttggatctcaggttcaacgaattcgaaggtacggtgccgagagagttgttcgataaggacctggacgccattttcatcaacgacaaccgtttcgtctttgatcttccggacaacttgggcaactcgccggtctccgtcatcgtcctcgccaacaacagattccacggctgcattccggccagcttggggaacatgtctaacttgaacgaaatcatcttgatgaacaatgcattccgatcgtgcttgccttcggagattgggcttctgaagaacctgacggtgttcgaccatggagcagctcaatgtggcgcataa

SEQ ID NO: 47334 - DNA, 306 bp, Glycine max
  Peptide Sequence Number=SeqID_164112
atggatgacagaaaaagagtaggttgcagagaagagaaaattgtatgtatagggatgaatccgagagcttatgttattatggctgcaaaggcagtggcagtagcagttccactttctgccgcagcggctgctggcacacaagtagagcttcttgttcctctacgtgtaaaattaaacgtaacatatttgagcgggtgtagggatcgggaacaaattgttcctacggaatggtccccaatagcccatggagaccaccatcagagtctgcaggttccgaatcagattacggtggttgggcgtaaatag

SEQ ID NO: 47335 - DNA, 628 bp, Glycine max
  Peptide Sequence Number=SeqID_164113
atggaagttggggaaagcaacagtggtaacgagaggcgtatcatatctaaggattcttcatggtgcagtcaattccgaaatgcatctaatccttggatggcaagatatgcctatgccttgatttttcttgtggcaaatcttttagcatgggctgcacgggattatggtcgtggtgctttaacagaaatgaagagattaaaaggatgcaatggtggaaaagactgtttggatgctgaagtcaagattgctctctgggtggtcacgactgtcattccatttctactcccttctgaatttattcagatttacggggaggtggctcattttggtgcaggtgaacctgctggaggaaactgcatcaggaagtcagactctgcaaccaaaacagactggctaagcatcattagctttgttgttgcaatactagcaattgttattgcgacattttcaacaggcatagactccaaatgctttcaggatgatactccaccagcacaggatgatgtaccttatggttatggcttcttccattttgtttttgccacaggagcaatgtactttgctatgctattgattggatggaatagtcatcattctatgagaaagtatggtggtctcctcccctcct

SEQ ID NO: 47336 - DNA, 147 bp, Glycine max
  Peptide Sequence Number=SeqID_164114
atggtggatgacgaagacgagaggaaaagtttcattttaccacctgttgttagtcgccttctgttaagtgataatgtggcacacgaagtgctatgccatcatgccttgatatggacacctcattacccacatcattaccttcaatga

SEQ ID NO: 47337 - DNA, 218 bp, Glycine max
  Peptide Sequence Number=SeqID_164115
gacactctcagctcgtgggggaggcagcaacaacagcggcaacaacaacctcgccgcactgaacctcgggtttaacagaattcgaggctacgcgcccacaaatcttagggtgtttcccgcgttgtccttcctatttatttggtacaacatgcaacatggcgcgatcccactggagtacaggcaaatcaagtctatgaagaggttaaagggagaagaag

SEQ ID NO: 47338 - DNA, 660 bp, Glycine max
  Peptide Sequence Number=SeqID_164116
atgtcgagctgcagcatcgatgttgcgcctgagcaactctgctacatcccctgcaacttctgcaatattgttcttgcggataaaagaactcaatcagatcctgaaaaggaagctacacttggggtgagtgttccatgcagtagcctgtttgacattgtgaccgttcgatgtgggcactgcaccaatctatggtccgtgaacatggccgccgcgtttcagtcactgtcatggcaagatgttcagggtttctgggagttattcttttcgagaaaatcgaaggctctccctctctccctgggatctgggcactgcaatccagagtacaggattgacactggctccacgtccaaatgcaacaataggattgcaatgcgtgcgcccaccactcatgtaactgaggaaagggttgtgaacaggcctcccgagaagaggcagcgcgtaccttctgcttataaccagtttataaaggaagagattcagaggatcaaagccaataatcctgatatcagtcatagagaagctttcagtacagctgcaaagaactgggcacattttccccatattcatttcgggctgatgttggagagcaacaaccaagttaagatggagaatgtttctgagaagcatttaatgtcaagggctgcgctattgaataaatga

SEQ ID NO: 47339 - DNA, 261 bp, Glycine max
  Peptide Sequence Number=SeqID_164117
atggaagcgccacgcgtaggaagcaatcctgcgataggaacgggatgccatacccccaaagccaaaggaatcacgtgttactaccaatcaactcctttccttcgtttgccccttctcccattccttggaccccaccaaagatcatcatcagtttcccttctcaaacaaatactactccaaaggctaccccattccttcccttttatacacttcttttgcggaaatgaatatgataggattcgtagttctaggtggtattag

SEQ ID NO: 47340 - DNA, 378 bp, Glycine max
  Peptide Sequence Number=SeqID_164118
atgccaatgtttgagcctccttgtaagaatgatggttttgaagtccagattctagatctagacatggcggtgaaagatggagttttgggtggtggagttgattatgggattgtgggaaatgggattcgtgaaaaattgaatcttgcaaaaatgattgaagagttggacttgtgtgaagtttcctctgtgttcatttgcccaatttcccttgagccaatgcatgaccttgcgaccctttgcattggccaaacctatgagaggtgcaacattctcaaatggtttagtttggaccacttcacttgcctcaccacaatgcaagagctttgggatgattccctcactcctaacaccaccctccactgtctgatatccacttga

SEQ ID NO: 47341 - DNA, 174 bp, Glycine max
  Peptide Sequence Number=SeqID_164119
atggatgggcgtattattttggcaaaggtagattgcactcaagaaggtgatttatgcaggagaacatgggaggcaaaactcaaaagaaaagtgtgcatggatgtgaccaatttagtccttataaagcttaaaacaatcctcatcttacaagccagttttgtgaggttgagttag

SEQ ID NO: 47342 - DNA, 513 bp, Glycine max
  Peptide Sequence Number=SeqID_164120
atgaaagcatgcatgcacacgatgatgcgtgtgctatgtacaggtgtatctcctggtgaaggaacgggtgcaacaatgtcagacgatgaagatgaccaggcagagagcaatgccaacttatacgaaggaagccttgatgggggtgaaactcttggatttggtcctcttgtccccactgaaagtgaaagatctttgatggagagagtgaggcatgaattgaagcatgaactaaaacagggttacaaggagaagattgtggacataagagaagaaattctacgaaagagacgagcagggaaacttccaggggacaccacatcccttttgaaagcttggtggcagtcacattctaaatggccttaccccactgaggaagacaaggctaggttggtgcaggaaacaggcttgcaattaaagcagataaataattggttcataaatcagaggaaaaggaactggcatactaataacccctcatcctctagtaactccaaaagcaagcgcaagaggtag

SEQ ID NO: 47343 - DNA, 234 bp, Glycine max
  Peptide Sequence Number=SeqID_164121
atgtgggaactcttgactggagaggagccatatgctgacttgcactatggtgctatcataggtggcattgtgagcaatactttgcgccctcctgttcctttatcttgcgatccagaatggagaggtgctggtcatctgagccatcagagatcagagagacctaccttcactgagattgccaatgaattacgttctatagcgaccaaggtctctcccggaggagagaactattaa

SEQ ID NO: 47344 - DNA, 585 bp, Glycine max
  Peptide Sequence Number=SeqID_164122
atggcgtttgatcaaaattccactctgttgggtcttcgtccgttggacgtggccgcgttggtggcagaggagccactattttctcctgccaccgtcacgccgcccactccgaattccattggggagcttttctacaagtcgtcggcctccgcaatgtggtgcgtctgccccattgtgcataccacagtgagccccgcggcggcgacgacgtttgggtttaactacgacgcttccagtttcagcaaccgcgttgtggctgggaatgctttaaatttggggaaattgttagggtgtaatggattggacaaggcattcaatgatgcaaatggttttggttatggtgttggtggtgttaggggcaacggagaggttgcaatagttggtgatcacggtggtggaagcggcggcggcggcggggaggaaggttgtggttatcttgaggaggatcttgatgccttggttaagaggtcacctgatggttctgccaagttgaaggtttttctgttttctgttttcgagactgaatgttcttcttttgatgctatgaatgggattggtaacacagactggatggttgtgctgtaa

SEQ ID NO: 47345 - DNA, 195 bp, Glycine max
  Peptide Sequence Number=SeqID_164123
atgacaatatacgttgattgccaacgtgtcacgttaacggtcattgtctcgtgctgctatgactatggtgccttgcgttgtcaccgtgtggctaaggtggtcatggaggcaatgggagaagtaacaagagaagatgtgagatgcatggagtgcgggatttgtatagagcgagtcacgacaatgacggatccgtga

SEQ ID NO: 47346 - DNA, 189 bp, Glycine max
  Peptide Sequence Number=SeqID_164124
atgggaggtgggaacagaagatcaaaaggtggaaacagaaaatccaacaacagcagtggcagcggcattcctaaatctcgaaaaagaggttcggatgttaaaactgcattgttcgtcgaaggcggtttcttgtctgattggcatctcccttcccctacccaaattccaggtgcagatgacaacataaaa

SEQ ID NO: 47347 - DNA, 231 bp, Glycine max
  Peptide Sequence Number=SeqID_164125
atgggaacatggatgatgcatgcagcagcggcatggatagcggggcccacagcgtgtatgtggtccatgaatcctgggagcgacacgtgttggtcgtgggtgctgaggtcgctgtcgggttgggtagtggccaacgtcgagtctggccagttgtgggcctcactcactgccactagcgcagcctctcatacgtccttttgggtttttgggtcccctgacactcacccataa

SEQ ID NO: 47348 - DNA, 528 bp, Glycine max
  Peptide Sequence Number=SeqID_164126
atgacagcagatcccagaaaatactatgtcagagataggcctggacagcatcacaactaccatcaagtaaactggcgagatagggctgacatcactttgttctacttcactaggttccccgaggatgcaacggaggaggagctatggtttcagttcaaacagatgggggatgtgagggagatcttcatccctaaattgagaaacaaagaaggaaggaagtacgggtttgagagattcaatggagtctctgatgcaaacagaatggaaagaaagctagataatattattgttgggggcctcaagctgcatgcgaatatcccaaagtacaggagaggaaaggcgagacaagaacaatacgtagccaaacatgtgaggcagatggagggagaaaatggaaagggcagagtggcaacacctccaaatgtgaggaggacatacgcggaggcagtggtttcacacactgagaacagaggacaacggcgatccaccacctcaatcctagcgttgtatgggagctcacaatcatcg

SEQ ID NO: 47349 - DNA, 420 bp, Glycine max
  Peptide Sequence Number=SeqID_164127
atggcgccgcgtctctggtcctgcttcagcagcagcagcagcaaggccagcaccacccgcggcggcggcggaggcggagctgggttcgtagattccctgctccaaccttccaggcctgcaccagattcattacaagtgttcctaagaggagcattgaggaccaaggtggacaacgatggcgcgaatatcttggtagcattatacgaaaatggtttggtcactgactgtccaagaggagagaacaaagggcgtgttctatccaatgactatgttgttagaaagctcgaaaagctatgcactgtcaaagacatcactgccaagaaaacagtatcaggaacggttaactttaccttactattgactccatattcaggagatggagagagaagtttaaatttgtggcctgaacaattttattga

SEQ ID NO: 47350 - DNA, 249 bp, Glycine max
  Peptide Sequence Number=SeqID_164128
atgcaaattgccactgtcactggcgatacgagcaacaggtggtttttcgccactgccactggcgaaatagctagtggtttcgccacttcagttagtgacatagccatgcagtggtttttcgccactgccactggcaaaatagccagtggtttcgccatttcagttggtgacatagccatgcagtggtgttgtagaaggcgtgtaggtcaggctagggcagcagagtttcagtggttttcgccactttga

SEQ ID NO: 47351 - DNA, 408 bp, Glycine max
  Peptide Sequence Number=SeqID_164129
atggtgatacccccctccgaaaagcttctcgccaatacgaatggcgatacccttggcacctctgaaaaaagcctaccctttgcacctctgcgcgctgctctgcaagccttccctgtgcctacccccgttgcatcactggtggcgataaccactggctatttcgccagtggcagtggcggaaagccatgtggccgtcccaggtggtatcgccagcgtgtatggcgaaacggcttgcatgcaggggtgtctccatgtaaaaaagagacccccttgcaacccatgtcggtttcgtttgtcatgcacgttggggtgtcagtgttagattggaaatggatgataaaatatggtgctaacaggtgtcagacagataacctacttaacgaatccaacacaacattgttgggttga

SEQ ID NO: 47352 - DNA, 654 bp, Glycine max
  Peptide Sequence Number=SeqID_164130
atggctaccccacccagctcttctccttctcctcttcctcctcctactgaggtagcatcacagtcgtcctttaccttgaagcagacgagaaaagccacacgactaagatcattggcgactagactagctggggcaaatagaccgatggtgcacatcgatcttgcgaccgggaaggctgacggtccccacaagaagaaattaagaacatatttagcgattgtcgcttgtgataaggtcaacgtgacatacgagaattggaagcaagtccctgctgctcagaaggatttgatatgggaggatattcagggagctgtgggaccagcaaaacatgcagataggctggatcatgaggtcgatgatccactatatctaatgacattgaatatcccacaactttttttaaagccgttgcaagttatgtgggatgctatcgtgttccaactgtttaattcatactttcccttgtacataaagcatgaagatctgtctgaaatatcacatggtggtcaatgtctcagcatctctattatacagttgtggatttttcatctatctgagataggtatgcgagcagggaatttcgatgtgtatggattcctcgagccacagtccatccagagatctgggcaatcgcaatttgaatcaaaaagttaa

SEQ ID NO: 47353 - DNA, 546 bp, Glycine max
  Peptide Sequence Number=SeqID_164131
atgtctagactcctgcgttctttttcgcgtatttcctttcggtctaattcctcttcatcaacttcttccagaaattcaaacttattaagtgatcaagataaccagacccaagaggtcgcccctaaacacaatctcttcgatgaggaagtccgattcgaagatatcaatcaaaacatggatgaatggaacatcctagaaatccctcaggatcaactatacgttcctgaaacaatgaaagataaacacaactttgattacataatcaaaacagtagaaaacaatattcctctagggcaagacataggggaagaattccatttactttcaaaaaattcaatttatgaacatagtcgaaagtataaatatttacacatcggctgtgtacaagtagccatcaagcccttaatagacatgggcatagatgcagcagtgttaatgtgtctaagagatattaggcataataaatttgaagactccttaattggaacagtcgaaagtagcctaggacagggtccagtatattttaattgttatccaaacaaaaca

SEQ ID NO: 47354 - DNA, 402 bp, Glycine max
  Peptide Sequence Number=SeqID_164132
atggatcaattgatttctgatgtcatctattgtttggagggatcgcgcccacaagacgcccagtggacccgaagaagtccaacagggccctggggtttccagctctggttacgggcctctgtcagtcctacagggtgcccgttccccctagcatggtcacgccatcataacatagggatcgtgcccacaagacacccagtggacccagagaagtccaacagggccctggggtttccagctctagttacgggcctctgtcagtcctacagggtgcccgttccccccagcaaggatcgcacccgcaagacacccagtggacccggagaagcccaacagggccctggggtttccagctctggttacgggcctctatcagacctacagggtgcccgtcccccctag

SEQ ID NO: 47355 - DNA, 381 bp, Glycine max
  Peptide Sequence Number=SeqID_164133
tcgtctgcaaagggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagcca

SEQ ID NO: 47356 - DNA, 498 bp, Glycine max
  Peptide Sequence Number=SeqID_164134
atggagtttcttagagaatgtcctaatgtctatgagattcttatcacattgggtttccctgattatgagatgtgtggactcaatgtctttctctgttatgtggagagacatgagaagtgtcttgaacttcctactctcacgggaaggtctaagaagcagatttttagctttgtctgggatcatgtggaagaagttgaaggtcaagagtctatgagttgggaagcgcctacagaaggaacttacaaggtcaatttcgatgcttcagacataaaggatgttggaacaggcttgggcatggttgccagagatcagagcggccagattatcgcaacaacaacttacttatatgaggctgagttgaactttagggaggtagaagttgcggccttcagatggactatcataaaggctaatggagtgtacttaactgattgtttgaacctggttcattgctggaattctcatcgggtggtagagagctcttccatggcttggtga

SEQ ID NO: 47357 - DNA, 648 bp, Glycine max
  Peptide Sequence Number=SeqID_164135
atggacgccgtagcaacaggttcggagctgaacaagtccggaagcggaggttcggaacgaagcgaggacagcggaggagctggaggaggagggatatttgagtactctgggtgggtttatcatttgggagtgaattccattggccatgagtactgtcatctccgattcctcttcattaggggaaagtatgtctccatgtacaagcgtgatcctcacgataaccctggcctcaaacccatcaggcagggaattgtaggacccacgctaatggtggaggagctaggtcgtcgaaaggtcaacaatggggatctttatgttttacggttttacaatcgattagatgagaccaaaaagggagaaattgcttgcgccacagctggggatgccaggggatggatggaagcatttgatctaggccaagcaacaggtatgaaaaaaccatgggaaggttgtgtttataatgctgagtatgagctgtcaagaggagttagtgccagagacaaactaaacatggaggccgagatcaatcttgaaggacatcgacctagagtcagacgatatgcccatgggttgaggaagcttataagaattggccaaggtacaaaagaagtatgttcctatttgaaaaccacaatgttaatggattga

SEQ ID NO: 47358 - DNA, 1227 bp, Glycine max
  Peptide Sequence Number=SeqID_164136
atgtataacaaatacccatcacctatcagatgcgatccatcctcggtggcaatgcctatcaaggaagggcagccacttacatttacttatgaggtcacctttgaggagagtgatatcaagtggccatctagatgggacgcctacttgaagatggagggagccaaagttcattggttctctatcctcaattcgcttatggtgatcacttttcttgctggtattgttcttgttatcttcctgaggactgttagaagggatctgacccggtatgaggagcttgataaggaggcccaagcacagatgaatgaggagttatctggttggaagcttgttgtgggggatgttttccgtgccccatcaaatcctgctttgttgtgtataatggttggtgatggagttcaaattctggggatggctgttgtgacaattttgtttgctgcacttggattcatgtcaccggcctcacgtggaacacttatcacagttcggctgtggaggacaattggctgcggtgatcagaagggatggatttccgttgcttggaaggctgcttgtttcttccctggtatcgcctttttgatcctcacaaccttgaacttcctattgtggggaagccacagcacgggagccattccattttcactctttgttatactaattttgctttggttctgcatctctgtgccccttacccttattggtgggctctttggagcaagggcacctcacattgagtatccagtcaggacgaatcaaatccctcgagaaattccccagcaaaggtacccatcatggcttttggttcttggtgccggcacccttccattcggtaccttgttcattgagctcttctttatcatgtctagtatttggatgggtcgtgtttactatgtatttggatttctcttggttgttatgattcttcttgtggtggtctgtgctgaggtatctctagttctaacctacatgcacctatgtgtggaggactggagatggtggtggaaatcattttttgcctctggttctgttgctatatacatctttttgtactccgtaaactatcttgtatttgatctcaagaatctgagtgggcctgtttctgcaactctttacttgggatattccctcttcatggttctagcaatcatgttggctacaggcacagttgggttcctttcctcattctggttcgtgtattacttgttctcttcagtcaagttggattga

SEQ ID NO: 47359 - DNA, 576 bp, Glycine max
  Peptide Sequence Number=SeqID_164137
atggccttaatgatggcagaacggtggaaagagctagcttttgcacgtgatgatcagaataatgaaacagctttacatgtcttggctttaaatcacaagatcaaccacggccagaaacagcatgagttttttgaattggttaattttctttggaaaagtattcttggccagcaaaacttctcgggggcaattagaatcataagtgaaccttctaaactattattcaatgctgcaaaagttggtaattttggattcttgtcagagcttattagttctcaccctagcttgatatgggaagtggatgacaaaaggcaaagtataattcacacagcggtttcgcatcgccactcctccatcttcaatctgatacatgaaatagggtcggcaaaggatgttatattatcatatattgtgcaagaaaacaacactatattgcatttggcagcaaaattagccccaccaggtcgacttggattagtttctggagcaccattccaaatgtgcctcgagttaatatggtttgaggtaacccctgttggggagaaagggagaaagccaggaaaaagcatatactaa

SEQ ID NO: 47360 - DNA, 435 bp, Glycine max
  Peptide Sequence Number=SeqID_164138
atgaatggtaagggtgttcttgcaaagtctgttggtgttattgatgcaactgcagatactgtttttgaagtgattttgagcactgaacaacagaaaagatacgagtgggatacattgatgtgtgacttggaactgatagattcttatgatggacactacgatgttgtttatgggacatatgattctaagtatctatcccggtggcactcaaagcaggattttgtcttctctaggcaatggtttcggggacaagatggaacatacactatcttgcaatttccagctatacataagaaaaagcctcaaagatctggatatcgacgtgcaaaagttaatctatccactttaatttcacccaatggtggagagtgtgttgatttctctttgatgggaactgtcactgttcctttaatttcagaactctctggcaactga

SEQ ID NO: 47361 - DNA, 285 bp, Glycine max
  Peptide Sequence Number=SeqID_164139
atgaagttagacaacatttttattggagattggaaattgaacgttcatgttaccaaaattgttcaaggggaggtgaaagtgcaacgacaggtcagtggatatggaaagaaggtgtgtcctcctaatgaaatggatctcgagaaggttggatctatggaaatctcaggttcagcatttgatagcaatatcggacccatccctccagcgccaggcaccattgaaccagcaacttgcagacccacacgtgccactaacaaaccgaagtatctagaagactatgcatga

SEQ ID NO: 47362 - DNA, 249 bp, Glycine max
  Peptide Sequence Number=SeqID_164140
atggctagaagattgtatgtggatgattcagcatcgagtagggcacatatgggtatggctcatgtgtcgattagagtcaaagggcaaaaaaaaagattgtgcattacttcaaattctagttcctatggagagtcttctgatgaggattatggagagccacgacgtgtggatggggttgtgcctacgtcggaggtgtttcaaaatgcgattttggaaatggttaaaaaaccgaatttgaattctgaatga

SEQ ID NO: 47363 - DNA, 1527 bp, Glycine max
  Peptide Sequence Number=SeqID_164141
atggagcgtttttgtgacacccatatgcccgcccatagatgtttggtgaaactcatccatgagtaccttggtgagatcgtggccggcagggtggttctgaggggaagtggtgacttggtgcaggagagtttggtaagcctaatcccgcgtcagtgtttgcgtcaattggtccagaaaaaggcttatactggattgtgtagtcgaagccaagtagtggcaccacttgcgcacggccgtggttatcgcatgaagttcgcggacgtaagtggaagccttctgaagctgcgggcacaattgtttgctgaaaaaggcaattggacaggactgctgaagcaaaacagcacctatggcggtgccggaagcatccgtctccaagggggcggcaatggcagcgtaattcttgatgaactttcgataaaagcctgtaagacccaagaagctgcaaagatcagacgcggtggcggggattggccaggcagtcgtggcctgtatcttgtcggggtctggtgctaccccttgtggggaaatgatgtgcccgagatagttcaaacgttgctctgcaaagatgcacttggaacgactgttccaggtgggactatagacgagtatatcatcaaagaagacagccacaaaccgtcgcaagaacgaccagagaagatcattcatggtggcttggaaagtagagggggcattagacaacccgaaaggcatcaccgtgaactcataatggcattgatgtgtgcgaaaagcggtttttggtatatcgtcctcatgcatgcgaatctggtgaaagccttgccggagatcaagcttcaaaaaccaggaagccccgccgattttgtccacaacaccggcgcggatcatgtcggattccaacatgaggctgacttgacgtttaagctcgttcttcttggatgcggtgggagatatggtgaggaggtggcagttgttgtgggtcctggaagagtggctcgtaacggagaagaagctgggttaaccgcgataccgagggtttgggcgattcgctttagttgttgggttgaagcggggctcgggcaaagaggaacatcgacattcatctatggtaacggggccaatgagcttcaaccactgaactccaagaacgatgtcggcgccacctatgggaaattggtaaaggtcaacagagaagaaatgaccctgaagaaggagagggacgtctgggcatttgatatcgcaagcgatggtactgccattaccaatcataacgcgcatcgccgaggcagggagatgggtcagatgcggaatgttttcggcactggcatgcctgatagtgcgttgagcctgatgtgggagacattgggtggatcgtcaggagaaagatgttcacgcacaattggcgaagaaggcggggccgaggtgcaagaatggcaactggagctggaggtcggacgtagcgacaccggtcatggagtttctcctcttgaagcttggccagagcaacagcttgaaggagtgagtggggttgaagcgcctgtacttcccgac

SEQ ID NO: 47364 - DNA, 596 bp, Glycine max
  Peptide Sequence Number=SeqID_164142
gtctgaaggaatacattgcagccaatcctgcactccaccatgaaaatggcaccacaattgttcattccaaattgtctgatgcttctatttctagtgctgaatatgaggatgaaatgcaggatgagttttatgatgcaattactgctgattcatcaacatcagacgaagaaagtgatgatgatcagaagcttgttctgcaggagccaagagtcaaactaaagaatatttcatgggcaatcacaaccttagctttgaagcgaactgcagctcctgatctaactgaagaactggatcctcatgtaactcatatcacaattccaagtgacttgcatggttctttgtgcaaaggaaaggatgataatgacacaaactgttgggcttctcctagcggaaaaggatttatgattagaggaaagaattatcttaaagatagttctaaggtagttggaggagatcctcttctcaagcttatagcagttgattggtttacagttgataaatccgcagatagaatttcccttcaccctaaatgtctggttcagggttggggggaagatgctcaatttgcttttgacatgttaattaagaaaacttaa

SEQ ID NO: 47365 - DNA, 513 bp, Glycine max
  Peptide Sequence Number=SeqID_164143
atgcttgatccttgccttacgtttaacattattgaccaagtgattcttcagcttgcctcaactctcatcctctttctggttcctgctaaaccaaactacagtctggttctatattatgcagctgacagaccgataaataaaaattctttgttagctaagtttgttgatggaagtgatgcatttcgagactcaagattcaaacttattccaagtatagttgagggatattggatggtcaagagagctgtaggaaccaaagcttgcctcttaggaaaagctgtgacttgtaaatactttagacaagataattttttggagattgatgtggacattggatcatcttctgtagccaggagtgtcattggctttgtcctgggatatgttacgagtttagttgttgaccttgcaattttgatagaggcaaaagaagaggcggagctgccagagtacattcttggaactgttcgattaaaccgtttgaaacttgagtctgctgtaccattggaggtttaa

SEQ ID NO: 47366 - DNA, 1644 bp, Glycine max
  Peptide Sequence Number=SeqID_164144
atgccggacggagaatcctctgccgtcgccggcggccaagtttccatggaaccctctttaagcctctccgatcaactacagtccctgagtctttcccaagtaaaaaatcatgatgactcggtcaagaaagatccccggaagattgcaagaaggtatcagttggagttgtgcaaaaaagctatggaggaaaatataattgtgtatttagggacagggtgtgggaagacccacattgctgtgcttcttatgcatgagatgggtgatttgattcggaaaccacagaagaacatatgtgtctttcttgctcccactgtggctttagtccatcagcaagcaaaggttatagcagactctactgattttaaggttgggacatactgtggaagttccaagcgcttgaaacatcatcaagactgggagcaggagatgggacaatatgaggttcttgttatgaccccacaaatattacatcataacttatcccattgcttcatcacaatggagatgattgcacttttgatatttgacgaatgtcatcatgctcaagtcaaaagcaaccatgcttatgcagtaatcatgaaagtcttctacaaaagtaattccacaaaggttccccgtatatttggcatgactgcttcccctgttgtaggaaaaggtgcttctagtgaagcaaatttagcaaaaagcatcaacagtcttgaacatatacttgatgccaaggtatactctgttgaagacaaggaattgcaatcttttgtgaccactcctgtgattaatatatatcattatgtttcaactgcaagtggggaaactagcttgcacttgaaaattgaggagattaaacgccagtgcatagcaacccttggtaggagtatagaagatcaccagaaacggatgaatacaaagaaacttctgaaccggatgcatgataatgtgattttcggtctgcagaatcttggcatttggggagcattgcaagctagtcatattcttctgagtggtgatcattctgagaggcatgaattagtggaggcagatggaaattcaagtgatgactctctgtgtgataaatatcttgctcaggctgctgaactatttacttcacaatgcatgatagcaagatccctgtcatacatactacagaagctcaagcttctaagacaatggaggagtgattttctagtaggagtccatgctggactgaagagtatgtcacgaaagaccatgaacatcattgttgataaatttcgttctggagagttgaatctactggttgcaaccaaagtgggtgaagaaggacttgacattcagacatgttgtctcgtcatacgatttgatcttccagaaactgttgccagcttcatacagtcaagaggtcgtgcacgtatgcctcagtcagaatatgcatttttggtggacagtggcaataagaaggaaattgacgtaattgatggtttcaaggaagatgaataccgaatgaatatggaagttacttttcgaacatccaaggagacatacatcatccctgaggaaagaatattcagaattgattcgtctggtgcttctgttagttctggatatagtatctcattgcttcaccaatattgttcaaagcttccacacgatgagtatgagcttatttaa

SEQ ID NO: 47367 - DNA, 1518 bp, Glycine max
  Peptide Sequence Number=SeqID_164145
atgacagaaccacaggagctggacgaatacttaatttatttgcctcctgagctttgtgaactaaaagtaataggtttttcgaaggatattggcagttccatatctttgctgccctcaattatgcatcgtcttggaaacttgctggtggctattgaactaaagcacatgctatcttcttcctttccagaagcagctgaaattagtgccattagagttttagaggctctcaccactgagaagtgtcaggagcgcttttcccttgaaagacttgaagtgcttggtgatgctttccttaaatttgctgttgcacgtcatttttttctcatgcatgacagccttcatgaaggagaccttacaaaaaggcgttccaatgctgtaaataattccaatttgtttaagttggctattaagcgcaatttgcaggtctatatatgcgatcagacatttgatcccactcagttttatgcattgggccgtccttgcccaagagtttgtagcaatgaaaccgaagaaagcatacacttttgtttaaattctgttatgcaacaaggaaaagcaactgaaacccgatgtagcaaaaatcatcattggttacataggaaaacaattgctgatgtggttgaagctctggttggagcattcctagttgacagtggctttaaagctgcaattgcctttctttcatggattggcatacaagttgattttgaagcttcacaagtggttgatatctgcatagcaagtgctagctattcccctctttcttctgaagtagacattccttctcttgaaggtaagctaggacatcacttttttcataaaggcctgcttctccaggcatttgtacatccttcttacaataagcttggaggaggctgttatcaggcaagtcgattggagtttcttggagatgctgtcttggattatttgattacttcatatctattctcagcttatcccaaactaaagcctggtcaattgacagatttgagatcattgtctgttaacaacaaggcatttgcttgtctagcggtagatcgcagttttgataattttcttttatgtgattcaagtggcctgtctgaggcaataaaaaagtatgtggactatgttagaagacctgtgtcagataatggcattaaagaagggccaaaatgtcccaaggcactgggtgacttagtggaatcttgtgttggtgccatccttcttgattcagggttcaatttgaacaaagtttggaagattatgacttcattcttggacccaatcatgaaattctcatcaagcttgcagctcagtcctgttagggatttgcgagaactttgccaatctcataatttggagttggagtttctgccagtgccctcaaaattgactaaaaggttttcagttgaagctaaagtgagtgggaatggtgtatgtgaaacagcttcagcaactggccaaaataaaaaagaggcttgcagaattgcttcacagctactttttttaaagttcaaggtaaagcaatcatgttaa

SEQ ID NO: 47368 - DNA, 1887 bp, Glycine max
  Peptide Sequence Number=SeqID_164146
atgtcaggctgggacgaaggagccgtctactacagcgaccaagcgctcgccggcgacgacggttccggtgcccgcggtgaagccggcaccgattcgaaccactctctcatccagaaattcaaggaattcatccgaaacttcgagaccaccaacaatgtcttcccttacagggagagtctcctccataaccctaagttccttctcgtcgatatgggagatctcgacaccttcgactccgaccttcccgataaactccgctctaaccccgccgatgtcttgccattgttcgaagctgcagcggctcaggttctcgtgaatttgaagacgaaggtggctggggataccggagatatggaggatcagacgcccggtgatgttcagattctgctcacatccaaagaggatcccgtgtcgatgagatcgctcggggctcaatatatatcaaagcttgtcaaaattgctgggattactattgctgcgtccagaactaaggcaaaggccacttatgttaccctgatatgtaagaattgtaagaaaggaaaacaggttccgtgtcggccaggacttggtggagcaattgttcctcgatcctgtgatcatgttcctcagcctggtgaagaaccttgtccaattgatccctggctcgtggttcctgacaagagcagatatgttgatcaacaaactttgaagatgcaagaaaatccagaggatgttccaactggtgagcttcctagaaacttgcttctctctgttgatcgacatctggttcagacagtggtacctggctcaagattgacaatcatgggaattttcagtatctaccaggcttctaactctaatacatcccacaaaggagcagttgcaattagacagccttatattagggttgtaggaatagaagaaacaaatgagaccaactctcgcggtccagcagcatttacacaagatgagatagaagaattcaaaaaatttgcttccgaacctgatgcgtataaaaatatctgctccatgattgctccctctatatttgggcacgaggaagtcaaaaaggccgtagcctgtcttctgtttggagggtcaagaaagaatttgcctgatggagtccggttaagaggtgatatcaatgtattgcttctgggtgatccatctacagcaaagtcacagtttctgaagtttgttgaaaagactgcccctattgctgtttatacttctggaaaaggctcatcagcggctggcctgaccgcttctgtaatccaagatagtggcactcgtgagttctatcttgaaggaggggccatggtcttggctgacggaggtgttgtctgcattgatgagtttgataagatgaggccagaagatagagttgctattcacgaggccatggaacaacaaactatatctatagccaaagctggaataacaactgttcttaattcaaggacttcagttcttgctgctgccaaccctccatcaggccgatacgatgatcttaagactgcacaggataacattgacttgcagacaactattctttctaggtttgatttaattttcattgtgaaagacgtcagaatgtacagtcaagacaagataatagctaatcatatcataaaggttcataaatcagctggtggaaggatgggagaaagcagaacttttaaagaagagaattggctgaagaggtatttgcaatattgtcgaactcaatgccaccctcgtctatcagaatcagcaacaacattattgcagaatcattatgtgaaaatcagacaggatatgagacaacaagcgaatgaaactggagaagctgcagcaataccaattactgtgaggcagttggaagctattgttaggttgagtgaggcacttgcaaagatgaaactgtaa

SEQ ID NO: 47369 - DNA, 591 bp, Glycine max
  Peptide Sequence Number=SeqID_164147
atgggtgtggatgtgcaggctcaaggttggaaagctaagtcaaaaaccctggaagaagttctggaatcaacttctaaaatggaaccaaaacttattggctatgatgaaactcccattgatgtaacagataccaatactgccaagcacatagtggttaatgctgacccgtacaacaactctaacccagaaatttgccctatgcaactgacagatgaaatatgctctccatgtgtgaaacctttcggccaacggcttcaatcttctgctaagggaaagcttagtcaaatatttgaaaatcgtgattgtggcagtgactcgtctgggacaggaacagcaagatcacgattgtatgaattatgtgctgcgtattgctggaaacctccttcatttgaatgctgcaagaaagagggaccagaccacctgaaacaatttacttgcaaggtgaccttagagatagaagaggcccagaatttgattttagagtttgttggggaacctctgtcaaagaagaaagatgcagcagagagtgcggcagagggtgcattatggtatctacaacatgaaggtttcttgcctagtattggtaattga

SEQ ID NO: 47370 - DNA, 1569 bp, Glycine max
  Peptide Sequence Number=SeqID_164148
atggataatatcatcactgaagggcattctatttcgaggccaccatatttcgatggaagaaattacatcgagtggaaggagcgtatgaaaatattcatacaatccgttgacttcaagctatggcttctgataaaaaatggaccaaaagttccaacaaagttagtagacaacgaagaagtggagaaaagtgaagatgaatatgatgaagaagacatgaagaatttggaattagaggccaaagcaaaaaatattttacattgtgccttgaatccagatgtttttgaaatattttcagagggtccaaaaacatccaagcaaatgtgggacgagcttgacagggttttcaacagggaaaggacaggtgactacaccccaactccacaaggacaattctccagcgatccaacggcaccagatacaagtcaatttaactctcctgatctttactttttacaggatacaagtgaatcgttggacaaatttatggagctttgtgtgccccttcacaagcttgctctagaaggcaattggccagcagccaaagtcattttacaaaaagatggtagactgaagcacgcagcaataacaactggttggactacacttctgcatgttgctgcaggtgcaaaccatgctccctttatggaggagctgctggaagaactcaacgacgatcaatacatttcattgcaagattaccagggcaacactgccttctgcttcgctgttgcatctgggaacatgaaaattgttaacttattgcgggaaagagatccatacttgccaacaaaaaggggtggaaatgattatatccctattcagattgctgcgatgcaagcaaaatgcgacatgacacgctatctataccacatcagcaaagaagcgttcaatgataaggacaagataatgttgttctttactcttatcaagacccgcagttatggcatggccttcgacatggcactacagtggcaagagctagcttatgcacgtgatcataataaggccacagctttgcacctcttggctaaatatcaaaaccctttggattcgtgttgtcattgtccagatatggacggttacctcccgatcaaccctgacacgaaacatgtaatgtttcaattggttaattttctctggaaaacgattctccaccacaaaggccactcgcaggcaatgggaatcataagcgagccttctcaactattatacgatgctgcagaagttggtatttttggattcttgtcagagcttattagtacttaccctaacaatatcatatgggaagtggacgacaaagggcaaagtataattcacacagcagtttcatatcgccatgctagcatcttcaatctcgtacatgaaatagggttcattaaggatattataatatcatatattgtcaaagaacacaacccttcgtgttttcgaaaaaaaacaaagaacaacactttattgcatttggctgcaaagttagccccaccagatcgacttgaaatagtttctggagcagcattccaaatgtgcctcgagatcatatggtttgaggtaacccctttatttcattga

SEQ ID NO: 47371 - DNA, 3811 bp, Glycine max
  Peptide Sequence Number=SeqID_164149
gcacaggtacctcacccaatgtgttccccttcacaaagcagcactggaaggagactggaaagaggccaagaaaatccttgaccaagacccggcgctgctgaactccgccataacaaaaggatgggcaacagtgctccacattgcggtcggagcaaaccacgaaagcttcgtggaggagttgctgaaactaatgtcgcgtgaagacttagaactgcaagatatcaagggtaacactgcattctgctttgctgcagcggttggaaacgtgcacattgctgagagaatgcgcagaaaaaatgcatcattgccaatgataaggggtggagaaggagtcactcctcttcacttggctgtgttacaaggaagaagtgaaatggcttggtatctgtttgataaaactagagaaacactgtacgatgatgattggtttcaagtgtttctcatttgtgtaaactctcgactttatgaactggccctggaaatgctcaatcagaaggaatcgctagcttttgctcggggtgataacgatgagacagctttgcatgttttggctcgaaagcctttggattgtggttgccgaagcaagaacatgaaggaccctccggtcctcaaacttacaagacgcgtgtgggatatatttcttaccctcgatgactctaagatgatgactgcaattagagaaccatctcaagtaacatttattgccgcagaagttggcaatttcgagtttctatctgtgattatgagcacttatccggatttgatttgggaattgaatacgatgggtcagagtataattcacgttgctgccttgcaccgccacgctagcatattcaatttgatacacgaaattggcccaagcaaagatctcctgttaacattttgggatgatgaaggcagcacgttactccattctgtcgcagaaatagcaccaacagatcgacttaatgtagtttctggagcagctcttcaaatgatgcttgagttgacatggtttgaggaggtaaaaaagaacatgcaaccatcatatatagagaggccaaatcatgaaggaattgttcctagagaactattcaccgagaagcataaggagttgttgaaaaagggagaatcttggatgaagcgaacagcaagttcttgcatggttgtttcaaccctaattgccacaggagtgttttctgccgccttcagcgtcccaggtggtaccaaagacgattcaggatctcccaattatttgaagaaacatttgttcacggtatttgcaatatcagatgccttggcattaactctttctaccgcctcaaccctaattttcttgtccatactcatctcaagatatgctgaggaagattttcttaggtcattgccattcaagttgatatttggactagtgtcactatttctctcaatagtcagcatgatgggagcattcagtagtgctttcttcataacatattaccatgctaaaacgtgggttgttcctatcaccattgctgtaactcctacttgggctactgaagtacctcttactattgttgaggtaactcttgtgaaagaagattttgtgaacatgactcccaagtcacctagagatatgtccgcacataaccaccgcaccaccatagcctgtgactcgcacccccacacaacccatcaccgtcatcaccgccgcactcatggtcttcgagatctgaaagagaagttgagaatggaaaaggcgagggatgggttgtttgagggtctcagagatgtgacgaaggagcgtatgaaaatattcatacaatccgttgacttcaagctatggcttctgataaaaaatggaccaaaagttccaacaaagctagtagacaatgaagaagtggagaaaagtgaagatgaatatgatgaagaagacatgaagaatttggaattagaggccaaagcaaaaaatattttacattgtgccttgaatccagatgattttgaaatattttcagagggtccaaaaacatccaagcaaatgtgggacgagcttgacagggttttccacagggaaaggactggtgacaactcatcaactccacaaggacaactctccagcgatccaacggcaccagatacaagtcaatttagctctcctgatctttactttttacaggaaacaagggaatccatgaacaaatttctggagctttgtgtgccccttcacaagcttgctctagaaggcaattggcaagcagccaaagtcatcttaggaaaagatagtagactgaagcacgcagcaatagcagatggttgggctacacttctgcatgttgctgtaggtgctaaccatgcttcctttgtgaaggagctgctgcaagaattcgacaacgatcaatacatctcgttgcaagattaccggggcaacactgccttctgcttcgctgttgcatctggaaacatggaaattgttgaattattgaagggaagagatccacacttgccaacaagaaggggtggaagtgattatatccctattcagtttgctgcgatgcaaggaaattgcgacatgacacgctatctatacgacatcagcaaagaagcgttcgaggatacggacaagataatgttgttctttacttttatcaagaccggcaactatcacatggccttaaaaatggcagatgagtgggtagagctagcttatgcacgagatgataataacgagacagctttgcatctcttggctgtaaatcaaaaccctttggattcgtgttgtcattgtccagagatggaaggttccttccggatcaaccctgacacgaaacatgtgatgtttcaattggttaattttctctggaaaaaaattctccagcacaaagaccattcggaggcaatgagaatcataagtgagccttctcaactattatacgatgctgcagaagttggtaattttggattcttgtcagagcttattagtgcttaccctggcaagatcatatgggaagtggacaacaatgggcaaagtataattcacacagcagtttcatatcgccatgctagcatcttcaatctcgtacatgaaatagggttcattaaggatattctaatatcatatattgtcaaagaaaacaacactttattgcatttggctgcaaagttagccccaccagatcgacttgcaatagtttctggagctgcattccaaatgtgcctcgagatcatatggtttgaggaggtgaagaagataatgccaccatcgttcataaatttgaaaaactctgatggtctaactgctcaacaattattcataaaggagcatgaaggattgcggggaaaaggagaggaatggatgaaacgcactgctgagttttgtatgcttatatcaaccgttattgccacagcgatttttgctgcggcaattaacataccaggtggtattgatgatgacacaaaaaaaccaaattatttgaacaaagcatcattccaagtatttgcaatagcagatgcagctgcattcatcttctcagcaactgcaattttgatattcttgtctattctcatctcgcgatatgcggtgtacgactttcacaagtcactgcccttgaagttaatatttggactgataactctgttcatctccatagcatgcatgatggttgcatttggaagttccttcttcataacctactactatggtttgaaggtgcttcctgattcagttgcaggtccattctccacggccatgcgagactattctacgaagttgttcaccacagtcatgttttcaagggagaataacactctgagagcatccttgactacagaggagcttgaagatcacaattag

SEQ ID NO: 47372 - DNA, 336 bp, Glycine max
  Peptide Sequence Number=SeqID_164150
atgattaattcttgcaccagatctcatcttgctactgaggagaatgtgcaagaagcagtaaggcttttcaccgtgtccacaatggatgcagctaagtcgggaataaaccaacaaataaatcttacacctgatatggcaaatgagataaagcaagctgaaactcagataaagagaagaattgggattggaaaccacatatcagaaagaaggctgattgatgacctcagcagaatggggatgaatgaatctattgtaagaagagctcttataatcatgcaccagagagacgaaatagagtacaagagagaaaggcgtgttgtatttaggaaagcatga

SEQ ID NO: 47373 - DNA, 210 bp, Glycine max
  Peptide Sequence Number=SeqID_164151
atggagcaatatagaacactagacaggatatttttcaagtttattattatgaagaaaaatctcatattaattccagaaagcagaagaagagggagaacattatccaagaataggtgtgctgaaatttctggcgtgcagaagaccaataatcagaccataaagtttttaccgttttcaaatgataggcgtgaatctcaggatattccttaa

SEQ ID NO: 47374 - DNA, 3813 bp, Glycine max
  Peptide Sequence Number=SeqID_164152
atggctgaccacaccactaggaagacgacgacggacagattggaagacgcggttgcacgactcaccaacagtcaagcatctctttccgacaaatacacggagctctcgggaaaagtagactcaatcctcgaccacctccgttcacgcgatacccaccacattcaaccaacccccacgacttcgtcctctcaccgcagccccataaagttggatataccaagattcgacggacgagacccgttaggatggatcttcaagatacagcaattattcgattaccagcatacgccagaggaggaaagaatcacagtagcatcattctatctcgatggcgctgcactaagttggtatcaatggatgcataataatggtttcattacgtcgtggaccggatttctgcaggctcttaagtcaaggttcgccccctcattctacgaagacccaaaaggagccttgtttaaactcacgcagtgtggctctgtaaatgaatacctcacggactttgagaggttagccaaccgtgttattggacttccccctcccttcttactaagctgctttatctcaaggctcacaccggagacccgacgcgaggtcttggccctgcaacctatctcccttccacaggctacgacgcttgcaaagcttcaagaggacaaaccaaagccgccattcatgcaaagaacaccggaggaaatggccttccgacgagagaaaggtctttgttataattgtgacgaaaaatggagctccggccaccgctgcaaggggcaaatccaactgttcatcgcagacagttctactccagaacccgagctcgattccacctccccacccgaaggcgagattaccaactccggcgagcttgatcctccaatcgaatccgactacccacacgtgagccttcacgcactatcgggcctctcatcttcagatactttccgcctttacggcgtcatcaaacaagcacacctcaccgtcttgattgacagcggaagtacacacaacttccttcaacccagggtcgcgcagttcctccatctcccgacacagcccacacatcccctccgcgtcctcgtcggaaatgggtccgttctcgactgcagccaagtatgcccacagctttctctccaaggtcatcccttcgaaatcacatttcacttacttccgatcagcggtgccgacgccgtcctcgatatagaatggttgaagcaatttgggccaattacgactgattacaccaccttcgttacgaagttcagtcatttgggccgtaacattgagttacatgcagacgttgagattgggcctgaacccgtatccgcgccccagatcaaacggttattacgcactgggtcaacctcggccctatttcacttggccatcctaccctccagcttaaccacacattcttctacatcaccaacccaccccatacccgccattgccactctgtttccccagttccaacacttattccaaaacccccaaggcgtcccaccttcacgcgagataacccatcgtatcaccctcccacccacaactgcgccagtaaatgtcaggccgtaccgctacccacattatcgaaaggctgagattgagaaacaggtatcagagcttctctccgccggcctaatacgcacgagcaccagcccatattcatctcccgttctcctcgtcaaaaagaaagatggtacgtggaggctatgtgtagattatcgagcgttaaactctgttaccatccgtgaccgcttccctatccctacgatagatgaactactagatgagctagggcacgctacatggttctctaaattggatttaaggcaaggctttcatcaaattcaaatgaacgaggctgacatcgagaaaacggcattcagaacacaccacgggcactacgagtatctcgttatgcccttcgggttgtgtaatgcgccgtccacctttcaggccgccatgaacagcctcctcgggcccttcttacgccacttcgccaccgtcttcttcgacgacatcctagtatacagtgactcccttgcttcccatatcacacacctgcgcaccatcttccaagctctggtccaaggtcaattctatttgaaggagaccaagtgcttattcgcgcagcgaaaattggagtatttgggtcatgtcgtttccggcaaaggggttgaaccagagccatctaaggttcaagctatcacccaatggcctccaccctcatcacccaaggatctacgtgccttcctaggcctcacaggattctacaggaagttcgtaagaggctatgcatcaatcgcggcaccactcacgaccctgttatgcaaggatgcctttgaatggtctctttcgtcccaagcagcatttgatcacctcaaggtagcaatgacgagcgcaactgtcctagcactaccaaacttcttcgagcccttcatcatcgaaattgacgcatctgcaacaaccatgggagccgtgcttatgcaacaagggcacccactagccttcttcagcaaaatgtttggccctcgtctccttctcgcttctacatatatccgagagctacactccataatcacagctgtccgcaaatggcggcaatacctcttaggacgaccgttcaccatcatgacggaccataagagtctccgggaactcatgactcaggtcatacagacgcctgagcaacactattacctctctaaattgcttggctacgattacaatattcagtacaaaaccggagctaaagtcgcaaccctatttctggatttggtttgtaaacatcacggcttcccgaagagtatagtctcagatcacgatccgatattcataagctccttctggcgtgagctatttagactcagtggtacccgcctccgcatgagcacggcgtaccacccgcagtccgacggccagactgaggtaatgaacatagttttggaacaatacctacgttccttcgttcactctcaaccatcaagctggttccgatacctggcacttgcagagtggtcctacaacacgtcgctccattccagctccggcctgactcctttcgaagtcatctatggcagaccacacccagtagttcctcactacattcccgacatgactaacaacgaagttgttgactccctcatcacttctcgtcaacacattcacgagaaacttcaacgacgtttgagaaaggcaaaggaagctatgaaacactacgctgacatgaaacgagatgatgttaccttcaacgtgggtcagtgggtgtatgttcagctcaaaccattccggcaacaatccgtcaccggagtaacccattcgaagctatccaaacgcttcttcggacctttccagatcattgctcgagtcggggcagttgcttatcgtcttcaacttccggaggactcccgcatccaccccgtcttccatagctccctgctacgcgcctaccatggtccacctccaccttcagacaagccctggcctctacaggtcatcggccttaaaccagtgccaaaccctctttgcattctcgactctaaaatggatagcgtgacatcaccacctactccaatggttctcgttcaatgggacggtcaacccccggaggacaccacttgggaaccatgggccgatatccgcgaagcctaccaccttgaggacaaggtggtgataggggatgagagtattgttagcagtcgcagtcttcacgaaggaccagcagcagaaccagggacctccatatcaggaacttccatggacagacccacgaggacaatcaccaggcccaaacacttacgcgattacgtcagctaa

SEQ ID NO: 47375 - DNA, 186 bp, Glycine max
  Peptide Sequence Number=SeqID_164153
atgcatcaggctcaagtccactccaacaattataaaaagagagtcaagccaaggaggagagaacaaccacagagcaggcctaaaagccaagcgatgtatgatgggttagacgctcggaagagggtaacttctaatagaacaaaaagaaaggatttcataagaaaatcattgctaggaatagaatga

SEQ ID NO: 47376 - DNA, 1470 bp, Glycine max
  Peptide Sequence Number=SeqID_164154
atggcgcctcggaaactgaccgattacgaacgcaaacggcttgagaacattcgccgcaacgatgaagtgatggcttccctcaagctccattctaaagccacccaactctccaacttcaagcgtccaagggtcgaacaaaccaaatcccacaacgtgaaacccaaaatccaaaccccgatcgtcatcaggcgctccctgcgaaccagagttattccaccacattccaccactccctccaaaaccgaaccttcaagttcgggtcctctttccatgtctgatgctcgtcacggcactcactctcattcttccttcattcaatcactcatgtgtatggccaaaaagcaagcccaaacagttcgagataaagttgggagatttttgaacgatgtaagtgttaaagaagagaaaatggaaacttcccttaggttgaaatctctgcatttggatcccgagaatattgcacgggttgttcctggaaggataaccgatgtgcggttttttccttccactagtgtcaaaatgattgcggcgggtaacaggtttggtcatattgggttctggaatgtgggacaaagagaggttcatttataccatccccatttggctcagatttctgggatcttgattcaaccacattgcttctccaagggtgcatttgaggttaaaggggaagcgaaggaggaaagtaagctttgtttcacagcagcagaatcacatatatcatatgagttcaggagttcgagtgttaatatatacacaagttgttatgatggaactgttcgactaatggatgccgagaaggaaatctttgatctggtagttgatagtgatgagtgtatatttgctctctctcaaccaacaaatgaagcaaactgcttgtatttcgctgagggttatggaggtttgactatttgggataacaggattggaaaacgttcgtcgcactgggttttgcacaaaaggaggattaacacagtagatttcaactgtgaaaaccctcatattgttgctactagttgctctgatggaactgcctgcacctgggatttgagatatactgatggagataaactcactcccttgaggatatttacccacgatagagctttgcaatctgcttacttctctccttctggaagtagcttggcaattacaagcatggacaccacaattggcatttacagtggagttaacttggaggatgctactcttatttatcataacaatcagaatagtacacgcctttctactttcagagcgaaatggggttgggatgactcatatctcttcattggaaatacgaaaagaggagttgatgtcgtctcagcagttgaaaggagaagagttatgactctagagagcccgtacttgtctgcctttccatgtagattggatacacactcttacgaggtagggatgctagtaggagctacaaatggaggccaggtttatacctggacttcgcgctag

SEQ ID NO: 47377 - DNA, 2619 bp, Glycine max
  Peptide Sequence Number=SeqID_164155
atggaagttgctgctatcatggccattgtattggccaacggagggggcaagccaccggattggcaggattttgttggtattgtcgtgttgctcatcatcaattcaaccattagttttattgaggagaacaatgcaggcaatgccgcagcagctttaatggctggtcttgcacccaaaaccaaggtgttgagggatggaaaatggagtgaggaggaggcagcattgttggtgccaggagatttgatcagcatcaagttgggagatattgtcccagctgatgctcgtttattggagggagatcccctgaagattgatcaatctgccctcacaggtgagtccttgccagtcaccaaaaaccctggtagtgaggtcttctctggctccacctgcaaacaaggtgagatagaagctgttgtcattgccaccggtgttcacaccttctttggcaaggctgcacatcttgtggacagcaccaacaatgttggtcacttccaaaaggtgttgacatccattggaaacttctgcatctgctcaattgctattggaatgttgattgagattattgtgatgtaccccatccagcaaagggcctacagagatggtattgacaatttattggttcttctcatcggaggtatcccaattgccatgccaacagtcttgtctgtgaccatggctattggatctcaccgcctgtctgagcaaggagccatcaccaagaggatgacagccattgaagaaatggctggcatggatgtcctctgcagtgacaagaccggaactctcacccttaacaagctcactgtggacaagagcttaattgaggtgttccccactggcatggacaaggatacccttgtcttatatgctgccagggcttccaggactgaaaaccaggatgccattgatgcttcaattgttggaatgttgagtgaccccaaggaggcaagagcaggaatcactgaggtgcatttcttgcccttcaaccccgtggacaagcgcacagctattacctatattgatggtcaaggcaactggcacagaagtagcaagggtgcccctgagcaaattattgagctctgtgaactcaagggagaggttttgaaaaaggcccataaagtcattgatgagtatgctaaccgtggtctgcgttcattgggtgtttcacgccagactgtttcagaaaagaacaaggagagtgcaggagaatcatgggaattcttgggactcttgcccctctttgaccctccaaggcatgacagtgccgagactattcgtcgtgctcttgaccttggtgtcaacgttaagatgatcactggtgaccaacttgccattggaaaagaaaccggtcgcagacttggaatgggcaccaacatgtacccttcatcctctcttcttggtaatagcaaggaccctgctattgcatcaatcccagttgatgaactcattgagaaggctgatggatttgccggagtcttccctgagcacaaatatgagatcgtgaagaggctgcaagaaatgaagcatatctgtggaatgactggagatggtgtgaatgatgcccctgcattgaagaaggcagacattggtattgcggtggctgatgcaactgacgcagccagaagtgcctcagacattgttctgaccgagcctggacttagtgtgatcgtgagtgccgtgttgaccagccgtgccatcttccagaggatgaagaactacacaatctatgctgtctccatcaccatccgtatcgtgtttgggttcatgctcgttgctcttatctggaagtttgacttctctcctttcatggtcctcatcattgccatcttaaacgacggaaccatcatgaccatctccaaggatagggtgaagccttctcctcttcctgactcatggaagctcaaggaaatctttgccactggagtcgttcttggagcttacatggccatcatcactgttgtgttcttctttttggttcatgacacggatttcttcactagagtctttggtgtcgagccaattgtagacaatgaagagcagcttaactcagctctctaccttcaagtgagtatcattagtcaagcactcatcttcgtgaccaggtcaagaagctggtcttatgttgagcgccctggtattttgcttatcacagccttctttgctgcacaattggtggccactgtgattgctgtgtatgctcactgggactttgctagggtcaatggagttggctggggatgggcaggagcaatttgggtcttcagcattgttacctatattcctcttgacatccttaagttcctcatccgcttggggttatcaggcagggcatgggacaacatgcttgagaacaagactgcattcacaacaaagaaggactatggaaggggtgaaagggaagctgaatgggccgtggctcagcgcacacttcacggtctccaagttggagaatccaacaaggccaaccaacatgaccagtctgaaatcgcggaacaggctaagagacgtgctgaggctgccaggttgagggagctccacacactcaagggacatgttgaatctgttgtcaagttgaagggtattgacattgataccatccagcaacactacaccctctaa

SEQ ID NO: 47378 - DNA, 930 bp, Glycine max
  Peptide Sequence Number=SeqID_164156
atggtcgcggcaggtagcaacacggggaatctagggttctggaatgtaggacaaagtggatcacatttctggcatctcgattcaaccacattgcttgtccaagcaaatgaggcaaactgcctatattttgctgagggatctggacctttgactatttgggatatcaagattggaaaacttttgtcccaccgggttttgcacaaaagcaggattaacacaatagatttcaactgtcaaaaccctcatattgtagctactagttcctctgatggaaatgcctgcacttgggatttgagatatactgatgcagataaactcactcccttgaggatattttcccacgatggagctttgcaatctgcttacttctcttcttctgggtgtaacctggcaactacaaggtatggagtttgttctattctaaaattactgcttttcaatactgaaaatatgatgaccttacctcctgggaaaaatatgttcaggcttcatgtgattcatgtaaccgatatcacccacgcggacaccacaattgctatttacagtggagttgacttggaggatgctggtgttatatgtcctaacaatcggaagagcacacccctttctacgttaagagcgaaatggggttgggatgattcatatctcttgattggaaatgtgaaaagaggagttgatgtggtctcagcagttcaaaggaagacagttatgactctagagagcccgtacatgtctgtcattccgtgcagattgaatacacactcttacgaggttgggatgttagagggagctacaactggaggccagtggtgcctctcagtctccgtccttgatttcaacaaccacgtgaccagagtcatggctggaggtgtctctgagtcctcgaggggtgttaaggctttgtttcatgtgaaacacctagaaatataa

SEQ ID NO: 47379 - DNA, 192 bp, Glycine max
  Peptide Sequence Number=SeqID_164157
atgagggatgcatcagttgaaggccttgagactagaaggaatacatcctctggttgttcttctttaattggaacctgtggcaacgatgtcttagtggtcctttctgcatttggatgctcttcatctgatgaactggctaggtcatcttcatcacttttatcaacagctggttctgtggaaggttggaaatga

SEQ ID NO: 47380 - DNA, 273 bp, Glycine max
  Peptide Sequence Number=SeqID_164158
atggagccatttatgaaatacgagtcagacaacgcagagacaaagaagcacatatggactcttcaacttactcaggaaatgctggatcatcctgaacccctgaaactcccccattgtacagaagttcttcttagagcttgcgacaaccacatgacagtcttaaggcggcatggccccccactgcaatggaaagttgaaacgctgaatcctgctattggtggaaaaggtgttatccaaccatggtatgattttcttgaaggtgggatcctctag

SEQ ID NO: 47381 - DNA, 246 bp, Glycine max
  Peptide Sequence Number=SeqID_164159
atgcccaataatgtgaatttaatgtgtttcaactttagtttcagcgcatcttcagctcgctcagcgaggcgtttgtctcttcccgtgctaagcgcgcccaactttcttagtggatattcactaacttgctctaagcgtgaaaatggtgctaagcgagcctacgaggacagaaagccctttttaaggatgaagttggaaaaatcaggcattcagctaagggagcatgaattggaacgtagagagtag

SEQ ID NO: 47382 - DNA, 303 bp, Glycine max
  Peptide Sequence Number=SeqID_164160
atggcggttgccacgagaggaggcaaagatggttgtagtttctgtagcttgttctcgtttcatatcttcatctctgtcttattttctcttcttttagtttccaccctttcagtcctcttcaccaccaacgcctccacatcaaacgatgacggaaatccaaggaagttagatgttgtgggtttgtatttgcgaccgaagaagaaaggatgttctgggtgtgggtcgttgttcgatggtggcgatggtgcatggagaggttgcaaaaaagaggaagaaggagctagtagaatgacatttttttaa

SEQ ID NO: 47383 - DNA, 672 bp, Glycine max
  Peptide Sequence Number=SeqID_164161
atgaacgacctcggcctgctgttcaaagagtggcgcgccgcagtctccgccgaggccgccgccaccggccgggaaccgcttcttctcactgccgcagtgtacttctccgtcgattacttcttatccgaaacgacgtcgttgaggtacccggtggattcgattaacgagaatttagattgggtcaacgttatgagctacgatcttaatgggccgtggagtaaccatactgggcctcctgctgggctttttgacccgaaaaataatgctagtgtgagttacgggttagggtcgtggatccggggaggggttattccgaagaaggtggtgatgggtttgccgctatatgggaggacgtggcagttacttgaaccgaatgtgcatggaatcggggctccagctagtggaccgggtcctgggtcgaatggtgcaatggccttatttcaagtgttggagtttaacaacgaaacgggtgcaaatgttgtgtgtgacaaggaaacggcgtcggtttattcgtatagtgggagttactgggtcgggtacgatgacccgaaaacggtggcggttaaggttggatttgctcaagctctttctcttcatggctatttcttttgggctgctggcctcgacactagcgattggaaaatctcaacacaaggtacaggaaacttttaa

SEQ ID NO: 47384 - DNA, 495 bp, Glycine max
  Peptide Sequence Number=SeqID_164162
atggctgaggctgtattcaaagttgtgcttgaaaatttgagctccctcgcagcaacagagctgggaacacttctgggtttcaatggagaaaagaaaaagcttcacaacatgttcactgcaatcaaggccaagtttcaagatgctgaggagaaacaattctcaaatgaagctatcaaggattggctgggaaagctaacagatgcatcttatgagctggatgacgtgttggaggaatgtgcctatgaagaattgtgtttgaatagaataatgaaaactatcatcgaagcatcgcttcgacaaccttgtgaggacttggataagccatataactgggagaggttgaaatttgtactggcttgtggggcaaagggttcttccatactggttactactcatctttcagaggttgcaacaatcatgagaacaataatgcatcctcctcatgaattaacaaagttatctaacaaagattattgggaattgcttaaagattga

SEQ ID NO: 47385 - DNA, 435 bp, Glycine max
  Peptide Sequence Number=SeqID_164163
atggtggatttgttcagacaaagtagttacatcgttgtcatttatattgcaacaaacatattttgcaaccagttgtgcaagatcatgaaaaagatcgtgcattttgaagctttcaactttgcccatcatctttcacaatatcctgaaaaaaatgatcttcgatacagttcatcccacactccatcaccatcatcttcagcatctaacaatccattcgatgaaatgaatccattagccatccaaataaccagtatggaagaaccctttgccccacaagccagtacaaatttcaacctctcccagttatatggcttatcttcccacacatcatccaaaacaagcaaatattttttcctcgaagcagatcttggagtttacattgtagtgactccagacccaagtcctcacaaggttgtcgaagcgatgcttcgatga

SEQ ID NO: 47386 - DNA, 1245 bp, Glycine max
  Peptide Sequence Number=SeqID_164164
atgttagttagagttagttacaataaagaggaagtgagttttgctgcaaatggtataactgcagctggattgagagcttttgatggtgttcttcaatcaaacatcacattgaagactcttgatctttcaggaaaccttgttggagatgaaggtgctaagtgcttatgtgacatattggtgaataactctagcattgagaagctccagctaaacagtgctgacttgggtgatgtgggtgcaaaagcaattgctgaaatgttgaagaaaaattcaagtttgcgggttcttgaacttaacaataacatgattgaatattctggattttcaagtctggccggggcacttcttgagaataacagtatacgaaatatacatctcaatggcaattatggtggggctttgggggctaatgcattagctaaagcacttgagagcaacaagtcaataagggaacttcatttgcatgggaattctattggagatgaaggaatctgttctttgatgacagggttatcttcacataaagggaaacttacacttctagacataggcaacaactcattaacagctaaaggttcattccatgtcgctgagtatattaggaagagcagaaaccttttatggttgaacctttacatgaatgacattggtgatgagggagccgaaaaaattgcagttgctttaaaggaaaatcggtcaatatcaacgttggatctggggggaaataacattcacgttgatggcgttaatgccattgctcaagttttaaaagataacttagttattaccactttagaacttagttataatcccattggaccagatggagccaaggccttggctgaagttctcaagtttcatgggaacataaaaacccttaagcttggttggtgccagataggagcaaaaggggcagagtgcattgcagatgctttaaaatacaataccaccatatcgattttggacttgcgagcaaacggtctaagagatgaaggtgcacagagcctggctcgcagcttgaaagtggttaatgaagctttaacctctctagatttaggatttaatgaaataagggatgatggagcttttgctattgctcaagcactcaagtctaatgatgatgtagctgtcacatcactaaacattgccagtaacttcctaacaaaatttgggcagggtgctttggctgatgcgagagaccatgttttggagatgaccgaaaaggaaatcaacatcttcctctag

SEQ ID NO: 47387 - DNA, 864 bp, Glycine max
  Peptide Sequence Number=SeqID_164165
atgggcaatgtgacgggaacagtggcggcgaaattcgcgtttttcccgccagagcctccgacgtacgacgtcagcagagaggaggatgggagggtggtggtgtcgggtgtcaccgccgacaaaaacgtcgacgttcacattctccacaccaaaggtggcaacgagatcgtcgccaccttctggaaacacccttttgccaggttcactgtcctctactctcacggtaatgccgctgacttgggtcagatgcacgacctcttcatcgagctcagagctcacctccgtgtcaatatcatgagctatgactattcaggatatggagcatctacaggtaagccatctgagttcaacacctattgcgacatagaggctgtatataattgtttgaagaacgagtatggaattaagcaagaagaattgattttgtacggtcaatcggttggaagtggacccacgctacacttggcttctaagttgcagaagttgagaggtgttgttcttcacagtgccatcctttcagggataagggtcttgtaccctgtcaagatgacattttggtttgacattttcaaaaatatagacaaaattcgacatgtcaactgtccagtgtttgttatacatggaacaaatgatgatattgttgattggtctcatggcaagcgattgtgggaactctccaaggaaaaatatgatcccttgtgggttaagggtgggggtcattgcaaccttgaaacattcccggagtacatcaagtacttgcgcaagttcattaatgcaatggagaaactctcactcacaaaacagacaaacaaacaactcacacaaaatcctaggaatcagaatcatggtttgattgaaggttga

SEQ ID NO: 47388 - DNA, 270 bp, Glycine max
  Peptide Sequence Number=SeqID_164166
atgcgtttcgccgtcaatcccatcattccacctcgctatctcacggaggacgatcaaattgttgattgcgtcaaccctgactatgaagcccgggagctttgcactgcgatgcgtgcttttactcttgacggcaaatcgatggatgagtacttgtgcaaaatcaaaggatatgttgatgaacttgccgacgtcggagttcctattcgtcacgaggagtatgttgatttttggacaaatggcctcggttatcttaagaagggggtgaattaa

SEQ ID NO: 47389 - DNA, 936 bp, Glycine max
  Peptide Sequence Number=SeqID_164167
atgttgaaaattgaatgccatggcattgatctgtttatgatttgcattaatagccagagacctgaacaaatcagcatgtcagtgtgcgccaagtttatgccctgtgattttggtgaagaaaatcttgaagtcattaagagtgttgtgaatcttgaatttgctaaagcagttatattgggaaaccacgatgcctggtttactaaacagttttctggaagcaaggagaaggataaagttcagcttcagctagaatgccttggtaaggagcacgtggcttatcaacgttcagacttccctcagataaaagtaagcgttgttggtggacgaccattttctattgggggtaaaccaatgtttcggaaaaagcttcttttggcaagatacggagtcaaagacatggatgagagtgctaagagaatccagaaagctgctcttggaacaccagaggaccattttcttatattacttgcacataatggacccacaggccttggttctgattcaaatgatatatgtggaaaggattgggaatttgagggtgatggtgatcatggtgacccagatctagcacaagcaatatccttgctaaaggagaacaatcagatatccattccattggttgtgttcggtcacatgcacaaagagctggcatatggcaatggctttaggaaaatgattgtggttggcgctgataacaccatatacttgaatggggcaattgttccaagggtcaaaaggttgggtggtgatgaagacaagaaaagcttagatgatgaaagtgcccttgcctcaccagaggccaaaggtacaagaagagcctttactttagttgagatttcggaaggaagagttgccaagattgcagaaagttgggtctcggttgtcgaagataggaccacattagaagaagagcacatactatttgagagcagctag

SEQ ID NO: 47390 - DNA, 2067 bp, Glycine max
  Peptide Sequence Number=SeqID_164168
atgttcagaagcttgtttctgatttccttgttgcttcatacaatagtggcccaaaaacctgcacttccaaatcttcctacacctcaagtccctccccagaaatggtcaacattaagtggcaatgagcctcttgtaatagcccgtggtggtttttcgggactcttcccagaaggctctcctgacgcaattgggctatcacaaggcataagcgttttcttgtgcaatcttcaggtggcaaaagatggcggtgccttttgtgtcacggggactacgcttgacaatacaacaactatatcattggtggatcctaaggaaaaaacctacaatgtcgatgggaaggacgtgcgaggacacttttctttggattaccctggtcttctgattgaccagaatgtatcaatgactcaggccatattttctcgacccaatttttacgatggtacttccccagttcttaatcttgatgctctactaagcggaaaatctcccccgaggctttggttgaatgttcagaatgcagcactctacaccgaaaacggagtacaggtggtagatattgttttagaattattgagtttttatcaaatagagtttgtttcatcaacaagtattggtttcttgaagagtatcagtgggaaatcaaacaaggcaactaaggttgtctttaaacttcttaataataataaggttgaaccttcaaccaagaagccatatggaagtattgtgaaggatcttgccacaatcaagtcatttgcatcaggaataatggtcccaaaagaatacatatggccagttaaaccagacaaatatctaggacctcccacaacacttgtggctgatgcccataaatcaggactagaagtttatgcttctggttttgctaatgacttcttttctagttatagttataactacgaccctattgccgagtaccttcaatttttagacagaggtgattctgttgatggtgttgtcactgatttcccagcaacagcatcaaatgccatcgcttgctttgcacacaacaataccttgcccaaaaaaggaccaactttgatcataagcaacaatggagcaagtggagtttatccaggcagcactgaccttgcatatcagcaagcaatagatgatggcgctgacattatagattgctcagttcaaatgacaaaagatggaattgccttctgctcaaactccacagacctaacatcagataccaccgcaatgcctaaattcatgtctcgatcttccaatgtcccagaacttcaaccaaaaagtggaattttctcctttgaccttacatggagtgagattcagacattaaaacctcaaatggttagtaaaggcagtgatttcctaagaaaccccgcaaacaagaccagtggtaaatttgtcaccctctcagcatttttggagttagccaaggctaaggcagttcctggcattttggtcaacatacaaaatgccccctaccttgcatcccaaaagggtcttgacattgtagatgctgtcagcactgctttgagcaatgccacctttgacaagcaagccaaacaacaagttctgattcaatcagatgacagctcggtcctatccaggtttaaagacatcccatcttataaaagggttatgttattgaaggataaaatgggcgacgtaccaagacaaacagtggaagaaataaagaagcatgcggatgcagtgaatcttccaaaaacctcaattatcaaagtatctaattccatcttagtaggaatgacaaatgttgtcaaagagttgaaagatgcaaacctcacagtattcgtccataatctcaaaaacgaatacacaaccctggcattcgactattggtctgatcctaatgtcgagattgcaacttacgtccaaactgccaaggttgatggaatcgtgaccgattttccagccactgcaagtagattcatgaggagtccatgtagcgatccgacccatgatcctactatcttacctgctaagcctggtgatctattgaacactattccaactgaacttctgccaccagcacaggctccacttcctcctcttgag

SEQ ID NO: 47391 - DNA, 1173 bp, Glycine max
  Peptide Sequence Number=SeqID_164169
gttcttaatatgcgccttgagaacggtaacaagttctctagcaggggcctgaagagtggcgacgagggcggaagcagggctcttcaaagcccccaagagagtggcgtaaatctcggcgcgggtggggagggattcgaggttcttaacctcatcggggccgtaaaacttgccctcaaaaacggcgccggtgaagtcgttgtcctcgagcttcttctccttctggaagttccagtagggcttgatggcggaagggatctcctcggtgtggacgaagagccatacgttcatgcccttcatgcagggcttcagggtctcccagggcgtgccctccaccgccttgtagacgagtcaggaggtagcagttctccagctgctaccgcactgtctccaccgttgcctctttcttgctgcggggaatggcggcacggatggagttgggcttgggcttgggcttgggcttttgaggaggtcattgcggaggccgtggcttccatggtcggaattgaaaaaaaagagagagcaagatgggaagggactgaggattgtagcaaaacactgcaaaccccttcggcgttttgtccttacgttgttattaagaagcgtaacgcattcaccacgatggtgaccaaagcgatggaggtggtgaaggatctggacgtgaagcggtacatgggtcggtggtacgagattgcgtgcttcccgtcgaggtttcaacccagtgacggcaccaacaccagagccacctacactctccgagatgacggcaccatcaacgttcttaacgagacttggagtggcggcaaaagaggtttcattgagggcactgcttataaggctgatcccaacagcgacgaggccaagttgaaggtcaagttctgggtgcctccctttttacccatcattcccgttactggggattactggcttttgtacattgaccaggattatcactatgctgtcattggccaaccttccaggaattatctttggatattgtccaggaagaaccatatggatgaggaaacctacaaccagcttgttgagagagctaaggatgaggggtatgatgtgagcaaactccacaagactccacacagtgattctccaccggaggaagaaggtcctcaggacaccaaaggcgtttggtggatcaagtcccttctggggaaatag

SEQ ID NO: 47392 - DNA, 273 bp, Glycine max
  Peptide Sequence Number=SeqID_164170
atggatctgccgccgtcaaacctcctcgccggtggcgcggcaactttatcgcttttgattttgttgcagccatccctggcggtgttgtttttcgatgaccgataccatcgctgtgccagatctgagcctcaccaattccctaatctaagaactctccctcattggcgttgtcttaacgcagtgtttggcagaggtgtatggagtgagagaagggaaagggttagacgagggagggaagactatcatgtgagagagactcacactggattataa

SEQ ID NO: 47393 - DNA, 744 bp, Glycine max
  Peptide Sequence Number=SeqID_164171
atggccttcacttccactctctctctctactctcacccgcaggttcgcctccgctgccagcggctgcaatcgctggccttcaccgccgccggcgtcgctcaatttgcgccgcttccgcctctgaactgccggagaacgtgttctccgagaagcttcgtggttagggcttcttcgagcgtggaaggaagtcgcgcgcgtgccggtggttctcgcagagtctatcgccagtctcaggccaacgcgccgctatccagtgcgccggtgaaacagattgccaacgttgttgctcccgtcgccgcgttcttcgccctcacttttggttcatccttagatcgtggttgtcataggttcacctctgccttgaggctcactgaaagagttgttgtgttcgccagagttatctggaaattagtggagaaacttcttgttccaactccaaagcaattgaaatattcaactggggagagtcaatccccttcacaaggactgaaatggtcttttgctgctggtacaaatttgttatcccagcttggggagaagattgagagacaatctagacagaagctcaatgagtttgcacgggaactgaggtcatttcctagtattgatatgtcagggcgcaactttggagatgaaggattattcttccttgctgagagcttggcattcaaccaggcatatgccgaaattattgagtgttcattccttcagttacttaatggaagaaatctactgaacagttga

SEQ ID NO: 47394 - DNA, 183 bp, Glycine max
  Peptide Sequence Number=SeqID_164172
atggcaattttgatcgccaatacttcaacaacatttcatagggatgaaagatttgggaatacgcatgctataaatggttttatgatcccaacatggttggctcatgaggaaggcataaggatcatgtatgagcaaacatgtagaacaaaaaggtatgcaatttgtagatcaaaaagacagtga

SEQ ID NO: 47395 - DNA, 261 bp, Glycine max
  Peptide Sequence Number=SeqID_164173
atgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggggtgcatgagtgtgaacgtgggtggtctagtgcccccacattgttccttaaaatcggttgtctcggatgacgcttgccctggcgcttgctttgttcaacgcgatgctactactcttagttag

SEQ ID NO: 47396 - DNA, 1233 bp, Glycine max
  Peptide Sequence Number=SeqID_164174
atggaggccatgaaagagcaaatggccacaatgatggaggccatgatgagcatgaagaagataatggaagccaatgcggttgcagttatcgctaccagcgttgttgctaagcgggtaaaaaccctcatgctacacgcccttacctttagaggacttcatgtcctcgccttcaaaggattacacgtcctcaccatcagaggactacacgtcctcgccttcagaaggcttctcgccctcccctttagaggactacacatcctggcctttagacggttgcacgtcctggccttcagagaactacacgtcctcgcctttagaggactacactctctcacgtttaaaggactgcatatcctcgccttgagaggagtacacatcctcagctttagaggactacacgtcctcccctttagagggctacacgccgtcgccttcagaggactacacgtcctcgtctttcgagggctactcgtcctcgcctttagagggctacacgccctcgcattcaggggggctacacgccctcgctttagaggactacacatcatcgccttcagaggactacacgtcctcccctttagaaggcttcatgccctcacctttagaggactacaggtcctcgcctgtagaggactacacgccctggacttcagagggctgcatgccctcttcttcagagggctgcacgccctcacctttagaggactacacgtcctcgccttcagaggactacgggtcctcgccatcagaggactacacggcctcgccttcagagggcttctcgcactccccttcagaggactacacgtcctcgacctaagagtactacatgtcctcaccttcagaaggctacacaccctcaccttaagagggatacatgccacccttataggactaaacgtcctcgccttcagaggactacatgtcctcgccttcagagggctgcatgccctcgccttcagagggctacatgacctcaccataagaggactacacctcctggccttgagagggctgcacgcccatgcctttagaagactacacgccctcacctttagaaggctacacgccctcacctttagagggctacacgccacctttagaggactacacgtcctcgccttcagaggactacatgtcctcgccttcagagggctgcatgccctcgcctttagaggactacatgtccttctcttcaaatggctatacacccttgccttcaaaggacttcac

SEQ ID NO: 47397 - DNA, 414 bp, Glycine max
  Peptide Sequence Number=SeqID_164175
atgacctcaccttcagaggactacacgtcgtcgccttcagaaggctacacgccgtcaccttcagagggatacacgcaatctttagaggactatacatcctctccttcagaggactacatgtcctcgccttttgagggctgcatgccctcgcctttattggactacacgtcctcgccttcagagggctacacgccctcgtcttcagagggctacacgccctcgcctttagaggactacacgtcctcccttttagaggacttcacttcttctcctatagagggcattacgcactctccttcaaaggactacacgtcgccgccatcagagggatacacgcctttgcctttagaggactatacgtcctcacctttagaggcctgcacgccctcacccttagagggctacatggcctaa

SEQ ID NO: 47398 - DNA, 906 bp, Glycine max
  Peptide Sequence Number=SeqID_164176
atgatttctttgcgagacaaagcacggctgatgatgaatatatattgctttggaaggaatctagtcactactgctgcatcctatttacctcctgttcaactcccaacacaaagggaagtgcatttttggtatattttacctgatgaggtaaagagcacaaccctattgaaccgatatttagaaattctatcaccttgtgagaaagaaaatatatttcgcatgcgtggggaacaactgagaaaaggagcactcctggcccgtgcattggttcgcactacattggcaagatatcagacgaattttcaaattgatccaaaatccttaaagtttatgaagaacaattatggcaagcctgagttggactggcaatatgctgatgattggagcctaccgcatctgcattttaatatctcacacacttcttctttgatagcttgtggagtgactgtgggttcacctattggtattgatgtggaagagaaacaaaggaggttaaagaatgatattttagcctttgcacaacgattcttttctccccatgaaatagaaatgctgactcacattgcagaccctgaacttcggcttcaggagtttattaaattatggactctgaaggagtcttatgtgaaagcaatagggaggggcttctcagcctcaccttttaagactttcactattcgattaagagaccaccatgtgaaaggagacatccatgctccacctcttataacttctaaggcacctgatattactgttgttgaggcttctgatgacgtgaagaatccgtcgaacaattggcagtttgtgcttcttgagttagctgagtatattgcatcaatgctagtagcacaacatcactatcacgaatggttgcatgtctgcatggaaatggacgtattccaataa

SEQ ID NO: 47399 - DNA, 534 bp, Glycine max
  Peptide Sequence Number=SeqID_164177
atgaggatgttgcggtggatgtgtggtaagactcgacaggataaaattagaaacggagctattagagagaaggttggagtagcgcctattgtagagaagatggtggaaaatagacttaggtggtttgggcatgtagagagaagaccggtagactctgtaatgaggagagtagaccagatggagagaaggcaaacaattcgaggcagaggaagacccaaaaagactataagagaggttatcaagaaggatctcgaacttaatgatttggatagaagtacagttgctgaaaacattggttatagggatctgacaacaaagtttgacatggacagggtgaagcatgcatctgaaattgctcatgctgataagtttgggagcatttggaaggtgcttgtgatttcctatcgcttggaaacagttatgatggctaaacgagtattccttttggacgatgggaagctaaaagagctgcctcaatcaactatgttggatggtcaaaaggattcattgctatcatctgggcttgttatttga

SEQ ID NO: 47400 - DNA, 273 bp, Glycine max
  Peptide Sequence Number=SeqID_164178
atggcaagtccacctcagaattcagacctaatattcccagcagcagacgttgctggagaactgaatcctgggagaaacacacactttcatgttgatcctacgtcttctgaggtggatgcctccaaggaacaagcccaggccaaacagaagaaaaatgaaagacaaaagaaggatgcattgcaaacaataaaatcagcgattataatttcaggcatagttgttgctgtggcaggagctgcctttgctataaccaagaaattaagagagaaatga

SEQ ID NO: 47401 - DNA, 276 bp, Glycine max
  Peptide Sequence Number=SeqID_164179
atgaaaataaagaaaaagggtatgttttattccattactttccttaactttttaaatagtgatcaagagcttcccatggaccctaagaaaataaaggtcattcctaagtggcctactccaccaagtgttgagcaaagaatccctgagtttcaagaacctatggatttgaggtcaaatccttttcaagggggagggaacatgatcccacaaatccaagatcaattccaagattctccactaagtgtgcttaggtgtcatgaggcatgtaacgcatga

SEQ ID NO: 47402 - DNA, 315 bp, Glycine max
  Peptide Sequence Number=SeqID_164180
atggcattaggggtcatggcagctcgcccaggcgtgctattgcttcaatctgatgtaaccttgctcgcccagacgagctgggaagtaaagataaggacacgaatttcgtttgagcgatcttgctattcgatcgtgtcgcaacctaccctttggcgggagggcaacgcgagggctcacgagtgcgtcttccaagggaggaaggcgcgtggagtcgccaccaacgtttatttgaggaaaacgtcagaaaaatcggaaagggtgtttccctcactcctacgtatcctcaattgcgatgaagaagtcagacctacgtag

SEQ ID NO: 47403 - DNA, 1044 bp, Glycine max
  Peptide Sequence Number=SeqID_164181
atggacaatacacagtggaaatttctcgacattgacgactcagacctctcatcctttgttcgcccttttaacccaaataaatcatcctctagttcaagagcacttattcctagtctcacaggggtcgtacaagctatcatggtggatttggaaacgttggtttccgcctgcgccggcggttgctccgaccagaaaatcgcctacgagcctcacgtcgacgacggagaccaccatccggactctccgccggcgtcgttctggctctctggcgacgccgagtacgactggtgggaccgcaacgccgtctaccagcggaacgaatcgacgaaaggaaactcgattgtttcctcaacgaacctgaacgctaactcgaacaacaattctcagcgattctcgaagaatttgaagtccaaagcagcgataatcggcttgccgaagccgcagaaggcatccttcgctgacgccagcagccgccgaaaccaccggcctccgggaaacgccaggctgttcccgaagcggagcgcgtcggtcggcggaaaattggaaaactccgtcgccgaaccgtcgtcgccgaaggtctcgtgcatagggagagtgagatccaagcgtgacagaaatcggagactacgaactcgccagagatcaatctcctccaccgccaccgccactaccgcttccacctccatcgccgccgccgtcgtcacgaggcaaaaatcgacgcggagccagcggaagaaaaccggtttcttcgaaagcgttcgcgagattttcaggtccggtcgaagaggaaaaccggttcagaaaccggatcttccacaggaggattcgttgtcgtcgtcgaagaagaagaagaaaaggagtttaggtaagaaagcgtggggaagcaccactggcagcacaaggagccgaaacgacgcgtcgtttgaagaatcggtttcgagtgcagcggctcctcccggtttgggttcgatgaaccggtttgcgtctgggagaaggtctgagtcgtggggagtgggtgactatgaaatccacatgtcgcattag

SEQ ID NO: 47404 - DNA, 177 bp, Glycine max
  Peptide Sequence Number=SeqID_164182
atggcattagggatcatggcagctcgcccaggcgagctgttgcttcaacctaaaggtttggacacaagtcccagtgtcgacctagtccctaatctagtagacacaatatgtctcgaaagatgtgcacctttgtgtggtggatgttgggactcaagaatgagttctggtgttgactag

SEQ ID NO: 47405 - DNA, 270 bp, Glycine max
  Peptide Sequence Number=SeqID_164183
atgatagcttgtacgacccctgtgagactaggaataagtgctcttgaactagaggatgatttatttgggttaaaagggcgaacaaaggatgagagtgcatcagggaatttgatggtttacgtcagggcgttagggaatcctctgctttgtgttagagtgtcagggaattcgatgttttgcatcagggcaacagagaagcctttgctttgcgttaggacgttagggaatcctttgttttgggtcagggtgttagggaatccgatactttaa

SEQ ID NO: 47406 - DNA, 1131 bp, Glycine max
  Peptide Sequence Number=SeqID_164184
atgtctgggagaaggaggaggaagttgaaattgttgagtgatacaattactgacagcagaagagctgcagtggaggtggaaaatgaaaatttggagctgcaaacttggtctgatctccctactgaactcttagaattaattctgtcccgtttaagtctagatgataatgttcgggcttcggttgtttgcaagagatggcattctgttgccacttctgtatgtgtggtaaaccaatcaccgtggttaatgtattttccgaaatttggtgactggtatgaattctatgaccctgtgcaccgcaaaacatattccattgagttgccagagttgagtggatctagagtttgttacaccaaagatggttggttacttctataccgtcccagaactcaccgcgtgttcttcttcaatccctttactcaggagattatcaaactaccaaggtttgagatgtcataccaaatagttgccttctcttgtgctccaacgtcatctgactgtgttctgtttactgttaagcatgttagtcctaccgttgtggccatcagcacatgttaccccggggcaacagaatggaccactgttagttaccaaaaccgcttgccctttgtcagtagcatctggaataagcttgtgttttgtaatggactcttttattgcttgagtctcacaggttggctaggggtgtttgactcatctgaacgcacttggagtgttctttccgtacctccacccaagtgcccagagaatttttttgccaaaaattggtggaagggaaaattcatgacagagcacgagggagatataatagtaatttatacatgttctaatgaaaatcccatcatttttaagttagatctgacgttattggaatgggaagagatgacaacactggatggagtaactctttttgctagtttcttgtcttctcatgcaaggactgacctccatggaataatgagaaacagtgtcttcttctctaaagttcgtttttatggaaagcgttgcatatcattctctcttgatggctatagatactatcctcgtaagcagtggcatgactggggagaacaagacccttttgaaaacatatggattgaaccgccaaaagatttctctgggttcacatga

SEQ ID NO: 47407 - DNA, 438 bp, Glycine max
  Peptide Sequence Number=SeqID_164185
atgaggagtgcaagattccttgaggaaattgagtttgcagggaaagaaaacataagaggtgttgtctttaatgaagaacgtgttattcacaatggacaagtttttgtatgtaccattgctcaagaaatagaactagtaattaataacaatgttattcctaacatcattcaagaacaagaaaaagagagctcattaggtcaagagaagggatcattgtgcataaaagaggaaaaagaactatgcattaatggcacagagaagcaacacggatctcaaggaaaaaaatggaccaattacgtcgtgccatttggcaacaccatcagagtagaaagaggggtcaccaggccttgcaccagtggcgcctttgtagaggtgctacccccttctcgcgctattttggaggttaagcacttagggtttttcaaccctgatacctaa

SEQ ID NO: 47408 - DNA, 375 bp, Glycine max
  Peptide Sequence Number=SeqID_164186
atggggagagttagaggaaacaacaaagtaggaatagagagacatgtgaagaaaaagtatcatcagtacttatgccccacaagtatccctattgaagtttggaagtatataggagaacaaggtttcatgtcgctcactaagcttttcaatgggattttgagatctaagaagatgccaaatgagtggaggaagagtacattagtcctaattttcaagaacaacgaagatatccaaaattgtgttgattatagagttataaaacttatgagttatactatgaagctatgggaaaaagtgattgggcatagattaagaatagaaacaaggattgtagagaatcaatttgattttatgcaagggatgtctacaacataa

SEQ ID NO: 47409 - DNA, 1452 bp, Glycine max
  Peptide Sequence Number=SeqID_164187
atggcatcgaaaagggaaagggaagcgagtgatagagtagaggatgaaggggttgataatgagtcgaaaaggcagaggctggatgaggattcttccccctctcctcctcctgtgtccattgcaaatcctctttctgggttggccaataattatgctgacattgatgaggaggaagattatgttagaagggaaaggggttctataaatgagaggaggaatgatgggtcccagcataatgggcataagaaatatggagaggctgatgatagtgatgaagaagatgattcacatgaacaatttagtggaagaaatcgccaggttgaggttcggaaggactgtccttatctcgatactgttaatagacaggttttggattttgactttgaaaaattctgttctgtctccctctcgaatttaaatgtgtatgcatgtttggtttgtgggaagtattaccaagggagaggaaagaagtctcatgcatatacacatagtctggaagcaggacatcacgtctatatcaatctccgcactgaaaaagtctactgtcttcctgatgacaattttttagcaacatatttctgtttctatggtcatcagccattggctggtaacaacgttgatattagcattttttgtccaatgtatgccacctgttgttggatgaaaaatgattcttatccattctggaagctcaaatttcatgctatggaccttccaaaatcaagtaggggtttaccacagcagccctgctgttcaggccaacctgggaatctccttctgtgtaccctaaaaagattcgctgcaaaagaagttgaacaacttgacaaaaataagcagtggtctagggctcttgatggttctagttaccttcctggaatggtgggacttaataatatcaaggagactgattttgtgaatgtaacaattcaatccttaatgagagttacccccttgaggaatttttttcttatccctgaaaattatcaacactgcaaatctccacttgttcatcgatttggtgaactcactaggaaaatctggcatacacggaactttaaaggacaggtcagcccacacgagtttctacaagcagtgatgaaagccagtaaaaaaaggtttcggataggtgcacaatctgatccagtagagttcatgtcatggctacttaatacgctacatgcagatcttaagacttcaaagaagaatacaagcataatatatgagtgttttcagggtgaacttgaggttgtgaaagagattcctaacaaagtgatctctgataagaaagaaaacaatgctgagaaactttcagatggggtgaatgagcgatatgcatttgtcaaagaaacttcaaaaatgccatttctaatgttagggttggacttgccaccacctcctcttttcaaggatgtgatggaaaaaaatataataccacagttgatgattagataa

SEQ ID NO: 47410 - DNA, 366 bp, Glycine max
  Peptide Sequence Number=SeqID_164188
atggctttaaatgaaaaaaggggttccccgacttggatagggaactatgtgagtgacctacctaatcttattgtagaaattttcaggatcaatgatttgaccatgcaagctagaaatgctttttctttttttgcacagcagggttatgaaaatcctcaagaagcaatcggtcgtattgtctgtgccaatttccatttagctaataagcccgtggatattgaggttccacaagtggtacttcctaatactatatttgaagcagttgttcgaattccttatgatatgcaagtgaaacaagttcttgctaatggtaaaaaagggagctttgaatgtggaggctgttcttattttattggaaggttttga

SEQ ID NO: 47411 - DNA, 906 bp, Glycine max
  Peptide Sequence Number=SeqID_164189
atggatggtaaagaaattatgagtccaaagaaatggtttaaggcgattattagattgaggaaaccgaaggaagataaatcgaaactagcaaaggtgcaatctacccctgaaaaatcaaatgagtcctccgaggagaaacaagaagacactcttgaagaggcacttagcattcctagtgaaggtttggcggtagaaaggacagttcccacgaggttgatagaagatattgctgctactcggattcaaaatgcatttcgtgcatttttggcaagaagaacattgcaccatctaagaggagcagtgaaatttgaggctttgattcaagatcacatggccagagaacaaacagtaactgctctaaactacatacatacttggagcagaatgcaggaccagattaaagctcgcagactctatatgataacagaagccaggattaagcaaaagagattggaaaaccagttaaaacttgaggccaagattcatgagctccaggtggaatggagtggaggctctgaaacaatggaagagatactttccaggttacatcagcgtgaagaagcagcggttaaacgagagcgagctatggcatatgcctactctcatcagtggaggcccaattgcagccagtacttgggccatgctacttacagcctagggaaggagagctggggttggagctggaaggagaggtgggtagcagcccgtccttgggaaattcgggttcgttttcagggccccatgacaaagaaaaccaatggccagccacagagaagcaaagtagacaaaaaagaccacaattataataataataataataataataataataatagaaaagtgcccttgtctaagcctgagttgtcaaacggaaaagaaaacaacaatattccagagctgtcttag

SEQ ID NO: 47412 - DNA, 849 bp, Glycine max
  Peptide Sequence Number=SeqID_164190
atgaacacttgccttttccatgttgttgcgtttgctagaagaaataagaactttattcccaaactggcgaaagaggatggtgcagaggtcacagatcaaggtgagatgtgcagtattactaagaagtactttgaggatattttcagtgcttgtcaagaaaactatgatccaatcattgaggtagttaagcacataattagtgctcaaggtaatgaatttctcttaacccaattctctgaggaggattttcgtgatgtgctttttcatatagatgttgataaagctcttgggccagacgatagtggcaagatccctcagggtgtaaatgacacgaatatggtcttgatacctaaatgcaataacccgagttcgatgaaggatttaagaccgatttcattgtgtaatgtggtgtataaaatcctttcaaaggctatggctaatagactaaaatttttgctcctaggatgtgtggcggaagagcaagcaacatttatcgcaaacagatctatctcaaataacatcattgtcgcgagtgaggttatacactatttacggtgtagaaagaaaggaaagagaggggaagtggcactaaaaatagacataagcaaagcttatgatgaggtcaattgtggtgatcttaaagctatcctgacgaaaatatatggagcatctggaatagcaggaatgccaagttataggagaagaaccagactgctactcaagttcatgtttaggaaaaagaaggatgataaaggttggtttgtgagagctgcaacaaatgttagacgtggaatgcctaaggttcatgagggagaagcacaagtcatactacaaactctgacggattga

SEQ ID NO: 47413 - DNA, 333 bp, Glycine max
  Peptide Sequence Number=SeqID_164191
atgccttcaagccatcagaaacagcaattactgctcaaagcagatgaacaaaagataatctctcaaaagcactcatggacttcgatcagctctaaaatcaaactcatagctccccatgttaaaccacttgcccatgaccaccgttgcccaaaagagttaaaaaagaaggacgttgaggcctacggtgaggacgcggtggtggtggtcacagaggacggtgttgttgaaggtgatgtcatagaggttgtgcttctcgtaggggaggtagtggtccaccacactgatcggcgctaccaccagggtggtggtggagggtggtgcagttggggatga

SEQ ID NO: 47414 - DNA, 351 bp, Glycine max
  Peptide Sequence Number=SeqID_164192
atgacgttgcaaatgacgaattctccgacaaatccttcttcttctcactggaatcttcagagctccatcaggcaccgcaattcccggcgaccggcacggaggttcgatgagatcaatgacaaaggggatgaatccggcaagatcgagatcaggaaacggaagtgcggcatcataaagtgtctagcatgcaagcgagtgaaacatgcgagctatttttctaagagggtttccttcgagaatcgagtcatcgacaaaggaaacatcgatgatgctgaggcacaaacagagagcgagagcgagaggcaatttagggctttattttgcaaaactaagggagaaagattaaaataa

SEQ ID NO: 47415 - DNA, 303 bp, Glycine max
  Peptide Sequence Number=SeqID_164193
atgaatgttaatgaagatgaaattatgcttgacttaaccgatcaacaaaaattggagaaagaaaagaatgatcttcaattgtgcaatgttgggcttgcagaaaagcttgacatttggttcaacaggtcaagaaactttctcaaagcaagctcaatactagtacatgaggaaggtttcagccttagagactcaaagcaaagaaaatacacaaagactgcacgcagaaatatcgaagaaatcagaggaaacagatactttgcaaaacaagagaatcaaactagggcagcatctggattctcttga

SEQ ID NO: 47416 - DNA, 693 bp, Glycine max
  Peptide Sequence Number=SeqID_164194
atggccgatcaacccaaattccatcctgctttgactatcaccaatgttaagtcccccattcccataacgttggatgtggagcatggcatgtatcactcttgggcggctttattcaaggtccttgttagggttcatgatttacatcaccacatcatctctcctacggaggcacaagaggtagccgcctatgccgcatccaaagccgcagacactgctctacggaagcgtctcgatgcattaggatgctacaacagtaagcaagggttcccacattttcgtgaacgggtgtgggtaaagaagctagttcatgacaggaggattcgctttggtacatggaatataggcacacttactggaaaatctatggaaatagtggatgttatggtgaggaggaagatcaattttatgtgcctacaagaaactaagtggacaggtgaaaaagcgaaagaattagacaactcgggatttaagctgtggtatacgggaaaaatcagatcaagaaatggggtagggattattgtggacaaggagtggaagaaggatgtcgtagatgttgggttagcagaacactttaaggtaaaattttgggaggatctagaaggggtacatcaggatataccccaaggagagaaagttttcctaggaggggatctcaatggacatgtaggtagcgtggctagaggttttgagggg

SEQ ID NO: 47417 - DNA, 273 bp, Glycine max
  Peptide Sequence Number=SeqID_164195
atggcaaatgtagggcaggtggttatagagggctacacattcatgaaaagaattgcagctttaatccttatttggcatggtgagtcgttatggaatgagaagaacttattcacagggtgtgttgatgtccttctaagcaagaagggtatagatgaggcaattgaagctggaaaaaaaattagcagcattccttctgaagttggagtttatgcctatactaggatattatttgtctggaaggctgcaatggcacttggagaccactaccaatag

SEQ ID NO: 47418 - DNA, 150 bp, Glycine max
  Peptide Sequence Number=SeqID_164196
atgggacctattttcccgccttatgccggtacctatgccgatttgattagttggaggagagtgatgcactgtttcagctattgttggagacctttacctgctgactacaagtgtaacagattcactgttccgaatccaccacccaagtaa

SEQ ID NO: 47419 - DNA, 171 bp, Glycine max
  Peptide Sequence Number=SeqID_164197
atgcagtgggtgaaaagttatcaatcaaatcagctggccatacatggcgccagtgctgatggcgccttcgacagggacgagccatgtggccatggaagcgccattccctacagcgcttcctcttttgctgaggtggctttggaagcgccagcattagtggcgacttggtga

SEQ ID NO: 47420 - DNA, 174 bp, Glycine max
  Peptide Sequence Number=SeqID_164198
atgggacgcgccagtagaactggcgacttcatgcatggcggacaatggtgttggcgctttgacccgtcttgtctcgtcaagcagcagcagcagcagaaggcagcagggctaggcaacttaggtgcagggaaacgccattcccattggcgcttcgtgcttttctttcgtttataa

SEQ ID NO: 47421 - DNA, 228 bp, Glycine max
  Peptide Sequence Number=SeqID_164199
atgtttgtgagaaatcttaataatattcatagctttaataagctcgacacaaaaagttatggtgactccaaggtgcaaggagaaacaccacaaaatgttgcctcgaaagtccttgaagatgcacccccaagcaacaagaccaagtgctgctattgcagccttggtccagccaaagaggggagagcaccaaacaacaagtttaataacatgggctcttatggtgaatag

SEQ ID NO: 47422 - DNA, 834 bp, Glycine max
  Peptide Sequence Number=SeqID_164200
atgctgtcatcgtcggatacaaccgacaacagacagataaatgccggaagcggtataaagagtacacacaacagcggagtgcctatgtttaagtcctattttccgcggccggcgctgtttttcagctcggccgcgatttggagcctgattgccatttttgcctggtttggctttttcaatgattttccggcgcgctttcccgctttgcaggcggcgatgcagcagccgctgccgaccaacgccagccgctttatccacgccagccagctgtggttttatgcctattactggatcatgggaggcgcctttgcgctggtgtggcgcatcatcgacaaccatccgtggcagcgctggtcggtatggggatcgttactgattatctttgtcacctggtttggcgtgcaggtaggcgtcggcgttaacgcctggtatggtccgttttacgacatgattcagcaggcgctgaccaaagccggctcggtgagcatcaatcagttctatgtgcaggtgctggcgtttctcggcattgcgctgatcgcggtagtgatcggcgtgatgaactcgtttttcgtcagccactgggtgttccgctggcgtaccgcgatgaacaactactacatgcataactggcagcgcctgcgtctggtagaaggactggggcatcagctttatccaggccatcatgacgctggtggcgtttctgccggtactggtgacgctatcgcatcatgtgaaagaagtgccgatcctcggcaatatcccttatgcgctggtgatcgccgcgctgctgtggtcgctgtttggtaccgcgctgctggcgctggtggggattaa

SEQ ID NO: 47423 - DNA, 999 bp, Glycine max
  Peptide Sequence Number=SeqID_164201
gattgtacgtcctcgccttcggagggctacacgtcctcgtcttcaaaaggctgcacgccctcgcctccagagggctatacgtccttgccttcagagggctacacgtcctcgcctccagaggactgtacgtcctttgccttcagagggctacacgtcctcgccttcatagggcagtacatccttgccttcagagggctacacgtcctcacctccagagggctagggctacacgtcctcaccttcagagggctgtacgtcctcgccttcggagggctacacgtcctcgccttcagagggatgcatgtccttgccttcagagggctgcatgtcctcgcctccagagggcttcacatcctctcctttagagggctgtacgtgctcatcttcggagggctacacatcctcacctttagagggctgcacgtactcgccttcagagggctgcatgtcctcgccttcagagggttgtccgtcctcgccttcagagggctgcacatccttacctttagagggttgcacgtcctcgcctttagagggctgtacattctcgccttcagagggctacacgttctggcctttagaaaactcaagcgaccacgactccaatttccccctgccaaagtgtcagctggtttatgccatcatgacatagggatcgtgcccacaagacacccagtggacccgaagaagtccaacaaggtcctggggtttccagctctgattacgggcctctgtcagttctatggagtgcccgtcgccaccagcaaggtcatcaggccctctattaatagggctttcatcgaaaagtacagtgcccccaggcgggcgcagggcgaggtaccacagcagcttagggacggccaacagcaagcaacagatgcaccgccaccacctctagggtccacctcagctcatctacaaaggttggagtgttgcccacgacccatggctgaccggcaggcgaccaagtccaaagccaaatgtaagaaaaagtactag

SEQ ID NO: 47424 - DNA, 291 bp, Glycine max
  Peptide Sequence Number=SeqID_164202
atgtcgatctccccctatggaagtatcagttggtctgtgtcgttccgacggatcgtgcccacaagacacccagtggacccggagaagtccaacagggtcctggggtttccagctctggttacaggcctttgtccgtcctacagggtgcccgtccccccagcaaggggtagcgcccacaagacacctagtggacccagaggagcccaacagggccctggggtttccagctctggttacgggcctctggatcgtgcccgcaagacacccagtggacccgaagaagtccaatag

SEQ ID NO: 47425 - DNA, 612 bp, Glycine max
  Peptide Sequence Number=SeqID_164203
atgccaggctaccatctggtcggttcatgtaatgggttgcactgtggggttagcgaaataccagaaggataccgtgtttgtttctggaacaaggcgacaagggtgatatccagagaatcaccaacgctgtctttttccccgggcattggtcgtagaacaatgtttgtgtttggctatgatccgtcaagtgacaaatacaaggttgtagcaattgcattgactatgctctcacttgacgtatctgaaaagactgagatgaaagttcatggcgcgggtgacagtagttggagaaaccttaaaggttttcctgttcttgggactttacctaaagttggtggagtgtatctgagtggaacccttaattgggttgttattaaaggaaaagaaatcattcattctgaaatcgtaattatttctgttcacctggagaaggagacttgcatatcactgtttcttcccgacgatttttgctttgttgatacaaatattggagtttttagagactcgctgtgcgtttggcaagatagcaacacccatcttggtttgtggcagatgaggaagtttggagatgacaaggggatggtaagtctcaagtttctgtcgttccctcag

SEQ ID NO: 47426 - DNA, 465 bp, Glycine max
  Peptide Sequence Number=SeqID_164204
atgatgacaaaggtgatgacaaaaagctcaaaggtcaatcaaagaatgagttcaaaatgttcaagatggaatcaagaacaattcaatactcaagaggaaaagttgaagaacacttcaagattcaagaggaaagttgaacacaagaatcaagattcaaggatcaagcttcaagaatcaagatcaagattcaagattcaagaatcaagagaagacttaatcaagataattatgaaaaggatttttcaaaaactgagaagcacatggatttttctcaaaacatgtttaccaaagagtttttactctctgagtcgcatcctttcacataaaagccttgtgtgtagacaaaggatcaagctgaatgttttgatgatgccaaaggattacatgaatcatatgcttctcaaagatttactcaagacaaagcaattagagatattcaagatggatgatcaagacagtctatag

SEQ ID NO: 47427 - DNA, 327 bp, Glycine max
  Peptide Sequence Number=SeqID_164205
atggctactctacctgcctcgcctcctcctcctccttctcctcctcctcctccttctacaagaccggtggtccacgtcgatcctgagactgggaaggctgacagtccctacaagaagaaattaagaacatatttggggattgtcgctcatgataaggttgacgtgacatacgagacttcaaaggaagtccctgctactcagaaggacttgatatgggaggatattcagtttaaatctgatttgacgaggaaatgggcacttgcagccgacaaggacaatgtggacgatgctgtttgtgaaaagtacgacattagcaaggagaaatag

SEQ ID NO: 47428 - DNA, 1457 bp, Glycine max
  Peptide Sequence Number=SeqID_164206
atggaagttccaattgagttagaaaataaactcttaggatatagcattctcacccctttctatgagagtaaaaatgaagggattagacaggaggttattgttgatttggtggagcagtgtcgaacttacaagcagagagtggtacaccttgtcaactcaactttggatgaatcactgctatgccaaggactagccctgaatgatgatcttcagcgtgtactggctaagcacgaatctatttcttctggaacttctaccaaaaatgaaaatcacacacagaattcgaaacctgcacctgctggggctcttgtagatattgatgctcctttggttgatactggagatactagcaaacaaactgatgggagatcctcttctaatgtcgaagcagggtcccaaacactgaatcagttactgcttcctgcacctccaacttctaatggatcaacaattcctgccaaggttgatcccaaatgggatctgctcagtggcgatgactataactcaccaaaagcagattcatcaaatgttcttgttcctctaggagaacaaccacctgccagtcctgtttctcagcagaatgaccttgttctttttgatatgttttctaatggaaataatgcacctacatctgtcaactcccagccaccccagccaactaatgttgctggccaaaccagtccatatggtcctcaatttcaacaacagcaaacagtcgtcacatctcaaggtggattttaccccaatggaaatgccccaaatgcaggttcacctcagtatgagcaatcactgtatacacaaagtacaggtcctgcctggaatggtcaggttgcacaacagcaacagcaacagcaacaaccaccttctcctgtttatggttcacaaggcagtggatcattgccacctcctccctgggaagctcaaccagccgataatggaggtccattagcgggaactcagtatccacacatgcagaatgctggacatccgatggggcctcaaacaatgggcaatgaccagggtgttggtatgtatatgcagtcaaatgctaatagccatacgtcaggaatgaataaccatgttgggagcaatcaaatgggcttgcaacctcagcatgtgcaaggtgttgcaggaccctacatgggtctggctccacatcaaatgcagggtggtcctgtgatgtattctcaacaaatgtacggaaaccaatttataggatacggctatgatcagcaacaaggagttcattatcagcaactaggagttccatatattgaacggcaaatgtatggtatgtctgttagagacgatagtagtttgagaaacccttaccaagcttctaccacatcttatgttccctctgggaagccttccaagccagaggataagttatttggagaccttgttgacatggcaaaagtgaagcccaaacccactcctggccgagctggtagcat

SEQ ID NO: 47429 - DNA, 276 bp, Glycine max
  Peptide Sequence Number=SeqID_164207
atggacagctgcatatggtccaacatggcatataatcaaagaacaaaacagcacttggaattagcaaattctgtagtgtggcatgtaaaaagccaaaagtctaatgtaaagtctccttttaccccttttcataggtccaaaaaccatgcgatatgctctcctctccaggttaaagtgtcctctgctccttttcaaagtgcagagatactatcacctcaaaacagaatctttatcactcaaaccagacaagatgaatggttgtatttgggaacttga

SEQ ID NO: 47430 - DNA, 1097 bp, Glycine max
  Peptide Sequence Number=SeqID_164208
atggcaaagtggagtctcacggagatgatcaaagaggctgacacggatggggatggtgttcttccgcgagaaggattgaaagcctgcggaagaaggtgttctttcgcgggctcctacggaagaacaccttcttccgcaggctacattttcatccactttcacacacgcggaagaaggttcttctcgcggaagaaccttcgtcttcaacctcaagcaccaaacaacaacaacgtcgtctatcctaaggccatttacgcgattcaaatagagaaccaaagccaatgggaagacgaagggagggaaccaaaatggagaacgaaagcttgtgtcggcgagaacaagggcccgtggaggagaacaagggaaccaaaatggagaaagcttgcgcggaggaggaagaacaccaatgaagaacacgaagggagggagaagacgaatgctgggtgcacagacgaagaagaagcgcagaagaagaaaaaatccatcaaactcgcttcaatcttcgtttctttgaatagagaaacaagagcgtgcggtgtcagaatcgttctccgatcgcaccgttggtcggtttatggtcatcggagaatcgccgatctcgccaagtttcgaatcgcagcggtgacaggaaatggtgaattccatggtggaacgcgctacgagcgacatgctcatagggcccgattgggccatgaacatcgagatctgcgacatgctcaatcacgaccctggacaatcataaagaactgcggagatattgttcacatgcatgttgcagaaagagatgtgcttcatgagatggtgaaaatagtaaagaaaaagcctgattttcatgtcaaagagaagatactgattcttatagatacttggcaagaagcttttggaggcccgagggcaagatatccacaatattatgctgcttaccaggaactgttgcgtgctggggcagtattccctcagaggtctgaacaatctgcacctgttttcacacctccacaaacacagccattggcatcataccctcaaaatatacacgactcagatgctcaccaggacacagctcagtcctctgcagagtccgagtttccaacgcttaa

SEQ ID NO: 47431 - DNA, 243 bp, Glycine max
  Peptide Sequence Number=SeqID_164209
atgaaatctccttgtaggttgggaattgatgaagagcttgtggctttgcttggcaaacattcaccgattcctgttacttatgctggtggtgtgactgaaatgtctgatctggagaggataaaaactgccggaatggaccgtgtgaatgttactgtgggcagtgcattggatatttttggggggaacttggcttatgaagaggttgtagcttggcatgcccagcaaaatgcctctgcagtttaa

SEQ ID NO: 47432 - DNA, 360 bp, Glycine max
  Peptide Sequence Number=SeqID_164210
atgagtgccaaatattcaatcaccgatttcattcactcaaatttcattggtctaacgcaaatttcattgattgaaagtcgcacaagctgtcagactttcattgattgtaggacatgcatccatgtagtagggagtcacctttatggaaagggagtcacctttgacacaagcacatggaagttggcttatagggatatcaatcatattggtcataacttagttaaaggaagtacatggaagttggcttatatggaagcacatggaagttggcttatagggatatcaatcatattggtgatccgtaaacattttctggatcaagttgatccagaagatgcttatgggtcaagtgatccgtaa

SEQ ID NO: 47433 - DNA, 252 bp, Glycine max
  Peptide Sequence Number=SeqID_164211
atgattcgaagccttgctctgcacttggctgcacgattccgacacaaccacaacctcgtgcgtctttcttcttcttcttctgccgcttctgcctccactcttcatcatgccactccctctccttcttcctctgagcccgttcacatcacccaaaactgcgttcgaatccaactatgtttgtttctatgcgccgctgaaactgaatccggaaacaaaattcaagcttgtctattcttctctgcaattccgtga

SEQ ID NO: 47434 - DNA, 858 bp, Glycine max
  Peptide Sequence Number=SeqID_164212
atgcgtagtctcgctgcacctcattccttccgggttttcgtcaactcgcccatctttcgccccattaagcttccttttctcactctcaaccctctctcttcaccttccagaagatctccagcttccgttcaatgcgccgttcaattccgcccctgcatcgacatccacaaggggaaagtgaagcaaattgtggggtcgacccttcaagacttgaaagggggtgacggttcggatcccgtcaccaatttcgagtctgataagtcggctgctgagtatgccgcgctttacaaacaagatggactcactggtggtcatgtcatcatgctcggagccgaccctttgagcaaagcttctgcccttgaagcattacacgcttatcctggcggtttgcaagtcggagggggaataaattctgacaattgtttgagttacattgaggaaggagcaagccatgtcattgtgacatcttatgtattcaataatggacaaatggatcttggacggctaaaagatcttgttcaaattgtaggaaaagacaggcttgtgttggatctcagttgcagaaaaaaggatggtaaatatgcaattgtcactgatagatggcagaagttcagtgatgtttttgttgatcctgatgtaatggaatttcttgccaattttgctgatgagtttctggttcatggtgttgacgttgaagggaagaaggggagagaatttagagagaaagtgaacttagagaataaaatgctttattatttaagggaatgcaatggtgataacttgctagaaaagttttacggtgtggtggattatggcaacggtgacccacagggtgacagaatgcactggaagaaataa

SEQ ID NO: 47435 - DNA, 2520 bp, Glycine max
  Peptide Sequence Number=SeqID_164213
atggttataggcaaacttactggacctgtacaaggttcagtcttccagtcattgagcatatctacaatttcagagcttttgagtaaccaacactggtcagagctcaaaccccattttagaacaaccaaacctgcaatattccttgaccaattgttcaatgcgggggttgattcagagcttgttttaaggttctttcagtggtctcagaaagagttcaggatttcatatggtcttgaaacaactggcaaagttttacatcttctagcaaattcaaaaaagtactctaaagtcaggtcctttttggataaacttgtgaagaatgagaaacatactgtttcttctgtttttcactctcttttgttgggtggtgatcgaccttgtgcaaatgctctaataactgatatgttggtcctagcatatgtgacaaatttagaaatccactctgcctgtgaagtatttaggcgagttcaagattatggatttaagttatcactgaattcatgcaatccgttgttgagtgctttggtgaaggggaatgaaacaggggaaatgcaatatgtgtacaaggagatgataaagaggagaattcagcctaacttgaccacatttaatattttcatcaatggtctctgtaaagctggtaagttgaataaggcagaggatgttattgaagacatcaaagcctggggattttccccaaacatagttacttataacactttgattgatgggcattgcaagaagggcagtgccggaaaaatgtacagagctgatgccattttgaaggaaatgcttgctaataaaatttgtccgaatgagattacctttaacactcttattgatggtttttgtaaggatgagaatgtgttggctgcaaagaatgcttttgaagagatgcaaaggcagggactgaaacctaatatagttacttacaactcactgataaatggtttatctaataatgggaaactagatgaggctattgctttgtgggataagatggttggcttgggtttgaagccaaatattgttacttttaatgctctaattaatgggttttgtaagaagaagatgattaaggaagcaagaaaactcttcgatgatatagctgaacaagatttggttcccaatgcaataacattcaatacaatgattgatgcattctgcaaagccgggatgatggaagaaggatttgcactgcataattcaatgctagatgaaggcatttttccaaatgtttcaacctataattgcttaattgcagggttgtgcagaaatcagaatgtaagagctgcaaagaagcttcttaatgaaatggagaactatgaattgaaagccgatgttgtaacatataacatcttaataggtgggtggtgcaaagatggtgaaccaagtaaggcagaaaaattacttggtgaaatgctcaacgttggtgtcaaacctaatcatgtaacatataatacattgatggatggatattgtatggagggaaatctcaaggcagcattgaaggtgaggacccagatggagaaagaagggaagcgtgcaaatgttgtcacatataatgtgttgattaaaggattttgtaaaacaggcaagctagaggatgcaaacaggcttctcaatgagatgttggaaaagggtttgaaccctaatcgtactacctacgatgtagtaagactggaaatgttggagaaagactcgattttgacgagcgctcacattgacttgattctcaatggtttacctgatgattatcgcacaatttgtagtattctaaacaatttgtgtgatcctctaaatctggatgatgtgacttctatgctactggctgaggaatctagcattgaaaagtctcacaagaagaatttgggctcgttgaatttggctgagggttcgaattccaattctgcttctgaagctcaggttcatctaactcagggtaacacacactcctcctcaaactatgattcaaagtatggtaataagagaggggtgatggtggttgttcataccgtcgaggtggagcccgtgggagagggcgtggcagattcactgatgttcagtgtccgatttgtcgcaaatttgggcacaaagcctctcattgctggtacaaaaatgatgcaagctactcctcctagccctctcaaccaaattcccaacctaattcccaaaccaattaccccaaacagaaatcccaattcaccctatctttattcaccttatcccttttacccatacttccctttcatgccaccatttggcttcccacctccaccccaaaatcactctcctaaacccaattcttacccatctcctcaagccaatgcttccggcacctcatcaaacagccggtatccaaattctggagcatctcaccatgtcaccaatgtctcccaaaacattcagcaagtcactccttttgagggtccagaccaaattaccattggtaatggtcaagggcttcctattgattcctcaagcttcgaaagaggtgtttctacatggcaaagttggtga

SEQ ID NO: 47436 - DNA, 1649 bp, Glycine max
  Peptide Sequence Number=SeqID_164214
cgatgtcagatctcgaggctcccttgcgccctaagaggaagaaggtttgggtggactattttgttcagtttcgatggatccttgttatttttgtggtccttcccatctccttcaccatttatttccttacataccttggggatgtaagatccgagtggaagtcctataagacgcgtcagaaggaacatgatgagaatgtgaagaaggttatcaaacgtctcaaacagaggaatccatcaaaagatggtcttgtctgtactgctcgtaagccctggattgctgttgggatgcgaaatgttgactataagagagcccgtcatttcgaagttgatttgtctgctttccggaatgtacttgagatcgacaaagaacggatgattgcaagagttgagcccctagtcaacatgggtcagatcagcagggtgactgtacccatgaatcttgcccttgctgtagttgcagagcttgatgatctaactgttggtggtctcattaacggctatggtatagaaggaagctcccacaaatatggcttgttcgctgatactgttgtggcctatgaaattattttggctgatggcactcttgttagagccaccaaggacaacgagtacactgatctatactatgccattccgtggtctcagggaacccttggccttcttgttgctgctgagatcaagcttatacctgttaaggagtacatgaagctagcctacaaacctgttgttggcaccctgcaagatcttgcacaggcatattgtgattcttttgctcccagagatggagaccaggataacgaggagaaggaagatattgcttcaaaggaagaggccaagaagaaggggaataagatcaatagtgtaggatggtggtttaaaccatggttctatcagcatgcacagacggcactgaagaaaggagagtttgtagaatacattcctaccagagaatattatcacaggcacacaagatgcttgtactgggagggaaagcttatcctcccatttgctgatcaattttggtttaggtatctgtttggctggttgatgccacccaaggtttctctcctcaaggcaactcaaggtgatgctataagaaactattaccatgaaatgcatgtcatccaggacatgcttgttcctttgtacaaggtgggagaggctttagaatgggttcaccgtgagatggaggtataccccatttggctctgcccacacaaattgttcaagctgcctgtcaaaactatgatttacccagagccagggttcgaactacatcgcaggcaaggagacacccaaactgctcaaatgtacacagatgttggagtttactatgcaccaggtcctgtttttaggggtgaggtatttgatggggcagaagcagtgcgtaaaatggagaactggttgattgaaaatcatggttttcagccacagtatgctgtgtctgagctgtctgagaaaaacttctggaggatgtttgatgctggtttgtatgagcatactaggaggaagtatggagctgttgggacctttatgagtgtatactacaaatcaaagaagggcaggaaaactgagaaggaggtacaagaagcagagcaagcgcaccttgaaactgcatacgcagaagctgatcaaccagtagactga

SEQ ID NO: 47437 - DNA, 2085 bp, Glycine max
  Peptide Sequence Number=SeqID_164215
atggagcatgctactaatatttcccaattccatatccctcagaattggaatgcgatatggaggctaaaagtttcaagcaagatttgtgtatttgtgatggagagcgatgagggggtgccttcacacaagacgaagactttcaaagaaggtcttaacatttcccacgagggtagtgacaagaagcaagatgaaggatgttttgatggagtgaaaggcggtgagaaagaaatttatatgcgaaagcgcttattcgccaattccggctcccgcaaattccgcagaaaatgcaccgtccgcttctgcgccgttccctcctccgacaacaaccacccaaactggaacgccgatttcgccaattccgcgcgcagaaccgccacaaccttcgttctcaaacgaatttccaacaacaacaacaacaacaacaacaacaacaacaacgataacgatgttatcgttaccgaattacaagcaccaccgccatcggttcaattaggttcaaacttcaccggtttcagcgaggatcctatcgtggataagctgaggacgcagctaggggtgatacacccgattccctcccctccgattaaccgcaacgtcatcggcctgttcgtcttcttcttcttcgtcggcgtcgtgttcgacaagctgtggacttggcggcggcggcggagcaagaacaacagcggcggcggcgaggacgggcttggcgtgtggccgcaggtgccaacgagcttctcgctgcttctggagaaggatttgcagaggaaggagtcggtggagtgggtgaacatggtgttggggaagctgtggaaggtgtatagaggaggaattgagaactggatcatagggctgcttcagcctgtcattgataatctcaagaagcctgattacgtgcagagggttgaaattaagcagttctcgttaggggatgaacccttgtctgttagaaacgttgagcgcaggacttctcgcagagtcaacgatttgcagtaccagataggccttaggtatacaggtggtgctcgcatgctgttaatgctttctctgaaatttggcatcattccaattgttgtacccgttggtgttcgagattttgacattgatggtgaactttgggtaaaattaaggttaataccaacagagccttgggtgggagctgtttcatgggcttttgtttcactcccaaagatcaagtttgaattgtctctattccgtctgttcaatttaatggttgctgttggtgttaaatctggagaaacgcaagaaggaaacaaggattctgtgggtgaactatctgttactctggtggatgctcgaaagctttcttatattttttacggcaagacagatccttatgttattcttagccttggaaatcaagttatacgcagcaaaaagaacagtcaaactactgtaattggaccccctggaatgccaatttggaatcaggattttcatatgcttgtttccaaccctagaaagcagaagttattcatccaagtaaaggacgttctaggatttgcagatttgactattggtacaggagaggttgatttaggatctctcaaagacactgttccaacagacagaattgtggttttacaaggaggttggggatttttaggaaagcgctcttctggggagatattacttcggctaacatataaagcatatgtggaggatgaggaagatgataaaactgaggtgtatgccatttatactgacgtttctgatgatgagttgtctgattcagaagtaaatggtactaatgagaaggatgaaagagattctgcgtatgaaacagataaggagtcatttatggatgttttggcagcattaattgttagcgaagaatttcaggggatagtagcatctgaaacagggtttagcaaagttttggatagtggctcaaatgctggacctagagtgtcaaaatctcaagttcccaatgttgaaccaattccttctagttctgataattccgaaggttttggagggtcagctttactttggcttgctgtgattactagcatatcactactaattgctctcaacgttgggggatccagtctcttcaatccctaa

SEQ ID NO: 47438 - DNA, 648 bp, Glycine max
  Peptide Sequence Number=SeqID_164216
atgggtggtattaaagaactccgtacaataattggtcgtcttcaactctgccttctggttatgttatgggtgctcttcattgaggacgtgacgtggggcggaggctgcttggattgtaatctgtgggataagatggttggcttgggtttgaagccaaatattgttacttttaatgctctaattaatgggttttgtaagaagaagatgattaaggaagcaagaaaactcttcgatgatatagctgaacaagatttggttcccaatgcaataacattcaatacaatgattgatgcattctgcaaagccgggatgatggaagaaggatttgcactgtgtaattcaatgctagatgaaggcatttttccaaatgtttcaacctataattgcttaattgcagggttgtgcagaaaccagaataatgtaagagctgcaaagaagcttcttaatgaaatggagaactatgaattgaaagccaatgttgtaacatataacatcttaataggtgggtggtgcaaagatggtgaatcaagtaaggcagaaaaattacttggtgaaatgctcgacgttggtgtcaaacctaatcatgtaacatataatacattgatggatggatattgtatggagggaaatctcaaggcagcattgaag

SEQ ID NO: 47439 - DNA, 504 bp, Glycine max
  Peptide Sequence Number=SeqID_164217
atggaacaaaaaaggggacaacagaacacattcatccctgtgtttccgttcccgccattgcaaagggggaagaaaaccaattcctccacgctctccctcgaacaaaagtcgcgcgtggaatacaacaagctcctcgccaagtccaagcgcaatctcaaactctgcatcgagagggtctccaaaagcaaagaatcagactctgctggtgtgaagctggaagagctgctggtggaggaaacgtggttggatgctctccctgatgaactccaaaaaccctatgccctcactctctccaaattcgtgggaagcgagatttcttgcggcggcgacgacgtcgttttccctcccacgcacttgattttcaacgctctcaactctacgccttttcatacggtgaaagccgttatccttggccagtgtcacaagttaaggacactggataaggaagtgagagctaaagtttttattgggatgcagcaaaatgtgctcttatatgatttttaa

SEQ ID NO: 47440 - DNA, 228 bp, Glycine max
  Peptide Sequence Number=SeqID_164218
atggattcagtgcctcgaagaagcagaggaggaggcgttttcgaaagcctctacaaggtcctcatgcgccgcaactccgtctacgtcaccttcatcatcgccggcgccttcctcggagagcggctgaggttccagtttttgcggtttcaggctgtggattacggagttcacaagatctgggagcacaataacgttggggtacttaatctactcctttgctcgaactga

SEQ ID NO: 47441 - DNA, 281 bp, Glycine max
  Peptide Sequence Number=SeqID_164219
catctcaagctcccaacaccaaaccacacccttttattcttcccattaagaaagaccccgcaacaaatttgtactatagttcagttggcatagatactcctaggcacaactttgatttagacattgatctttcaggacaaaacttatggtacgaccgtgacactgattacaactcgtcatcctaccgccctaccccgtgtggctcaaagcaatgccctcgtgatggtcaatgccttgattgctatggccctttccaaccaagttgcacaaataacacctga

SEQ ID NO: 47442 - DNA, 837 bp, Glycine max
  Peptide Sequence Number=SeqID_164220
atggccctttcaaaccgggttgcacaaacaacacatgtggatttcatattcatttctcaaattcaagtgtctggcattcgttctggctgcacaaatgcacataaattcactagcaatcttgtaggagggttacccaaaggcagcaaaggaatgttaggccttgcaaggtcagaacttgcagtgccaactcagcttgcattgctgaagaaactccctcttaagttttctctatgtttaccttcttctaacaacatcggattcactaacttactcattggacctgagggacatgaacaatctcaggatgtttccaaatatattcaaaccactcctcttgttgtcaaccacttcgacacaggtcctttgtttgaggaagataggaagggcaatgggggcacaaaaattagcaccatcactcgttttgctgaattacaaacttttgtctataagccttttgttagaggtttccttaagaaggctgcggaccgaagactaaagagagtggcatcagtggcaccatttgaggcatgtttcgattcgagaagcattggaaattccttcactgggtttgttgtgccaactattgatttggtgctacaagggggagtgcaatggactattcatggagccaattccatggtaatggtaaagaaaaatgtagcatgccttgcatttgttgatggagggacaatggcaacaatgtcgttttttaaagcctcaattgttcttggtgcgcatcagttggaggaaaatcttttggcgtttgatgtggcttcctccaaattaagcttcagctcttcgcttttgctccacaatgtgacatgttcccacctttga

SEQ ID NO: 47443 - DNA, 273 bp, Glycine max
  Peptide Sequence Number=SeqID_164221
atggattgtgatgaaactgaagaccctggagtgagaaagaaatattttctaagcaatgtcaatgatggtggtccaattggcttgattcaaaatggagacgtaatcaatgttgacatcaagaataggagaattgatgttttggtatcagatgaggagatggaagcacgcaggaaaaagtggactgctcctccatacaaagctaaccgaggagctctgtacaagtatattaaaaatgtgacacctgcttctagtggatgcgtaacagacgagtag

SEQ ID NO: 47444 - DNA, 261 bp, Glycine max
  Peptide Sequence Number=SeqID_164222
atggcacaagttgcgcctaaatcatgtagagttggttacactagttttcaaattggggaaactgctccatcactactggtcgaagaggctgaactgctgagaaattatagagaggggagtgcaaaaacattaatttttgaaactgggacagaaattgtccaaagtgggttgagcttcaatcacaacccatccttgggttccaatacaaaacttcacaaaaacaaggtggggttgctattggcacccatcgttgctatttaa

SEQ ID NO: 47445 - DNA, 2604 bp, Glycine max
  Peptide Sequence Number=SeqID_164223
atgatggaatccggggctcacttctgcaactcttgtggtgaacaaattggacttgatgccaatggggagctgtttgtggcttgtcatgagtgttattttccaatttgcaaggcttgttttgaatatgaaatcaacgaggggcgtaaagtctgcttgagatgtgccactccctattctgatagagtaaaggataatgatggcaccaaggtttatgaaaatcaatccacaacagctgcccagatcaatgtttctcaggatgttggcctccatgctaggcatgtcagtactgtgtccacagtggatagtgaattaaacgatgaatctgggaatccaatctggaaaaatagagtggaaagctggaaggaaaaggataaaaagaagaagaagaagaaaaagtctgtacctaaggctgaaaatgaggcaccaattccaccagaacagcagatggaagaaatacagtcctcagaggcttctgctgctgaaccactttcaatggttattccaatctcaaaaacgagactcgcaccatacagaactgtgataatcgtgcggctaataatcttgggtcttttcttccattatcgagttacaaatcctgttgacagtgcttttggtctgtggttgacatccatcatatgtgagatctggtttgccttttcctgggtgttagatcagttccctaaatggtctcctgtcaatagggaagcttttgttgacaggctttctgcaaggtatgaaagacctggtgaaccctctcagcttgctgctgtggatttctttgtcagtacagtcgatcctctgaaagaaccaccattgatcacggctaatacagtgctttctattcttgctgtggactaccctgtggataaagtatcctgttatgtgtcagatgatggtgccgcaatgctgacatttgagtcccttgtggagacagctgactttgcaagaatgtgggttccattttgcaaaaagttttctattgaaccacgcgcacctgagttctacttctctcagaagattgactacctgaaggacaaagtacaaccttcttttgtgaaggaacgtagagcaatgaagagggagtatgaagagtttaaagtgcgagttaatgctttggtagcaaaggctcagaaaacaccagatgaaggatggactatgcaagatggaacctcatggccaggaaataactcccgtgatcaccctggcatgattcaggttttccttggacacagtggtgcacatgacgtagagggaaatgaacttcccagcaaggctgtacgagaagcaatgtgttttctgatggatccagtagttggcagagatttgtgttatgtgcagtttccccagagatttgatggtattgatcgtagtgatcgatatgccaatcgcaacacagttttctttgatgttaacatgaaaggactggatggcattcaaggacctatgtatgtgggaaccggatgtgttttcaatagacaagcactttatggctacagtccaccttctatgcccaaattaccaaaatcatcatcctgctgttgctgcccctcaaagaagcaaaccaaagatgtctccgagctttatagagatgccaagagggaagaacttgatgctgccatttttaatcttagggagattgacaactatgatgaatatgagaggtcaatgctgatttcacaaatgagctttgagaaaacatttggtttgtccactgttttcattgaatctacactgatggagaatggaggacttcctgaatcttctgatccctcgatgctgatcaaagaggccattcatgttattagctgtggttatgaagagaagactgcatggggaaaagagattggttggatctatggttcagttactgaggatatcttaacggggttcaagatgcaatgccgtggatggaggtcagtttactgcatgcccctaaggcctgcattcaaaggatcagcaccaatcaatctttctgatcgattgcaccaagttcttcgttgggcccttggatcagttgaaattttctttagcagacattgccccctctggaaaattcatcataccaacgtaactagtgtgctcgagctgcggtggagtggtgtgaccattgaagctttgtggcgtaatgagcagttctgggtgattggaggagtttcagcccatctatttgctgtgttccaaggattcctgaagatgttggctggtgttgacactaacttcactgtcactgctaaagctgctgatgacactgagtttggtgaactatatataatcaagtggaccacactcttaattcctccaacaacccttatcattattaatatagttggtgttgttgctggattttctgatgcactcaatggaggatatgaatcatggggaccactttttggaaaggtcttctttgccttctgggtcattttccatctctacccattcctcaagggtctcatgggtcgccaaaaccgcactccaaccattgttattctgtggtcagtgctgttggcttctgttttctctctggtttgggtcaagattaacccttttatcagcagacctgacagtgcaagcatttcccagacctgcatttctatagattgctaa

SEQ ID NO: 47446 - DNA, 435 bp, Glycine max
  Peptide Sequence Number=SeqID_164224
atgacgttgttgggccttggatatgcattatatgcgggtttatattttgacccaattggttgctcatgcatggaatcttcctctaaagaagattgctcaatgtcaaaaggaggagatgaaactgttgtggatgttgatgactttgtaaagggaactaaagatcccaagcaagtaatcaatagtctgaatattttagcacaaaaagatgtggcccaaggattccaaaccttgattcaactcctatcagatagtccattttgtcttgacaggtcattagagcttcccaagaatttgaaaacagagatttttgcatctagcagtgatgaaggccggtaccaaggcaatggaattgctcagaagtcctgcatgggaaaactctggattttgatgaacaaatacaccagaggctttactgtttttgaatttatggcttga

SEQ ID NO: 47447 - DNA, 153 bp, Glycine max
  Peptide Sequence Number=SeqID_164225
atgtctcaggtgttactagtaatgcatttatggatgagtggaatgaaagaagatgtccatttaccatcatttgacacctatttttgcatttacaagatatccccttcttccattgactacgctcaacccttggtcacggcattgaaaaattaa

SEQ ID NO: 47448 - DNA, 180 bp, Glycine max
  Peptide Sequence Number=SeqID_164226
cggttttggtttaatgcgaatgtgaatggtcgtggggaagataagagggcttgcaaaaataaagacggcgattttggcggcaaagcacctggttctctcccagttcaggagcttcaggctagatacagtttattggatacgtcaaagtctcttggtgtattggagttttacctcctatga

SEQ ID NO: 47449 - DNA, 186 bp, Glycine max
  Peptide Sequence Number=SeqID_164227
atgggtgtagaagacgacattagtctctgcatggtaccagactctgagtgtgacggattgcgaaagagtgtttatacggatgaccacttgggtatctccgcctgccacctaacttcacaagatgacaaaggtgctgaagacgatgtgagtctccgcatgtcaacgggtttgcttgcccctgattga

SEQ ID NO: 47450 - DNA, 435 bp, Glycine max
  Peptide Sequence Number=SeqID_164228
atggtaaacgaagacgagtgggtgcgagcggcgatggcggacgacaccgtcgtggtggagcttctgctacgcctcaagcaaggtaccgtttcacacaaatctcaccaccagcttatacctttctcctggggtgtcaaacagccgcgctcaagatcaaggcttagcgccgccgtctctcgctgcgacgccgccgtttcaaccagatgcagccccaccacgcccctctcttggagcgctggcaccgacagttacgaagactccagccgccaccaccaccaccacgccgccatatctaagagtttggttttttcaccgaaatacccttgcgaagtacgaacctcgcgcaactctgtcatctgtcggagaactgtggtatttcggggcggttcaaatggcttggcgtgcgtcacgaaacattctttgccttccgaatga

SEQ ID NO: 47451 - DNA, 195 bp, Glycine max
  Peptide Sequence Number=SeqID_164229
atggaaagtggtattgagaaaaaaataaaaggaatatgtatggaaagtggtagcaaaatagcaagaacagaggacggtggaaaggagaagacagttgttgctgccggatgtgttgttgaagggtttcttgtgaaactgatgctcacaagtccagctcttttcaccatcactttcattctccatctcataaagtaa

SEQ ID NO: 47452 - DNA, 696 bp, Glycine max
  Peptide Sequence Number=SeqID_164230
aggtttcttctcactggtgtaagagtaggccttgaagctatagaccctggtgcttccttaacttctttgaagtcagattctggggagaaagtttcagatacaaagtcttcttctgtctctagaaaggtttccacagtgccccagccatcaaattacaatgaagtgctacccattgaagttggaggagttggggagtttccaccagccaaggtgtcttttggtggtggttctacagatggaaatatctcacagtggactattgatgaatttattggcttaaacgagttcagtcagcattatgattacatggaaggatcatcaaggagttcagattcatcttttgtcagagattgcaggctgtatggtagtgccccctcactcatgcacacacacacacacacccacataccagagaaaggacaggccgatggtggtaagcttggggattctgattctcctgttttaaagtctggtgaagaggatatggaggaggaggatgactatttggaacgtgttccagattcgtcgtggacagttcctcagatcccttccccacctactgcttctgggttatgctggccaaaagaccctcaatattcatctgatagtgttctgtttgttcctgacataagcttctctctcattcaacaatctcagattagtagtatttgtttgagacgctggaggcagctttaa

SEQ ID NO: 47453 - DNA, 141 bp, Glycine max
  Peptide Sequence Number=SeqID_164231
atggcagattctcttatcctcgtggtgactggtgaaacacaagatcctggcaccatgtatgtattattctataccctccatgtcaaaacaatggacagtgcaatagggaaaaaagcatcaacaatgttatttgagacctag

SEQ ID NO: 47454 - DNA, 918 bp, Glycine max
  Peptide Sequence Number=SeqID_164232
atcttacagttcttggagaataggagaaaggtgcaccatgatgcaataaacttttgtcaagccattctgcaaaaaaagtcaattgaatggaaagctgtgcaccgtaacaatttgtcacagcccatcaatgatgttgacctagttgttacagttggtggtgatggaactcttctgcaggccagccatttaatggatgacaaaattcctgttcttggagtgaattctgaccctacacagattgatgaggtggaagagttcggcagtgagtttgatgctcacagaagcacgggccatctttgtgctgctactgttgaaaactttgaacaagtttcaattttgttacaaaacttacaatttgataccaaggtagtccataagttgatgagctgcaagcctgcagcacaagttttagacagtatacttgaaggtcaaattgttccttctgagctaacgaggatcatgatgtctgtgaatggactagacttgtcaacatatgctctcaatgatatcttaattgcgcatccatgtcctgcttcagtttctaggttctccttcagaatcaaagagggtgaccagccatgttctcctcttgtgaactgcagatcaagtggtctaagagtttcaacagccactggttcaactgctgcaatgcaatcagcaggtggatttccaatgcccattttatctcaggatctccaatacatgttaagagaacctatttcactgggggcaacctcaaactatatgcatgggttgatcaaacgtaaccagacaatagtggccacatggacttgtagaaaaggtgtgatatatattgatggttctcatgtcaattatactttcaaagatggggatatcattgccatatcttccaaagcaccggttctgaaagttctcttgcctcataagtttttatag

SEQ ID NO: 47455 - DNA, 447 bp, Glycine max
  Peptide Sequence Number=SeqID_164233
atggtagtggtgagattggtgatagtggtaatgatgatgatgtcaatggtagtgatggcaacaataacaggggtggtaatgatggtggctgtggcaacattgattgcggcaatggtggtgatgatggttgtgacaatgacagcactgattgcagtcacaatggtggtggtggggccagtgatgatcaatgttatggttgtgaaagcggttgtcgaggttgttattgctgtagtaatggtgatagtaacagtgatcgcagcctacataaatggtggcgatagcaatggtagtgaatctagtgatagtggtggtggtagtgatcaaagtggcaacaatagcaatggtagtgaatctagtgatagtggtggtggtagtgatcaaagtggcaacaatagttgtgacagcagtagtgttagtgatggtgtaacaaagagttgtgtaatatga

SEQ ID NO: 47456 - DNA, 282 bp, Glycine max
  Peptide Sequence Number=SeqID_164234
atgtctgagtgcgagtgtgatttcaaacgtcgcaagtctcagtggggggaccatccaattggagatgaagcacgtgatgagtggagtggggaccatccaattcgagaggaagcacgtgctgaggtggagtggggaccatcctcaattttggcttcagaaacagccgccgcctcgagtggtcccaccctattagtggaccctactttttttattttttcatatacggccccacctttcgggaaaattgttcgctgttcacgcctatttgtcctcctactataa

SEQ ID NO: 47457 - DNA, 4332 bp, Glycine max
  Peptide Sequence Number=SeqID_164235
atgggtgatcgtcttgatttgttggaggaacagatgggtgaagtgaaatccaccttgcaagcattggcgttacagatgcaagaacagagtacgtcgatagctcaacaaatgcaacaacagagcttggtactgagtgaactcagcaagcagattggtcagaaggtgaacgagaactctaatgaaagcgagaaatcgatggatgattactatgagtctcgattctcggggaagaaggtgaaacttccggtttttgagggagatgatccagttgcgtggattacgcgagctgagatctactttgatgttcagaacacttcggaggagatgcgagtgaagttagctcgcctgagcatggagggggcaaccattcactggttcaatttgttgatggagacggaggatcagttgacgtgggaaaaactgaagaagtcgttgattgctcgttacggtggccgacgtttggagaatccgtttgaagagttatcaacattgaaacaaaccggaagcgtggaggagttcgtggaagcttttgagcttctctcatctcaggtgggacgattgcctgaggagcagtatttgggatactttatgagtggattgaagcaaccaatccgacgcagggtgagaactcttaatccacagaatcggatgcagatgatgaggatggcgaaagatgtggaggaagagctgaaggaagaagatgatgatggggatcgggcctatggcaagaaattactggggcgcagtgaacccagtgggcttggatctaagttccgaagcgggtttaacccgggccagaaggaaatgtccagatctacgaattcgggttgggccaacccgagtagaaaaacgggttctgttggttctaattccaaatcgacctcgtccttgagttcgacaggcaagaagggtgaatacgaccgccgatctggaggatccgagaagtggaaaggagttaggaacgaagaaatggaggaaagaagggctaaaggtctatgtttcaagtgtggaggtaagtaccatccaactttgcacaagtgccctgaacgagccttgcgtttgttaattctgggtgaaggtgagacaatgaacgatgatggagaaatcgtggctatggaagctgaggggtcagaggaagaagaagaccaggaggcagagtgcaatttgataggaatattggggaagatgggggagtatcaaacaatgaagattgaagggaagcttgctaatgtaactgtagaggtgctgattgacagtggagctagccacaatttcatttctccgaagctgactatggccttaggactaacagtcacgcccacgactgtgagaagtatcaaactgggagacggtcatagagtgatgtctgaaggtgtttgtaggggagtcagaatcgcacttggaacccagaattttgtgattgatgcgttggtcttagagttaggaggattggatgtggttttgggggtgtcatggttgagcacgttggggaaagtggtgatggattggaaggatttatctatgcaattctggcataaggatgaaatggtaaccttgcagggccaaagtgggagacagctgcaacagggttttctgaactcctttttggaagacagaaaaagagagtttagtaatgagtggtggtggtcccctaatgtgaagattgaaggggggaaagaacaaattaacaaaggaattgcagaggtcctgggctcatttccacaaatcttccaggaacaaataacattaccacctgaaagagagcaggtacaccagattaatctactacccaaccatggtccagtcaatgtcagaccgtataaatatccacaccaccagaaggaagagattgagaagcaggtggcagaattgttgcaagctggagttattagaccaagcatgagtgctttctcaagtccagtcatcttggtcaaaaagaaggaccactcttggaggatgtgtgtagattatagagcattgaataaggcaactgttcctgacaagtaccctattcccattgtggatgaactgttggatgagctatatggagcaactgttttctcaaagatagacctcaagtcaggttaccatcaaatacgggtgcatgaggatgatgtgcataaaactgcttttaggactcacaatggccactatgagtacctggtgatgccttttggactaatgaacgcgcctgcaacttttcagtctaccatgaatcatatattccgaccttttctcagaaaattcgtattggtcttctttgatgacattctggtgtatagcagcagtgagcaggagcaccttactcacctcaaacaagtgctaactgtgttgatgaagcattgctttgtagccaacagaagcaaatgtaaatttggttgtttgcaagtggattaccttgggcacatcatctctggagagggagtttctgtggaccctgagaagataaaatgcatcttagagtggcctgaacctaagaatgtcaaaggagtcaggggtttcctaggtctcactgggtactataggaaatttgtcaaagattatgggaaaattgcgagacctttgactgatctcacaaagaaggataattttctgtggagagaaactgctagagaagcttttaatcagctgaaaaagatcatgaccacatccccagtgttggttttaccaaacttttccatcccttttgaagtagaatgtgatgcggctgggaggggaataggagcagtcttaatgcagaataagcaacccattgcttattttagcaaagccttatctgacaaaaatttagcaaaatctgtctatgagaaggaacttatggcattggttctctccattcaacattggaggcactacttgttaggaagggaatttgtggtatatacagatcacaaaagcttaaaacacttcctgcagcagaggatctcttctccggatcaacaatgttggctggccaagttattgggttaccaatttgaagtgaagtataaaccagggccagaaaacaaggcagctgatgcactatcacgttgttatgatgaaggggaactaactgcactaaaatctggtcctacttgggtggatagcaaacagttactgcaagaggtgaagcaagacgcatctgtgcagcaaattattgcagaagtggagctgaatcctagtgctaaacctgggttctcagtgcagcaaggggtattattgtatcaagggcgtttggtgttaggaaagaattctccctcaattcctgctctgttgaaggaatttcatgagactcctatgggggggcactcaggttacttaagaacatataggcgcatagcagaaaatttgtattgggtggggatgcaaaaaacaataagagattatgtgagggcttgtgatgtgtgccagaggcaaaaatatgctgctacgtcccctggtggtctgcttcaacctttacctttaccaaatgctatttgggaggacatttctatggattttataactgggttaccaaagtctaagggttttgaggcagttttagttgtagtagacagactttccaagtatagccacttcattttgatgaaacatccgtacaatgcaaagactgtggctgaattgtttgttaaagaggtggttcgattgcatggggttcccaactcaattgtcagtgatagagatccattatttgtgagtcatttctggagagagttattcaagttgcagggtactacactcaagatgagctcagcttatcatcttgagacagatggacaatctgaagtgatcaataggtgccttgagagctatctgaggtgttttgctgctgatcaacctaagacttggtcatatttgataccatgggctgagtattggtacaatacaacgtatcatatatctctaggcaaatctccatttgaagttgtatatggtaggcaaccacctaatctgatgagatttttgagtaatgagactaaggtggctgctgtagccttggagttgcaggatagagatgaggcactgaatcaactgaaactacagttgttgaaagctcaacagcaaatgaaatactatgctgatttgaagaggaaaaatgtgcagtttgaggtgggagattgggtattcttgaaactaaggcctcatagacaacaatctgttgtcagaaggataaaccagaaacttgcagctcgtttctatgggccatttcaaattattgctaaggtgggggaagtagcctataaggtgcagttgcctgaacagtctagaatccaccccgtttttcatgtgtcactgttaaagaaggctattggagattatcaagtacagggcgagttacccaaggagttagag

SEQ ID NO: 47458 - DNA, 405 bp, Glycine max
  Peptide Sequence Number=SeqID_164236
atggacctcataacacccctcatgcatcccatgcatcctcctcttattcctgccacatcatcacttagtaactcttttcccacgaatggaaaatacgatgaagcactagagaaatttgagtctattttgggatcaaagccagaacccgaggaagcagcagttgcaagttacaatgttgcttgctgttactctaagctaaaccagattcaagctgcactttcttcactggaagaagctctgaatgctggttttgaagacttcaagagaataagaactgatcctgacctggctaacgcaagggcatcagaggaatttgatcctttattgaaaagatttgatgaatctttcatcaatgagaatgccatcaatgccattaaatctctttttggatttggtaagaaataa

SEQ ID NO: 47459 - DNA, 789 bp, Glycine max
  Peptide Sequence Number=SeqID_164237
atgtcattgcctaccaccactagtggtcactcatctctttactctgcatttacattgccaagaaccactcaaattcacccaaccttgttttctcccaccaccaagttattttcttccagaagcccctcatattcaggtgtttcccattgtttctcaaacaccctttcgccaagaccgctgccttttgctgttaaggcttcatctggggttggctcagaagcatccaaacaggagaatgacaatagtgaagaagaagaagaggaaccgtatgaagagtatgaggtggaaattgagcagccttttggactcaaatttgcaaagggtagggatgggggaacttacattgatgctattgcaccaggaggatcagctgataaggctggagtcttcaatgttggggataaagtaattgccaccagcgcagtttttgggaccgaaatttggccagctgctgaatatggaaggacaatgtacacaattcgccaaagaattggcccattactcatgaaaatgcagaagagatatggaaagaacattgattctggtggtgagttaactgaaaaggagattatcagagctgagaggaactctgggtttatcagtaacagagtgagagaaattcaatttctcttctatagaaagacgtcgctgctgtacttccatgtggggtacaaacatccattatcaattctcaaacttgcaaaaatttcagatgctaaatgctttgaggaaaagggaacagaaagagcgcagggaaagggatttgagggaaggattacaactgtataa

SEQ ID NO: 47460 - DNA, 282 bp, Glycine max
  Peptide Sequence Number=SeqID_164238
atgtacccagtcaaggtgcttggctcaagagttactgtgcagggaggggtttccattcctcaaagtttgattcagtggaacaagaaatcaattgatgatgtaacttgggaagacaatgctgtgatcagaggacagttcccaaattttagccttgaggacaaggctctttctgaagagggtggtaatgataggaacgtgaatgaggaattgggccttgacagccccaagcccaaagtgtggagagtgtatgaaaggaaacgtgggaaaagagttactaagtga

SEQ ID NO: 47461 - DNA, 315 bp, Glycine max
  Peptide Sequence Number=SeqID_164239
atgtttccgatattctctgcaaacgatatgagcaaaaaggatatatatatcaattgccagcccaaaaaacccaaatacaacatcttaaactttagtttcaccaaggtgatgaaaaggaggaggaggatggaggctacaaactttccaaacttattcactattctgccaaatttgggaatcctctccttaaacgtaacttgtcatgctatcatggcaatctttaccaacatcaagaacaaggttgcggcagcattttttgttaacttctccggtgtcatagaatatcttctggagcatttggtcgccacagtttga

SEQ ID NO: 47462 - DNA, 303 bp, Glycine max
  Peptide Sequence Number=SeqID_164240
atgacaatcaatggcgacaatgtcgttggtggtgacaaaggagatattaatggtggtgacagtgacgaatgtggtattagtggtggtgaaaattatagtgatgttgattgtagtggcactgaaagaggtgatattgttgttagtggtgatgataacattaatggtggtagtaataatgtcggtaacaacaataatgataacattgacaatggtgataataatagtggcgataacgatgttagagatgataatgtcaatgacaatgatgatcatagtgacgatggtgttatctgtgcagtgtga

SEQ ID NO: 47463 - DNA, 180 bp, Glycine max
  Peptide Sequence Number=SeqID_164241
atggttaggtgtggtggttgcaagtttgtgtgttgggtagaccccaagagaggaaggattaattggagagaagtgagaacaaagacaaagaaagaagaagggtttagtaaacgaaaacgtgagcgtgacagtgttgagggttgtgggagtcatcagagtatagagtttcatccaatgtaa

SEQ ID NO: 47464 - DNA, 2085 bp, Glycine max
  Peptide Sequence Number=SeqID_164242
gccactgggaatcagtatggatcagttgattcaggaaatgctgcgaatggccagatcccatcgtatgatcggtctgtaaccccagtgttgcaggattttattgatcctactatgtgttacctcccaaatggttacccatccactgcctattattatggtggttatgatggaactggtaacgagtgggatgattattctagatatgtgaattcggaaggagttgagatgacttcggcaagtatttttaccttcctgctttccaaaattcttggagtttatggggataatgggtctctactttatcaccatggatatggatatgcaccctatggcccctattcgccagcagggtctccagttccaaccatggggaatgatggtcagttgtatgggcctcaacactatcagtaccctccatattttcaaccgctaacaccaaccagtgcaccattcacacctactcctgctgtccttcctcagggtgaggtttccacctctgttgctgctgatcaaaagcctcttcctgttgaagcagccaatggaaattctaatggtgtctcaaatggtggcaatgcaaaaggtaataacgctgctgctcctattaaacaggccaatcagaattcatcttttagttccaaagcatcaaatgaaagggttgctatgccaggtcgtggtccaacctcaggttatcaggatccaagatttggttatgatggagttcgctcacctatcccctggctagatgccccactattttcagatgggcaaccaaggcctgtaagtagcacaaccatcacttcttcgatatcaggtggcaacaacactgcctcaaggagccagactttccgccctaattctcagttcatgggcttgcaccacccaagaccaatgcctgccatgggagccacccatagcttcataaataggatgtaccccaacaaattatatggtcaatatgggaacactgtcagatctggaatgggttatggtacacatgggtatgattctcgggctaatgggcgggcttggttggctgttgacagcaaatacaaaactaggggaagaagtggtggctattttggctatggaaatgagaatgtagatggcttgaatgaactgaacagaggccctagggccaagggtggcaaaaaccaaaaaggttttgcaccaactattttggcagtcaaagggcagaacttgcctgcaagtttaggcaccgatgaagagaaagacaagactagtaccgttccggaccgtgatcagtataacaaagctgattttccagaagaatatactgatgctaaattttttgtcatcaagtcttacagtgaggatgatatccataagagtattaagtataacgtgtgggccagtacccaaaatggcaacaagaagcttgatgctgcatatcatgaggcacagcagaaacctggtggctgccctgtttttctctttttctcagttaataccagtgggcaatttgtggggcttgctgaaatgattggtcctgttgattttaacaagagtgttgagtattggcagcaagacaagtggaatggctgctttcctcttaagtggcacgttgttaaggatgttcctaacaatttgttgaggcacattaccctggataacaatgagaacaaacctgtcactaacagtagggatacacaagaggtatgggaagggaaacctgctgatgagaagattgagataaatggggaagtcaatactcaaaaatctgaagttagctcggaagtgctcaaggagtcccttgctgagaaggatagtgatgaccacaaagttcccgagaatggatgtgctacaaaaactggagatgccccaaagggtgctaaaccagttgttcctgagagcaagattgtagccaatgggtctgaagatagagattggttgcctagtgaagataaagatctgtatattgagattggctgggcggagttacttcatagaatgctagcaccaatcccttctcattgggttttgtttacagtgagcagctttactttgttactttcaacaggggtagaagcaaggtgggaaatactgaaaaatatagttggattttaa

SEQ ID NO: 47465 - DNA, 120 bp, Glycine max
  Peptide Sequence Number=SeqID_164243
atggctacttatcccgatgcatttcctgaagactcatcgagcgaagtgattgataggagaccggatcttgaaatgtccaagtggcgtgggtacaactcgggtgctcacgaaaaaagatga

SEQ ID NO: 47466 - DNA, 432 bp, Glycine max
  Peptide Sequence Number=SeqID_164244
atggattatgaacctccattcctcgagacctacaaggcccttgttcaaaaccacgtcgatgattcaaagaatgactcctctttggtggagagatgtgaactaccagtgatcgatcttggcaagttcaactacgagagagacgaatgcgagaaagaaattgcagaagctgctaataaatggggtttctttcaagttgttaatcatgggatttcacaggagctgctgaagagtcttgagtttgagcaaaagaaattgttctatcaaccatttgtgaataagtctgcaaaatttaatttctctagtttatctgccaaaacttacaggtgggggaatccatttgctaccaatctgagacaattgtcgtggtcagaagcctttcatttttatttgtcagacatctcatggatggaccaacaccatagtatgaggtag

SEQ ID NO: 47467 - DNA, 1437 bp, Glycine max
  Peptide Sequence Number=SeqID_164245
gccttgcgaaatgtaagacaaattgcacaagaatcaagtggagaagttcagtatggtgggggtcgtcagcctgctgtcttgaggacatttagtcaaaggctttgcaaagggttcaatgatgctgtcaacgggtttgtggatgatggttggtcattgatgggtaatgatggggttgaagatgtgaccataggcataaactcatctcccaacaagtttttcagttcccattacaatacatcaatgcttcccgcatttggaggtggggtcttgtgtgcgaaagcatcaatgctgctacagaatgttcctcctgctttgcttgttcgttttctgagggagcatcgttcagagtgggctaattatggggttgatgcatactcttctgcatgtctcaaagctagtccttatgcagttccttgtgcaagacctagtggtttcccgagcagccatgtcattataccacttgctcatactattgagcatgaggagttcttggaggtagttcgtattgagggtaatgcatttccccctgatgatgtagctttggcatgtgatatgtatttaatgcagctgtgcagtggaattgatgaaaatgcaatcggagcatgtgcacagcttgtgtttgcacctatcgatgaatcatttgcagatgatgctctcttactgccttctggtttccgcatcataccattggatcctaaaacagatggtccggcttcaactaggacattggacttagcgtcaacactggaaactggatctggtaatgctcgctcagctggtgaaagtgacctgaataactacaaccttaggtcggtcctcacaattgcattccaatttacctttgagaaccatttgcgggacaatgtggctgttatggctcgccagtatgtgcgtaatgttgtgcgatctgttcagagggttgctatggcaattgctccctctaggatcagtacacagttggggccaaagtcacttcctggtccaccagaggcccttaccttagcaagatggatctgcaaaagctacagtctccacacctgcacagagctttttagcgttgagtccacatctggtgatgcaatcttgaagcaactttggcaccatccagatgcaatattgtgctgttctgtaaaaacaaatgcatctccagtgttcacctttgcaaaccaagctggacttgacatgcttgaaaccactcttgttgctcttcaagacataatgctggataaagttcttgatgaagctggcaggaagtttctctgcattgagttctccaagataatgcaacagggatttgcatatctgccagcaggaatatgtgtatcaagtatgaatcgaccagtgtcttatgagcaggccattgcttggaaagttctcgatgatgatgattccaaccactgccttgcctttgtgttcatgaactggtcttttgtctga

SEQ ID NO: 47468 - DNA, 261 bp, Glycine max
  Peptide Sequence Number=SeqID_164246
atggaagatcaaggctgcactactaaaaaaacagctttctacatcgcccaattaacatcggttatagctaaaaccgatgttaacgaaagcacggtggcattttttcgcctgcgtttccgtgactgcaaccacattgtggagatcgtctttgccacttatccattgagttcgtgtttgtcacaaattgggttgcacttccgtgactgcaaccacattgtcgagttcgcgtttgtggagttcgtgtctgcgcttccatcgaag

SEQ ID NO: 47469 - DNA, 286 bp, Glycine max
  Peptide Sequence Number=SeqID_164247
atgtcatcacatcagtttggcggctccaacaaaagaatcttactccatgtaatctactgttgtccatctgctcccacgaatgaaggttcacgatcatcaaaggtaccaactacacggtacaaaaattgcaaaggaaatagtttgagcgtgcccacgcaacactcacacttaggaaaactaggtagcaagtgtcgaggtcaccttatcatgcacgaacaactccccttcgcccatggtgatcagcctgagtcactagggagttccaaactgagtgatatgcccccaa

SEQ ID NO: 47470 - DNA, 708 bp, Glycine max
  Peptide Sequence Number=SeqID_164248
atgaaggagtgtggaggctctcttgggggagagggcaaggaagaagaggactactcaaaacaaagagattcagcatcaaacaagcaacagctcatggattgtggcaagtatgtgaggtacacacctgaacaggtggaggctttggagagggtttatattgaatgtccaaagcctagttcttccagaaggcaacaaatcattagggagtgtccactccttgctaacattgaaacaaagcagatcaaagtgtggttccagaatcgcagatgtcgtgaaaagcagcggaaggaagcctctcgtctgcagacagtgaatagaaagctgtctgcaatgaacaagttgttgatggaagagaacgaccgactgcagaagcaggtctcacagttggtttatgataatggattcatgaaacaacaaatacatactgcatctgctactactactactgacaatagctgtgaatctgtggtagtgagtggtcaacgccaacatcaaaaccccaaaattcagcatccccagtgggatgccaacaacccagctggtcttcttgcaattgctcaggagaccctggcggcgttcctttcaaaagctactggaactgctgtcaactgggtccaaatgattgggatgaagcctggtccggattctattggaatcgttgctgtttcccgcaactgtagtggtgtagcggcaagagcctgtggcctt

SEQ ID NO: 47471 - DNA, 1137 bp, Glycine max
  Peptide Sequence Number=SeqID_164249
atgggcctgcagcaccgcctggccggcacgcgcggcgcccagcgcttcttcagcggcatggcacagctcgaccatggcggtgacgccgaggaatccggcgccgcccttgagcgtgtgatagccgcggaacaccgcgttgagctgatcgctgtcctgcggtgcctgctccagcgacaccagctgttcgccgaggcgatccaggatttcctgtgcctcgatgatgaaatcggcagtgatgtcgtcggataccgcgctcatgcttacagccccagatccgacaacaggtcgtcggcgtcgttctgcgagaccgcgtggcggtccagtcccttcagtgccggcccggccagttccggctctgggtcagggcgatctcggtcaggttgtggcggatgcgctcgagctgcgcgtcctggcccggctgcaggccttcggcgcgcagctgttcggtcaggctgcggcattcctcggccaggtccagggtgcggtgcgtggcctgctcggtcatcgccaccacgtggtccaggcgcgcgcaggcatcgtccagttcaccggcttcgctcggcacggtcggcagttcacccagcgcctgtcccagttcgcgggccagccgcgagagcccactcatcatcggctgcgtgcgcagcgcgaccagtccgtcgatgcgctgccgccaggcggcctcgtcaccggactccagtgcgtccagggcttcctgcaggcgcagggcgagggcgttcttgtcgaccgtggtatccatcaggcgctggccgccaggcgttcgaagatcttgccgagcttctcttccagcgtctgcgcggtgaacggcttgatgatgtagccgttcacgccgctctgggcggcttcgatgatctgctcacgcttggcttctgccgtgaccatcagcaccggcagggtcttcagcttggcatcggcacggatcgccttgagcagctcgatgccggtcatcaccggcatgttccagtcggtgaccacgaaatcgaacggctggctctgcagcagcgacagcgcagcatgcccgtcctcggcttcggcggtgttggtgaagcccagatcgcccagcaggttcttgacgattcgacgcatggtcgagaagtcgtcgacgatcaggatgcgcat

SEQ ID NO: 47472 - DNA, 363 bp, Glycine max
  Peptide Sequence Number=SeqID_164250
atggatgtgattgcaaaacttccaccaccaactgatgaaaggggtgtgagaagtttccatgttcatgttggattctataggagctttatcaaagacttcttcaagatcgctaaactcttgagtaatttgcttgaatttgatcttgaaatcaaggataagaagagaagtgagaatttagtggttgaccacctattcagactggtgagtaaagaagtgacatccaaggagcaagatgttcatgataccttcccagatgaagctttacttgttgtgcatgaatactgttgggatgtggcaaattgtaaggcagttatggtgattccggaaggaatgaattggcaacaaaagaaaagatttttttag

SEQ ID NO: 47473 - DNA, 576 bp, Glycine max
  Peptide Sequence Number=SeqID_164251
atggattcttcgttgatagaatggaaagaattaggggaagagggatccccggacaatgaaaacgaatgggaagatcgaaaagttggaagaagaaagaattttttggttcgacgcatagaattagctaagcattttctccgaacaaatatagaaccagaatggatggttttatgtcttttaccagttcttcctcccgaattgagaccgattattcaaatcgatgggggtaaactaatgagctctgatattaatgaactatatagaagagttatctatcggaataatactcttatcgatttattaacaacaagtagatctactccaggagaattagtaatgtgtcaggagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgttgtaggtccatcactttcattacatagatgtggatgccccgcgaaatag

SEQ ID NO: 47474 - DNA, 579 bp, Glycine max
  Peptide Sequence Number=SeqID_164252
atggatcaaaacaagcaaggtgaagcagcagaaggagggaatattggtcatccagcacatggcaagaaccaagaagagcaatctaaccctatgatagcacctacaaatcctcccaaaaagaaaagcttggaggaacaactcaacgacttctgggcagcacagcgcgaggaagctaagatgaccactaatttcaagactcacagcttgcccttgtcgaggattaagaagatcattaagaccgacaaggatgtaaagatgatatctgctgagactcccgtggtgtttgccaaagcctgtgaaatgttcatcaaggagctcacaataagggcttgggctaatactgaggctcgcaaagggaagatactttcccagcgtgaccttgtatccgccatctcccagactgcttcttttgattttctcgatgatattatgcccaaggatgcaggcttaccaagaacaagcattgcttcaacagagaatgcttatctaaacatgccacctcagcagaatgttgcaggccttccatatgatgctccaaccatggcctttcctaatctaaaccatcatgctcccaattag

SEQ ID NO: 47475 - DNA, 936 bp, Glycine max
  Peptide Sequence Number=SeqID_164253
atggatgcttccgcagcagataactccatccctctgtccctaccaacgaagcaaacggtgatgatcccattcagcgtgatgataatcacattggctaaagccaaaaggagcgagagagaaaaaaatgttggggatcttcagcagttccgtggtgtcgccgccggaggagctggtggctgccggcagcagaacgccgtcgccgaagacgacggcggggaagctgctgaaccggttcgtggagaacaaggcgtcggcggtgtcgctgcaggtgggagaacacgtgcagttggcttacacgcaccacaacgagtcaccgtggcatcccaggatgagatattctgcttgtttgagggggctctagacaatttgggcagcctgagacaacagtatggactggccaagtcagccaatgaagtggttttggtgattgaggcttacaaagctttacgtgatcgagcaccataccctgccaatcgtgttgtatgccatctcagtgggagctttgctttcatagtttttgacaagtccacttctaccctttttgtggcttctgatcaagctggtaaggttcctctttattggggaatcacagctgatggatatgtagcatttgctgatgatgcagatttgcttaaaggttcttgtggcaagtcacttgcttctttccctcaagggtgtttctactctacagcagttggaggattgagatgctatgagaatccaaagaataagattactgcaatacctgctgaggaagaggaaatctggggtgcattcttcaagaacagagaatcagtgatttgtcccaatagtaatataaggttaatgtcagttcagactgcattaggtacaaagggaaaatgtgaggtaatcttagagcttaagaagttagagttgaatatcctttatgtaactaggattgtcagttgcaactaa

SEQ ID NO: 47476 - DNA, 588 bp, Glycine max
  Peptide Sequence Number=SeqID_164254
atgaataaaggagaaagttcagtcaatgttagaccctacaggtacctagactcccagaagaatgaacttgagaggcaggttgccgccatgttggaagcggatatgatccgccctagccgtagcccgttcttttctctggtgttattggtgaagaagaaggatggaagctggcgttgctgtgtcgactatcgcgccttaaacgccataactatcaaagatcgtttccccatgacaacgattgatgagttactggatgagatcggcaacgcatcttggttttcgaagttggatctccgtcaagggttccaccaaattcggatgcacgacaatgacatcccgaaaatggcgttccgaacccattatggtcactacgaattcaaggtgatgcccttcggcttgaccaatgcaccctttatcatcgcgacggtcttctttgacgacatcctcgtctacagtccttcttttccggcacaccttcagcattttgatgagaatcatgaaactggcctaatacaggctaaaggcccaagtggagaaggacaaaggtccaagtggagaaggacaaagcccccgagtggagaaggatga

SEQ ID NO: 47477 - DNA, 132 bp, Glycine max
  Peptide Sequence Number=SeqID_164255
atgggatttgaatcggatatgggacgggatcagggatacccgatatccaacgggtatggagatgacataataaattttaacctgtcaggtatcaggtacgggtatagggatatattggagagtcgggattag

SEQ ID NO: 47478 - DNA, 504 bp, Glycine max
  Peptide Sequence Number=SeqID_164256
atggttggattccagagtgaccataagcccgggaacaagtgcaatggtaattctaatagttttccggttccggatcgtcatgtacgacttatgagaggaagagagctaagaaaaagcagcaaggcatctcctgatagtaataatattagtaatgtggttagtgaatattctgagcataacctgcgcttaagagaagataatagtaactctgctgctccctttgaacgatacctggaaggagtggcagcagcagcagcagcagcacggggcgcaagggaagatgggagacctttcagacaacggcttttggtggtggccaataggctgccagtctcagcaataaggaaaggcgaggatttgtggtctttggagataagtgctggtggcctggtgagcgctctcttaggtgtgaaggagtttgaggtgaggtggataggttgggctggggtcaatgtgcccgatgagattggacaaaaggcacttacaaaagctttggccgaaaag

SEQ ID NO: 47479 - DNA, 879 bp, Glycine max
  Peptide Sequence Number=SeqID_164257
atgtctcacatagccgtcgagaggaacaggagaagacagatgaatgaacatctcaaagttttaagatctttgaccccatgtttctatatcaaaaggggagatcaagcatctataatagggggtgttatagaattcatcaaggagttacaccaagttcgtcaagctttggagtcccagaaaagaagaaagagtttgagccctagccctggcccaagtccacgaacactgcagccaacgtttcatcaacttgatagctcctccatgattgggaccaattctttcaaggaactaggagcaagctgcaactctcctgttgcggatgttgaagtgaaaatctcgggttcaaacgtgatcttgaaagtcatttgccacagaattcctggtcaagttgcaaagatcataactgttttggagagtctttcctttgaagttcttcatttgaacatcagcagcatggaggagactgtccttgtagacagtagaagcaaagcagcaagtgatgacgtcgaaacaaacatacaacgtgtgcttctgctggcgctagcagaagcaccgttggaaatcaataccctattcgatgaatatttcgagaatgagctcatgacaccttcgcatcttaagagattcttggtcaaagtgcagaggcaaaagaaggccattgaagaagacgcgcaagccatcattgatagcttcaagaatttccatcgtagaggggttggccttaatcttgaaactttcttcaagtacctcttcagtgacgataatcctcctcttcttccttctcatggggttgtcaaggttgttgattttggggttgtcggggcacaaactcagtctggagtgatgacacagctgaaactagaacatactgttggatga

SEQ ID NO: 47480 - DNA, 954 bp, Glycine max
  Peptide Sequence Number=SeqID_164258
atggacctagtcattgacctcggaggaccaatcctatggaacggctgcgacaaccactacaactcttcatcctacaaccccgtccattgtgaatccaaaaaatgcccggcaggttctgcatgcactggctgcaacggccctttcaaaccaggttgctcaaacgacacgtgcggtgcctacatactaaaccctttcgctgacgctatttttagcggcgatttaggtgatgatgtcctgttcctgtcccacacctcactctcactctctggtcttatttccggtttcacttccattgatgacacttcgcttctaaacaacttacccaaaagtggtaaagggatattaggacttggttccctcttcattggtggggcaccccaaattgcttcttccaagttaactctcttcaccacccctcttgttgttaatccctttagcacagctccagtattcactgaaggccggttgataaactttaagtcttcccttctttctattgacaacaagggacatggtggaaccaaaattagcaccatgaatcccttcacggttgtacacagtgccatattcaaaccccttgttagggaattttcgaagcaagctggtcagagaaagataaggaaagtggcaccagtggcaccgtttggagtgtgttttgattttagcaccattggtaggactgtcactggacttgatttgccctctattgagttggagttggaagggggagtaaagtggacaatttatggtggcaattcaatggtattggtgaacaaaaaggtggcgtgcctaggatttgtggatggaggtaaagagccaaggacatcggttgttattggtgggcatcagttggaggataaccttctggagtttgatttggtttcttccaaactaaacttcagctcctccctccttcttcatgataatgcaagatgctcccacttcagaagctaa

SEQ ID NO: 47481 - DNA, 975 bp, Glycine max
  Peptide Sequence Number=SeqID_164259
atggaagctatctttcttaacaaactcaagtcacacatacaccacatttacaaccaaaaatatgctttgaccgctttcactggccgctatgtgtacattctccctgtttcttactcagatgtagcacttgtcacatctttgagggatggaatgaatctttttgctggtgctgcacagtcacttggtgctggggctattctggtcaacccttggaacatcacagaagttgctactgcaattgccaaggctctgaatatgccatcggcagaacgagagaagagacataagcataactatgaacatgtaaaaactcacactgctcaggaatgggcagaaacttttgtaagtgaactaaatgatactgttgtcgaggcacagataaggacaaaacaagttccaccacggctcccaacagagactgcagttgaacgttatttgcagtcaaataatcggttgcttattttgggtttcaatggaactttaactgaaccagttgagagagaaggtgatcggtttaaagaaagggaactcactgtgcatccagaactgaaactgcccttggcagaattatgcagtgacccaaagaccacagttgttgtgcttagtggaagtggtagagcagttctagatgaaaacttcaaagaatatgacatctggctggcagcagagaatgggatgtttttaaacccttcaaagggagaatggatgacaacaatgccagagcaactgaatatggaatgggttgacagtgtgaagcatgtttttgattacttcacggacagaacacctcgatcatattttgaagaaagggaagcttcacttgtatggagttacagacatgcagatgctgagtttggaagattgcaagcgagggacatgctgcagcatctctggacaggtccaatttctaatgcatctgttgacgttgttcaagggagccgatctgttgaggtgcgagctgctaatgttacaaag

SEQ ID NO: 47482 - DNA, 326 bp, Glycine max
  Peptide Sequence Number=SeqID_164260
cgtggttctgcacctccaatcccaaagcctcccttctacacctcttctcaaaccgcatcgtccaacaatcaccgccagtagagatcttgcgcttggatttgccaaccgctatcgtggctcaacgtcacgctcctccaccaccccaccatcgaaaaacctccacattgtcgtcggcaaccccaactccttcgtccatgtgtttctcgtccaaaacctcaaccctccactctcatgccaactctaatggacgatcaggttttagcgccaaagctctgacaatcatatttcttgctccgatggtccccaaagatatgacaccaccatag

SEQ ID NO: 47483 - DNA, 472 bp, Glycine max
  Peptide Sequence Number=SeqID_164261
gatcacactcagatgcaattctcaacctcaaccactgccaaacctttttgcatcaaaatcaccaagagtctccggttccaatgttgctccacttcggtgcggcatttcttcgaacgagtacagcgcaaatgaaggtaggagtgttggggaatggcttgtgctggccggtgaggtcctttcgacgggatttccattgtgggtcacaattgcgtctgttttggggttgatgaaaccaagttacttcaattgggtcactcccaagttgagcatcatgggtctcaacatcatcatgctgggtatgggtatgactctcactcttgatgatcttcgtggggttcttgctatgcctaaggaagtcctctctggcacagctagtaacattataacttatcttgcacgtgcaaatgtggcgctttctgtgataatgacaactgcaagcaccatatctgccatggttggtaccacgttttga

SEQ ID NO: 47484 - DNA, 339 bp, Glycine max
  Peptide Sequence Number=SeqID_164262
atggatagcttatgtggtgaggtaaatgttcttaaaatgattttttttctcgttttccaaagatgggcaacgagggtgtacgtgaacaacgatgaggcctgttatcacggaagaaaggaggtgggacttccaagtcagatggctaggttttccaagacaattacagcaatctcaagacaacagagggagataaagagtggatttcttaatcggattggaattggtgccaagtactctactccaaaggatcccctgaatgttcaagtaaccaaaatcaaatgtcttgatgcagaagacacttgtaatattaatatcagtctcaccagtcctggtgagtga

SEQ ID NO: 47485 - DNA, 910 bp, Glycine max
  Peptide Sequence Number=SeqID_164263
atgaaaattactctctcaacagcttttgggcagtcgtcgtcgagccctttcggctctcaatcggttttcggacagaccaattcgagtagcaataatccttttgcccctaagccatttggtagtacagctccatttggttcgcaaaccggcggttccatatttggaggtacttccacgggggtgtttggaacagctcaaccgtcttctccattcggtgcttcgtcatcaccggctttcggtagttcacaacccgcttttgtgtcatcttcaactcctgcttttggtagttcctcgtcgtcgtttggtggatcttcagtttttggtcagaagcctgcttttggaggctttggatctactcctactcaaacaactccatttggtgctgctcagccatcacaaccagcttttggaagcagcatatttggttcctcaacaccttttggtgcatcgtctcagcctgcatttggtgcgacaagcaacccagcatttggtgctacaagcactcctgcatttggtgcaacgagcacccctgcgtttggtgcaacgagcactcctgcatttggtgctacaagcaccccctcatttggtgcaactagcacccctgcttttggtgctacaagcagtcctgcattcggtgcaaccagtgcccctgcatttggttcaacctcaactccagcttttggtagcacagggagtgcatttggggtgtcaagtactcctgtatttggtagtgggggagcatttggggcttcgagtaaccctatgtttggttcatcaagtacatctgcttttggcacttcaagcagtccatttggggctactagtactcctgcttttggggcctctagtaccccagcattcagttttggatccactcctcaagcttttggtcaatcatcttctgcatttg

SEQ ID NO: 47486 - DNA, 270 bp, Glycine max
  Peptide Sequence Number=SeqID_164264
atggttctcatctctgaagaagctaatagtagccttgagattccagttattgacatgcagaggttattatctgtggaatctgggagttcagaattggataagcttcaccctgcttgcagagaatggggattcttccagctgataaaccctggtgttagctcttccttggtggagaaagtaaagttggagattcaggatttcttcaaccttccaatgtcagagacatatattataagtaatggaatataccgaagtgttgaccatcaatag

SEQ ID NO: 47487 - DNA, 438 bp, Glycine max
  Peptide Sequence Number=SeqID_164265
atgaagactttagccatggaagagaccatcaagaacctatcaggaacttcacttttggtatcatcagttcaagagttggctaaacagaatttgtctagtgttcctcaaagatacattcagcctcaaaatgaagacattgtgagcctgctctctgtggaatcttgtagttctaaattggccaagcttcaccttgcatgcaaacaatggggattcttccagactatgaggatgaactattacccaccatgtcctcaaccagagaaggtttttggcctcacttcccattcagatgcagctagtgaagtagaagggcttcagataaggaaagatggcatgccctccgaatctatatccaccacttgtcccgccacaaccccttccgtactgatcgatttcactaactccccagtcacgccaaccacgcctatttgcttgtaa

SEQ ID NO: 47488 - DNA, 2218 bp, Glycine max
  Peptide Sequence Number=SeqID_164266
gatacaaggaactgcagtatcttgtgcaaatgtagttgaaagtcattgcatattttttcttgcaggatcccaaactccgacatcaacttttggaaatactggtgggcagtcaggttttggaggtcaacaacggggtggaagtagagtagctagttacacagcaacaactgaagcagatagtggtacctctggacagactgcaaaattggagtccatatctgccatgcctatttacaaagacaaaagtcatgaggaactaagatgggaggactatcaattgggagataaaggtggatcacttccctctacgcaatcaactggtttgacaggctttggttcgtctacaacacagacaaatgccttttctccttcaccagtgtttggtcaatcatcagccaatcctttctctagcacagcacctaattctaacccttttgcgcaaaagagttcacctttttcttctggatttggaacttcggctgctcctgccttcagttcatcagcttttggttcttcaacgtcagcagcagcaccttctctttttggctcatcgccatctccatttggagctaactcttcttcaacacccggctttgggcaatctccatccctgtttaatactgctcctgctcaggctacatcttcaccatttggcaatagcatttttggcaacacacagtcatctccattatttagttctgcagcccctacaggtggacagacaggttcagcttttgggcagaatacctccccctttggacagactactacaccttcttttagtcaatcaagcctgttcagttcaccttcttctgggcttgttggaagtattttctcatcaagtgcacctctcacttctaataatctgacaggttttggtcaaacagcgccatccatttcaacaccttttcaacctgcacaacctgctcagtcgagtggtgcttttggctttagcaactttggtcagacacaacctgttggtgcaagcagcttcggtggcactccaggcatatttggtcagaataattttggactcgtgtcttctaccccccagagttcagtggctgtacaagcagttccgaatacaaatccatttggaacacttcctgcgttgcctcagatgtcaattggtcgagttggaaccactccttcaattcaatatggaatctctagcatgcctgctctagacaaacctgctcctgttagaatatcctctttattgacatctcggcatctctctcaaagacgaataaggcttcctgtcaggaaatatcattctaagaatgatggtccaaaggttgcattcttcagtgatgatgaggatactccaacgacacccaaggctgatgctctgttcattcctagggaaaatccaagggcattgataatttgtcccatggagcaatggccaggaaaggtttccgagaagccatcaacatttaaggatagatccatcccagtgaatgagaatggaaatatctcgaaagatgcatctgtaacacctgatagaaccacttcacaggataaagataaagagaagagtgctgtagaaaatggtgttgtcaaggagcaagctcagcctataacgacaaagccaacatccaatgggagcaatgaagatcattctctacaaaaggcggacgtgtacaagacactcagtggtcacagagctggtgaggctgccattgtctatgaacatggagctgatgttgaggcactaatgccaaaactacggcgatctgattactacacactgcctcgtatacatgaactggcggccaaggaaagagctgaaccaggattctgcagtcatgttaaggacttcgtggttggaaggcaaggttatggcagcatcagattcttgggtgagacggacgtgcgacggctcgatcttgagtccctcattcagtttaacaaccgggaggtgattgtatacatggatgatttaaagaaacctcctgttggacaagggctgaataagcctgctgaggtgacactactcaacataaaatgtttcgacaaaaaaactggccatcagtatacagaaggaccgaagattgagaaatacaaggagatgctcaagagaaaggctgaggaccaaggtgctgaatttttatcatatgatcccactaaaggagagtggaagatcagggtcagccatttcagcatctacaagctagtagaagatgaaaacagttggataaatgatgacaactaa

SEQ ID NO: 47489 - DNA, 2505 bp, Glycine max
  Peptide Sequence Number=SeqID_164267
atggagggtgatgttggtcaacatggtgacagggagattgatgattcggtgttggatggggaaattgggagccatgtggaggagattggtggcaatggtgagagggagattaatggttcggtgtcggatgagaagggtgatggactggtgtttggaagcactgaggctgccaataagttcctggaggatttggaattacatcaatcgcgtgatgctgagaggattgttactgactcggacgaagaagaggagtctgacgatgaaggagaaggcaaggagctgtttgatactgctacattggcagctcttttgaaagcggcatcgggtgcggaccaagatggcggcagcatcacaataacctctcaagatgggtccaggcttttctctgttgagcgccctgctggcttgggatcaccgctccagtcagaagaatcaatagcagcacaggtgctgtatcggatgacacttgttgcaggcaggcaaagtggtcaaatgtttagcgtagagtctgcaaaggagactgcttcgcgtcttgaagctgagggaagagatgattttgatttttctgtaaatattctggttcttgggaaagcaggtgtgggcaagagtgctacaataaattcaattttcggcgagacaaagaccagcattaatgcttgtggtcctgctactacttctgtgaaagaaattgttggggtggttgatggagtgaagttaaggatttttgacacaccaggcctcaaatcttctgcattggaacaaaatttcaatatgaaagtcctgtctgcggtgaagaaattgactaaaaaatctccccctgatattgtcctctatgtggatcgcctggacctgcaaactagagatatgaatgacctgcctatgttaagatcaattactagtgtcctgggttcatcaatatggcgaaatgtcatagtcactctgacccatgctgcctctgctcctccagacgggccatcaggtgccccattgagttatgaagtatttgttgctcaaagatctcatacagttcaacaaaccattggacaagctgttggggacctacgtcttatgaatccgagcttaatgaatccagtttctcttgttgaaaaccatccttcttgtcgaaaaaatagagatggccagaaggtgcttcctaatggtcaaagttggagacctctcttgttgctcttatgcttctcaatgaagattctctctgatgctagtaactctacaaaaactcaagaatcatttgaccaccgcaggctgtttggttttcgtccccgctccccaccacttccatacttgttatcttcgttattgcagacacatacatacccaaaactccctgcagatcaaagtgggcctgacaatggtgattctgatgttgaaatggctgatttatctgattctgatctagatgaagatgaggatgagtatgaccagctcccaccatttaagcctatgaagaaatctcaggttgctaagcttactaaagaacagcagaaagcatattttgatgagtacgattatcgggtgaaacttctacagaaaaagcaatggagagaggagttgagaaggatgagagagatgaagaaaaaaggtaacacaaaagaaaatgactatggttacatggaagaagatgatcaagagaatggaagtccagcagcagtgccagttccattgcctgatatggccatgccaccatcctttgacagtgacaatccagcctatagataccgtttcttagagccaacttcacaactcctgacaaggccagtcttagacaaccatggatgggatcacgattgtggttatgatggtgtaaacattgaacagagtctagctatcatcaataaattcccagcagctgtcactgttcacgtaacaaaggataagaaagacttcaccatccagttggattcctcagttgctgcaaaacttggagagaatggatcagccatggcaggctttgacattcaaagcgttggaaagcagctatcttacagtgttagaggagagacaaaattgaaaaatttcaaaagaaataaaacttctgctggggtgtctgtgacatatttgggtgaaaatgtgtgtactgggctgaaagttgaggatcagattgctgtggggaaacgcttggtattagtgggtagcacaggggttgtgaagtctaaaactgattctgcttatggtgccaacgttgaagtgaggcttagagaggcagattttccaattggccaggaccagtcttcactgagcctttctcttgtgaagtggaggggagaccttgctttaggggccaatcttcagtcccaaatttctgttggacgaggttataaggtggctgttcgtgctggattgaacaacaagctcagtggacagatcactgtgagaacaagtagctcagaccagcttcagattgcccttgttgctatccttccgattgccaaggctatctacaaaaacttctggcctggggctagtgagaattattctatctactag

SEQ ID NO: 47490 - DNA, 645 bp, Glycine max
  Peptide Sequence Number=SeqID_164268
atggcttcatcttacaccatctttaaacttaaacaaaatgtttatccagataatgaagatgatggacagcagcagtcagaatcacaaattcagtccccttctgcaaatggaatttctgatccagatattagtacccagaatgtcaatgtacagtatgcaacacctggccagcttggaactgggcatgcaatggtaccacctgtgtatccatatccagatccttactatagaagcatctttgctccctatgatacacaaccttatcccccgcaagcctatagtggacagccaatggtccatcttcagttaatgggaattcagcaagctggtgttcctctgccaactgatgcagttgaggagcctgtgtttgtcaatgcaaaacaataccacggtatattaagacgtagacaatcccgtgcaaaagctgaatcagaaaataaagttataaggaataggaagccatacttgcatgaatctcgacacaagcatgcactgagaagaccaagaggatgtggtggtcggtttctgaattcaaagaaagacgagaatcagcatgatgatgtgacatcagctgacaaatcacaatccaatatcaatcttaattctaataaaaatgatcaaacctcatcagataggacatcctaa

SEQ ID NO: 47491 - DNA, 954 bp, Glycine max
  Peptide Sequence Number=SeqID_164269
atgcaaagtaaaagaagattgcaggatttattgcttcaaaaagataatcgcttttgtgctgattgcaatgctccagatcctaaatgggcgtcagccaatattggagttttcgtatgcttaaaatgctgtggtgtgcacagaagtcttggctctcagatatcaaaggttttatctgtgacattggatgaatggtcaagtgatgaaatagatgcaatgattgaagttggaggaaattcttctgctaattcaatttatgaggcttattttccagaaggatttacaaaacctggaccagatgccactcatgatcagcgtgtgaaattcatccggttaaagtatgagcatcaagaatttttgcaacctagtttgcgcattgtgtcaggaaaaagcaaccccccaaaaagtatatccaaagggattatggatagttttcgaattacaagtgattcacagcatatggaaggaatggtagaatttattggaatgttaaaggtgaaagtgatcaaaggcacagatttagctatcagagatatgatgacaagtgatccatatgttatcttgaaacttggccaacagactgttcagacaactgtaataaagagtaatttgaatccagtctggaatgaggaacttatgctgtctgttcctcagcaatttggaatattgaatttgaatgtatttgattatgacttgttttcggctgatgacataatgggggaagcagatattgatcttcagcccctgataacatccgcaatcgcatacggtgatgctagaatgtttgatgatatgcagataggaaaatggctgaaatccaatggcaatgcgcttatagatgatagcatagttaatatagttgatggtaaggttaaacaagtcatatcactcaagctccagaatgttgaatctggagaattagacttagaactcgagtggatgcctcttgattattag

SEQ ID NO: 47492 - DNA, 1740 bp, Glycine max
  Peptide Sequence Number=SeqID_164270
atgccccgccgaaccgtcgtgtcgtggaccaccctcgtcgacgggttactgcgcttgggaattgttcaagaggctgaaaccttgttctgggcaatggaacctatggacagggacgtggctgcgtggaatgcaatgattcatgggtattgtagcaatggtagagttgatgatgctttgcaattgttctgccaaatgccttcgagggatgtgatttcttggagttccatgattgctgggcttgatcacaatgggaagagtgaacaagcattggttctttttcgtgacatggtggcttctggcgtgtgtttatcttctggtgtcttggtttgcgggttgtctgctgctgctaagataccggcttggcgtgtggggattcaaattcattgctctgtgttcaagctgggtgactggcattttgatgaatttgtttctgcttcgcttgtcactttttatgctggttgcaagcagatggaagctgcgtgcagagtttttggtgaggtggtttataagagtgtggtgatatggactgctctattgacagggtatggtttgaatgataagcatagagaggcattggaggtgtttggagaaatgatgagaattgatgtggttccgaatgaatcttccttcaccagtgctttgaattcttgttgtggattggaggatattgagagggggaaagtgatccatgctgcagcggttaagatgggtttagaaagtggcggatatgtgggaggttctcttgttgtcatgtatagtaaatgtggttatgtcagtgatgcagtgtatgtatttaaggggattaatgagaaaaatgttgtctcgtggaactcagtcattgttggttgtgcacagcatggatgtggcatgtgggctctagcactctttaaccaaatgttgcgggaaggggttgatcctgatggaattacagtgactggtttgctttctgcttgtagtcattctgggatgttacagaaagcaaggtgcttcttccgatactttggccagaaaagatcagttactcttacaattgagcactatacaagcatggtggatgtacttggacgatgtggagagctcgaggaagcagaagcagtggtgatgagcatgccaatgaaagcaaattcaatggtatggttggctttattgagtgcatgcagaaagcactctaatttagatttagccaaaagagctgcaaatcagatatttgaaatagagcccgattgtagtgctgcatatgtattgctgtcaaacttgtatgcatcttcgagcagatgggctgaagtagctttgatacggagaaaaatgaaacataatggagttgtgaagaaaccaggatccagttggctaaccttaaaaggacaaaagcacaaatttctctctgcagataggtctcatcctcttgctgagaaaatttatcaaaagctagagtggctaggagtgaagttaaaagaattaggttatgttccagatcaacaattcgctttgcatgatgttgaaactgagcaaaaagaagaaatgttgtcttaccatagtgaaaggcttgcaattgcatttgggttgcttagcactgttgaaggcagtgcaataacagtaatgaaaaatctacgtgtatgtggtgattgtcataatgcaataaagcttatggcaaagattgttgaccgtgagattgtagtacgtgattctagccgctttcatgactttaagaatggtatatgttcgtgtggggattattggtag

SEQ ID NO: 47493 - DNA, 3582 bp, Glycine max
  Peptide Sequence Number=SeqID_164271
atgcatagaggccttgcttcaatcattactggcatccgggaaatgggttctcgtttgagcaaagcacgtggttctctcaaaaatgaatcagaaggaacatcctcgggaaaaaatgaagtttcatacgaggagctgtctagattgatgaggataagggatttgatgagcctattgttgacttatccaatgaaaatggacgagggaggtaaattaaaatcctgcattagtgcatttcctgaatggaaagctcagttattgtccactgatcatgatactattgtgatggacaaaccatggcgtgtactaactgagaaggcactgggatgtatgaagggatttatgcccacggaaataataagtaaaatagaaagtggtgagagatccatcttcaaccataatgatgccgatgcaataccaaaagccattctccacctaactgttgatctcgcagttaaccaactaattcaaactttgttttctggagattactatgcacgctatatcagtctgtcatccagaaacttggctgaaaaaagatctgtagtgaacaaaatagaagcagcctttgaagagaagcacaatatgtttggaatcgacaaagattttcttagtgccctgtggatcaattcctcaacatataagactgatgcagagattcgagttcaagaagagatcaataacaagatggcagcaggtttttcggagacaaaagggggtgaggaaaaaatgaataggcatttggtgattgtagtggatgcagacagcaacaagaagctggaccttcacaaagtgcgttttcctactggagttgtggtggtgttgataacaactgagctgaaggatgatgacttcagaatcacaagcatgatggatttgaatataaggacccaggatcatttgttgccttgggaactcttttgcagctatgtgggcagtagcaaggtatgctcatcactggtcattcagagaattgcagtgcaaattgttaaggaatgtcatggccatcttcttgccgttgtccttgtggcaaactacctgaagaatgtggaagatgttaaacagtggcaagttgcacttgacaaattaagcagcagcctgaatccttcctatgattatagagatagtgacggaattggcattagtagggtcatggtcaatgcatttgtagatattatttgggaagacattgatgatacacaaaagctttgccttgaactaagtttgtctgttcacaacattaaaattgggaagcgacttgctatcttagtgtctgattgggccgatattttatcaggacatacacaagaaatgaaactgaattcaaatgaatttggtgaatacataaggcatatcagagtgcttctagaccgttttgtctttttgaaaattgaaaggggagatgtctatttgcctgtagaaacctatgatataataaaatcattacacaccttgaatccttccatcataaggcatgatgcattagggtttctggagccaccctgcattgaacgatggcacaaccttattcggatagaattgatggacgacaaaatatgtgagctaccagaatcaccagaatgccctaaactcagagtgctcctgttgcagggtaatgttgatttgatggatatccctgactcatttttcgagcacatgcctttgctacaacagttggacttatcctacactagtataagggatttgccctcttctgtctccaaattaacacaacttaagaaattttatcttagaggttgtgatctcttcatggaactaccaccacaaattggactactaaaaaatcttgaagagcttgatcttgatgggactttgataacccatctacctaaagagatccgagaattgatcaacttgcgaagcttaaccctttgctttgatggataccatcatgtacttggtcatggcaataaaggcaagcaaatttccaactcaacaattattcctacgggactgatatcaaatcttactcagttgaattatttaaacatcaaagttgaccctgaagatgagcgatggaatgataatgttaatattgtttttgtggaaattattggattaaagaggttggagacagtgagtatatatatcccaaaggctaaccttttgaaattgatacctgtccacaaatccctcaatttcagattggttgttggtaatcatatgcgacgtttcatatcgcgtgtgacacctgaactggaggaaaaattcaaacgttgtgactatagtataaagtttgttaatggtgtaaatgttccaaacgtagtgaagatgacgcttggaaacttcaaggccttatacctagaccgacatatgaccatcaagagtctctctgattttgagttgaggaatttatctgggttgcaaatatgtgtattggcggaatgtaatcaaatggaaacaattgtggatagaagttatttacatgatgggcctgctcttccaaatttggagtttttgagcgtattctatatgaaaaacttaaaaagcctttgtgaaaggcctaacccctcttttctccgcttgaagtctatagcattgcacacttgccccatgttaactacagtttttaccgaagattctcttaaggacctttccttattggaggagattattattgaagactgtccaaaagtaaccacccttatacgccatgactcatcagaaataaaaacacggttcacaatgcccaagttgagaaagatatctcttctctatcttcctgaattggtcaacatttttaatggcctgcatgttgaacatgatgtagaaaaaatggtattttattattgtcctaaactccaaagtctttcacaatgggagttgtcaaaggcatctgtgaagatcatcataggagaaagcgtgtggtgggaagcattgaaatggaatgcagcagagtggggagatgctggtcgacccaatgtttttgaacgaattttttcaccaatcagtgaggaggctgacatcatgactcaactggctgcacatcaagagactcaattaagtacagatcacgatgagtttctgagtttaatgtgcatatcgtttgttctcatttctcttattgattcaccaaaacgacaaaaccagggaaccaaacaaaggcatgatgatagtaagttaccatcaaatcctgaagaagtagaagacctacggcgtgactcagctgcaaatcctttgattgcattcacttatgatgagttaaagattatcacagaaaattttaggcaagatcgtgtgttggggggagtaggatttggaagggtttacaaaggattcatttctgaggagttaataaggaaagggcttccaacacttgatgtagctgttaaggttcatgatggtgacaacagtcatcaagggcacagagaatggctgtcgcaagtcgaattttgggggcagctttcacatccaaatctagtcaaagtaattgggtactgttgcgaagacaaccatagggtactaatatatgagtacatgtcccggggaggtctggacaactatttgttcaaatatgggtacgtgtcaatccacgtaatcattgatggactatggatatcatag

SEQ ID NO: 47494 - DNA, 3144 bp, Glycine max
  Peptide Sequence Number=SeqID_164272
atggcggagcttccttcacaggacattttagcattgttggaattcaagaaaggcatcaagcatgaccctactggttatgtccttagttcctggaatgaggactctgttgatgttgatggatgtccatcttcatggaatggagtactgtgtaatggtagtgatgttgctggtattgtacttgataaccttggtctcgccgctgatgccaacttgagtgttttctcaaacctcacaaagctagtaaaactctctatgtccaacaattctatctcaggaaaacttcctggcaacattgctgaattcaaaagcctcgagtttctggatgtttctaataatctcttttcttcatccttaccggtgggaattggcaagttatctagcttgcagaatctttcattggctggaaataacttctctggctcaatacctgactctatttctggaatggcttcaatccaatctttggacttgagctgcaattcattttctggaccactgctagcatcattgactaagctgactaacctggtatcatttaatttatctcataattgcttcactggaaaaattcccaaaggttttgagctgattttttcccttgaaaagattgacttgcatgggaatatgcttgagggtcatttagatgatgaatttatacttttttcaagtgccagctatgttgattttagtgagaatatgcttgtgagttctaattctcagcagcagaagtctctgccacaattatctgaaagtattaagtatttgaatctaagccataaccggctaactggatcattggttagtggaggcaagcaaccaaattttgaatacttgaaggtgttagaccttagttacaatcaattatccggagaattgcctgaatttgattttgtttatgaactcatggtccttaagctcagcaacaacagattttcaggatttgttccctctggtcttcttaaaggagactctttggttttaactgaactggatttgagtggcaacaatctcttagggccagtaagtataattgcatcaacaacactgtactttcttaatctgtcatcaaatgggtttactggtgagctgccattgcttactggaagctgtgctgtacttgatttgtcaaataacaaattagaaggaaatttaactaggatgatgaaatgggggaatattgaatttcttgatctcagtaggaatcacttgataggatccatccccgaggtaactcagttttttcgattaaattatctaaatctttcccataactttcttagcagctcccttccaaaagtcttaacacagtatccaaagcttagaatgcttgatgttagttccaaccagttagatgggaaatttctaattgatctggtcacaatgcccactttgcaagagcttcatcttggaaataatacgatttctggtggcattagtttatcatcctttcctcctcgtcctttcaatcttcagattcttgaactttcttataaccattttaatggttcttttcctgctgagtttgggtcattaacaggcctgaaagtgctcaatattgctggaaatcatttttctggttctctgccaaccacaattgctaacatgagttccctagattccttggatatatcagaaaataattttacaggccctttaccaaataacataccaaaggggctaaaaaaattcaatgcttcaaacaatgatctgtctggagttgtcccagaaaaccttaggaagttccctagttcttctttctatcccggtaatgataggttgcattttccaaacgacccttctggatcaaccaataaatctgatgaaagttccaataggaagtctatcagctctattgttaaagtgatcatcatagtatcatgtgtggttgctgttctcttcatgttagtactgctcgttgtcatcatacactacactcgaatatcaagatctccatcagaatatgctactgctaaggatatgagagagcatgctcaaccacaaaccactggccctggtcacgcaaaagattcgattggtgctttggttgtatcagccgaggattttgtgacctcacagaaaggttcgtcatctgagattatcagccatgatgaaaaaatggcagctgcaacaaggttctccccatcaaaaaatagccacttttcatcaccaggatctagtgattcagtttctgtaggaaatcatgcaagactatatgcaagatcagcagataaattgactggagaactttattttcttgatgatgcaataacattgacacatgaggagctgtctggagccccagctgaagttttggggagaagcagtcatggtacatcttacaaggcaactctggagcatggtttgttattgagagtgaagtggctaagagaaggaatggcaacaaagagaaaagaatttaccaaagaggctaaaaaaattgcaaacatcaggcatcccaatgttgtgggattgaaagggtactactggggtcctactcagcatgagaagcttattatttcagattacatctctccaggaagtcttgcaagttttctttacgatcgaccaggacaagaagatccaccattgacttgggctctgagactaaaaatagcagttgatatagcacgtgggctgaactatctacacttcgatcgtgctgttcctcacggcaacctcaaagcaacaaatgtgttgttagatacatgtgacttgcatgcacgtgtagctgattactgccttcacaagcttatgactcaggctggtacatttgaacaaatgcttgatgctggggtcttgggatatcgcgccccagagctttctgcttccaagaagccaatgccttccttcaaatcagatgtttatgcttttgggattatacttttggaacttttaactggaaggtgtgctggtgatgttgtgtctggcgagaaggaaggtgttgatctggcaaattgggtaaggttgcatgttgcacaaggtagaggatcagaatgttttgatgatgcactggtgcaagaaataagtaattcaattgttgaaaagggaatgaatgaggttcttggaatagccattcgatgcataagatctgtttctgataggccaggtatcaggactatatatgaagatctttcgtctatatag

SEQ ID NO: 47495 - DNA, 543 bp, Glycine max
  Peptide Sequence Number=SeqID_164273
atggcaacacctgccataccaccattgtcctggtccatgagaatgaagattgcatttggcgctgcaaagggacttgcatttcttcatgaagcagagaaaactgtcatctatcgatgtttcaagacatcaaatattttattggaccaggagtacaattcaaaactttccgactttggccttgctaagtttggaccagttggagacaaatcccatgtttctactcgagtaatgggaacatatggttatgccgcacctgaatacttagcgacaggtcatctgtatatcaaaagtgatgtttacagttttggtgttgttcttcttgaacttctcactggaagaagatccttagacacgacatttgatggagagcagaaacttgcagaatgggctcattctttgctgaaggaaaagaagaaacttctaaaaatcatagatccaaggttggatggtgattatccaattaaagcagttcacaaggctgcaatgcttgcatatcattgcttgaaccgcgacccgaaagcaaggcctctaatgcgagaaatt

SEQ ID NO: 47496 - DNA, 441 bp, Glycine max
  Peptide Sequence Number=SeqID_164274
atgccaatctcaatccaatggtgtccattctcggagagtgtctttccactaaatctcgatccacaacctacgtcgatcactcataagccattaaaatttgatgaaacaagttttagaagcgaaaacaataacaccgttgcttctctttcccataaccaaaggcctaaacccaaaagggttgcgaacggtgacaagcttgtcctcggtgatgaagacaaaagagtaagcccctttgagcttttcataggcgttaatgattcgcaaaatgaagggtttttgtttagaggtttcgatgaggtagagaacaacctcagtgtcggaggtggtgactttagagatgaggcccatgccggtgatggattggaagacgttgttgttgatggtgacaattttggcaccttcttagctgcggtgttggagggcaaggtagtagaggcgtaa

SEQ ID NO: 47497 - DNA, 1138 bp, Glycine max
  Peptide Sequence Number=SeqID_164275
atgtcgggggttgaggttgtcgcccctcttgttggagaggtgggagcgcttggggttggagaattacatactacaattgcatctaaaattgcatcttccagaaaccttgatgacaactacaacattttgctcaaagacatggagaagctacttgcaataaagaaggataaagagagggagattcaaagaaacaaccacaaagacaccactaatgcttacaagctttggacaaacagggtatcagatgccgcagaagaagtgcagaagctgaaagttaaatacaaagaaaaaatgctaccctggtggcgtattcgtcgacgttcacgtctgagtgaaaatatggtgaagaagagcaactgtgttcgtgaacttgtgaaggatgaatgtttaagagattttcttgttgataaaccaccagagcctgtcttaaaggagttaaatgtcccacggataagtggatatccaacccttcaagatgccttggaaaagactctgggtttgctaagaaataataagattaaagtcattggagtgtgtggaactaaaggggtggggaaaacaacaataatgcggaacctaaacaacaatgaagaggttgctaaactgtttgaaattgtcatttttgtgaaagccacaactgatgatcatatgcttcaagagaaaattgctaatcggttgatgctggacataggaaccaacaaggagcatagtgatgatgttgcaagaagaatacacaaagagctagaaaagaagaagtatttattgattttggatgaggttgaggatgccatcaatttggagcagttgggaattccaactggcatcaatggcagtaaggttgtaattgccactcgattccctcgagtttataagttgaatagggtgcagaggctcgtcaaagtcgaggagctaactcctgacgaagcatggaagatgttcagagatactgttcatgcctttaatcctaagattgattcccttgacattcaacctatagcccaacttgtatgccaaaggtgctcttgtcttccacttctcatttacaacatagcgaattcttttaaattgaaagagtctgcttcaagttggtcggtgggacttgaagatcttaaaccttggccagaacttcaaaaccaag

SEQ ID NO: 47498 - DNA, 594 bp, Glycine max
  Peptide Sequence Number=SeqID_164276
atgttggagaagaccatgaagacatctagtacgatgtttcaggacaggcatcataatcatagcagtggcaaaaaggagagatgtctgagtctgaccttagggaagggtgtgccttttgtcttgacctctctcttaatggcttcaattttcagtttgttcttcctctataatccaaaccctttaaccctcacaccccatcaaggccatgacatgtttgaaaatccctctgatccaaagcaagaagaacatcccatcacaacaacaaaggtttcaccatccaaaccacaaaaggaacagaaaacatgtgacctttctaagggtaactgggtaccagttttgagagggtcatcaacctattacaccaattcaagctgcactacaatccctgatagcaaaaactgtttcaagcaagggagagtggacactgattttctcaattggaaatggaagcctgagcaatgtgatcttccaaggttcgaccccagaaccttcctccacatggttcgtggcaagaaaatggctttcattggtgactctgtggccagaaaccatgtggattccctcctctgcctcttgtcacaggttagtgtctaa

SEQ ID NO: 47499 - DNA, 549 bp, Glycine max
  Peptide Sequence Number=SeqID_164277
atgtcgcagcaagggttcgcgatcgagctatacttagagccagcgctggagaatcaggttctgaaagcatggaacgttctggcgcggagacaaatcagcacagagctgatagaaatggagtctcggccacacataaccctattctcggcaccatttctagaaccttccaagctcgattctctcctaaaagtgttcgcctccaagcacgaccctctccctctcactttctcatccctcgccactttccccaacaacctcctcttcctcgccccaaccccttccctctccctcctccactttcagtcacagctctgtgacgctatcagaaaagaaggcatcgaaatcgctcatgaatttgctttcaattcgtggatcccttattgctccgttgcgcaccatgtcccccaaaacagaatgcctgaggctttctcactcttgagggaactgaagcttccggtttccggttacgctatggatgttgcgctcgtacagttctctccggttcgggaaatcttctcgtttgtgctcggcaacaacgtagactcgtga

SEQ ID NO: 47500 - DNA, 1164 bp, Glycine max
  Peptide Sequence Number=SeqID_164278
atgagcagtctacttctgttagacttgtatggtagcatgattacacaactgccatcgtctttatcaaaattgactggtctaaggggtttattcttgaaccgttgcgagctcttggaatcattatcatctgaaattggatcacttcaatttctagaggtccttgacatacgagatactaaagtaactttcatacctctacaaattggatgtttgactaatctaagatgcctgcgaatcccattcgttgcaagtgaagatgatgctcaaaatgttcatgtgatttcaaagcttcataggttggaagaattaaccattcaagtcatatcctatgaacaatggtgcaatgatgctgaaaatatctccgatgttgttttccctcctcaatcattcttagagaatttctttcaagaagtaaatcatggagttgaggatgactcggcaattattgaggtactaccaaaaactgatgcatttgaattagtttgccataaagatatcaaaaagttgtcaaattttgctggcatagtgtgtttggaacgcattcgtggtcttttgattaaaaaatgcaacaaagttttaacaattgtgtcagctgatacaagtagcaacaccatgaatggaatccaaatagaaacaagagtcatcttaccaaatttggagaaattgtatttggaaaatttgctcaatttgaaatgtgtttttagaggtcccttgcacagtggaaccttttccaaattgcatactttgtcattgaagaattgtccatcactgagagaaattttcagcaatggagcaattcaacatttttcagaacttcaaaacctgaaacttgaagattgttcaaaaattgaaatactgatcagcaaagacattgaaccagaaaaggatgtgcttccaaaactagaaatgcttctgctggttaacttgcctaactttaatactatatgctcaactcatacattggcttggtcctctttggagctgttaaggatacataactgtcctaagttgaaaactttaccactagacagtgacaatgcagtcaacttaaagtccattaaagggcagcaagagtggtgggatgagttggagtggacaaacaacgatgaggtgtatcagcggttgcaacccatctttgctgcctccaatgagtatttttcttag

SEQ ID NO: 47501 - DNA, 1261 bp, Glycine max
  Peptide Sequence Number=SeqID_164279
ggatgcaagcgtagtatatggaagcaacggagaagttttacagagagtgagaactttcaaagatgggaagataaagatatcaaaagatggtcatcttctccataacgaaaatggaacagcaattgcaggtgacatccgcaatagttgggctggtgtttcaaccttgcaatcccttttcattcaagaacacaatgcagtctgtgatactcttaagaaacattatcctcacttgggagatgaagaactttatcgccatgctagattggtgacctcagctgtgattgcaaaggttcatacgattgattggactgtagagctccttagaactgatactttacttgcaggcatgcgtgctaattggtatggattattggggaagccatttaaggatacatttgggcatgttggtggagtcatcttgggaggattagtgggtcttaagagaccagaaaatcacggtgtcacatactctctaacagaggaatttgcgactgtttatagaatgcactcactcctacctgataacctacaactgagagacatatctgctactccagggcccaacaaatctctaccattaatcaaagaaattcctatgaagaatttgattggactgcaaggagaaaaaacattatctgaaataggacttgcaaggcaacttgtgtcaatgggtcaccaagcttgtggggcactagagctttggaactacccagagtggctcagagacctcgtaccacaggaaatagatggcacagataggcctgatcatgtggatctagctgctcttgaaatttatagagatagagagaggagtgtggctagatacaaccaattcaggagggcattgctgttgatacctatctccaagtgggaagatttaacagatgacaaggaagcaattcaagtattggaagaggtatacggtgatgatgttgaagagcttgatgtgctggtaggccttatggcggagaagaaaataaagggttttgcaatcagtgagacagcttttgtaatattcctactcatggcaaccaggaggttaaaagctgacaggttcttcacaagcaactttaacgaagagacatataccaagaagggactggaatgggtgaacacaactgagagtctgaaagatgttattgatcgtcactaccctgaaatgacacacaagtggttaaactcttcaagtgctttctctgtttgggactcaccaccaaatactcacaatcatatacctctctatcttcgtgttccccactaa

SEQ ID NO: 47502 - DNA, 207 bp, Glycine max
  Peptide Sequence Number=SeqID_164280
atgtgtcaaggattattgtgcattcttcagaaagctgagagattcatgtgtttgaagttggagtggtcacattggattggtaaggagtacttcaagagtgggtcacgcgaaaatgacattcagagaacaaacattcctcacatccggttggaattccgtgataaggagaaaattgaactgcttctagtttcaattttctatctctga

SEQ ID NO: 47503 - DNA, 843 bp, Glycine max
  Peptide Sequence Number=SeqID_164281
atgcagcagccaatagagaattcggttgggaaggggttaatgaaagttgaagaagagagtgaagaatacgaatccattaagaatgttttcttgaagggtatggggtttgtgggacatgccacagatgccatggcaatttacaagaacatgctttcctttagtgtggcaaggcaagctcgttgggtttcgtttaaaattttctctaaggcggtggcaattaaatctggaggggatgctaatattggatatgcttggtatggtagttcgttggatgatctcttagagattgtatctggtggattccatggatgcaaaaaacatgatgataatgatgatgatgagtgtcatggtattgggattcccttatttgctgccaatttttcccttgatagtgctatgtgtacggtggcagatgagcatggttttaggcatgtgctactatgcaaggtgatattagggaaggtggaagctgttcatgctggctcaaagcagagccaacctagttctaagcaatatgacactggggtggatgatatatcagcacctagaagacatactatatggactgcttatctgaatacacacattcatccaaattatattatatgtttcaaatccagagatgcatggggcactaaaacctcaatcaccatatgtgtcatttcccaatttattggcaagagtttcaaaccatttgaaaccagcacaaatgtctatgttactcaaagactaccggatttacaaagaacaaaagatttcacgagaacaatgggtaaacaaagtgagattgattgtaggagacgaactgctgcgtttggtaatcacaacccagtgacaatgtga

SEQ ID NO: 47504 - DNA, 651 bp, Glycine max
  Peptide Sequence Number=SeqID_164282
atggcgcaaggcatggcgagtaaccgaaaccggaacccttgcgcgcaagaagcgcgcaaggtgatggtggtggcggacccgacgcgggaatcggcgggcgcgttgcagtacgcgcttgcgcatgcggtgatcgaacaggacgagctgattctgctgcacgttgagaaccctagctcgtggcgaaacaccatatcgacgttcctgaagatgccttcgttgggaagcagcaccactgcgtcgctggacctcggaggaggtggaggagggggagcagccgcggcgccggacggagaagggttggattttctggaggagatgaagcatgcatgtagcgtttctcagccgaaaatgaaggtgcgtgtggtgaaggtggagatggatggaagagacaaggctagcattgttctctcgcagagcaaaacgcatggggttgacgtcgtagttataggccagaagcgcaatattacttcggccatattaggatacaagcgacctgcaagtggatctatgaaaggggtgaaagcgatagacactgctgagtatttgattcaaaacagctcgtgcacctgtgttagtgtacagagaaaaggccaaaatggaggctttgttctcaactccaaaacccacagaaatttctggctcttagcctaa

SEQ ID NO: 47505 - DNA, 1131 bp, Glycine max
  Peptide Sequence Number=SeqID_164283
atgaagtcctttctgaccagtgtcaagtccttcatctcaaaccattttcttcgcttcacccaaagagacacacttctaatcctcgatcgctttcactggaaggacaaaatctgcggccatcacttatttctgctagatgtcaaaagaaaaaaactcaaacaacttcatgttccaaaagtcacagactctgacatgggtttcaagatggtgtgttcatgtaacggtttactttgtgtcattcactattctttggaccaaaactccaccatttttctttggaacccaaccacaacacaaaccatgcgaatcatggaaccagaaaatgctttgcttccttacaaggtgccaccacattgtctcctaggcttctatctcaacacaagtgacagtgattatcaagtggtaaggcttcactcttttagggacacaaacaatgcatgttttggggattatttcaccaaaatttgctctgttcgagttgaaaagtattctctacgtagagggtcgtggcgagaaatcaaatatagtaataatcaatgtgtaactgtgaatggatgcttgttttggactgagaacagtgtgacattggaggaaactttgttttgggtggctatggaggtgaatgacaaatttagtaacgaaatgattatttctttcaacacacataacaatgttattagcaagattgaattgccccctttggttaaggattgtaatgaggtgcataagaaacttgcagtgtacaaggattcagttgcagttattatttgttcagaaactgaaactatggcacaatgcttagatttgtggggtttttatgataagtacgaaggtgtagagtgttggtgtaagttacacacaataggaatgttttcaagattggagcgtcctgtaggtgttttgaaaaatgaaattcttatctcaacagatagagtgatacatagtgttggtggaaccatagctttgcttcctgaagatgatcttggagctgagttttcatataacgtcttcaattatgttgagaacttcagaacttcatatggtggaaatttggatgtggaggaagctgatccccttgaaagaaaaggagtctcgttacatgatttgttcttcagcagcgtcaatatataa

SEQ ID NO: 47506 - DNA, 675 bp, Glycine max
  Peptide Sequence Number=SeqID_164284
atgaatgctagaagctggcacctcgtattattctccttatgtcttttctttggttcaggtctaggaacaaccaaaatattaataaatggcaaaaaacaggaaatcttctcatcatcggaattgggtactcaattagatgatgttcctatcgtcaatcccacaactcctgacacaggaaatccatatatgggaaaccctaacattcctcaaacacctgacacatcagggccaaacccaacaaccccaaccacaaatccaacaaccccaaccacaacgcccacaaccccaactacaacacccacaaccccgactactacatcctcaggtggtcaatggtgtgttgctaaccagggagcttcagacactgctctacaggttgctcttgactatgcttgtgggtttggaggtgcagactgctcagcaatacaaccaggagcaagctgttataatccgaacactgtccgcgatcatgcttcttatgcattcaatgactactaccagaagaatccagcacctaccagctgtgtatttggaggaacagcatctcttacaagcaatgatccaagcacagagcaagtatccaatacataccatcatgcatccaatatctcaagacctgttgggaattttgagtacagcatggatagctcaagtcaccattcttctttcatataa

SEQ ID NO: 47507 - DNA, 1788 bp, Glycine max
  Peptide Sequence Number=SeqID_164285
atgctcccatctgagaataacaccacagacaccaccaccttacctagcgaactccaatccctgttactcaaatatgatgccctgtttcagcaacaacaatccctgccgccacgccgtgacactgaccaccacattcatttgttgccacaatcatcgccggtcaacgtgcgaccttaccggtatccccatttccagaaaagggaaattgagatacaagtagacatgatgcttcagaagggcctgatacagccaagctctagcccgttttcgtccccagttctccttgtcagaaagcaagatgggtcttggaggttctgcgtcgattatcgggctctgaacgcggtgactgtcaaggacagatttccgatcccgatgatcgatgaacttcttgacgaattgggaggcgcttgttatttttccaaattagatttgcttcaagggtatcatcaaatacgcatgcacgaagcagatattcctaagacggcctttcgcacccaccacggccactatgaattccgagtaatgccgttcgggttgtgtaacgcgccttcctcgtttcaatccacgatgaacactttgtttgggccatttctgagacaattcgtgattgtattctttgacgatatcctggtgtatagcgcctcgttccaggatcatcttcaacatctcgaaactgcgtttcagactcaggtcgaatacttgggacaccttgtctcttaccgtggagttgaaccagtggcctcgaagatatctgtgatacaacaatggccgctacccagaaccaccaaagctttgcgaagttttctcggcctggctgggttttaccgccggtttatccggggttatgctacgattgccgcacctctagtaaaggctaccacgactgatcccctgcaatggtctcagtcagcccaaattgcttttgatcgtcttaaggaagcattgtccacagcgccggtactggccttgccggactttaccaagcctttcacattagagacggatgcatccggggttggtatgggtgccgtactttctcaacagggccatcctttggctttctttagtaagccgttcacgccaaaactcttgtgttcctcgacatatgtccgggagctctgtgccattaccacggcggtgcggaagtggcgtcaatacttacttggacaccacttcacaattatcaccgaccaccgtagtcttaaggagttgctgggacaggtcatacaaacgcctgaacaacacctgtacatggctcgcctgttgggatatgattacgatattcagtatcgttcgggcacgtgtaatcaagcaacggatgccttatcacgcttaccagaccccaacgcttccctgacaatgcttctctctgttccttgtttatctttcctcaaggaattacgtaatcagttgaatgataatgatgacttccagacccttcgccggaatattctcttgcaccctcctaattttccagattacactgtgacgcaggatcttattctttacaggtcacgtatctggcttccacgcgaattacccctcattcagacccttcttcaggagttccattccactcccacaggtggccacgccggcgtcacgaagaccacaactcgaattctggaaaatttttattggcccaaactccgggaggatgtggcgcgctttgtagctcagtgcaaggattgtcaaatcacaaaatatgagtctaagaagactgcaggactcttgtgtcccctacctacaccgcatcgcccatgggacgacttgtccatgaaattctga

SEQ ID NO: 47508 - DNA, 702 bp, Glycine max
  Peptide Sequence Number=SeqID_164286
gagaaagaagaaatgtcaagaatggcaatgcgtgtgtctccttcagcttcaagtgcactctctctcctaaactgcaagcaaccacctccagtttcatgcatccgtgtaccttgtctctctcgctcctcgccgccatcgctctcctacaccttcaatcctcttaggtccttcatcggtcacggcggaagcagaagcccagggtttcgtgtccattgctacgctcctgctcctctcactcctcccaatctgcaatggatctctaccatttcctcagtggttttgatactggcgagaggcaccgcggtgccgaaatcgtatattgttccgttgtttgctctgcaagcacctgcaggtgtcgtttcctggatcaaaggtagatatggtgtgtggacagcattcttggcacttctgattcgtctattcttctatattcctggtgaacttgagttgccatttctggcattgctcttgctgatggtagctccctacgaggctatgaaattaagggaagccaacagaccacatgtgaacaacatcagcagggaattaaatgcaaatgtggctgtgttggggcttcctgttggttctgaaccaaagacagttgatccgccaccaggatttagcatgtctggtggagttggggtcatcactggagttggtggacttggtgggctgacaaatgttggtgttggtggtggctga

SEQ ID NO: 47509 - DNA, 1221 bp, Glycine max
  Peptide Sequence Number=SeqID_164287
atgtcgttgacaatctcccatgcttcctccacgaggccttcgttggtgacaacctcgggagcggtgggaagcagagacagatggagctgttgcatagccactcatcttctgctgctcaacatgttaaaggcaatgtcaggtgttcctctcttcaacctggctcctaatctcacagtgtcgaggctctgcttaggaagcatgagtttcggggagcagaacacgctggcggagtcgttccagcttatggaccaagccttccatgccggcatcaacttcttcgactccgccgaaatgtatcccgtgcctcagcgcgctcacacgtgcggcaggagcgaagagtgtctcggccgttggatttctcaacgaaaaatccccagggatagcctcgtaattgccactaaggttgctggaccttctgggcagatgacttggattagagggggtcctaaatgtttggatgccgctaatattactgaagccattgataatagtttgttgcggatgcaaatggattatattgatctttatcaaattcattggcctgatcgttatgttccaatgtttggagaaactgagtatgacccagtccaacaatatgcttcaatcagtatagatgaacaacttgaagctctcagtgcagctgtgaaagctgggaaggcaagtggtattatcagatatgttggtcttagtaatgaaacaccttatggcttgatgaagtttattcaggttgctgaaaaatatgcttcacacctgaagatagtatctctgcagaattcatatagcctgctatgtagaacttttgattctgcaatggccgaatgctgccatcaggagagtattagcttgttggcctacagtcccctggcaatgggtatactttcagggaaatatttttctccaggcggtggtccaacagaagctcgtttaaatctgtttaaagggaagtattcagaaggagaatctaggtacaacttgtccaagaaaattataaaggctgctaccatggaataccttgatattgcaaaaacatatggtcttcatcctgtatctctggctatagcttttgttttgcgacacccccttgtcgctagtgctgtttttggggctaccaaatcatggcagcttcaggaggttctaaatgcatgcaagatcgagctcgcatctgaagtaattgaagatattaacaagattcatttaaggtttccaaatccatgcccctga

SEQ ID NO: 47510 - DNA, 522 bp, Glycine max
  Peptide Sequence Number=SeqID_164288
atgcaacagctccatctgtctctgcttcccaccgctcccgaggttgtcaccaacgaaggcctcgtggaggaagcatgggagattgtcaacgacatctttctcgccacagatgctgaagaaggaaactattttgagcaattccattcagacaagatcatcacacgaatgctctccagcttggccgatccttatactcgctttctctcccctcgtgagttctccatgatggcaaggtatgacatgactggtgttgggataaaccttaaggaagttcctgatgaaaatggagacctcagactggaggtactgggaattatattggatggtcctgctcattctgctggtgttagacaggttgcttctgcacttcatgataattgtagagctgttcttgttggaaaacgcacatatggcaagggtctaatccaatctgtatttgaccttgatgatggatctggtgtagttatcactgttgggaagtatgtaacaccaaatcacaaggaaataacggcaatggaatag

SEQ ID NO: 47511 - DNA, 1857 bp, Glycine max
  Peptide Sequence Number=SeqID_164289
atggagcgtctcatgaatgttcaaaactgttgcagtgattctgtccgtgtctgtgatggactatcttcatcacaacatggtggattgcaatctccatgggcggcgaacccaggtcaagtatcaatggctgacattgtcaggatgggtaggccacaggccaaggcatccatgcctaactcttctctccacagtggtagccatcagaatgattttgcactcccatcagcttcacaaaacaatttgcattcagtgcaagttcatgcttccaagttgtcagagacaaataatgaccatggctttgctattgactccaatgttgaacagactgatgaatggccatcgattgagcatcaaccagctgtttctgtatccttggttgtagatggtcatccaacgtctgagtaccatacaaactcgtctaactctggtgaagctaatcagcagctgaagacccatgtaaatgaatttgtagctgaagatgatcctgttgagaatcccgacattgttggatctgctaaaagtatatctgaagagaatcccgaaagtacatctgtttttgatggtagcttgtacaaggacataaattcttaccaacctcatcggcatccttttgaaaataatgaagctgaagatggtgtttcatcagtagccacaaacttagagcagctaaatttacactcaaatgatcaggggacagaaccagaggaggaaaattcttctgtagtaattccaaatcatttacaactccattccgccgaatgcttaaatctgagctttggaagttttggatctgcaaatgatgcttccctttctggatctggtccgtatgcatctaggcccttgaaaagtaacttggaggatacatctggagctaacgatgtttcaacaattgggtcctcagatgttaggcatgtgacatcaacatactttgctgcaatattctggtcattcctagtttacttatgtattgcactgttggcttcaacagttcaaacagcaagggaggatatcccatactcacccttccctgcaacacaatcaatgccttcaaaatatagcaacattgcttcttcaattggtggtccctctataaccatgtcagaggctctaagggcaaataacatttcaacacctcaacctaatccacaagctctgcctggtgccaatgttgccactggacctgcacttcctcaacaccttgctgtgcatccctattcacagcctactcttcctctgggacattttgctaatatgattggctatcaattcttgcctcagagctatacctacatgccatcagcatttcagcaggcttttcctggaaatagcacataccaccaatctctggcagccatgcttccacaatataaaaatagcatttctgtcagtagcttacctcagtctgctgctgttgcatctggatatggttttggaagttccacgagcattcccggaggaaattacccattgaatccacctgctgcgcctactagtacaaccattggatatgatgatgttataaactctcagtacaaggacaacaatcatatgatttcactacagcagaatgagaattctcccatgtgggttcatggacctagctctcgaacaatgtctgccgttcctgccaacacgtattacagcttccagggacagaatcaacaaccaggtgggtttcggcaaaaccagcagccctcacaacaacattttggatcccttggataccctaacttctaccattctcagactgggatttctctggaacatcagcagcagaatccaagggaagcatcccttgctggctctcaaacccaaccacctaagcagtccccacaaatatggcaaaacagctactaa

SEQ ID NO: 47512 - DNA, 302 bp, Glycine max
  Peptide Sequence Number=SeqID_164290
atggttagtcatgctgagcaagggaagacattgctgagcagcaatgtcatccatatcttggtcaaggtagtcatgctggtgcgcatgatccgcactcgcctccctgcagcggtccaggcgaaatcctgccccgatatgcacagcagctgggcgatggcttcctcattgaaatcgtctgcctggctcctcctctggctgaactcacactactggccttcctccaagatcagcgggtctccctggaactggctgagggcatttgcgtcaaagggaatccactgccccctcacccatgagcgcat

SEQ ID NO: 47513 - DNA, 273 bp, Glycine max
  Peptide Sequence Number=SeqID_164291
atgtctagactattacgatctttttcccgtatctcttttcgctcaaactcctcctcctcatcttcttcaagaaactccaatttattaaatgatcaagataaccagacccaagaggtcgccgcaaaacaaaatctcttcgatgaggaagtccgattcgaagatatcaatcaaaacatggatgactggaacattccagaaatccctcaggatcaactatacgttcctgaaacaataaaggacaaatacaactttgattacataatcaaaacagta

SEQ ID NO: 47514 - DNA, 578 bp, Glycine max
  Peptide Sequence Number=SeqID_164292
atgcgggggtactgtatggttatccacaccttttttcatcccgaggcggcaagcccgatgacatgcgggggcggcaagaccgatgacatgtgggggtaccgtatggttatccgcacctttcgtcaaccgggggcaaacaagcccgttgacgcgcagagactaacgtcatcttctgcaccttccgtcaacctggcaaacaaagcccgtgtcgagcccgatgacatgcaggggtaccgtatggttatctgcaccttttgtcatcccgaggcggcaagcccgatgacatacgtcaagtccgatgacatgcaggggtaccgtatggttatccgcaccttttgtcatcccgaggcggcaagcccgatgacatgcgggggtaccgggcaaacgagcccgttgacgtgcagagacttacgtcgtcttctgcaccttttgtcatcccgacccatggagtcagatgacatgcgggggtaccgtatggttatctgcacctttcatcaaccaggggcaaacgagcctgttgacgcgcagagacttacgtcgtcttctgcaccttttgtcatcccgacccatggagtcag

SEQ ID NO: 47515 - DNA, 302 bp, Glycine max
  Peptide Sequence Number=SeqID_164293
atgtcatcggacttggcatctctggatgagaaaggtgcggataaccatacgagggtgcagaagacaatgttagtctctgcgtgctaccagactctgagtctgacggatagcaaaagagtgtgtgcgggttaccgtatagggcgtctccacgtgccaacggactcacaggtcgcgatagcaaaagtgcggggcgagaaaatcgctggcgcacaggatttggttggcaatcaaagggagacgaccactttgggtcgtggtgtcgcaacctacccttcggcgggagggcgacgcgtgactcgcgg

SEQ ID NO: 47516 - DNA, 2382 bp, Glycine max
  Peptide Sequence Number=SeqID_164294
ggcatagcaagcctggaattgcaatctgaatcatgttttgatggtgaaattcctatgactacctgttacaaggatgatgagatttattgcattatcaatgatatcatggattcatctgttggattgactagttcaatagccctaaaaaggtacagggtcattggagaactgctttatcataaagcttgtgagttgtattcgaaaattagtccttttgaggctaatattcgaagacattactttcatgttcggcctcttgatgcaaatcaattgcagaattggcataattatctggattttattgaacctcaaggggactttgactgggctgtgaaactttatgagagatgcttgattgtgtgtgccaactatcctgaatactggatgcgttatgtggacttcatggaagccaagggaggaagagaaattgcaaactattctttagtccgagcgactgaaatttatttgaagaaagtgccagaaatccatttattcaatgccaggtttaaggaacaaataggagatgttttagctgctcgtgctgcatatattcagagtggtaaagagacagattctgactttgtggaaaatgttatatcaaaagctaatatggaaaaacgtttgagtacaaacagtgtggatgctgccggagatgtcttaattgatggtgtcagaactttgcctcaaaacaaattgcttctggaggcgtggaatcggcacataaaattatttccagactctgtccggactgctaaacgtagaagattgattaatttgatggacaagagagaagaggtttttgttgtcatgcctaatcaagcatctagggattctagttctgatttggatgctgcacatttacataaaaaagacaagaaagtgttattgctgaaatattgtgataatcagtctgatgctactaaagatgaattaatgctgacaaaaaatcataatgctcggtctaataatgatacagatacatgcaatcttcaaattatggaatcagaatacaaaatagaagaaaatgggagagaattacctctcccaatttctgaggagccaagagacaatgatcctgaaaataatgtgtcatctgccaatttagtggaagttaaagagcgatcaataaccaagaatttaaaaaatagttgttcttctgaatctgatgtttcatcagaggaattattacgtcaaactgcctgtggaaaccaatcctcacaagctttgcaaataccctctaaggaaaatactgctttttctaagggaacgtgtgagcttgagcctgaagaacttaagccgctttctccgtcaagcatatcattaaacccccaggaaagcacatgtcctgattcaggaccgatggtgtctcaggaggagtgtgatgcaattccggaaagctgcaagtcaaatagtagagcagtagttggtggtcataccacaaatcaagacaactctgcaagcactcaagattccgagtctgcccaaatccccattgaaattaacagtccatattcagcacgccatcgagaccagagagcaagaaaaccacttctgcctccacggtcttctggtaatagtggtggaaactggcataaaatgagaaatgctggtcaatttcgtagaggccccaaatttggctatcggggaaatacacataggaaacagcaccaacggcagcagctgcctcctcaacagattcatccccctgaaaggggttcacaaatggctgtggctccaggttactcttctcaacctgtattgcaaatccagcaatgcaatcaaggacaaaatcagtttcactctgctgctactcctactgattttgcagcagctagttgttggcctatgcaaaacatgcagatacagaacacttcatctcagtctcaaacacctgccaatactacatcacatgtattacaacatgcaatgcaaggcaatgagcgatatggatatatgcagaatgaccaagaatataatcagttatggcaatactatcagcagcaacagcaacagctgcaactacaacaacattatattcaattacagcagcaatcgttccagcagggactgtcacaacaacagctccaacatagcctgctggaacctcttcaaccacaacagctccaacaacaggttctgcagcagcagcagcagcaatactttcaacagcagcaacctctgcagcaagaacaccctgaaaaccttatgcagcaacagcagccatcaacacagagcagcagtcatcccgtagcagaccaagggcaggcaatagtgacattgcagggccacggagcagtattatcgcaacaatcagacaaacttgggccgatttcttctccagttgtgcaccatcctcaagagaaatctacccaacaagagtga

SEQ ID NO: 47517 - DNA, 258 bp, Glycine max
  Peptide Sequence Number=SeqID_164295
atgaaagaatctaagcctttgaatcctagaaaaaccaatgatttctgtagccaagcctcactacaagcctgtgaaagtccttctgattctatttatgcatttctgactttatggtgtcgcaacctacccttcggagggagggcgacgcgaggctcactggtgcgtcttccaagggaggaaaatacgcggagtcgccaccaacgtttattcgaggaaaacgtcgaaaaaaccggaaaaggtgtagtctacgaactttaa

SEQ ID NO: 47518 - DNA, 540 bp, Glycine max
  Peptide Sequence Number=SeqID_164296
atgagagaggaagagcgaagggtcgggtgtgttatgaaagaggattgggaaagtgagagaagtagggagaagctagtagtgggaatagttgttctcaacccggagtcccgaacctatctttcttctcaccctcacctcaacgacggtgcggtgcggtgcagttctctctctcatcgttctctaatggcaccgattctatcatcagccagtgatgacaatcttgatcttcaagaagttatttctaagggctcattagattttgacgaatggactttactgatttcagagatcgagaaactatatcctgatgacgcagagaaaatatgtctggtttataaccatttcttatccaaatttcctttgtgtcatgggtattggaggaaatatgctgcccacatgacatgcttatgcaccacagataaggttgttgaagtatttgaaaaagctgttttagcagcaacatattcagtgggcatgtgggttgattactgtagctttggcatgtcagcttttgaggacccatctgatattcggaggtaa

SEQ ID NO: 47519 - DNA, 837 bp, Glycine max
  Peptide Sequence Number=SeqID_164297
atgcggcccgccaaccggcaacgcatcggcgccgcgctcggctggctcgccatgcggctggccagatcgcgcacccgcatcgtgcgccgcaacctcgagctgtgcttccccgaacagcccgcgcaggtgcgcgaacgctgggtgcgcgaacacttcagggcgctggcgcagtccatcgtcgaccgcggcgtgttgtggtacggcacgcccgaggcaatccaggacatggtcacgcaaagcggcgccgagcgcatcaacgagctgaccgcccagggccgttcggtcatcctgctagcgccgcatttcatcggcctggatgccgccgccacccgcctcaccatggaagtgccgagcgcggccaccatgtacacgccgcaaagcgatccgcacatcgacgcggtcgtcgcggccggacgcgcccgcttcaacgaggtcttcctggtcagccgcaaggacggcgtgcgcgaactgctgcgccatctgcgcgcaccgcggccggtgtactacctgccagacatggatttcggccgccagggctcggtattcgtgccgttcttcggcattcccgcggcgaccctgctggcgaccgcccaactggccaagaaatggaatgcggcggtgctgcccatcctggatttctggaacccggaaacaggccgctaccatgccgaagtactgccgccgctcgagaacttccccggcgacgatacgctggaggaggccaccgcgcgcctgaaccgggaactggaagcctgggtgcgccgctgtcccagccagtattactgggtgcatcgtcgcttcaagacgcggccgccgggcgagcccaagatctactag

SEQ ID NO: 47520 - DNA, 1161 bp, Glycine max
  Peptide Sequence Number=SeqID_164298
atggagcaaaaacacatatttcatggatttcaatatggtgagaaagatcaatggagctcgcttagtgatcagattgttggtgtaaattccaaattgctccaggaggctttacaaagtcttgagcggccagcaaagaggcaagttaatataacaacaacaaaaatgaaagcctgttcccacacagtaggatggaaagttgctgagttggtcggtgccatagaagcaaagcttataaattctatccaaatatcagaggaatattttttaaatggaggtaaaaataagttgtttagagatatgcaagagaagggacttgagctcatgtctaaggggaaaatggctattgtctttctcttgaatgacaaagagcatcaggggagcatttctgactctaacaaggttgaaaatgaagcaattgacacttcggtacttcacatgtttcaaaaggtcaaagatcatgtttctgtgcctttaattttggtttcctcagcccaacaaattcagtcttttaggaatctgtttacaagcaacaattacttcgcatttgactctgaaaaggtatggtttttggaggaagagaagctgccagtaattagcagtttgcccaagggacagaacaaatataagattttaatgaaatcaccttgggaaatactccaatctccagttggatctgggggacttattagcttgttttcaaaccatagtattgcagataatcttattgacatgggtgttgagtacattgaggtttgctgcacaagtgaaaaaatggccggtggaaactctctacttcttgggttgattaattcacgggaagccaagattgggatacaaatttcgcctaaaatcactgattcggaagaaaactttgacttgatattctcgatggactttgtaaagaagttaacgaagcaaagcaacaaactccaatttgatgcaatcccaaaggcacattcctttgttgagaaagttgacaaagaatgggttactctcacctcgtccacccccaattcatatgagctctcttgtagcatatatagttccttaaacgcatgttcgttggataagctaagctttcaagtgtttctacgtcccaacgtgttgttgaaggtggtggatacatgtaaagctattgtaatgtccgaagtcattggatga

SEQ ID NO: 47521 - DNA, 729 bp, Glycine max
  Peptide Sequence Number=SeqID_164299
gactacacggcctcaccttcaaaagggctacacaccatcaccttcagaggaatacacgacctcgcctttagaggactacacgtcctcaccatcagaggactacacgtcctcaccttcagaggagtacacgccctcacctttagaggactacacgtcctcgctttcataggattacatgtcctccctttcagtggagtacacgtcctcaccttccgagggctacacatcgtcgccttcagaggactacacgtcatcacctctaaagggctacacatcctcgcctttagagggctacacagcctcaccttcagaggactacacgtccttgccttcagagggctacacgcactcaccttcaaaagactacacctcctcgccttcagaaggctacacatccttgccttcagagggctacacgccctcaccttcaatggacttcccgtgctcgccttcagaggactacacggcctcaccttcagagggttacacgccctcaccttaaaaggactacaggtccttgcctttagagggctacacaccctcgcctttagaggtgtaaacgccctcgccttcagaggactacatgtcctcacctttagaggactacacgtcttgaccttcagagggcaacacgccctcaccttaaaaggcctatacgccctcgccttcagtgggctacacacgctcaccttcagaagactactcgtcccttccatcaaaggactacac

SEQ ID NO: 47522 - DNA, 468 bp, Glycine max
  Peptide Sequence Number=SeqID_164300
atggacgctctgaggaaacaagccagcaagctcagagagcaagttgccaaacagcaacaggctgtaataaagcagttcagtagtagtggttatgagagttcagatgttgtggtcatcgatgaggtcgaaatgcagagacatcaccagctggaaaagttgtatagggccacacgttcagggaaggacttccagaaggaaattgttaaagcagcagaaacatttacagctataggttataagcatattgaaacagtcttgatagcatgtgttcaggaattagaagcacctacaggaacaaaactttctgaggattgctgtaaatatggagcagagaacaacagtgacaacatattagctaaggctgcatcagtatatggtgatgcccgcaagcatgtggaaaaggagcacgaagaattaaatcggcttttatctacgcaggtggacttttcatatgttgttcaggtgtaa

SEQ ID NO: 47523 - DNA, 924 bp, Glycine max
  Peptide Sequence Number=SeqID_164301
atgccttcaggtgctaggaagagaaaagctgccaaaaaaaataaggcaaagaaaaacagcatcaacccatcaaccaacaagcccaaaggaaatggtgatttgaagtcgcgggatgagaaaggaagtgatggtggtgagggtaattctcctgcatttcgtgaacatggtgaccatcgtaatccattcaatgatgggagtgaagatctggaagagagagggccatcagctgctcaaccacatgctcctgatgtcgtcgggtccctggaagaagttgttagtgatgtcaagattgaccaggtgttgggaggaaaggaagatggtgttgttttggtagagagaggtttgaagtctgaggagtgttttgagagcaaaactgcaagttttgagaatgggaatggtggcaacactccaaagggtcaatccctcgctgagaagaactcaaaggatggaaattgtaactcagttgaagaggcagttgcaagtcataagttggttaagtccattgattcttccccttccaaaatgacttcaattactgaaatgccaccagttgaggagactgttaattcacctgctgactcttctgttaatttagttacagccatggcttctgtgtctgaggtggaaaagagtgatactggaatgttactagagaagtcagtagtccatccagtagaagtgaccaatctcgcaatgaagataaatgacgataacgtatattccttaaccaatgataatgtgacaatgtcaagtgtggaggagcctaagccaaaggaatgtgatagtaaaatgttaacttcaccgtctgctagtcctttcactaaatttaccaatggtaaagaacatattaaggattcctcatgtagcattggctccaaatttggtgcaaaagacctcctggttgagttgctgtggattgtttga

SEQ ID NO: 47524 - DNA, 739 bp, Glycine max
  Peptide Sequence Number=SeqID_164302
cgctcttccctcacaaaccaagcccaatcccaaggaggatttgaaggtggtgagcacaaggagtgggaagccacatgcagaatacaaggaaacagagaaattgaattctctagagaaggaaaaggaggcccccagtaaagaaagtcctactaaagacaaggaagctccaattgagtggagttcaaagatagggaaagaaaatgaggaacctggcagtttcactctgccttgcatgatagggtactctttctttgaaaaatggttgtatgacttgggggcaagcatagttaaggatgtactaggtaaggtagacaagtttgtccttttgactgattttatgacgcttgatatggagaaagatgaagatgtctcaatcatactgggacatccattcctaaatacttgtgacatggtgatagaggttaggcgaggtagcctcattcccaagtgctttggtggaagccttattgttgaggacttgcacaaggatttgagcagtgatggagatgaaatattgatgtttctccaagctcagagtgatgtcaaaccgatgagaaatcaaaggtttgaagagttggaaaggagtagtgggccaaagcctaaactccccattgaggaacctcctacatcatctatcccatcttcgacagtgaatgggaaattgaataaagccattcaaaatgaccatttccattttccctttattgatcaaatgcttgagaaattgtctagtcattga

SEQ ID NO: 47525 - DNA, 885 bp, Glycine max
  Peptide Sequence Number=SeqID_164303
atggcaaaatatgaaacatatctgagagcctcagctctattgctggcccctctcttgatgtgtctctttggagtcactgctgagggtgatttctttgaagatattgacatcacttggggtgaacatggtggtgtaaatatactaggaagcaactctctcgtgctttctcttgaccagtcctctggctctggctttcgatccaacgcagaatatctatatggtagaatagacatgcagattaaacttgtctctggtaactcagctggcacagtcactgcatattatctatcttctgaagggccaaaccatgatgagattgattttgagttcttgggaaatctcagtggagaaccctacatagtccacaccaatatctacactcaaggcatagggaatagagaacaacagttctatctttggtttgaccccacaaaatatttccacacttacactattgtatggaaccctcagcgcatcattttcatggtagataatgtccctattagagtcttcaacaactatgaagccaggggagtaccatttgctagcagccaggccatgaggctatactccagtctatggtgtgcagatcaatgggcaacaagaggagggcttgtgaaaaccaattggtcctatgctcccttcaaagcttactataggaactttgatgctaaagcatgtgtgtggtccaaaggatcatcttcctgtccttcaagcccaccttccatgactcataatacttggcaagctcaagatttggatgctgatggtagaagaagtctgagatgggtgcaaaagtattacatgatttataactactgcaaagattacaagagattccctcaaggtcgacctcgtgaatgcaggctttctagattctcttga

SEQ ID NO: 47526 - DNA, 1200 bp, Glycine max
  Peptide Sequence Number=SeqID_164304
atggacagaatactccttataagactttggcaatcctcctcccttgagctaacttttggaattgaagacgtaaccaaaagtcctggagcatccaagttggccagatctctttttcaatcattacaacaacagattgccaaagagactgtattatttccaaagccagatgatggttttctgacagatggcagtaacttctacaagcttgacaatgtccgaggagaatttcatgaaattcataaggattttagtactcaaagccatccacatttaaacatagatcctttcaagttcaatgttccatcccccgacgatgtggtttatactggcctacgttcttccaaaacgggtttgaaagacaaagctacaaactctaattctcagctttcatcaagcaccagagagaagaatgaactttctgtacagtcaaatgctgaaagttcagacaacttatcatccttaatgcaaaagagcagacaggatagttcaactgagagcaagctttccaaaaaagtagcaattgatctgcaaacaagtggtaaaacttcaaacagcttgccggaatctttgtcaaaagacaaagataacaatattaataaaataaattcttcgaaaaatggtacaattgatattcaatcaagcaaagaaaagtcaggtagtttgtctacacggtcaaaagtcaaggaaagtgataacatcagttcctcttctatcaaagatggaaaacctgaaagtatttccagcagtttcagcaacatggttgtcgatgtaagatttggaaattctgataacactaatgctaaaggaactcactcacgtgtttcttataagccagaaaaatggatgctccctgaacaagctgaagatacattgactcagctgaatcttgcaattgttggccatgttgattctggaaaatcaactctatctggtaggttactgcacctattgggacggatctcccagaaagaaatgcacaaatatgaaaaggaggccaagttacagggcaagggatcctttgcttatgcttgggcacttgatgaaagttctgaagaaagagaacggggaataactatgacagtggctgttgcttattttgacacgatgagatatcatgttgttgtgctcgattcccctggccataaagattttgtcccaaacatgatttctggggcaacacaagctgatgctgcaattctt

SEQ ID NO: 47527 - DNA, 396 bp, Glycine max
  Peptide Sequence Number=SeqID_164305
atggatgacaaaaaggtgcgtaatgaccataatttgtctccgcatgtcatcgggctcaccgtctctgaattacaaaaggagcagaaagaccataatttgtctctgcgagccaccggacataatcgttttggatggcaaaagacacgatcgtatcttgatggcaaaaaggtgcgtaatgaccataacgatcgtctatggatggcaaaaaggtgcgtaatgaccataatttgtctccgcatgtcatcgggctcgccgcctctggatgataacaggcgcagaatgaccataaattgtctctgcgtggcatcggacacgattgtctccgattgtcgaaaagttgtgcggaaggaccataatttgtctctgcatatgatggggctcaccgcctctggatga

SEQ ID NO: 47528 - DNA, 252 bp, Glycine max
  Peptide Sequence Number=SeqID_164306
atgaagcaaacatcatttttgagtgaccactgtagcttctcgcttgaggacaacttagctcatcagtgggctaagcgtgcatccaccgctaagcgcagcttcaatgcgcttagcacgacagaagaatctggcagggcatcatcatcaaggccgtgcgctaagcgcgagattagtgcactaaacgcagcagttgtcttcagccaaactcagcgcatgactggtgctaagctcaaatccacttactcgcgctaa

SEQ ID NO: 47529 - DNA, 337 bp, Glycine max
  Peptide Sequence Number=SeqID_164307
cgcccatccagagggaggccccccaagctccggctcaaaccccgactcgcatggccggcaatgcccactttggcgtcggttccaacgcgataagaaactttcccccaaggccaactcaagaattcagcccgatccggatgacgtacgaagacctcttgccatccctcatcgccaaccagatggctgtgatatctcccggaaggcgagaatggagaactacactaggcaatcactacgcatggctccaaactcgttggtggaggaatcaaacgggaaaataacaaagaccacatttcccagtcaagaggatccacacttgacggtggaggacacatga

SEQ ID NO: 47530 - DNA, 495 bp, Glycine max
  Peptide Sequence Number=SeqID_164308
tgcggcattgtctgatgggatccagaggaaaacgtactactaaagctacaggaagacaggattctgctgctaaatcacagaaaaaagtcattgctgatgttgccaaagacttggatctggaaccggattctgttgaacatgatgtcgatatccaaatggaaaacacagtacaagatgccgaccaacatatacctgaaccaggtattcaagataataacgaaataccaactacatctgtgacggcaatgattgatgaatttgcaaaagaaagagttgctgctcgccaatccgaggttgacaagatgatgatgcaagttcctctgcaggatttatgtgagtacaactaccattcccatgcattatatgaagaagactgtctgcgacacccattcaccatcaagtcttggacccgatacattgcccatctgtctgctcgcaaggcttcatttgatgaaatttcatttatttttgaacgggccatcaaggaacttcctg

SEQ ID NO: 47531 - DNA, 274 bp, Glycine max
  Peptide Sequence Number=SeqID_164309
atggcggagttgcatattcttggcacgctagtaggtgcatccgagttccccaaggcaacactgtgttgtcaatgggagctaacggcaggagagaaatggactcctatagaaggagacctttccggacaaactcatgtagatgtacctttgattagagttcaggtctactatcaagacatgtttggtcgtaatgagttgtatggatacgggtttgcacatatcccgtcatctcccggactgcataaaatcgatatttcaacttggagacctgttg

SEQ ID NO: 47532 - DNA, 190 bp, Glycine max
  Peptide Sequence Number=SeqID_164310
atgcttgttttgagtgttccaaagggagcaaacaaggttttgatgatgccaaagtattacctaaagatggttgtcatcatcaaaagaggagagaatgtgaatgaatatcatgcgagttttgatgatgccaaaaagggaaccgctagagatgacgctatcgctatgggaagacacgtgaatccgcttagag

SEQ ID NO: 47533 - DNA, 424 bp, Glycine max
  Peptide Sequence Number=SeqID_164311
tagccaagatgaggctacttcttcaccttcccctagtgaaagtgaagaagcaaaaggggaagaatcaagtaaagagatctaccccaaagaagaaggaaaacctttaatggttaaggaagagtgtaaggagacacttgttagcattgccatacctcttaggcttgagtttattcctcaagtaaaggagttgttggatgagggggttcccatgaaccctaagagaataaaggtcattccagagtggcccactctaccaacaccactcattgagttggtgagaaaccatgttccttcatgggaagatgcccaggaaatgggtgttgagaaaaaaagcccagagtttcaagaacctcgggatttgaggtcaaatccttttcaagggggagggaatgatgcaatcctaccccgcaagggcattggatag

SEQ ID NO: 47534 - DNA, 435 bp, Glycine max
  Peptide Sequence Number=SeqID_164312
atggttgtcaagtctcacagtgtggcccaacatgtaacagatttagaagaagtgtttggagagatctgcaaatatgacacgcgcctcaatctggagaaatgcaccttttggaatggtagcagaaaattcttgggctttatgatcacccatgggggaatcgaagccaaccctaacaagtgtaaggcgatactaaagatgcatagtgctaccaacttcggagaagttcaaaaactgaatggtagactggcatctttgtccagaccaaagccaagagcacccttgctcctttatctttcagtagctgaggaggccataagctcagccttcgttcaggaagacgggagcaggtcaagcatcatccttgaagggcccaacaatgttactttggagcaggccctcaaatttaatttcagggcatcaaacaaccatgcctaa

SEQ ID NO: 47535 - DNA, 249 bp, Glycine max
  Peptide Sequence Number=SeqID_164313
atggaatcttcccaagttcccattgattcaaattccaacagttctgcaaataaaattgaagaaaaagctggagatggaaatactcaagccattctcttgatgaagttgagcaatgatatgcagcacaatatcattaaggataggaaaagagggggtgggcgaatagaaaaagaaaggacaaatgggcctcagaaacaaggcctgcttgtgtatgagactagaaagaatcagcggtacaagttgaactag

SEQ ID NO: 47536 - DNA, 321 bp, Glycine max
  Peptide Sequence Number=SeqID_164314
atggtgcaatcctaccacccaagggcattggatagaagactccaaaaagatggggccatagatgcaggagaaggccctagggttcttatgagctttatgtggcgtctccaatcacctttcctccttctccattccgctgccattattcttcaaaaagtaaaggactccattgatgaagaagatctaaggcctacaagctctacttggagctacatcaaaagggattcattccgtctgaagcaagaccaagccttaggtttcttggatcctgtccaaaatccatatacaagcgatcaattatcttccattggggagaattaa

SEQ ID NO: 47537 - DNA, 429 bp, Glycine max
  Peptide Sequence Number=SeqID_164315
atgggactggcgaaacctccagataggccgaatcatgatgtcgatgatcccctatatctaatgacattgaccatcacacaactttttcttaagtcattgcaggttatgtgggatgttattgtgtttggggtgtttaatgaaaatttccccttgtacataaagcatgaagatctatctgaaatagcacacggtggtcaatgtctcagcaactctgttatacaattgtggattctgtcagacaactacctcaaaggaataattaacaagtcagttctatttttcaatacatttgcattagcactagtcgggaacatcaatattttaattgtacaatatgaatccatgtttgcattgaacaattctttgaaaggtcttgacgatactccacaaagtaaatccaaggctgctgctaggtggattgttgttaaa

SEQ ID NO: 47538 - DNA, 234 bp, Glycine max
  Peptide Sequence Number=SeqID_164316
atgacaataggcaatgctctagcctttgtaaatcagttgagatggattctggaggtgggttcctctcggtgtggggtttcaatggagaacaatggcggtttgtggtggataatggtggtcatgggtgatggagaaagtccttgggacgttagaaatggctttggaagaaagaaagaagaagaaatgacgtttttcctaagctacacgaaagcaaaggctgacacgctcaagtga

SEQ ID NO: 47539 - DNA, 246 bp, Glycine max
  Peptide Sequence Number=SeqID_164317
atggcatcattgactgatgtgctgcctccatttgttgcatttgctcaagcatttgtggttgttcttacagctatccttactagttctctctattacatggatgcctctcctaaaggcaaggaatggatatttcaatttcgcttctggccaaacaataacagcaaaatgtatgttttagagggtgtcactccatgcatacagtccatgcagttgcaggctggagatattggtaagacgttgtcatga

SEQ ID NO: 47540 - DNA, 2316 bp, Glycine max
  Peptide Sequence Number=SeqID_164318
atgggaattcaggggtttttgccgctattgaaatcgattatggttccagtccacatcaaggatttgaagggttgttctgtagcggtagacacctactcttggctccacaaaggtgccctctcttgcagcacggaactctgcaaagggatgcccactaccaggcacattgagtattgcatgcacagagtaaatttgctgcgccattttggggttaagcctattctagtgtttgatggagggcttctgccgatgaagagtgaacaagagaacaagcgtgccagggctagaaaggataatcttgcacgtgcagttgaacatgagtcagatggaaattcagctgctgcttatgagtgctaccagaaagcagttgatatctcacctcaaattgcatgtgagctaattcaggtcttgaagcaggagaacttgcagtatattgttgctccttacgaggcagatgcccagatgacattcttggcaattagtggacaagttgatgcagttataactgaagattctgatcttataccatttggttgcccaagaattatctttaaaatggacaagtttggtcaaggtgttcagtttcagtattccatgctacaaaagaataaggagcttagttttgaagggttcaacagacaaatgcttcttgaaatgtgtattttgagtggctgtgactatctgcagtccttgccaggtatgggtctcaaaagggcccatgcaagcattaaaaaatttagaagttatgacaaggttcttaagcacttgagatacagtggagtttccgtgcctcccttttatgaagagtcattcaagaaggctatatttactttccaatatcaacgggtttacgatccaattaatgaaaatattgtccatttgtctaatatacctgatgatattggtgatgactataccttaacctgggatacacccatgccaaaagatatagcacaaagaatagcaaaaggggatcttgatccaattaccaaaatgccatttgagggagagaatcttacagccagattagcaattgcaggaactagtcaattcaagactcaccattctgaaagtgcaaagaaaaagattgatttgcccgtgcagaagaatctcttgactaaaggaggaatgcagggtaatattctattgttcaccgggatactgcctgatgctgttgatgctttaagtaacgtttccttagccatgaaaggttttgcttctcttgaagcgaaaaggaaattcagagctcctcgggtgtcacctagtgctgctaatgaaacaaagaattctactgcatcagtaattgactctgaggattggggcagtgtccctcctcctaatagccatgttgaatatggttctgccacaaacatttctgaatttacagagtctccatgtcacatgtctatggtgggtgaggagaagaaaagccctgaacatacagtactgcgacagcccaggcagccaattcataaaccatgcctggggttgcataaggatcatgagcacacaaatgtcgaagacacagttgaaggaaaaaccagggaggcaacacaaaaggtaattgtaaggagtgcttattttcagcacaagcaagtggaaaagaatgtttatgatgagaaacaagattgcctatcctctggcgttgtcattgataagagaaaaaatgccttatctgatagtgatttttgtaacaatgatttcaagaataaagaccaggtagtccatgacttacttgaaggaaaaagcagggagggaacaagaaaggtaattgtaaggagtgcttattttcagcacaagcaagtagaaaagaatgtttgtgataataaacaagattgcctgtcctctggcattgtcattgacgagagaaaaatcgccatatctgacagtgatttatgtaacaaccttttgaagaataaagacctgaaaaggaagatctcccctaatgacaatattcaaaatgaaaatttgcagcccaggcaaatgcaccgttcttcacctcctcataataatggttgctgcgatcacaatgttgacggaccatttacagagaataatgctgaagaagaaaattttgggacaaaaatttcccatctgggccagtattcagaaatagctgagaagtctatggaaagatttgtctccgttatgtcatcctttagatgcacttctggcactcgagtcagtggtctccgtgctcctctgaaagatgttcgaaacacttctggtaataggccaaaaaaaactgtagactttggtcaatatgcatatgtgccaaaacaaaccaagactagaagaatagctcctgggaattaa

SEQ ID NO: 47541 - DNA, 2684 bp, Glycine max
  Peptide Sequence Number=SeqID_164319
gtgtgcaactattcacgtgtttgtttcataatgtgattgaggattatccatccattgttgaatatttgaaggccaagcgtatgccagggaacaattttaactgcgtccctttaacaccaaggtctagattggaaaggcttctgagggaaagagagctaaggaaatccttcaagcttgttcaaccgaccgaggaagcaagagatggcagcaaagagggagaacaattttatggtgattcatacataagtgagaatgaaatttcaggtaatcataaagaggaagaggtcacggaaacgaatgcggatgcaagaggttttacaggcaaacaacgcttgttggtggtagctaacaggttgcctgtgtctgctgttagggagggtgtggagtcatatcgccttgatatcagtgtaggagggctagaatttgataccagatggattgggtgggctggtgtgaatgtgcctgatgatgttgggcagagagcattgacaaaagctttagctgaaatgcgatgcataccagtatttcttgatgaggagatagttaatcaatactataatggctactgcaacaacatcttatggcctctatttcattaccttgggcttccacaagaagatagacttgctacaactcgtactttccaatcccaatttgatgcatataagaaggcaaaccaaatgtttgctgatgtagtaaataagcattatgaggaaggagatgttgtttggtgccatgattaccacctaatgttccttccaaaatgtttaaaacaatacaatgacaaaatgaaagttggttggtttctccatacaccctttccttcctcagaaatacataggactctaccgtccagatcagagctgttgagatctgtacttgcagctgacctggtgggcgcttgtactcgtattcttgggcttgagggaacacctgaaggagtagaagatcatgggaaactgacccgtgtggctgcgtttcctattgggattgactctgatagattcactcaagcccttgaactccctgaagtccaggaacacatgaaagaactaaaagaaagatttgcaggccgaaaggtaatgttgggtgtcgatcgtcttgatatgataaaaggaattccccaaaaaatcttggcatttgaaaagttccttgaggagaattcacactggcgtgataaagttgtcttgctacaaattgctgtacctactaggaaagatgttccggaatatcaaaagcttacaagccaagtgcatgagattgtaggacgcatcaatggaagatttggtacacttacagctgttccaatacaccatctggatcggtcacttgactttcatgaattatgtgcactctatgctgtaactggagcagcacagtctcttggtgctggtgctatcttggtaaacccatggaacatcacagagatagctgcttctattggttatgcgttggaaatgtcagctgatgaaagagaaaaacgacatcagtttaatttcaaacatgtgaagactcacacgtcacaggaatgggctgcaacttttgtgagtgaacttaatgataccattgttgaagctcagcttaggacaagacaagttcctccattacttcccaacaaagtggcagttgattgttactcaaaatccaataaccgattaatcatactgggtttcaatgccactttgaatgaaccagtggatgcccttggaagggctgcggccgagctgtcctggacaaagtactatcaagaaaacttcatgtgtttttggattttcagcaacaatttctttcgaactaacaactactttgtgcagaacttcagtgaatttaacatgtggttggcagcagaaaatgggatctttttgcgacatacttcaagtgagtggatgacaaccatgcctgaaaatttaaacatggattgggttgatagcgtgaagcatgtttttgagtattttactgaaagaactccaaggtctcattttgagcttcgggagatgtcaatagtatggaattacaagtatgcagatgttgagtttggaaggattcaagcaagagatctgcttcaacatctgtgggcagggccaatatcaaatgcatctcttgatgttgtccaaggtggtcgatctgttgaggtccgcacaattggcgtgtcaaagggagcagctattgatcgtatccttggagagatagttcataaaaaaggcatgaagacaccaattgactatgtcctatgcgttggccactttctagccaagtctggtagctatcctaatgatagaacatccattgataaggatgaagatgtgtatcaattttttgagccagagctaccatctgaatcacctccagtaccaagagctatgctatccaaatccaattcttacaggccatcatctctgtcaaaattaccagccaccaccaaaaccagttcgaaggcagctcaatacaagaaacaacgttcgttgtcaaacatagaaaagagagaacttgatcaatggagaccaatgtgtggtgataaaatagcactgcatgagggttcctcagtgcttgatttaaaaggtgataattacttctcttgtgttgttggacggaaaagatcaagtgcacgttaccttcttaaaacctcagatgatgttgtcaacctcttacgtgacttggcagaacattcttcttcaccaacttaa

SEQ ID NO: 47542 - DNA, 471 bp, Glycine max
  Peptide Sequence Number=SeqID_164320
atggggctttcattctcagtccctgaaggagtcaaagtcccttccagtttggtaaatatatttaaggagcttcaccaagaccttggctgctctattccaactcatggaaatcttcaaaaatgggctttgcagggtgttctcttactcaatgctgttctcacagtcaggaagcatcatgcgaattctcatgccaaaaaaggctgggaacaatttactgatggtattatcaaagacaatctcacagaagatggaagagttgtgtttctgttgtggggaaacaatgctcgggagaaatctaggaaccatcgggtttttcgggaccaaatgtggagtgaagagtttctagctcgtctaaagaagctggaagaagcatggaaagctgctaaaaatgttggtgacaaatttccggccaataccgtctacaacaaaagcaaagagccaatgaaatggattccggcaggggaatattga

SEQ ID NO: 47543 - DNA, 741 bp, Glycine max
  Peptide Sequence Number=SeqID_164321
atggagtattggagttggtcacttggtgtgggccaatggattatatgcaaggctgctgagaaatttactgagtcactcttgagtgacttttcttttgcaaaaactaaaaaatggactgtgggtttgatcttccaccgcctgtccatagactcctcgaccccaccgcctgtccttcacctgcaagtcctccttcctaagatgatgaagttgagacttagatctttagaatccaaagaaaccctcaaaatcgaagtccttgattcttgttctctgtttcaactcaaagacactatttctcgcaccatttcttcttcttcctcttttctgcatatttccctcaacagaaaggacgaaattcatgccccttcatcggaagagcccctcaactctctcggcgtctccgccggggacctcatcttttactctcttaaccccaccatcttaaccctcgaaaccctcctccacaagctagaaactgctccccgcgatggacccaccatccaagactcaccagaaaccctcaccaatgactccacctctgttcccgatgccaaaaagcctccgactttggacaccgcggaaccgaaatccatggaaattattgatgggtctgacgagacggtggtggtgggtaccaattccgagcctttcttcatgacaagggtcctgaaagaagcgcttgggaacaacgttaatgatttcaagttattagtgtttacggttcatggtgttgttctttaa

SEQ ID NO: 47544 - DNA, 492 bp, Glycine max
  Peptide Sequence Number=SeqID_164322
atggttcagacatactcaaaaggggtgaattatgcatccggttcagcggggattcgcaaagagaccgggtcacatttgattgaacaactcactttaaaggatttggatgaacttggggcaaggaagtttgctttgataggcgtggggcttataggctgcatagtccacaacaagtctctattcatgggaaagctgggtcaatatgggttgacgagcacattgaagcatcactcttttttaatgaaaagcttaaatcagttgttgatcgtttcaataaagaattacctgatgtcatatttttcttcattaacagtgctgtggtctcacaggatatggcctcagctcaaagtaccccaaagttaccagggatttcagaacttgcttgagggaaaaactattatggttgtagatcacaacactcctttcaagcttccacatagagctgagtatgtagatgttgaagcaacgaagattgcaatttcagtaagatga

SEQ ID NO: 47545 - DNA, 369 bp, Glycine max
  Peptide Sequence Number=SeqID_164323
atgtcgagcgacccgatatattatgtcactcaatcggacatccgagaaaaaagttattgtcgtttgaattggcttagagcttcaattcaattcaatatattacgggactcaatcggacatccgattaaaaagttattgtcgttagaattggctcaaagcttaaacattcaatttcgagagtttcgttatattacgggactcaatcggacatccgaagtttcaacattcaatatcgagcgtctcgttatattacgggactcaatcagacatccgagtaaaaagttattatcgttagagttttctcagagcttcaactttcaacttcgagcgtctcgttatattacgggactcattcggacatccgagtaa

SEQ ID NO: 47546 - DNA, 648 bp, Glycine max
  Peptide Sequence Number=SeqID_164324
atgcaaggaaaattttctgatttccaaattacttaccctcaacatgggttaaggatacaagatagaaaatccggggctagtcatatcgaaagcccgtgcactgtttgcgtcaaagcttcaattgagaggtacaagaaagcaagttcagattcatctagtggtggacgatctgcttctgaggctaatgctcagttttatcagcaagaagcagccaaactgcgtgtgcagatcagcaatctgcagaatcacaataggcaagtggcattagtcgttcacaggatctcaagtattactccaatatttggtaaacatgttttgaattgcaggcaaatgatgggtgagggtttgagcaccatgaatggcaaggatctcaaaaacctagagactaaattagaaaaaggaatcagcagaattcgttccaagaagattgcacaggagatatacttgcacaatgacaaccagcttcttagagcaaagataggagaaggtgagaggagtcaccataatgttaacgggttgtctggaaccacaagctatgaatcgatgcaatctcagtttgactctcgcggcttcttccaagtgactggattacaacctaataataataatcagtatgccgggcaagacatgtcccttcaatttgtgtaa

SEQ ID NO: 47547 - DNA, 447 bp, Glycine max
  Peptide Sequence Number=SeqID_164325
atggcttttccaaaccaatccatgtcatcagagtctccccagagaaagatgggaagagggaagattgagatcaagaggattgagaacaccaccagtcgacaagttaccttctgcaagcgcagaaatggcttgctcaagaaggcatatgagttatctgtgctttgtgatgcagaggttgctctaattgtcttttcaaaccgtggccgcctctatgaatatgctaataacagttttttccatgttagaaatattgtttatgctgcttctgatggagttaagcacaaagaacctaaccccttttgtgatttcttgatttggtgggcacatagatctggtgtacgcgatagatatagaagcactatggttgttaactatagtagcacgaggaaaggatttagggaaattatgaaggcctgtgagatcagccaatccctaaaactctcataa

SEQ ID NO: 47548 - DNA, 156 bp, Glycine max
  Peptide Sequence Number=SeqID_164326
atggaagattggaacaacctcttcacccctcaaagactaatcaagctgaatcaagttaggaagaatttgaaaagaaaagtagtagaagaaaatgaaagcttggaacagcctcttcacttcacccctcaagaacttaatccaacattaaaatcatga

SEQ ID NO: 47549 - DNA, 234 bp, Glycine max
  Peptide Sequence Number=SeqID_164327
atgttgtcatgctctttgatggattccatgacttgccgacaaccaaagcccgacggtgttgaggctaccgtagaacttcctatggtatcaaaaacaatcttggatctgattttgggggaggagagcttcctgcagcatttggggcggtggtgggtacgtctggacggagcctccggaggtgctcgagagtggccggaaacggaaaagagtctgcagcagaaggaggaagagtag

SEQ ID NO: 47550 - DNA, 555 bp, Glycine max
  Peptide Sequence Number=SeqID_164328
atgaagcttggtttctttatggtctttctagttctctatatgatactggaacgagggatcttgttattaccccaagtagaagctgctgctgctgatggatttgtgaaagtaagaggggtgcagcttatgttgaatgggagaccctactatgctaacggttacaatgcatattggctgatgtatatggcctctgatccatctcagagaaacaaagtatcatctgtgtttcaaaagggtacaaaccatggacttaacatagccagaacatgggctttcagtgatggtggttacaagcccctacaatactctcctggatcctacaatgaagacatgttccgggggctggactttgtgatatcagaagccagaagatatgggaccaagcttgtgttgagtttggtgaataactatgataactttggaggaaagaaacaatatgtggactgggcaagaagtgagggtcaggccatagattctgaagatgatttcttcactaaccctctagtgaaggaatactacaaaaaccacgtcaaggaaaaacgagggagggactag

SEQ ID NO: 47551 - DNA, 759 bp, Glycine max
  Peptide Sequence Number=SeqID_164329
atgtggatctccaacaacaagtggttcacagaagatgctcatatgaatctctttggtttgctccaggattatagttggcagttaggtactaacaatatcttcaagcagctcaaccttcctagcatgcttccaccttatttggttaagcttcctcacctcagacatgttgattttgctttgaactacctaagtggtacgatcccaaaggagtggggttcaacaaaactaactaatatctctctatttgttaatcgtatatcaggggaaattcctaaggagttgggaagtattaccactctaacatacttgattttatcatccaataaattgtctgggaagttacgggtgacatttgctaagtttcagaatttgacagatttgaggattggtgacataaatggtccaagtcaggactttcctatgttaagaaacatgacaggaatggcaatattggttctgaggaattgtcatattactggagagcttcctatttacttctggagtatgaaggatttgaatatgttggacgccagtttcaataagttggttggggaaataccagtcgctgcgcatgtggggcatctgagatttctcttcctaactggcaacatgctaagtggtaatgtacctgagccagtcttgatggatggaagcagtgttgacctttcttacaacaattttatgtggcaagaaccagatcaacctgcttgtagagatgacctgtcagaatgcaaagtctttcacaataattattcctga

SEQ ID NO: 47552 - DNA, 636 bp, Glycine max
  Peptide Sequence Number=SeqID_164330
atggagaaggagaaggtgaaggatgagattctggagtacatatgtggtcgtcaccaaatgggcccttctactattcctattatattcggcccaactggccctttagccgataatgtgctcatcttttttggatctaagaattatgcttctaataatgtcgttgtgaattatgttagagaccgaacaagtggcgaattattaacatgtgtaaagcataaagagaagatttctttcattacaaaatttcaattttataaacctgggctaggaccttgcacaccaccatcttccccggctccgacgcctcccacctcttcaacctccactctgccaccactcgcctcaccctctcccgtgccatctccgcctactccggcgtcttccacgtggcctccccttgcaccttcgaggaccccacaacgtcctaacctcctcaatctctgcaatgctagcaacgacgctgatcatggaggtggcgaggaaggagaagacgaactcggcggagttctggaggaggatcatgacgacgtcacccttgcggattccgaggttggacaatccaacgacgatcttgcgggaaatgaggtgcgtctcggcgtaggtgaaggttttggcggcaggttctcgaagcagtag

SEQ ID NO: 47553 - DNA, 696 bp, Glycine max
  Peptide Sequence Number=SeqID_164331
atggcttgggaactcatgaatgaaattagatgcccttcagatcaatcaggaaacacggttcagggttggattactgagatggcatcttatttgaaatccatagatggaaaccatttgctagaagctggtctggagggtttctatgggctgtccaagcaagagtctaatccgagcttccacgtaggaacagatttcattacaaacaaccaaatccctggcattgattttgccacagttcattcataccctgatcaatggcttccaggttcaagtaatgaagaccaaatcttatttttggttcgttggctcaatgatcacatacaagattcacagaacattcagaagccagttctgtttgcggagtttggagtagcaacaaaaaatatcagtactgactcaacattaagggaccaatttttcaacttggtctattctgcaatctattcatcagcaagtgatagcggggcagctgttggcggcttattttggcaacttctagctgaaggaatggattcttttcgagatggttatgaagtgccattagatgagagctgctcaactgctactttgattgctcaagagtctgaaaagctaaacagaatccggatgaagatatttcccagagtgaaaaattctaagaagtggaacaaagcaagggaagttagaatcccacgatggcagggtggtgctaattaa

SEQ ID NO: 47554 - DNA, 579 bp, Glycine max
  Peptide Sequence Number=SeqID_164332
atggagtttgaagacacacttggttacatagctaagattcactcccaagatgaaccttatggcatatgtaggattgtccctccagcttgctgggtaccaccttgccttcttcaggagaaagatttatgggaaaatgcaaaatttcccacttgtattcagcaaattgacttgcttcagaatagggaacccacgagaaagaaaattaggggaaggaaacgaaaacgtagaaagcagtcaaagatgggcatgggtacgagaactgccaaatcaggttctgaagctaatgttgcttctgagcctgaggagaaattctactttggattgaatgatgccaatgaatatgaaaaagttagtgatagtagtcaccagcacagatggaaaccctttgtggaggaaattgaaggtgaatactggcgaataatagagcaaccaactgatgaggttgaggtgtattatggagctgacttggaaattggatcacttggaagtggttttcctaagacattatccttaactaagaatgagtcagatagatatgccctgtctggttggaatctgaataacttcccgggactgtaa

SEQ ID NO: 47555 - DNA, 408 bp, Glycine max
  Peptide Sequence Number=SeqID_164333
atggaagcagaaacgcaaatgacacaacaaaagggagaagaggcttacctcgatgtcgatggagcagtgcaatgcacgtcctcaatgtcggaagagaaaaacctccaaagcaccacgaacacactgacaataatgctgaagaagaacacacagaagaagaataggctcaagaagaagattcacagttgtagaaggaagaagaagggctcaagacgcagtcgcgagaagaagaagaagaggctgggtgcacaaatgttttttaaaaaagggcagggagtttgtcttcatgtggtcagtaagttttatattccgattaatggcctagaaatggcggagacgtcccgagggaagatggagggaaaaaaagaagaagatgtcggtgtcgtgttatggtctggtgtgaggtga

SEQ ID NO: 47556 - DNA, 733 bp, Glycine max
  Peptide Sequence Number=SeqID_164334
aggatcccacagaggactacacgtcctcaccttcaaagggctgcacgtcctcgccttcagagggctacacgccctccctttcaaaggactacacgttctcaccttcagagggctacacgccttcacctttagaggactacacatcctcaccttcagagggctacatgccctcaccttcagaggactacacatcctcgccttcagcgggctgcacgctctcgccttcagaagactacacatcctcgccttcatagggctacacgacctcaccttcaaagtgttgcacgccctcacctttagaggactacacgtcctcaccttcataggggtacacacccttaccttcagaggactacacgtcctcgccttcagagggctacacgccttcgccttcaaagggctacacgcccttgccttcagagggctacacgtccttctcttgagaggattacacgtcctcaccttcagaggactacacgtcctccccttcaaagggctacacgccttcgccttcagaagactacatgtcctcctttccagagggctacacgccctcacctttagaggactacatttcctcgccttcagagttttacacaccctcgcctttcgaggactacatgtccacgttttcagagggctgcacgccctcaccttcataaggctgcaccacctcgccttcataggactccagatctgtgcctttagagaactcaaggtactccgcccttaa

SEQ ID NO: 47557 - DNA, 303 bp, Glycine max
  Peptide Sequence Number=SeqID_164335
atgattgccaaaggtgctcaaccccttcccctaagcctccaacgtccatttatagaaaaatgggggaggaggttgctgcctagctcgcccaggcgagctggaggcttcctcctgaaacaacatgctcgcccaagcgagttggttgcttcataccgaccattagctctattagcgaaacctgtcaaaagaaagagcataaaagacatcaagtgcatcagcaaaagccttggtgccttgaaatcgataaagatggataaccgtgatggtctccgcatgccatcggacttgattgtcttcggatag

SEQ ID NO: 47558 - DNA, 321 bp, Glycine max
  Peptide Sequence Number=SeqID_164336
atgacgcaatttatgttcagacaagaaaaatactgtgtagaggttgaagctcaagagaaaagccctgtaaaagagcatgagtcaagagaaaaagatgaggagaaagatgagaaacaagtacaacaacaatgggagaatccttttgctaagcgcaagcctcacgctaagcgcgtctttggtcatgtgttaagccgagagtctcaagcgcttagcgatcaacccttgcatctgaggctgatttggtccgctaagctggccaaggatgagctaagccaacttcaattcgatctgaatttggctaagctgcagcctgatcgctaa

SEQ ID NO: 47559 - DNA, 656 bp, Glycine max
  Peptide Sequence Number=SeqID_164337
gatacgtaggagcaaaagcctcgcttttgtcgactgccccacctttccctatcatgacctgtgagtccgatgacgtgtggagataccgtatggttatccgcacctttcgtcaaccaggggcaaacaagcccattgacatgcagggactaatgtcatcctctgcacctttcgtcaaccaggggaaagcgagcctagacggcaagttcgatgacatgcgggggtaccgtatggttatctgcacctttcgtcaaccaggagcaaaaaagcccgttgacgggcagggactaatgtcgtcctctgcaccttttgtcaaccaggagggaagcaagccctttgacgcgcagggactaacaaacggcgagtccgatgacatgcgggggtaccgtatggttatccacacctttcgtcaaccaggagcaaacaagcccgttgacacgcagggactaacattgtcctctgtacctttcgttaaccaagggggaagcaagcccgttgacgtagatggcaagtccgatgacatgcgggggtaccgtatggttatccgcaccttttgtcatctcgagatggcgagtccgatgacatgcgggggtaccgtatggttatccgcacctttcgtcaaccagaggcaaacgagcccgttgacgcgcaaagactaa

SEQ ID NO: 47560 - DNA, 1140 bp, Glycine max
  Peptide Sequence Number=SeqID_164338
atgatcgacggtgtagcaatatacaatattgtggcggctcttgtgccgctatatgtgcccatgatattagcctatgcctcagtcttgtggtggaagatcttcacaccggaacagtgttccggcataaaccgcttagtggcactgtactcggttccctttcttaatttcaatttcctagcctttaacaatccttatgctatgaacctcaggttcatagctgcagacactcttcaaaaagtcatcattttgggcgctctttttctatggagtgctttcacaaagtgtggtaacctcgattggaccatcacgcttttttctctttccactctaccaaacacactcatcgtgggcgtccctcttctgacggccataggcgccaagagcctaatttcgaaccaattccccgagaatggaggctccatcgcctcgtttactgttgattctgatgttaactctctcaacggtaacgagccgctgcaggccgacgtggaaatgaaggaaaatggagaacttcatgtggtggtgaggagccattcattcaacaatgactctccttgtaactgttcaacgtcaaaccattgtagcgaggcagagatctgttccatgcaacgatctttgagttttaatacaacacgtgatctcaaaagagagggttctaaagaggagatgtcgaagatcgaccaggaaaaaatgtccaggaaggacgcttgtaatcacctttctaatggagtgaaacatgaatcgattgacatgagtcctaatcttaaagcaatgggagacaaagaggttgggattgtgaatgtggtccaatatcctttaagtgagggcctaaaagaggagaaaattgaagaaggagatgcatacaaaaagcagcagcaaatgccacgtggtagtgtcatgacaaggcttgttctaaccatggtttggaggaatctcattagaaatcctaatacctacgcatgtgttttaggactcgcatggtctctcatatcatttaggtggaacatcaaaatgccatcaattgcaaaaggttccattttaatactgtcaaaaaccgggaccggaatggccatgttcagtttgggtactagccttcaacattttttttctttccttcctgacgatgtcattttcaactaa

SEQ ID NO: 47561 - DNA, 444 bp, Glycine max
  Peptide Sequence Number=SeqID_164339
atgacatcaaatggagttgtcgctagcgaatacggtggtaacagcttcgttaacggttacgcgaacaacgttatggaaagtgaggatgcaaatagaagcttggtaaagtacgtgaatgacaatggtgtagcagcgaaagtggtggaatattttgcggaagctttgaagtggaaggaagatggaagaaagaagaggttggaggagattggtaaaggggatgcttggttaaaaaaacaaaccggggaagcaccaattgagaaacccattagccaaggagtcgtaggtgccacactagtggtggaggagctaggacgtcggaaggaaaattttggaaattacatggaagtgactttcaggaaaaggcagtttttaaaaaagataaaacttccatcaaccgccaaaaaccacatattcatcaaccgccaaaaaccacctgttctttga

SEQ ID NO: 47562 - DNA, 633 bp, Glycine max
  Peptide Sequence Number=SeqID_164340
atggacctagaggtggttggtagtgctttgaaaaagataagagatagaataaaatatgtgagagcatcagaggcaagaaagattgcattcaaagagtgtgttcttcaagtgaggggtattgatgctaaggtgggtttgagaatggatgtagccactagatggaattccacttatgttatgcttgaaagtgaaactaagtaccaacatgcttttggttgtttggctatccgagatagaaactatgttcattgtccatcaaatgatgaatggaaaagggctgaaaaaatgtgtgagttcttgaagccctttaatgtcatgaccaatttgatttcaagcgcatcttatccaacatctaatcgctactttatgcaagtatggaaaattgaatctttattgcgtgaatatgttgtgagtcatgatctagtgattagagtgatggctttgaaaatgtttgccaagtttaccaaatattatcgtgagtattatgagattcttgttattggagccattcttaacccacggtggaagttcaaagttatttggtttgcttatactaaaattgatccttctacttgcgaagagaagattatcaatttaaggaaaaagattgaaaattgtttgacgaatatgtga

SEQ ID NO: 47563 - DNA, 183 bp, Glycine max
  Peptide Sequence Number=SeqID_164341
atgagagagacccagtcgagctatggtctgctccgctttaagcctaaaatacccaagacatggaggagcatgatagcagagtgggtttgcaagaagagcagtgacaacagtactctagacacgacggtgagtgtgacttccggtgagcacgaaggtggacacagggttggagaagcgcaatga

SEQ ID NO: 47564 - DNA, 609 bp, Glycine max
  Peptide Sequence Number=SeqID_164342
atggaattggacaagtatggtgactcgctttaccggtgtaagtgtgttaaggttgttgctcttggccacatgtgcactgtgatcaagagggttgacccgagtttggcttatttagaacaggtcagacaacacatggctaggcttccctctattgatccaaatacgaggactgttttgatctgtggatatcctaatgttggtaagagctcgttcattaacaagattatgagagttgatgtggatgtccagccctatgctttcactaccaagtctctctttgtaggtcatattgattataaatacatgaggtaccaagtaattgatacgccagggattttagataggccttttgaagattataatattattgagatgtgtagtatcactgctctaacacatttgagagctgcaatcttgtttttcttggacgtctctggatcttgtgacttgcagccactagaggggatatcaaaggaaaacatgaagttggtcaatgagatgaaagctgaagccttgaagactctagttggtcaaggaggtgagcctacagacaataacagtgtattgttgaccgtgagcactttgacagaaaaggagcaattgctgtga

SEQ ID NO: 47565 - DNA, 1137 bp, Glycine max
  Peptide Sequence Number=SeqID_164343
atgctagatactcctctaggtgaaagtgctcctctgatgctgaggaaattaagtaaacaactgagtagtgaggattggacatggaacaatttgaatacactctgttgggcaattggttctatatcaggttccatgatggaagaacagattgacaggaaactggtcaaacagacagtgaggacttcagtttatggtgttacctttgttggggcacgagagcaaatcaagagaagattagaggagaaaggtcttattactgatgaaaaacttttatttgctgcagcttgctatgctgctaaagtgacattaactgcgcttggagaaatttttggtgctgcacgtgtcattatgggttggcttggtgattgtgcaaaggtaattgcttttgaaaaccagcctgtttgttggaccactcctcttggccttccagttgtacaaccatactgtaaaactgaacggcatctgattgcaagggaagtgttggatgtagctgctccaattattcagcctagtgtgacgactgatgagattgacagagttgttcatgcggcaactattgctgcaagtgctaattttaatgttgaagctgtagcagttcaattgactcaaagggaaggggaattaatacaagagaagtctgaggtgaagaagctaacaaattttcttaagcagtttaggctggcctatgtttctcctgagtcaacagtggttggtgctggacatttagttgatcatcccaagaaaattgcccttcattacttgaagggacagtgcctacgtaagactattcttgaaagcaagcttaagacgtgtaggcactgtcttagaaagttatcttctaagacaatgtcttcgtacccgtcgttgaaagttaacactttcaacgacgtgaccttctatgacgatcaacaactgtcgttgtattattccataaaaatgattatcttgaaatttgccgttgctacaaggcaatatatgagattccatctgtcaaagaaaattcctgtcgagtggatttcaatcctgaggaaaatatgttggtatttggttttatcaccgcatgatccaatgcagtcaagtcttatcaattctaccttggagaataagaatgttaaacaagtggcctcaataacttaa

SEQ ID NO: 47566 - DNA, 201 bp, Glycine max
  Peptide Sequence Number=SeqID_164344
atgggtggaaccatttctttgaatattcacttcaaacaacatactgcatggaatggtgttgctcttattgcacctttgtgcaaggtgtatctccttgaatttaaagcaccttataatgtgttactctacaatgataaaccaagactgggaactgctgaaagccacacaggagctagaacaacatttggaagaagtaaatga

SEQ ID NO: 47567 - DNA, 813 bp, Glycine max
  Peptide Sequence Number=SeqID_164345
atggatttggaggtgtttgcactcatcctctatatccgttcttgtcaatggaagcccaatggaggagttttgcatgaaaaaatgaataagacaagcttggtgagggaagccgaagataaagatttacttgcgggggtgaaagttagcaatgggaacttgaagttgccattactccaatatgtggacgatgcaatattcttctttagaaaaggcattaaagatactatcaccctcaaaacaatattgagatgctttgaattggtgaccggtttgaaagttaacttctccaaaagtagcttggtgagtatcaatgtggatcaaagggattgcttgtcttgtgctagaatcctaaattgtaataccatgagcttcccttttacatacttgggattaccggtgggagcggatactaggaagatctctacttggcaaccagtcattgataaattgaagaagaaattggcacaatggaggaggagacatttgtcttttggtggaagaatttgtcttatgagatgggggagaagaggaaagcggcttggagctttgttagggaaatgggtttggatgcttgtgagtgagagagtagggctgtggagagaggttttgatggaaaaatatgggtttagggacttcgataagttcataggtggttattatgaccacaaagggtcacattacgagagaaacagagggttgggttcaaaagagtcttgttcgagtcgtaggggatggggaaaatatgagcttttggttttcaaagttggagggcgaagtgaggttggtgtggggatgcttggaggtggaacctag

SEQ ID NO: 47568 - DNA, 429 bp, Glycine max
  Peptide Sequence Number=SeqID_164346
atgggggaagggttgttgggagggggtctaggactggaggtgaagcttttttcaatgggagttggagggagtagtgggggagtgtatcgtgttaaatatgcttataaattattaagaatgatgaaggataggagggtggaggagggtataagaaaagtttggaacaaattggttcctttgaagctcgtaaaccacagtttggcaactttctgtcaaactgtttctcaaatccgctactatgcatggggcaacattgccaacaactgcatggttggagtgttgggtaaccagatcaaaggggctgcaatgaaagttaatgatgcaatcctccctaggaagggaccagtcactagatccatgagcaagaggctccaagaggattgggctagagctgccgaagaaggccctagggttctcatgaaccttagg

SEQ ID NO: 47569 - DNA, 624 bp, Glycine max
  Peptide Sequence Number=SeqID_164347
atggaaggagatcaaagaacttatcgcaaaggaaaagctaaatatagtatgcctacaagagatgaagatggaggtatatggaagggtatggataaggccattaatcttgtgaacgtatattcacattgtgcatttaatgagaagctggccttgtgggaggagttgttgcaattaaggaggacggtgggagagggactatggtgtttggagagagtgggcaacaatggaggtattcaacaaaggggaagggaaattttggagttcaataatttcatagaaaatatggagttggtggaattaccttcggtgggaagaaagttttctcggattaaggaagcgggacctaagccattcaaggtgttcaatcattggattgagaaaccgggctttgttgactatgtaagacaaatgttcacatcatacgatgtccgagggtggggtgcaatcatactcaaagaaatcaagcttctaaagaaaggtataaggaaatgttgtgtggaaaaattgggaggcttccaagctattgtggatggaaacatggcacgggtgaacttgttagatggaaaggaagagctaggaatgattactcttgatgaagtatatgaaagggaagaattgctatag

SEQ ID NO: 47570 - DNA, 993 bp, Glycine max
  Peptide Sequence Number=SeqID_164348
atgatgtggttggcgtctatatgcaccaccgttgcattcgcatcagcgtcttatatagttgttgtgttcttggtactatgtgctcaaagaggtaggagaaaagagaagaacttgttcatgagtggatcaaactccggctcagaaactgatttagatgtgagcccaattatgctatttgatgatgatgcgtcaagctttaaagggtttgatcacttgatacttctctatgcttgcttttggagattgaaaaatattgagaagatgaaaacacttcgatcacaaagtgtctgtgtatttgcaacactggtgtttcaagggggagtaatcaacaaagcatccaaattggttggaatgaggctttacgagggaggctggcattgcataaggacctttggtagtggatgggctatttgtggtcactactcactagtgtatgactttaaagggtttgagaggggttcaatagcttctactgtggatgtgcacctgtacaactgtagctcaagcagggtagacttcttgtcttctgatggcaaaataatttgtagttcaaaccaatcttgcatgttaaaattcattagtgagcctatccgcctaatcacgacattcctcaagattgtgcctcttgtcactggctatatatcagaaacccagtcactgaatgtcaagatgagaggttttgttgaagaggatatacctacttcatgcttaaaactaacccttgagcagcgagcagaatattcacctggtgccggtattcctcaaatgtattatgattcatcagtagttattgaatcagaacttcccttattcaagaggattatatggcattggaagatttgcatatttgcgtggatcacaatgatggctttcatgatggagttactattcgttctagtgtgttatttgcctataataattccaagaaccacgcaaaggagtggttctgctcggggtactggtacccaaaataatcttcaggcactaagttaa

SEQ ID NO: 47571 - DNA, 696 bp, Glycine max
  Peptide Sequence Number=SeqID_164349
atggccagtttggaaactggttctgtacggtacccgacgtttggttataaagaaatggttcctggtggattagaagatggtagtgggagagcattgaacaagcaaaagatatacttatcaaagagcagtcctaagtgcgttctagatgcttattctcgacaattcaaaaacgatttttcagtgtttcttgcttcacgttcccaagaaatagtagctgggggacgcatggtcttgtctctaatgggcagagaaacaatggacccaaccactgaccatagttgctatcagtgggaactcttagcacgctccctcatgaccatggtttccgagggtcttttagaagaggaaaaggtggattcttttgacgctccatactatgcaccatgcttggaggaaatgaaaatggagattcaaaaggaagggtcattcattgtggatgagcatgaagcttatgaaatcgattgggatgctggaatgaaattgcaaagtgattcccccacagttacgccattaacgagtggagaacgagttgcaaggaccataagggctgtggttgagtccatgttggaacctcatttcgggtgtcacataatggatgagctgtttcgaaggtacgcagaagttgtagaggaccatttatccaagactaggaccacatacattaatttggtcatttctctcgtcaagcaaggttga

SEQ ID NO: 47572 - DNA, 581 bp, Glycine max
  Peptide Sequence Number=SeqID_164350
gccctgctggcctagcaaccgctgcatgccttaacaaatattccatccctaacgttgttttggaaagagatgattgccatgcatctctttggaggaaaagggcttatgaccgcttgaaacttcacttaggcaaagatttttgcaacctccctcacatgccatttccgcctgattttcccacctttgtccctagggttgactttttacgctacttggacaactatgtcacccgttttaaaatttccatccggtacaaccggaatgtggaatctgcttctatggatgaacaaaacaatgggaaatggagggttgttgtcaaggacacaacaacaaatgctgatgaggtttacgtggcaaactatctggtggttgcaactggggagaatagtgaagggtatgtgccccagattgaagggcttgaaggatttgaagggaaacacatgcattgcagcgagtacctgaatggaagagacttgtatggcaaacatgtccttgttgttggctgtggcaattctggcatggagatcgcttatgatctctcaaattggggtgcaaatacctctattgttgttagaggccct

SEQ ID NO: 47573 - DNA, 207 bp, Glycine max
  Peptide Sequence Number=SeqID_164351
atgttgaaactacttcaatttcaggctaaaagaagagaaggttcaagcagctattgtctcgctaagcgaagcatatgcgcttactcgcttagcgtgctgagaaaccctagaagagaattcagtcagagatgtgctcgctcagtgcgtcgcaagctcgcccagcgagtcatttgtctcttcccgcgctcagcgcgcccaactcgctaa

SEQ ID NO: 47574 - DNA, 387 bp, Glycine max
  Peptide Sequence Number=SeqID_164352
atgggattatcatggtttggaacaactatctatgtctttgtcgtcaaatatcaagggcagaggtcatcttttgatcaactcatggtttcttccaccatgtgcaacagtcaagatttctctcgcatgcctttacaagcattgtctgacggtcctcctgaacccctcgtcgtccctgtacccgaaatagatgggctgcgctacacagcgcataagcttgtctcccctactcctctttctggttatgccattaccaatcacgggcttagggcagtccttggaaaccttgttcttttactggcctgggaaagacccgttttgagcactccatatatgaaaaacaacagagctctcattcaacaccagcagctgtcaaagtcaccacagtga

SEQ ID NO: 47575 - DNA, 2550 bp, Glycine max
  Peptide Sequence Number=SeqID_164353
atggatagtggtgaaatgattggtctagatggtattcctattgaggtttggaagtgggttaatcatcttgatcctactataaaaaaggaagcgtggactcaggaagaggagttggctctaatacattatcatcagagttttgggaacaaatgggccgaattgtcgaaggtcattcctggaaggacagacaatgctattaaaaatcactggaacagttctgtcaaaaagaaattggattcttatttggcatcaggcctgcttactcagtttgaatctgttcctcatgctggaaatttgaatcaaccaacaaggttgcagtgtagtagagatgataatggtcccaagtcgactgaaggagaggaagtttcagattgcagccaaggttcagctaatgctgtttactttccatctgctacaggtccgagcagtgttgacttacaaactggagaggcatataggccaaatgaagaatgtagtcttggaaaggatcatagtccgagtcgagcttgttcagagccatattatgtatcaattgatgatgttactatatgcatcccagaaattgctcaccaagaggcttgcacttctcaattcattgagcaacagtcacatgaacctggaaattccatttgtggggattgccagttcaatttacattccttacccaatgtttcatcaatggtcttggggcaggaatcctcggagttgcaaagagattttatagctccttgtgaaatctgtgacatgatatctgaaactggtggaacctcaacttcacagctaacttgtcctcagtgttctaataattataaaggaatttcatcctcccaatctgtccctctagtactttctgctagtgatgataggttggggcctactgccaacggcaatcaattatttgggatggaggatcaccactttgtctccagagcatgtgctaacttcacttatgtcaacaacatatccagttcttgtgttgatggggtaggtagtgcagtaatggaagagccacatgatattctgaagggtacttcaaaattggtccctgtaaataattttggctgtggatcagatgctaagcaaacttgtaatccaacagctgaaaaaacaaatgtgcatacagaaaaggagggctcaggatctctatgttatgaacctccccgctttccaagtttggatattcctttcttcagttgtgatcttgtacaatctgggagtgatatgcagcaagagtttagtccattgggtatccgccagtttatgatgtcatctatgaactgtcttactccttttaggttgtgggactcaccctcttgtgatgatagtccagatgcactgttaaaaagtgctgctaaaacttttactggtacaccatccatattaaagaaacgaccccgagatttgttgtcaccactctcagataaaagaatggataagaaacttgagactgacatggcatcatctacgtttaccagaaacttttccagtttggttgctgcatttggtgacaatgagactcgaaaagcagatatgccttcatattcatatccattgcaaaaacagaacagcagggcatctgttgatgatgataataaagaaaattgtggacacacttataaatgggaacaattaatgaattgttccccaattaaatctgcaactttggatgaaaagaactctcaaagagatactgttgacggcaattctcagcataatgtcaagcaacgacctcttgattctaaaatgaagactactgagattgagcaacaacaatctggaattttggtcgaacatgatatgaatgacctgtcactgtcttctcctgatcaagttggtttaaaatcagatagaggtctggattcaagtgctaaaattacaaaaggcttgaacaagtccttggaagcagcttcaaatcagagtggccatttgaaattatcttctaaaaatccatgcccaagggttaattcttgttctccttgtgttcgcgctaaagagcatgaaggactttcagttgctgttactcgtgttcaagctccaggggacaattcaggggaacaaaccagaaaagatggtggttttgaaacatgtagcatctttggtggaacaccttttggaacaccttctgcgtggaaatccccttggttcttcaacacttttctatctagccccagacttgatactgaaattacaattgaggattttgggtattttatgagtccaggtgatagaagctatgatgcactcggattgttgaaacatatcagtgaacaaactgctgccacatatgccaatgctcaggagattttaggaaatgaaactcccaaagcattaccaaaagatgcatctgaaaacgacaaggataaggaccatgaaaataattatcctgtcaatcagtctgggaaccattctcagttgccttcaaatgctttgatagagcgacgcacacttgactttagtgaatgtgaaacaccaggcagagatgaaaacagcaaatcctcagctatgagcttctcaagcccttcttcgtatttgatgaaaggttgtagatga

SEQ ID NO: 47576 - DNA, 552 bp, Glycine max
  Peptide Sequence Number=SeqID_164354
atgggtgaagtcactcaaggtagcgtcaccaagttattcacacttgaactagtgacactcttcaaagtgatgtcactaggtggagttgagttgactagtgccaccaatttcctacgtgctgggtcaaaagagatgctagacctgagtggaagtcaaaagcggaacacgagacacttgagttttggaatctgcaaagtcaacgccaccatattattagtttcaatcattagcataaacttaacgatgccaattgaattgaaccataacagaggcgaagccagcagcagcgtaccacaaagcgagggtccggattggtgggaactgctgagagtggtggggcagtggcggtggaagcggcggtggccgtggcgctttaaggaaagagaatggtcaagcagtttagaggaagtgtgtggaaggaattgttggagagagaacatgatgatgagttttcacttttcaggtgtgagagaaagtgagaacggaagcagagtgcgattgggaagtggtaatagtagtagtagttggcttcgttttgtgctttacaattaa

SEQ ID NO: 47577 - DNA, 363 bp, Glycine max
  Peptide Sequence Number=SeqID_164355
atgaaaagagaaaaggggagagagagagagagagagagagagagagagagagagagagagagagagagagagagagagagagagagagaggtgactggtggtgatggagaggtacaattcctggaatttggtgtgaggttggatttgttttcaccttcttgggtcaattgttcccttttgggtttaaactcttgcactgttgggacatataagtttattcctgcggccccttggaaagggattataatgatttggagaaccaactttgaagagagttgcaatcccgtgagaattgggagcatggctgctccatctcatgggcaagttgatggtgctcagaaagttagagcattacatgggtaa

SEQ ID NO: 47578 - DNA, 339 bp, Glycine max
  Peptide Sequence Number=SeqID_164356
atggataaagagaaattatggcctaaagtgacatcgatacacaaggcatccatcgtgacgttgtcggagcctggcctgtctttgaggctctttgtgatcaatgatgataatgaagtggtaaccaaggagataatgtctccatttgcatattgtcgtcgtaatagcataataacccccatggcattaccagaggcatcagtctctaaagtgaatgatattgcgaagtttgtgggcaccaatacaagggcttctgtcgtagccttttttaggctagtcgagcatggcattgatcttggatggatctggggcaacaccattggcagagacgacatgacctag

SEQ ID NO: 47579 - DNA, 2163 bp, Glycine max
  Peptide Sequence Number=SeqID_164357
atggaagaaacatttgttcccttacgtggcattaagaacgacctcaaagcaagaattccgtgctatagacaagattggactagtggattccaagctggaatcaggatccttgccccaactacatacatattttttgcttctgcaattcctgttatttcttttggggagcaactggagagaaatactgatggaagtctcactgctgtgcagactcttgcatcaaccgcactatgcggtattatccactcaatcattggagggcagcctctcctcatactaggtgtagctgagccaacagtcctgatgtatacattcatgtataactttgctaaggatcgccaagatttgggacacaaactattcctaccttggactggatgggtctgtgtttggactgccctgttgctgttcttgctggccgttcttggtgcatgctcaataatcaatagattcacacgccttgctggtgaattatttggtctgctaattgcaatgctctttatgcagcaggctataaagggtcttgtggaagagtttggtgcacccaagaaccagagagaaggtaccaatcagattgcacttcaatcatcttggctatttggcaatggaatgtttgctttagttttgtcatttggtcttctttttactggtcttcaaagccgcaaggctagatcctggcgttatggctcaggttggctacgaggattcatagctgattatggagtcccactaatggtcctcatatggactgccgtgtcttacataccagtcaatgaggttccaaggggaatccctaggcgacttttcagtccaaacccatggtctcctggtgcatactcaaattggactgttgtcaaggaaatgttgaatgtgccccccttatatattgttggagcatttataccagcaactatgattgctgtgctttactactttgatcacagtgttgcatcacaacttgctcagcaaaaggagttcaatctaagaaaaccctcatcttatcattatgacttgctgctcttaggatttttgaccatattgtgtggacttattggaatccctccttccaatggtgtgattccacaatctccaatgcatacgaagagcttggctactctaaaacatcagcttttacggaataagcttgtatctactgcacgaaaaagcatgcggagaaatgttaatttgagccagttataccaaaatatgaaagaagcatatgatgaaattcagactccattggttccccaaatgccaactacattggggctgaaagaactgaaggaatctactattgaactggcttcaagtcaaggatatattgatgcccctgttgatgaggttgtctttgatgtgaataaggatgtggatgaccttttgccagttgaagttaaagaacagcgcctcagcaatctactgcaggcattgatggttgcggcttgtgttgctgctatgcccgttttgaagaagataccaacttcagtgctttggggctactttgccttcatggccattgaaagcttgccaggaaatcaattttgggagagaatattgtatcttttcactgctccaagtcgaagatacatactgttggaggaataccatgccacctttgttgagaccgtgcccttcaaaacaattgccatgtttactgtgttccagacagtgtacttgcttctctgcttcggcataacctggataccaattgctggggttcttttcccattgttaatcatgcttcttgtccctgtacggcaatattttcttccaaagtttttcaaaggtgcccatcttcaagagctggatgcagcagcatacgaggaagcacctgctattgctttcaacatgtcctttgaaggtccaagtagccaggcaccaacaatcaatatcagcggtggggaaattcttgatgaagttattacgaggagtcgtggtgagtttcgccgcactcaaagccccaaaacaacaagttcaactccaacttcaacaggagatataagaccagccaatagccctcagttagcaaggaggattcccagccctcgagtaactgaattgagaggggaaagcagcctcagaccaaccgggaaggagatcaagttaatgcaaacacctagtccacggtcaccaggtcttggaaaagttaccaaagatttgccttga

SEQ ID NO: 47580 - DNA, 1143 bp, Glycine max
  Peptide Sequence Number=SeqID_164358
atgccggtctctgctgcgaccccctcttcaggctccttcataggcgtgtctgctggagtctccttaggtgtctcctcagcctccgcctctacctctggtcacatgagccatgaaggcctccatgctcatgataggcctctgctgagccagattgtgaatactttgcatcaccaggcaaaggccgtggggtcggctggtgctaaaggtgctggaggtgctggtgcaagagctgaggtggaagcatctgagggagccttagccctggccttgtgggccccaggaaatataatcgtcggatcatttggagacaactcctctggctatgcacgatgctctgatcagtgcaagaaagccaagcctagaggagttggactaggccatctgagagatctgtccagaaacgatcgagcctacgtccatgtccatcttcatcatgagctcgtaaaccaacctcaccttgtccatattaagatcgaaggtgtgagaggctctgtgccacttgcacctcctcctggtggaactcatcatactgtgagaaggccaactccacattcctttatgggaggatgtctggaggtggaagcgcgtctctttcttgagaccatctgcaccaaaacacagcaaatgagtcaagttagacaggacaagtatgggccttccgatgggggtccttcaaagaggcagaggttgaagccaatgccggactctaaccccaaggctctcattcaagcctctatgcttagccaatccgatagggatatgctaaggaaggttggtccttctgcatcaatggatcccattgctcgttttgctgcgctaaagatcaagctcactactgttgacaactcggttaaagctcttcaagaagaggttgagcttcttaaaaaagagtttgctctttccaaggttgctgctgagaagatgaaggaaaaaatgaagatcgatcttaatgaagttgaagtcaagattctaaagactcatgaggttggattcaataaggctattcgtcaggttaagtattttttcaaagatgctgacatgttcctttttaatgttgacaacaacattacttgtcaaggggatttagtcaatgaagttgagatgagtgatattccaagttcttggaactgctttgctggataa

SEQ ID NO: 47581 - DNA, 564 bp, Glycine max
  Peptide Sequence Number=SeqID_164359
gctggtgagtcaggaagagctgcaacttcattatctgagtcatcgggaatgagtatcaaaggtggtgccggtggagctagtggaggtggtagaatctcaaccttcggggaagccggtgggtctactattggtggttgcagctcagctggtgcaggctctatccttgttggtatgggactgggggcacaacctcgggagatcttcctaacggcagctgagcttcaggccaggccactttatctaaaaattgctccatggatactattggcctattatgagccaactgctgctggaggtgggttggataatgaagggatgtctttagctcttgctctctttcttgaggccatctatctcgctaagcctaaaacttgtcgtaatgatgtgcgcttagctctccctgagccacgcttagcgctgtccctacactcaacacttgtcattgtgatgaagttacacttaaccaatgctttttcgacgctcccgcttagcaaacgctttgctaagcaggagagtcatttggttctccaaggccagccgcttagcggggctcgctctaagtag

SEQ ID NO: 47582 - DNA, 417 bp, Glycine max
  Peptide Sequence Number=SeqID_164360
atggaggagctcacggaggatcactaccatgagaaggttctaccaaacttagtaagaatatttggcacccaccgtgagatgaggtcagaaaaaccaccacaagggaaggcgttcgccatacttggaacccctgtcatggggacccttggaaatgggagtcctgcatctgtggtggaccttctgtgccagaatgtggagagaaggaatgtcctcggttacacaatcaggtacaaaacagcaaacacagggagtcgaatgcaccctttcatcgatggaatcatgaaagtacatttaccacccagatggaagacgctgaacatagaccgttatgatgggctatcagacccagacgagcatgtaggcgcattcatgatgcagatgaatttattcaccaatgaggatgctcttatgtgttga

SEQ ID NO: 47583 - DNA, 267 bp, Glycine max
  Peptide Sequence Number=SeqID_164361
atgatgtttttcctaagctacacgaaagcaaaggctgaaaacgctcaagtgagaaatggtatcggacagggaaacgtcacgcacactccagacgtcttctcaaagatcccaacgatatatatatcagggtgttacacactgagcgcgagaagagacaacgtccttgctgggcgagctggctgcgtgttgggtgcacagatctctgaattatcctcttctagggtttctcatccactaagcgagctggatgcctcactaaacggatga

SEQ ID NO: 47584 - DNA, 1428 bp, Glycine max
  Peptide Sequence Number=SeqID_164362
atggttattgatgtgctgaatgaagttccaaaggagaatggaggaaaggcgattcagacccttctttttaatgaatgtggaatctacaaagaaagtagcagtttggttatgtattcaacgtcttccgatcgagctttacaatggcaccttccttcaaagggtagtttgggaaaattgttgaaggataaaggattgcagtcaatgtgcttccgatgtggacaagtaggacataagaaggacaattgtactcaattcataggggctgatgcagtgaagcaaacggtgagtcaaacggaagaggcctcgaaatcggtgaatattttggagactcagacggcggtgaataatctttcgaacatacatggagggtccaatgctaacatcaaccctaagcataatttgcaagttacaaaatctcataatcatgtcattaatgatacagattctattcatggtgaatggttgattgccaagcgaaattataggaaaatgaaattgaacgttgcaaaaaaggaaggtgttattatggggaagaataataaaggggtagctgagaataattctaataatggcaagaaatctggatcaatatctgttgatattggatcacgttttggagtgctatctgtgagggataatggggagttggttataggagctgaaggtgacgcaacaaaaaactccaatgttgatggagcagcaaataataatgatgaggttaataaaagtcgtgttggtcctactaaggttaatggcaatcacgtgagagtcgtgcatgttcctgaattaaataagagtattgtactctccatgagtagtcaaaagttgacttatgcaagcagttctaaggaaccagttaaacaagcacatgtccgaaatatggtgggacgtgtgttgaggaagaacaaaacacaagtcaataaggaattagctaagcagatagccaaaaatgtgctagtgggtgtcaagaagagggatgctatgtacgaggagagtttaaacctcttaaagatgagccaattcacgaatccaaatattcaattaccatcatttatggtgaaatcgcatgttgataaggaggcgatagagtttgtgaatagccaaagacaattagaggtggcttcaaaggtgcataatagtgtgcaagaatctgtcatggactattcaggtgtggcagctatggaggaggagagaactcaggaaacccctagcattggatatgatatgcgtcaatttgattcctctttcttggttcttatggagactcgtactagtagtggggattgtgctagaagtattattcacagaattggacttaatttctttgtccaggatgtgattggtcatgtcggggggatttggttcatgtggaatccgaaagattggcaggtagatgttcttaataattcaagtcagtttgtgaagaag

SEQ ID NO: 47585 - DNA, 456 bp, Glycine max
  Peptide Sequence Number=SeqID_164363
atgaacaagagagggggaaaagctaagaatgcaactggccctgagaaaccattaaagcacgcgaagggaacacatttgaaactcgactccaaggccaccaaaagcatgccacccatcacctttatggatgaagactttagagatatcgatcgatgtcataatgaccccatggttgtcaaaatagaggcatccaacttcttggataagaaaggatcaaaatccatcatgatcaagtacctcacagtcagtgtacgcacatcatataatgcactcatagggcgtccttcccttaatgaactaggagttatcatctcaacacctcacctcacgatgaagttcccaagtaagaatggaaggatcattgtcgtctgggctgatcagataacaacacgagagtgttacgctacaagccttagagtcggcaaagagaagaaaggaatcaaacccaaggcatag

SEQ ID NO: 47586 - DNA, 531 bp, Glycine max
  Peptide Sequence Number=SeqID_164364
atggacgtagaaaaagttgttaatcgagtactagaagcaaatgcagacctatttgcatggtccatgtcagacatgcccgaaatcgaccccgaattccactggcacaagctagcattattcccggaagctagaccttttgtgcaaaggaaaaggaagctcgaccctgaaagagggaaagttgtggacgaggaagcaagaaaattgttaagtgtagggctatatgtaaatggtttgtccaatgaaaaagggagtggggctggagtcattcgggaaagcctagacaaagttatcctagagcaatctctaaggttcaaatttgaaaccacaaataaccaagccgagtatgaagctctgttagctaaactaagatttgccaaggaacatattgcccaagaaaacaatgagcaagctgacttactatcaaagcttgctagtacgaagaagaaaggacaacataggatggttataaaagaaaccatcttagaacagagcttagtagtggctagtatgactccttccaatcaagaatga

SEQ ID NO: 47587 - DNA, 333 bp, Glycine max
  Peptide Sequence Number=SeqID_164365
atggaaaataacgatagaaaatcgaatgaaaactcacagtccaagtctacatctgaagtcttggaaaagggagatccaccaagtgccacccagagaggcagtgacactaacatcaagagggatcatgacaccatcaatgatggtgtcacccacacaaacgtcataggcttaggtactagcaacatcaaaaccaccatgaagaacgatgtttcgagtatctcatcactcaggcttggcaccatgtatatctacgacaaagatttaaagctcttacatcttgctttagagcttggggggcttatgtcctacttagactcgggaagtctttactga

SEQ ID NO: 47588 - DNA, 135 bp, Glycine max
  Peptide Sequence Number=SeqID_164366
atgggcatgtttgactaccaatccattaggaaggctcaagacgagaaggttgagaaggccaaggctgagaagtgttttaatggctcttggacttctcagcacccgaaggctcgctcagcgagcatgtctcactga

SEQ ID NO: 47589 - DNA, 927 bp, Glycine max
  Peptide Sequence Number=SeqID_164367
atggatcttgagacaatgttcaaagaaacctatgtctcacagccaacgcatttacaagaaagctgcttgcaacctagcttgaaagatgtgcttctttcatcttatggattctttaaagattttcaccatattgatcagtttcatcacgtgaatatctcctcatccaatacaatccaaactccaaattttgatgcttttgacaatttcacaaatacaggttcatcacctgattttgattttatgattcttgaacctccctcaaagagtcaaaggaatcaactagatatgatggttgcaaatcaaagatttttgccttttaatcctcaagaaatcaagccctccaattttgttgtaccatatgaagtttcatgcacatccccggtgtattattacaaaagagttggcgtgaacaaaaataataaatcctacccaaccactagaagaacattcaaagttcgcaagaagtccaacatagtaaaggggaagtggacaatagacgatgggtttacaatatccaattctatacaacctcatattgcgaagatattgcccggaagaattggaaaacagcgcagagagagatggcataaccatttaaggcctgacattaagaaggacacatggactgatgaagaggataaagtactaatcgaagttcatgatgaagtaggaaataaatgggcagagattgctacgaggttgccaggaagaactgagaactcaatcaagaaccattggaatgcaaccaagagaaggcaacattccaaaagaaagtgtcgctcaaagtaccttagaggcactcttctgcaagagtacatcaaaagcctgaacttagacaagaaccccccaagatattataggagaaaatgttcttctaattatggtagtgccatcatgagtgatgacaacaaaatcagcacaagctaa

SEQ ID NO: 47590 - DNA, 195 bp, Glycine max
  Peptide Sequence Number=SeqID_164368
atgtcatggtggaggaatgaatggagtggaggaacatattgggatatgattgctggtcgtggaggaactgggcgagatgaggatggtgtggttggtgctggaggattgaaatgcgaggtgggaggattaggaacatgtgaggtgatgttaggagagagggaattgggcttcttgaaaggcaagatggtttcatga

SEQ ID NO: 47591 - DNA, 1341 bp, Glycine max
  Peptide Sequence Number=SeqID_164369
atggcctgtaatagcatccaaagtagctcttcactatgcacaagaaattttgatgtgtttctaagttttagaggtacagatactcacaatggtttcattgatcacctttttgcaagtcttccgaggaaaggtgttgctgccttcagagatgaccaaacaataaaaaagggaaactcttggagcctgggaatcttgcaggctatcgaaggattgcgcgtttacattgttgtcttctcaaaagactatgcattatccacatggtgcatgaaagagctagcaaagattgttgattgggttgaagaaacaggtctgaaaacagagtggagagttcagaaaagcttttggagggaagctctaaaagcaattaccaatagttgtggtggtgattttgggtctttgctctactttggtgtttctggccacaatatgaagaaattgaaaaaattgttgaagagagacgtttctgaatggagaagtgcattgactagattgaaagaaaatccaagcaaagatatgatggatgaagatgtgacggaacttctagcttactgtagattttatcctaacattgctatgaaagttctcattgagaaatcactcataagttgcactgagactaggatgattcaaattcatgatttgttgaaagagttggataagagcattgttcgagaaaaatcacccaaggagtcaagaaagtggagccgaatatgggactacaaggatttccaaaatgccacgatagaaaatatggaagccgaaattcttgaagccatagttgttaaacaatatccaaaagagtcaatggaaaaagtattgaatgttgatgctatatcaaaaatgaatcatcataagttgctcatacttgagaatgattccttgcaaccctctagttccttaggtaagatggatattattattcctggaactcaaattccaaagtggttcaataaacaaaactcgagtagttcaataagcatggacccatttcctgttatggatgatccaaatttgataggtgttgcctgttgtgtactatttgtgacacatgatgatccttctaatttgggtgatagatggcatccttgtgattgtccaagttttggatacggtgttcgaaataaacagctcgagtgtgagacctatttcacggttccaatacttttcaagaaagatttggtcacagtggaattccatcacttgttagtaatgttctttactcaagatcttttcattcctctagtaagtgaatgctcaaatgaaatgcaagatcttgatacgatggaatttgcaccccttatatacccccctcctggtttgcatttggaggtgaacaattga

SEQ ID NO: 47592 - DNA, 216 bp, Glycine max
  Peptide Sequence Number=SeqID_164370
atgaaccatatgcaggaattcgatatgcaaatctattcccttagatgcaatatatgttggccttggaacacagtgccatctagaaacttaggttcattcaaagatgctctcttggccacaaactttttatgggactatacaaatgtggtcatgaatttccattatgaatccagtgaggaaaatgagaggagtcccagtatagatggtactaggtag

SEQ ID NO: 47593 - DNA, 552 bp, Glycine max
  Peptide Sequence Number=SeqID_164371
atgaactataaggatgttattgaaatgatcatagtgccaaagtcatatacagaggcattgttaggggggaaaggagtttcgttacatggaaaagatgtggaagaagacgaggatgagttttgtggactgaggattgaagaaaggaagttgggggagtatgagtgtttgacgcttattctgtctgaaagcgaagagaagaggatacaaagaccctggtctacttctgttattgtaaagttgttagatcgaaaaataaggtttaaggccctagagacgagacttaagcaaatgtggggagggaaggattcaggagtgggccaacatatacctgaaggtccttggactatagtgaaaaagatgaggcatcctagaagaggaaaagagagagacaatggagatcctaatttgatgcataatcaaggatctagatttagggttttaagtgggcatcaagatgaggataaccaagcaggagtagggaaacaaccaatggttccaagggttaatgagatgagagaaaatttggtgacaatggaaataaaagatgggtag

SEQ ID NO: 47594 - DNA, 663 bp, Glycine max
  Peptide Sequence Number=SeqID_164372
atgtacaaagttatgtgtactaccctcgtcaatgaggatgacaacctcatgacccttgatgcttccaatgatgcgcaatgttgcttatatagggtggccggacaaagcgggagggttgtgtttcctcaggggaaacaggaggttccgagttcaagagctcatcgtcctcggaagcaacgaggagaaagaatttggcacgacaacggtagttcgaactgtaacactcatcacaattataacataagtcgtgctcgtgatgcgagaccatctcagcctggccgggctagagccactgcctggactagggacaagagctgtaaggcaaggacttctcgatgtatgttcggtgagcggcctgagatgatgcagctgaggaggaaagggggcacccctagggtcatcgtacagggatggagcaaagcgcagctccagagcttgaaggaaggacgatcaggagggcaactgatcattatgatacatccactaaaaccaactcagtgcagctccgtcgaggtaggagcattggtgtcgtcgaatcggggaacatcgagattcatgcgagggggagaaggagggtcacgacttcttctaagcgggacaaggagtgggaataggtgttatcgaccatgggagggatcaatgaaagcaccaattgatggataa

SEQ ID NO: 47595 - DNA, 1098 bp, Glycine max
  Peptide Sequence Number=SeqID_164373
atggcaattcctaaaagtattttgttggagattgagaaggtgcagagagcgtttatctggggtgatactcaagataaatgtagagttcatgttattgattggagaacgatgtctttgcctaaggttaatggaggagctgctatgtgtaatcttcggaagacgaatactgcctgtttgatgaagttggggaaagagaggtgggcgattgggagtggcagcactgctcatgcttggaaagataagtggattgatgattgtacaagggtggaggatgttgtgagagacatcccgtatcaatttcagaatttgactatgagtgagcttactgatgatgttggtcaatggagtttgtctcttttgaaccaatttcttcctattgggagatttctctatttcaagcacttatatgaggttaaactgtttttcatcaactggagcaggcggatcattgaagactcatatggaatcttaaatctcttcaaagatcactgtcaagttgtggatgagaaaattcttcatgttatgagagattgtcccttggcatcaatggtttggatgcacttattaagggttgatcatagagctgatttttttggattgcagttggatagatggatcttatggaatttgaacatgagggcccattctatgtacgggatctcatggctagagctgtgggctaatgcttgtcatctaatctggttttggaggaataaggatttgcatgatgctaactttgtcaggcctattagaccatggattcctcctgatccaggctggatttgtcttaatacagatggacccttgaagagagatttgggttttgcagttgtggagttgtggggagttttcaaaggtttgaacttggctagagctaagaatttttctcatgtggtgctgcatgttgattccttggttgtggtccaagtgagtcatgtgtataaggaagggaatatgtgtgctgatgctttggccaatttagcttatcagatgcaggagtctgattctgttgtttttgaactagctcctagtagtatttgctctctagtgtcctctactgctcggggagattctctccctcaagatgttctgctgtag

SEQ ID NO: 47596 - DNA, 1485 bp, Glycine max
  Peptide Sequence Number=SeqID_164374
atggttggcaacgacatcgagatcgcttgcgacaaggtttgtcgcgacgttgccgttttgattcagggccacaaatttgacctagacttatatgtcatggcattaggtggcgtagatttagttctgggtgtggccaggctcaaactcttaggcccaatcaccatagactattcacacctcacaatgagttttgtgtaccacggacaacccatcactatccagggaggcatcaccccaggcccatccgagatcactcacggccaggtcaagtacttgatgtccacacagcgagttgcgaccctattccatatccaactccaggaaagtggtccagttacttccgataccctcattcttccgcctccattacatcgtctcctcgacaaatattcccactttttccaaacacctacccttctcccaccatctcgtcctacagaccataccattcaccttgagccaaatttgaaacccgtcaatgtccgcccttacaggtacccttactaccagaagcaagaaatcgaaaggcaagtggaggatatgccttggtgtcaactcatccgcccgattcgcagtccctattcttctccagtattgctagtgaagaagaaggacgtgacatggaggttctattggagcttcgtcaagaattacgcacatattgtagacccagtgacccatttactacgtaaggatcaatttgtatggtcccctgaggctcaactagcctttgacaatttgaagcaggccatgaccaccacattggtgttatccctatcggattccagtgttccttttatcgtcaagaccgacgagtcgaggtcgggaatgggagttgtgttgatgcaacgaggtcatcaaattgctttcttcagtaaggataacctccttctccaccagggacacatttggattaaccgcgagaattctttcatccctcttctcctggaggaataccacaagtccttgttagacggccacatgggattagctaaaactctcaatcacatccaacaaagttttttctgggagggtatgcgtcgggacacccaacaattcattaagcaatgcactgattgcttacaaactaaatatgttccccagaaaccgacgggtctactccagccaactccgccaccgtcacgtccgtgggaagatttggccttggacttcgttactggtctaccaaactatcagggagccacggtaattatgaccgtcgttgatcgcttttctaaaggagcccactttggaacactccctactcatttcacagctcacacagtggcccttacagagtggtgttacaacaccacgtgccattcctccaccaactggttcccatacgaggtcacttatggcaagcccccaccgggagttccagattaccttcccggtttgtcaacagtagaagtcgtggacttccttctctcctctcgacaagacatgttcgaagccctctgtcgaaaacttgagcgaacttag

SEQ ID NO: 47597 - DNA, 164 bp, Glycine max
  Peptide Sequence Number=SeqID_164375
ccagcatttttacggcacgcacgttgaactttgcgtttatgccagagtatgatccgggtgagttttatgccagctttgagatgcagccaggcactccaattgaggtgacagaaaagcaggcacgcaaggggacaagggggttgcacgactcttgcgctagctaa

SEQ ID NO: 47598 - DNA, 402 bp, Glycine max
  Peptide Sequence Number=SeqID_164376
atgaattgtgttttcgttcatgtgtacgagtttggagctaggcttagtgattgcttactgcaattctccattctcaccctttttcagagccccatgaattgtgttttcgttcatgtgtcatccaccttcgagtttggagccatgcgtagtgattgcttagtgcaattctctattctcattctttttcggagccccatgaattgcgttttcgttcatgtgtcctccaccttcgagtttggagccatgcgtagtgattgcttagtgcaattccccattcacaatctttttcggagccccatgaattgcattttcgttcatgtgtcctccaccttcgagtttggagccatgcgtagtgattgcttagtgaaattctccattctcaatcttttcggagccccatga

SEQ ID NO: 47599 - DNA, 435 bp, Glycine max
  Peptide Sequence Number=SeqID_164377
atgttaggtatgaagcagatcaaggagaagaacgcggccaccgccgccgctgtcagttcggctgccgaaagcagacccgactctcttggcagccacgcaccagcctccctcaaacataaagatgcgggccacattgcttctcccgtccatgaaaaagagcctcctcagcagcccgacgaagtccataaagaccctcaagattatgctcggagggatgtcgagttttatcccccgatccccgaagggccggcaccaggcacgttgcctcaacccaacatcgcagcatcgccaatagttttgtctatggaagggccgcccccggcgactgaagaaaggaggaagctcgatctccttgaggaaagattgagggctgtggaaggatttggggactatccgtttgcagacatgacggatctttgcttagtacccgatgtt

SEQ ID NO: 47600 - DNA, 396 bp, Glycine max
  Peptide Sequence Number=SeqID_164378
atgtccgcaaacgttcgagatgaattggtgactctgtttcaagactaccaagacatctttgcttggtcctaccaggatatgcctggtttgagctctgatatcgtgcagcacaaactacctctaaatcccgagtgttccccggtaaagcaaaagctgaggagaatgaagctcgagatgtccctaaaaataaaagaagtgaagaagcaattcgacgttggtttcttggccgttgctcagtacccagaatgggtcaccagcatcgtgccagtccttaaaaaggatgggaagataaagatggcattggaggatatggaaaagacaaccttcatcactctgtggggatatggaaaagacaaccttcatcacaaatcatcttttaaagagattgaaagttaa

SEQ ID NO: 47601 - DNA, 783 bp, Glycine max
  Peptide Sequence Number=SeqID_164379
atgagctttaaaggaagaaggaagaagaagggctatgggcacatgggagtgggaatttgggataatgtgggaatgggttgggaaggtggcaacttgagagagaaaagaacacctaggccggataaaagtagaaattctatactttccagatgtggaaaagtgatatcatgtggaattactaggttaaaggatcatcttgcacgcattccgggagaagttacgggatgtggggatgaacatgatgaagttcaagatttcatggatgaggatgcatatataatacaagctgcacaagagaggataatgtcacacaaacaatgggaggataagcaaagatttagacagcaaacaagaggcaattcatatgcagcaaaagcatggaacaacccaaaattaactagggaatcaagaaaaccaaaaaagtttgggaaagcagtgtctaagttgattatatatgaacgactttctatcaacttggcaaattctccaaggctatacaatttgataaatgcagatgcagaattaggtttaggtgttaaagcccctcctccttatgagtttttagaagtgtacttggaggaagaacataaagttatgcagagttggattgaaggacttaaacctacgtgtgctcattgcttggatttgtactcggaagatattgggaaaaagtacttgaaggctactgatataattaaggtgtttgaatcgattgtcaaggttgttatggaagtgatgaagaacaaacaagaacagcagcaggagatgcagcagaatagaaat

SEQ ID NO: 47602 - DNA, 258 bp, Glycine max
  Peptide Sequence Number=SeqID_164380
atggggtcgaaccaagcgccctcttttgaaaaaaggttctatcatgtcaaagtcaagaacctagaactagccagcttgcgagagctagggcagtggatggatcaagttcgacgtcaagccttcagcaaggcgtatgggaaaatctgggatttggccatgatagaagtgtccattgaaggataccaaggaagcacttggaggagaaggcaaaagctttggcagatcaaggagagtggacctcgttcattgacatattag

SEQ ID NO: 47603 - DNA, 618 bp, Glycine max
  Peptide Sequence Number=SeqID_164381
atgaagttgaatatgagacaaactatgagaataagtcaagaggaaattcaagatagttttaatcctatcaatcttaattatatatttcaagaagaagatacgttatcaccatggcttgaggaaagagagaggccattgacggagggagcccataactttgatttgctccctatggaatttgatgatgataatgaagaagcaattggtggaaatgattcagatttaagtcaaacacctagtgatggagggggcgatggtggtttaagtccacccaacaataataataatagttgtagtggtgatggtggtgataatatatcacaaaaaggagaggttgagggaaaaggcatgaaaatggtgtattggatgattcttcctcatctagagtatcacaatcctttggtgattctggtattgttgcatcagttgaagcatttacgtaagacagctgcaatccgcatcgcagaattcgtaattctcgtaaccgtgaaaaccttaacgcgaccgcaatttgaaatcttaagctggactgatgcttcaatggcaacacaagaaggagaagcctatgaaggccatgaaatgggtgagacagctgccctatcaatggaaaacagttga

SEQ ID NO: 47604 - DNA, 276 bp, Glycine max
  Peptide Sequence Number=SeqID_164382
atggtgcttgtgatcaaatgggtttataaaataaagcatagagtagatggcactattgaaagatataaagctaggttggaggccaagggatacaaccaagtggagggattggatattgatggatattgctatgttcctgaattagaggacaggaacttcctccagaatgaaagggtagctattaatcctaacggctttgccaacacaaaggggacaagccataaccgaatggatagtgggggacaagcactaacgggaaaacaacaacaatattaa

SEQ ID NO: 47605 - DNA, 822 bp, Glycine max
  Peptide Sequence Number=SeqID_164383
atgatgcagtcgttgatgagcatgaaggcttacgtgggtacgaggttaccgattttaacgaattccgagacgagtacgaggaagcagcgcgtgaattgtccgaaccgtaggaatgtgatggtttcgtgcggttcggagaggaatgggaacgaaggaataggttcgaactcaggttcgtttatgtctccgagccataattacgcgatcttgaagcaccggatggagaaagcggccaagtccgagtattacgaagaggcttcgaggattcgtgactcgctcaagtgcttcgaagatgagattcctgttctgcgtctgaggagattgttgaaggaagccgttgctgatgagaggtttcaggacgcagctagatatcgtgatgagctaaaagaaattgctccacattctctcttaaaatgctcaagtgatgcgacaaccttgggaatccgggtccaagtgaagagtgcatatatagagggcagaagtcagccttcagaggaggtatattcctttgaatatagaatcaaaattaccaataacacaaaccgccctgttcaacttctcagaaggcattggattatatctgatgctaatgggaaaactgaaaatatttggggaattggagttgttggtgaacagccagctatctttcctaggagtagttttgaattctcttctacatgcccattaagcacacaaaatggtagaatggaaggtgactttgagatgatacatgttgatcgagtaggctcaagagcatttaatgtcgccattgcccctttctcgctctctctactaggagatggtgatggtgaaactacttaa

SEQ ID NO: 47606 - DNA, 231 bp, Glycine max
  Peptide Sequence Number=SeqID_164384
atgacagaggtagaagggagatggagatcgatgcgaggcaagatccataaacaaagcctaaaggaagggcaaaatggtctattcatgaaggtttctgatcctaaattctcccaggctaacatccatcttgcctgggctaaagatgtaacttcaggcttaagcaagcaactcgtctgggcgagctacagctttcctgggcgagtggatgccttcaccattatcagaccctaa

SEQ ID NO: 47607 - DNA, 939 bp, Glycine max
  Peptide Sequence Number=SeqID_164385
atggttatgatgaagcatttcatcaactttcttttcaatcttatgtttttggaagtaaaggtagcgatacaggttctgatgggttatcgggagaggcacaaagctgaaggtggaaaaaagcagcaacacgccattccactccaaaacaagatcaagatccccaagggccataacatagaggtccatggagaaatagtgcttgtggatggaaacagacacatttctgcacacctaattacaacaaagttcactcccatttcccaccatgacgctaagtggttgagtgggttgggccctaagattcaaaaagtggaccatgtcatcctagatgaagttgtgggtactacccccatcgatgaggaccacgacgttatgcccattaacggaaccatcaatgtgcaaagtggcggaggcaggatgatcagagttagatcagaaggaccaatgtcaacagggttgtcattgtcatttgtgataaggagaaagaatttcaccttgcatttatggttgtctttgggagagtcagaagaaggggaggtaattgtgaagggaaacggaggtgaggggaataatataaagcttccttggggtcgtcatagaatgagggtgcgaagtgcatctccaaagcctggaagaaagtcgtttgtcattgggagtgccatagaactcgaaaaattgagaaattttaaagatccaggacatggcattagaaccatcaaaccacaggacatcaagtttcagatgtggaggggagttgaggtgagaaacgacctcctcaattttggagtggagggagctctaggtagcggtgagggcactctagttttgggtgagttgagtgacagcctcttcaaggtgggtgattgtttgggaacttgtgttatcaatcatggaagagaggcaatgaaagcaccaaagatgatagctacaaaactttaa

SEQ ID NO: 47608 - DNA, 282 bp, Glycine max
  Peptide Sequence Number=SeqID_164386
atgaatgcagaccctacaacatttttctttcacatgaagatcataataaacgtcgtggctgaaggagtaggtgtgtacggttcccttggcggcattgttgttgtcgtcaagcaacatggctgtgacgagggcggagagcaccctcttggaacggtggacctagccatcatcgacggagatttgtttgagggtcgtgatggcaatctcggtgaggcgctgaagatccttgacggcatcacaaccgagggtgtcgacattgcagacctcgacgacgcggtttag

SEQ ID NO: 47609 - DNA, 2337 bp, Glycine max
  Peptide Sequence Number=SeqID_164387
atgaccagaaaagagtgtcatccattgttaaggggtgggagaggggatagcaaatataaacatggattttctgcagctgagatggagtcactggcaagcatatgtgaggttgtgttgcctcctttgcctatggatgctcttaagatcagaaaggaagaccaaattgatgattatgattctagcaagagtctcaagtccttctgggacatttctgcttctcgctatccaatccctcatgaggttttattaattgaaatattactgaaagaagctgaaacagtaaaaaatttccctacaccctttcctgcttcacagataagaaattccctgtattactatgttataccaaaggttgctgagatgttaacgaagaggagcttaattgaagcagtaatactgattagagtagttttatggctgctggcaacaaggttgggaaccttgttgctctgtggtttcctctgtcttggtgaaaaatggccctatgtcaacaacttctcaaacatatctttggagaaaagagaaatggttatgcagaagtggctgaaacataggttcctcacacctattagactggcctttgcttacatcaaagttgatgaaaatggtgacaacccagcatggaaagccattggatatgaggtaccagctgatgaaaacttgaccaatgcctccaaaactaggccccttgaaaaggggattatagaaaccatgaatgaatctgactccgctcttcaacaatctcttgctaacaaaggccttaatgttacactggactcaaaaagcaacatcctcaaagtcaaatgtgatgcactagttgttggttctggttgtggaggaggtgttgcggctgctgttctttcaagtgctggctacaaggtggttgttcttgagaaaggaaactatttttctactcaggattattcatctctagaaggtccttccatgaatcaactatatgaaactggagggatccttgcttctgtggactcaagagtgctagttttggcaggatcaacagtgggtggtggctctgctgttaattggtcagcctgcattaagaccccacacaaggtgctaaatgagtggtctgagaatcacaagcttcccttcttttcaagccaagaatatctctccgcaatggaaactgtgtgtgaaaggattggtgtaacagaaaactgtacacaagagggattccaaaaccaagtgctgagaaaagggtgtcaaaatcttggcctcaaagttgactatgtgccaagaaactcctcagggaatcactactgtggctcatgtggttatggctgtccgaaaggagagaaacaagggactcaagctacatggcttgtagatgcagttgaaagagatgcagtaataataacaggatgcaaagctgagaggttcttgttggaaagcaacaggagtggaaatggcagaaagaagaaatgtttgggagtgatggcaaaagcattaaacagcagagtcacaatgaagttacaaattgaggccaaggtgacaatttctgcaggtggggcacttttgacaccccctttgttaatctctagtggactaaaaaacaagaacataggtaaaaaccttcatctccaccctgtgctaatgacatggggatactttccagaatcaaatgattcagaattcaaaggaaaagtctacgagggaggtataataacatcagtccacaaagtgccatcaacagactccaattcagattcaagggcaataattgaaaccccttcgctaggaccagcttcctttgcagcactgtgtccttgggagtcaggactagactttaaggaaagaatgctgaattaccctagaacttcacatttgataacaataataagagacatggcttgtggacaggtatcaacagaaggaaggatcagctacaagctgaatgaaattgacaaggagaacatgaaggctggcttgaaacaagcactgaagattcttatagctgcaggagcagttgaggtaggtacacacagaagtgatggtcagagacttaagtgtgatggcattggtgaaaatgaagtgcaagagttcttggacagtgtgtgtccaatggagggggcactttcaccaggtgagtattggaacatatattcttctgcacatcaaatggggagctgcagaatgggagtcaatgagaaagaaggtgcagttgatgaaaatggtgagacatgggaggctgaagggttgtttgtttgtgatgctagtgtgcttccaagtgctgttggtgtcaatcccatgatcacggtccaatcaactgcatactgcatctctaatagaatagcagattatcttagaagggattaa

SEQ ID NO: 47610 - DNA, 903 bp, Glycine max
  Peptide Sequence Number=SeqID_164388
atgggttttctaacaggctctcacaaagactcatggaagccaattatgactgcaaagacaaacactcaaagctactggcttaattggagagttttgctttgtgccatatggattctggtttcagtaatcttctcaaccttgcttttatggaagtatgagcgtttgagaaaaccagcaaggaatggtagccgggtgacacaacaagaaacatcagcaactttgtatgaggatgaaacttggaggccttgcctaaaaggaattcaccctgcatggctcatggccttcagagttgtggcgtttatcatgcttttggtgcttctcataatcaatgcaactgttgatggaggaagcattttctactattacactcagtggacttttacttcaatcaccatctattttgggcttggatctttgctctccatatatggatgttaccaacatcataagaaagcaactggggataaggttgataatgtggatggagatgcagagcaaggaatgtatgatgcttctgcactcccacaaagctctaatccatcagaccaagagaaaagcctcggtgccccagaagaagttcttgtacgccaacatgcaggcttttggggttacatttttcaaataatattccagattaacgctggttccgtcatgctcaccgattgtgtattttggttcataattgttccatttctaaccatcaaagattacaacctaaattttttgatagtcattatgcactcaatcaacgcagtttttcttataggtgatacagctttaaattgtctggtactttgcggtggcattactgcatattccatgctatggaattttcgctttgttaatgaagctgaaacaccatgtattgtcaacgcggtacccggactcatatcaatgcgttag

SEQ ID NO: 47611 - DNA, 195 bp, Glycine max
  Peptide Sequence Number=SeqID_164389
atgggtggagacatcatcgttttgcataagcttacaggtaccacaacaaatcgaagggaaggtggggtaaatcaaagtgaagcgagattttgcatgtcgttgggtctgccaatggctatgacagtgaattataccaacaacacgagggccaagaacatctacatggttttggtgaaagggataaatgatcgttga

SEQ ID NO: 47612 - DNA, 1461 bp, Glycine max
  Peptide Sequence Number=SeqID_164390
atgaaatttcaagggaaaagctccttgttattgcttctccttgtgctcatagcccttcatcttgcatcttctcgaacttctgtttataattgtgtccttgatattcaattttctccatccttgattagttcaaattgtgaattgtacaattggggagggtttacccatggctgttgtggaccatattttgatgattacctatatgccttggggctgagggccaaccaaactggaaaaatattcttgaattcctcagagcaagaaaactgcatagcatcaatgcaagcttttgacaaaaacttcacttgttatgggatagagaagctaacaagtggagttggtggttgctctgattacaccatcacagatgttattaatcatcatggagacaactttaggagactgaatgaagattgcatgccttttagaagaaatggcaggccaaatgaaacttgcaccaaatgtttgaaagcatgggaggatatcagtgcaaaatcagactctacaaggggatcagaatcagcaaatatcaatgtttatctttgtaggtttgctgtgcttgtctcaataacaagcacaagaatttatgatagggaatcaattcaggaagtctataaataccttggggaacacaccctttctgcagttaatcaagaagttaaggttaaggctagtgctaatgctaatatcaactcagcaggtctctggattgccttcggtataacaggagttacagcagtggtgtttcttgccgcactagcattatttatcacaagaattaaaagtgctccaaccgtacaagatgagtctgattcaacttcaccgaagataacattgaaggatgtttatgtagcaacaaacaatctcagcgcttcaaatttcataggccaaggcatagccggaaaagtgtacaaaggtgtgctctccaacaatcagtctgttgcagtgaagcatatcaccaatgaaggttacatggagacatttgttagagaagtgagaagcctttcccatgttagacatcaaaacctagtagctttgctgggatactgtgaaagtgaagctgaatgcttcctagtgtatgagctatgccacaatggaaacctttcagagtggctatttggcaatggtaaagttctttcatggattcaaagactagagattgtcattgatagtgcaagaggtcttgagtttctccacacctacccaaatggctgcattgttcaccgtgatataaaggttatggaccttggtcaatcctacgtgagctctgaagtaagaggaacatttggttatattgatcctgaatataggacaaatcaccaagtaaaagcctcaggagatgtctacagctttggaatagtgttattgcaacttctatcaggacaaagggtcctaaacattgatttccagagaccaatgtccctgggtaaaatggtgagaaattacattctaagagcttaa

SEQ ID NO: 47613 - DNA, 579 bp, Glycine max
  Peptide Sequence Number=SeqID_164391
atgaccaagctattcatttctctctctctctccctctcgccattctccttctcttctcatccctccacgtcgaagatttcaacttcctcaaggaactcgatgacatcgctgccacttctcaccacactcattttccaaatcccaatcagttcaacgatgacttcaacaacttcgactactcgtcggaggaggcgttcaaggagcccgaggtggacgacaaggatatcatcattcaaggcaccgaagcatgtcgccgcatccaccgagctcaagcctaacgacattgttctcaccaacgtcgatgccaccgttgaaaatgaactggtgaactcgtacgacgttcaaggtttcctcaccatcattttgggcttccttaactctttagttatcaaggagaaagaaggaggaggtgtgatggtgaatgatgagaagggcatgtttgggttgtctgatttgatgagagagaccacgaaagtgcttggaaatggaagctttggatctttttacaaggtcgtgatggctaatggagttgtagtggtggagaaaaggactagagaaatgaatgttcaagagatgtag

SEQ ID NO: 47614 - DNA, 471 bp, Glycine max
  Peptide Sequence Number=SeqID_164392
atgcagaacttctggtatgtgcctaaacagacaagaccccaaaatatccagttcgtggaatccagttccatatttttagtttttaaaactaaaaaacaaaaacagcttttccatgttttgcttttcggattctcttctctgactgagaattgccccttccaaaaccctaataacaccttccgaaaagagttgagtcacggaaagggtcgcatgcgctcatatctgaaggtggaagcaatgcatgacgtcgatctggtcgcagatggtggcgtgacggcgacagtgaggcctgatgtggtgtgcgcagtggttggttgttgtcgagcggcggcgcgcgcgtctggtgcgggtgggtcacgatggcggagtgtggatctgggagagagagaacgacgcgcgacggaggaggagcttagaggtgatgtcgcgcgcggaggggagagaaaggtaggtggcagcgcacgacggtga

SEQ ID NO: 47615 - DNA, 609 bp, Glycine max
  Peptide Sequence Number=SeqID_164393
atggaagccaaaagcaaaacttaccaagacacagtagacacagcagacatgagaataggagcaaaaagtgctttggtgccaatggctacaaggaaagcaacgtcagcagacacaacagacacagtagacacgaagcaagaaaacttaccagagcgcagtgaagaggttggctttgcgaccagagcacgaccagggtggctttgcgaccagagcacgaccagggtggctttgcgagactccgcgtggtgggtcaaggacaatggcagtacagagggtggctttgcaaggtgggtcaggagcaatggcagtgacgagggtaagtttgcgagaatgagcacaagcagtgatgagggtaagtttgcgagaatgaaaatgggcagtgaaaaggatttttattccctaaggaaggatgttgaaattatgtcacagtgtgttgaagagattagagaatcttctggtctacagctattggagcaagaacttgccaatttggaggagcaagcacttgatagctccttttgggacaatcgggccaaagctcaagagactctctcgaccatggatgatgtcaaagataatataaaattactcaatgatttcaaaacccag

SEQ ID NO: 47616 - DNA, 435 bp, Glycine max
  Peptide Sequence Number=SeqID_164394
atgcaacttttgctagatggcatcaatcctctccttgcttactgggttgaacaaggaaaaaatagttgcctttatgggagtgaaaacttggtttggatccaacaattcaatgataagataattgagatcaaacaaccaggtctgcagctggaaacaatatatgttggtaatagtcaatcaagtgaaaatgttaagcaaataatggcaaaaggtggtgaaaaaagtctcaatgatccactttccttcataaatgtgcaacacttttgggttcaattggagaccatgagaatgtctaaactcatactaggaaatacaccaagttctgatcatgtactagctaagttgtcaactttgcttgacatggatgatagagaagaaggttgggctgtgattggatgtaggggttcaagctcaactaatattcttaggctttaa

SEQ ID NO: 47617 - DNA, 447 bp, Glycine max
  Peptide Sequence Number=SeqID_164395
atggaagaagttgatgactcccaaaattctggtgccttaacatggttcataccaagtgaagatccatctctcatctctaagaaccaactacttgctagaatagttggaggcttaggggaaagagcagaagaggaagtcatatttggtgaaactgagataaccactagagttgcagtggacttgcaacagattacacaaatagcaagacagatggtaacaaggtttggtatgtcagagattggaccatgggtattgactgatcctaccgtgcaaggtcatcatgcgctagttgctcactctcttgctcccccaggaattagaactattcctccaagtcccaaatggctatcaacttctcagggatgtattgaagcgcatttaacaaacaacagtgaaccagtaggattcatcatcacaaaaatagatgaattctggcaacttaagtag

SEQ ID NO: 47618 - DNA, 111 bp, Glycine max
  Peptide Sequence Number=SeqID_164396
atgtgggaagtgggaacttgtggctatgtaattttagggaagatgggctcacagagctctttggcatgcttccttggggcacatgcacgagatttaaaatccatttactag

SEQ ID NO: 47619 - DNA, 2487 bp, Glycine max
  Peptide Sequence Number=SeqID_164397
atgaatgcgcgaggcgaggtcggttcaccggatccgttggattcgttccctccgttacgggttcggggatcggacggtgcctcggacgattccgagttcgagcggtattgcagcgccaactcggtgatggggacgcccagcaccagcatgagcctctgcagcgccgttacgctcttccacgaattctccgattgcgatttcgcttctgccggcggcgagggtttcgagaatttcagtttgggaaaaggagccgcggaggtgaatcgcggcggcggcggcgaccggaggcggagtttgcggtacggttccagtggattggagatgtacggtgattgcagtgaggagctctctatgacagcgctcgattcgtcggagtttatcgggcttaatcatcggatcgaagagtcgaaagggaacggtgaagtgagtggtggaaatggttttgaattggaaattgagaaaagagaagaagaagaagtggaagaagaaaaggaggaggaggaagaaaaggaggaggaggaagaagaggagttatcggagggtgatgattctatgtatgactatggtagtgatggtgatggtggaaatgaaatgtatttgtggaaaaataaaggttattttgaggagccggaagtgagaaacgagaactctttgtttatgaattcttccgtggcatttggatcgcgagacctggatgattttttgttgcagagtggtgacatttctgtcatgcctgatctgtttcagaatcagcgaaaaaagaatgatggagtgaatatgggttctggtcgaaatgaggaagggaaagatgaaaagtacgtggtcagaggcaatgaagttgaagaaactaaagatgttggttattttgattctgtagaggaggttagggatagcgaaatttctgcagattgcgatcatgttcgagattctgatatgcttgctaacatagtggaaagttctccctcaatagattgtcggaaccatgttgaaccgcaggtccaaggttctgatgatttggttagttgtcctgaaacttcgtctattgtcaaggtcgatgaagttgatttggatatgctggcgaaagaagctcctcctcggaatatgggtttggatgttaatgatggtggtagcatggaaaaggggaatatcaacagtgaagaagctattgccgcttgtgatgctcatggtttaaagtcagagttggatgattctaagttcaatcttgattgccttagtgctagccgatttgatagaagttcttccattccatccaaccatcttgggaatgttaacgcaaaatcatttgagagtcttgagcaaattgagccagtgttggactatggaatgaggaaaacattagagaagtcttccacttcaacaaatcttttagaaaaaagtcctgtggtatctaagttttgttgtggtcatagttgcactatggctgttgtgggccaaaacgtagcacagttatggtgtgatgtagttgtgacagaagactttgagctaaatgaattctatgatgaggttgttcaggaaatggaagaaattttactggaatctgtggattctcctgggactaggctttccatgcgtgacagatttgctgagcctcaattttctatgccttcaagagacggtggattgactgcttctacttctagtaaagatgatgcttacctgctagttcagtgcccaagaaaaatagataggattgaagtggtaggtgcaaggcagaagaaaggggatgtttctttcagtgaaagattagttggagtgaaggaatacactgtgtataaaataaaagtgtggagtggcaaggatcagtgggaggttgaaaggagatatcgtgatttcctcactctctatcggtacatgaaaaccttattctatgagcaaggctggaaattacctttgccatggtcttcagttgaaaaggaaacccagatatttagaagtgcatcgcctgatattattgtgaagaggagtgttctcattcaagagtgtttacagtctattatccgttccaggttttctttaagtcctcccagagcattgatttggtttatatcccatcaagattcatatcctatttcacctgtgtcaaatgcaccagtgtctcagtcttcttttacaagaggggaaaataccagaagcatttccaatttaggaaaaacaatttcacttatagttgaaattccaccaaacaaatctgtgaaacagttgttagaagcacaacatcacacctgtgctggatgccataagcattttgatgatggaaaaactttgattcgggattttgtacagacatttggatgggggaagcctcgactttgtgaatacacgggccagttgttttgctcttcttgccacacaaatgagaccgcagtcttgccagccagggttttacatcattgggatttcactcactatcctgtttctcagctggcaaaatcctatctggattctatatatgaacagcaaagataa

SEQ ID NO: 47620 - DNA, 255 bp, Glycine max
  Peptide Sequence Number=SeqID_164398
atggatggagttgtcttcgctctttccactcccaaacttaatgttgctaataaagccagtcaacttcaacaatgggttcaggccaataaggtatgtcgtcatagtttgttaagtgccttgtctaatgatctttttgatgtctgctgctctgacaaggaagtgagaatagtagacggaggcaacaacaccatagtagtagacactgagtctggaactcaacgcctatggtggccttggagtgcatgtcgaacttag

SEQ ID NO: 47621 - DNA, 249 bp, Glycine max
  Peptide Sequence Number=SeqID_164399
atggtgagcttgggtccaaaactgtcaatgtacctattgagtgtctatgttagtgacgaggacatgacctataatggggttaatgctagtagtgagccatctgaagctgaatatgatgacattgaagatgatgttgatttgattaaaggtgaagtgcattcagattatgatataaatgaaatatatgttgaaaaaggtattttggggaaacatttgagaggcaaccaaatggcaagatcaagtttgtaa

SEQ ID NO: 47622 - DNA, 291 bp, Glycine max
  Peptide Sequence Number=SeqID_164400
atgaagcaagatcgtggcctacttatgagttggacaaaaagatcatggcttgtgtggctacctttgggttgcacacaaagatcgtcgaacctgaagataaatcacggtgctagcttttggttattaggtgaggttgtggagcaggtgttcgatataatgtctgaatcaggagcaacatcatcttctagtttatgtgccaatgctgtaaaggtgaaaaaatcttatgaattgttgaagatggactttgaagatttgaagacggaagttgacaaaatgaaggccaacttatga

SEQ ID NO: 47623 - DNA, 342 bp, Glycine max
  Peptide Sequence Number=SeqID_164401
atgcacattctcaagaatgaaataccaatggacttctgtaaagcttgggatccaaacatagaggccattgggatcaaaacacagggcaaaagcacaccaaatctagcactcaatacatgtataccaaatgcgaaagtaatacaaaacttcttcaactcaacaattgcaagtgaacccttaatactatcacttcttcgagcaatacaaaacaaaaaacaaaaaacatcttaccttgacgaacagttgcaagtggcgacaccactcaaaggagcacgacttcggcaacgtggcggcggtgggaccaacatgacgttcggaggtcgacaaacgcgacaatgttag

SEQ ID NO: 47624 - DNA, 357 bp, Glycine max
  Peptide Sequence Number=SeqID_164402
atgcacgatgcgactcaaagaagaaaaatgtgcaacgaaggcttccgagagttcacggctgaaacgaaccgtggagaaggaacggtgaaacaaacggtgaagaagaagcaaagaagtgaagagggtgaagacagtgtgaaatgcaacttttttattaaaagatacttgatgtacaccgctccaccgcccaatgatgaagaattgatgcaagcggcaagccgcagtgtgataacatcacagctagagtttgcactttgcaggaagcaggtcgatgatccattccgtttgcatcttgttgacaaccacagacgcgtggcagtcgcactggcaggacacggtggggcccatagtggttga

SEQ ID NO: 47625 - DNA, 225 bp, Glycine max
  Peptide Sequence Number=SeqID_164403
atgtctcattacagagagggttatgagcgctccgacgggggtaggattctttcaccagaggttcgttcaataggggaaagttataaggacggtccctctcaccatcacaatggctcagaagccactaatggtcaagtttctggtgttcccgttggtggcgccacccttgttggtggtgtcattgctactaaaagagggctcttccctaactctgacatatgttaa

SEQ ID NO: 47626 - DNA, 447 bp, Glycine max
  Peptide Sequence Number=SeqID_164404
atggatttggcagccactgatgtacaagtcataatgcctcatcctttcattcctcctcttcctccacccgaaaaacctagtaagaccaaaaaggtgtttcctcctgccgtcctttctggttacacccgggttcatggggaagttggttcctactcgactagttttttaacttataagtctattaccaaattccttgagatcgtcgagttttttcacgatgatcatcccgacatggtgatcattgattcttgctcagaggaaaaatgtgtttcttgggcacttctccaagttttgatgatgccaaaacaaaagcaacacaaattttatttcaagtccaaatcaagaccaagaaaagaaagatcaagaaaaaagctaagtcttagtctatctttgttaaaagagtctcttagtgattgcaaaagtttggcctcacaacataatttttaa

SEQ ID NO: 47627 - DNA, 333 bp, Glycine max
  Peptide Sequence Number=SeqID_164405
atgaccttcatgatcttcgtgactccacgttcttctttagacacgattcatctggtggcgacacatgactctatgccaggtggtgatggtggtggtcgtgtagatagatttgatgtgggagtgaaggcattgcgtgcaactcgatattgggtagtggcggtcgtcataaaacatgaatctaatgtggtggtgaaggcgttgtgtgagactacaatggtggttgggtcgcgtgcgattgaggtgctggtgttagggggatgtgccacagatggtggtggtcacatgggtgatggtggcagtcagcaatgggtggtgatgggacacgatgggtga

SEQ ID NO: 47628 - DNA, 915 bp, Glycine max
  Peptide Sequence Number=SeqID_164406
atgaactctgccgccgtcgcaatcaaatccatcaaactcaaccgctcccggcctgacttagacgatgtccgttgcgaggccaaaaccccatccctcctttcctaccccaacatcctcaaagcacattgttccttcacagtggatcgctgcctctgggtggtgatgtcgttcatggccgcaggatcacttcaatccatcatttatcattcccaccccaacggcttaatggagccctacatcaccgtggttctcagagacacgctcaacgcgctctcctacctccactgccagcatctccatagagacattaaagtcggtaacatcctcatttacaccaatgggcaagtgaagcttgctgatttcggtgtctccgcttccatatacgagtccaccaccaccaccaccacgtcttcttcttcgtctctgaagttcactaatgttgtcggcacgccctattggatggctcctgaggtgattcactcacacacaggttacagtttcgaggctgatatatggtcttttgggataaccgcgttggagcttgcgcatggaaggcctcctctctcgcaccttccaccttccaagttcatgatgctcaagatcaccaagaggtttcctttctccgatgatttcgatgacaatatgccacagggaaaatatgataacacaattaaagaatgcacagaggcattagaactgaatcttgtgtgcgttaaagctttggtaagaagaggagaagctcatgaaaagcttgagcattttgaagaggccattgctggtgagttcaaattttataatagagtggagggtaattatacaaaggtggtgcataggcttgctttcattgcattccctgtatcatcattagagcaaagtcataacaacagtaagcaagaaagaggcggtctaaagtga

SEQ ID NO: 47629 - DNA, 360 bp, Glycine max
  Peptide Sequence Number=SeqID_164407
atgcttttgacgcataaacaaaagcactttctgaaagtacctctttctcaatcggtttggaaaaaacttcagacaaaaattgagaaactttctttggaggagcagggattagatgatcaaataagggaaatgcaagaaaggctgaggaatttaagtgaaaatgaaaacaacccgaagtttttctttttattaatactagttcatttctgcaagcagaatgaaactctaatagcaattaaagctccgcatgaaaccaccctagaagtccctgatcttgaggaaatgcatgatggagaattgctgcttctatatgcatcaggatgtagactatccacagagaagatagagaatcattcttag

SEQ ID NO: 47630 - DNA, 300 bp, Glycine max
  Peptide Sequence Number=SeqID_164408
atgacaatcttcggggatgatgatgggcattgttcacccgtgaaaaaaagaagaaaggtcccccagggacaccttgagacaaagggagagaagattagtgtgacactagcgacatcatcaccagaagcacgaccaaaatggaggttgcacatgcttccatgtgccggaaatgtgtctagcgcaaaaggtgtttggcacatctttgagatgtgcttgggggagcgtcaacggtttgctcatgatgttgtaaacattgccttgtatatcagtgaaaggtgcttcaaatggaggggttgttga

SEQ ID NO: 47631 - DNA, 324 bp, Glycine max
  Peptide Sequence Number=SeqID_164409
atgacaagtttagatgcttcttgtgggggtaacctcatgttaaaaccccgtgttgatgccattaggatcattgaagatatgtgttctaacccctatcgcaactcaagggatatgaggattatgaagagaggcatcaaccaagtggagaaaaatgattctcaaactgaattgggaaagcagattaccccaacaatttcaatcaaggacaaggcttcagacagaataaaggaatgtataggtctcaacctatgcaaaatcagaggcccggacaaaaggagaagactacccactcttcaagaaaccatgcttcaatatatgacctag

SEQ ID NO: 47632 - DNA, 234 bp, Glycine max
  Peptide Sequence Number=SeqID_164410
atggttgaacaaaaaaatcaggtcatccctcttcttactccttacaagatggggaacttaaatctttcacacagaatcgttttggcgccactatttagagcaagatcttacaacaactttgctcagccgcatgctattctatattactctcaaagagctaccaagggaggtcttctgattactgaagctactactatttcacccacttctaaattgtacgtaatttgcatttaa

SEQ ID NO: 47633 - DNA, 99 bp, Glycine max
  Peptide Sequence Number=SeqID_164411
atggcagctactcttcctgatgacaagggcggcacaatgaggatggcagctactcttcgtgtctcagcagcggcgagggagattcttatactgagataa

SEQ ID NO: 47634 - DNA, 303 bp, Glycine max
  Peptide Sequence Number=SeqID_164412
atggttaaagtagaagtaacttgggtgcatggttgtagggttggcgagggcaatgctgaaacacgcgacaaaggtagagagagggtttggacgatgtggttgacatcgtgggaaccggaggggacggtgccaacaacacggtcaacatttcgactggtgcttcggttctcgctgcggcttgtagtggcagagttgcaaaggtctgtgtgtcgaggaaagcgtttgagttcttctgcgtgtggaagtgctgacgtcgtattagaagctttgggagtggtcatggacttaggccctcaggaataa

SEQ ID NO: 47635 - DNA, 141 bp, Glycine max
  Peptide Sequence Number=SeqID_164413
atgcctgaagagtttgtagggtgggcagtttgttccccgttgggaatgaaggcaagctacaatcaagaagtgagggcttctggtaacattctggtgaaaagaataggagaaagaaccgagagtggatccaaaagcatatag

SEQ ID NO: 47636 - DNA, 204 bp, Glycine max
  Peptide Sequence Number=SeqID_164414
atgcaaatcgcaggagggaatgacgcttttcctgtgaacgcgacaactggccatggtgtcgccattaatgatggcgtgttgctggagcttggactcgccagtcaaactggcgagttgatgttagggcattttgggagtagccagtggcactggcgatttgaggttgatgtagccattcccaatggcgatttcagctctttataa

SEQ ID NO: 47637 - DNA, 175 bp, Glycine max
  Peptide Sequence Number=SeqID_164415
atgagcaatttaaatcttgacgaagatgatgatcatgatgatgatgattatcttgagtctaactcatacgttgaagagtctttagacgaagatgatagtgttgacggtatatctgatacagacgatgaagtcaccgacattcctcaaccagtaagaattgttcacccagcagaag

SEQ ID NO: 47638 - DNA, 822 bp, Glycine max
  Peptide Sequence Number=SeqID_164416
atgggcagtgcttctctgattccagtttcctggttgccttggcggccactttctcctttcaagggaacggtgaaaaccttggtcgcaaaaccatggctgaagaagattcagcaagcaagacccctcatttccgtggttaacaaggctgcctctctatcttcccccgtgacagcacccagcgtcggcgttcggtttcggctggacaatttggggccgcaaccgggttcgaggaagagggctaagagaaagggtagaggaatatccgcagggcaaggggcaagttgtggttttgggatgagaggtcagaaatctcgatctggacctggcgttaggaagggtttcgaaggtggccagatgccgctttatcgccgaatccccaaactcagaggaattgcaggaggtatgcatgcgggattgcccaaatatgtccatgtaaatctgagagacatagaagatgctaaatttaaggaaggggaagaagtgtctctagagtcactgaaggcgaaaggtgtgattaatccatcaggaagagaaaggagacttcctttgaagctgttgtccttaaatcttgcttctccaagatcattttctggatctgtagagatcttgggtgaaggagaactgagcaagaagttgacattaaaagcccgcgccttttccacatcagcaaaggagaaacttgagaatgctggttgttccctcaccgtgcttcctggccgcaagaaatgggttaagccatcagttgctaaaaaccttgcccgcgctgatgaatactttgccaagaagcgcgccatggctgcttccgagccagcctcagcttga

SEQ ID NO: 47639 - DNA, 454 bp, Glycine max
  Peptide Sequence Number=SeqID_164417
atgctgccaaacaataggaacggggggttatcatccctcaggagacccaacagtgcctctaagattcccaagatacttctcaggttcatcctcaactcacatgccaccatccccgccaccgccgccgccaccgcaacgaccatacctatacccttcacctacgaggccagtgtcatttgggtcatcacacttccctctccagcatgcagtgaacgattactatgtgggccacgtgatgagtggtggcagccacggacactatgttggaggagagagcacaaggagttacacgtgcattggtgcaccggtggggcaaggtggcggattcgctggtggtaaggaggggtctgcagtgcaggaggaagggttgagtacttggggaaggggctattcaggtgcacaggatcgtttggatcctccctcagcgatcaatcggtttcaagatggtttctaa

SEQ ID NO: 47640 - DNA, 138 bp, Glycine max
  Peptide Sequence Number=SeqID_164418
atggcactcttcttcagagggtgtcgcgccagtatgggtatcgctaagatattcctcgacacccagctgtgttcactgatgagattcccaccccacaacaggttgatgataggtggttgcactcgcataatcatttga

SEQ ID NO: 47641 - DNA, 312 bp, Glycine max
  Peptide Sequence Number=SeqID_164419
atgaggatagaagttggacacggacacgtgcacttccgaaattcaacgagcttacataatccagtggaaatgcctatggaaccagtaagtgagccagagcctattacagacaacaaacagggttcagtgagggacagaagagatgatccacttagaaaaagaactataatcataggatttgcaggatggattcgaggtggtttaaatgcaagtgttgctagtacaaatattaagacatttacaacttcaacgggaggggcagcttatggtgaaactttatttgtagttggttcaatgacgggcacactttga

SEQ ID NO: 47642 - DNA, 558 bp, Glycine max
  Peptide Sequence Number=SeqID_164420
gcttgtcgcccgcgattgacgaaggtcgcagaagacgacattagtctctgcgtcttctcaggcttttcgtcttacagacatcaaaaagtttatacggataaccactcgggtatttccgcccgtcagcgtgactcaaaagtcagtatgacagatcttgtgagcgcggaagatgacgtcgcagaagacgacgttagtctctgcgtgctatcaagcttttcgtcttacagacagcaaaaagtttatacggataaccactcgggtatttccgcccgtcagcgtgactcaaaagtcagtatgacagatcttcaaaaagtttatacggataaccactcgggtatttccgcccgtcagcgtgactcaaaagtcagtatgacagatcttgtgagcgcggaagatgaccaaaaagtttatacggataaccactcgggtatttacgcccgtaagcgtgactcaaaagtcagtatgacagatcttgtgagcgcggaagataacgtatatctccacgtgtcaacaggcttgtcggccgcgactgacgaaggtcgcagaagacgacattag

SEQ ID NO: 47643 - DNA, 201 bp, Glycine max
  Peptide Sequence Number=SeqID_164421
atgatgagaaacccaagaagaggatcaaccagagatgtgctcgcacaatgtgccgcaagctcacccagcgagtcatttgtcttttctcacgctcagcgtgcccagctcgctaagccaaaattcactaactcgcgcttagcaattaggatttttagcattgggaagtgctttaaagccttagaacttgatagagcaagctag

SEQ ID NO: 47644 - DNA, 210 bp, Glycine max
  Peptide Sequence Number=SeqID_164422
atgtcggcctccctctactcttgtacctcctcctctttacccattactctagctccagcacaggacatggggttgaatcaatttagatttttcaacatggttcatgacatcttggtcaagaggaaaatgcaaggatcacgcatgagcaaacatgaaaacaaaaggtatgctgtttgtagaacaaaaagtatgttgaacgcatatgcatga

SEQ ID NO: 47645 - DNA, 714 bp, Glycine max
  Peptide Sequence Number=SeqID_164423
atgaccccaaagaagagtgaaaatgttaggattcttgctatcaacaacattgaagaaactataagacggcctaaaggaggactcatccatagctttctgtttaacatagtgatgcccagactgggatcaagagactatgttagtgataaggacatatgttgcatgtataaggtgatagtgaatggaaagactccccaacattcacctaaaccatcttctccccccaagagcaagaaagaagtttttgcattggctaaggtgacgaagaagtcgtttgcgaagtccaggaagaaggccaagatagacaagactcttgagcgaaaggatgctataaaagaggaaaatgatatcattgttttgtggaagctatatctatggaagaacataagaaaaagtaagctaaagatgcaaggttgggtgccttggcaagaaaggtttctgaagaaattccagaagatgtttttttttggagtctctaaaggcattgcctatttaggaggttcagaggaagcaacagaaaaggctatcatggttgatgttgatggtgagctagtgcctgaggaacaagctaaaagggaagagcttaagagaattcaattttttgttgagcatggagccgaattgattgatgtggatgttgctacaaggcaagtaaaggttaaagtggctatcattcctgaagactcagacccaaaagagaaaaaagttctctaa

SEQ ID NO: 47646 - DNA, 624 bp, Glycine max
  Peptide Sequence Number=SeqID_164424
atggaggggatgagggagtcagggcttttcttggggagcgacacgaatcttggagtagttaagactgaccaaccaggttgttccacttggcactgctgccagagaaggaagatgggtctcccaggtattccctcactttccctcgctctttctttccccttcttttcttatatttctcatcctttccctacattttgtgatctgatggagcgagacaaacatgttacaagccgcctcgcccgcaactctgtcgtggcacggcaagtctccgtcacggtacgcggtgtcctgaaggccatcgttagggttcaacgcccctttgctagtgggtattcgcgttttcatcccgtttgcatgagagatgttggctttctcgttgccgttgtcgcacgtctcgcagtcactggccttgtggccctcgcaccaccacgtcgtggcggctcaaggtcacacaaggtggttccttctcgcgcctcccgtgctatttggctggggttttcacgactcttggtgtcctccatcatgtcgttgtgtcgtgtctcgttgtcaccagtcccgtggcggccttgcgctgccataccctatgccccgtggcgtcagggctcgtgcctccctttatggtga

SEQ ID NO: 47647 - DNA, 813 bp, Glycine max
  Peptide Sequence Number=SeqID_164425
cggcaatcctccgagtcaaagagactgcatcattgcctctgatgatgaaacagaagatgcagaagcacctttcattcaaaagttgtttggcattcttaggatatactacgtgttccttgaatcaataagacgtgtctcattgggaattttggcaggtctctttgttctgactcagccatctaagagtccggtgattatcgtgctgtccatgacctcttttcagctattcttcatgctgctaaagaagccttttataaagaaaagggttcagttagtggagattatctcactcgcctgtgaagttactttatttgctacttgtttagtcctcttgaagaaggacatttctgtgagtgctgagactaagtatggaatttttatgcttgtgctgttcctaatagggtattgtgcacagatcactaatgaatggtatgctttatatatccaagcaaagatgctggaccctgaggaaaaatcactcttgacaggtttgaaaaatgcctccattgggtttcttttgtattttgtccctcaaaagtgcatcaaagatttggaaaagaggttaccacaaaatgacaatgtgaatgaagagcctagagacactgcttcgggcgctgacagatccaggcgctcgagtagcaggagctcaggtacacctgatggagcatggttgaaacaactaaggggatttgcaaagtctagcttcggtagggaaagaagtggaactagaaatgatccttctactagtggcactactggatggagtgggttatggggaaacaaaaggagtgggagctcatcttctgagttcaa

SEQ ID NO: 47648 - DNA, 954 bp, Glycine max
  Peptide Sequence Number=SeqID_164426
atgtcacattttcacaattttttggttgatctaccccaggataaattcatgattaattgcataacaaaagctgaagagttgaagctgccatacttgagtgcatatttggattccattggttcaaattacaattatggggcaaactttgcagctggtggttcatccatacgacccacgggctttagtccagtcttctttgggcttcaaatatctcaattcacacagttcaagtccaggacaatggctctctataatcaaagctctcacaacagagaagatgcacctttcaaaagcaggcttcccaagtccatggacttctccaatgccctatacaccatagatattggtcagaacgatctaagctttggtttcatgtcctcagatccacaatctgtcagatcaacaatccctgatatattgagccaattctctcaaggattacaaaaactttacaatgaaggggctagattcttttggatacataatacaggcccaattggatgtttgccacgagcaagtgtggagaacaagcccagacctgaagacttggattctactggatgtagaaaaatggagaatgagattgctcaggagtttaacaagcagcttaaggacattgtgtttgagctaaggaaaaagttacctacggccaagttcaccaatgttgatgtctactcagccaaatatgaactgataaaaaatgcaaggaatcaaggttttattaatccaaagaagttctgctgtggcacaaccaatgttatccatgttgattgtggtaaaaagaaaattaataaaaatggaaaagaagaatactacaaatgtaaacatccatcaaagtacattagctgggacggggtgcactactctgaagcagcaaaccgatggcttgccacgctcattttgaatggctctttctctgatccaccaattgctatagggatgattggtaattaa

SEQ ID NO: 47649 - DNA, 763 bp, Glycine max
  Peptide Sequence Number=SeqID_164427
atgcagagaattttgagccatattcaggtgtttgcactatctagatggttaacagttaaattgccagtcgagttttacgaatttgccagacatttacaatggaccgtaccctattttcctgttccatgggaagctgaacctatgaacctgtttatggtaggctctaatccttttgggagctctaacttcatcaccaaagccccagcaacaatcccaaagaagttcttggacaagagtttgaatttggccgcttcagtgtatggatcaccacttacttcttccgagtacctgcaatactttgagagcgaaaatatgaaaccagaagctgaatatcttttggattcacaacattccgctggatggacagaattttatagaagcatgttttggttagctgtgatctgtggtggtttaatggttctgcatgcttttctcctcattgtcctgaaatttgggaagagaaattctgagaaggataaaatacatggagcactcacattccctagatttgaaatgtttcttatatttcttgcactacctaatgtttgcaagtcctctggtgtgcttcttcaaggggggtctccttctggattggcagttggaattctactgttggtttttgtgggcactgttcttctagctttgttcatgttcctctctattggaatcacatttggaaaactacttcaatataaggaagttcatcaagaaggtgagacatttcactggtaccaagagcttgtcagagtaactctggggccag

SEQ ID NO: 47650 - DNA, 384 bp, Glycine max
  Peptide Sequence Number=SeqID_164428
atggaactagagagagacacgtggcatacccacgatggcgctgtcggttgcaacaagtcgttgagagtttatgaagacacaacttccctcgagatgaaagtttctcggcgggtggagtggtggcagaacatgatgttccccgttcggagggtttggtttgtcgttgccaagcgcctcggcattcgcaaaactgggttactgaagctaagtaatgatgtgagggcatgcgaatatgaggacattcaagtgatgtgggagatactaaacagaaacgaatcagagtttggtcgttcttctagcactaggaaaggcaacaacaagaaggggcattgctggaaattattgaggtgggcaaggtgtgctccatgcatgtgccgcacatga

SEQ ID NO: 47651 - DNA, 1230 bp, Glycine max
  Peptide Sequence Number=SeqID_164429
atgtctttttcatttctctctctgtctctctatttaatttcattaggccaaggtggttacaacccatctctgcaagcctttggagcagatcaacttggtgaggaagaagaattgccatgtagcaaagaagataaaagttgcaacacaaaaactctattcttccagtggtggtattttggtgtttgtagtggaagcctattgggtgttacagtcatgtcctacatccaagatacctttggatgggtgctaggttttgccatccctgctatttcaatgattctctctattttaattttctctggtggaagtcctatatatttatataaagaacatgatgtccttcaagctaagaagcccatcatgaacatatttcaagccataagagcttctgcattgagatgcttccattgtgaaattaccctaccaaatgacaagtctgaagtggtggagctagagcttcaagaaaaacccctttgtcctgaaaagttggaaactgtcaaggacttgaataaggatcctaaaagtggcatgtatctgctagcaaatgccaaggttatggtgaggcttttgcccatatggacaatgcttctcatgtttgcagtgattttccagcagcctgccacatttttcacaaaacaaggcatgacaatgaagaggaacattggtgcagatttcaagattccaccagccacactccaaagtgctataacattgtccataatactattgatgccattgtatgacaaaatattcataccaatgactcaggtgatcactaggcaggacaagggtataagtgtgatgcaaaggatgggaataggaatggttctctcaatcatagccatgattattgctgctctagttgaaatgagaaggcttgatattggaaggcaaatgagaagtgcagggtcacaatcagaaacagtgcctctaagtattttttggctgctaccacagtacattcttcttggcatctcagacattttcacagttgttggcatgcaagagttcttctatggtgaagttcccaggaatatgaggacaatggggattgccttgtatacaagtgtttttggggttggaagctttgtgagtgcactgttgattacactagttgaagtgtacacaagttcaaagggaataccaagctggttctgtgatgatatggttgaagcacacttggacagttactattggcttctagcatggttaagtacaatattaccataa

SEQ ID NO: 47652 - DNA, 345 bp, Glycine max
  Peptide Sequence Number=SeqID_164430
atgggtgctccagagatgtcgcctcctccctcttcagctccaccggttccttccacgaccgtgttgactgtgaagtccccttcctcctcttttcaccctcatgtgtcgttggatcacatctattcctccaacaatgcttattctctgtggggtatgaggtataagcctgaacaaaagaccttgattggctttgtgttggcctttgataaaaatttgattcggtcagctggggtccaacatgccatgaattctgctaagaaggagaaaaaggacttggttggccaggtggagggcatggaggtggagaaaggcgagcttgccaaggtggtggagaacctcatgtag

SEQ ID NO: 47653 - DNA, 1005 bp, Glycine max
  Peptide Sequence Number=SeqID_164431
atgtcatggtggacatcgctaaggtgggctcttagacttcgcacattggctggacaagaggtccttgttgataagggttgttacgggttgggtgttcatgctcctatgccagggctgccatggagggttgacgtgtgtctcggagtgccacgtagcatggcacgtgtatttggtggaccgtggacagtatataagcccccaagctttgagaatgcttgcaggcaaaagaggttgtccaatgtcgaaggagattatcccgcgttgagggaaggtaacctcgataggtgtgagaattgtaggtctggcaggcttgccaagccgccgagcctggacaagagaggtctgacgtgtcaggcatgtgcgatgaacgcgcaatactcttgcatacgtgtaactcgtggattggggttagattcagtaacccttgatcggcctagaggtcatttccgttgtggaggcactaggttcaagtcatttgatgaggatctgttgactcatgtggagagggttgataaggctattctggagcagctgccagcctcgctggatgcgcaggccattttatctcttcctttggcgagtgatcctctccttgccttggatggtgaacattttttccttgtcggacctactagtgggatcgtgccactatctgttgttgctcctactgctggagaagggggtcaacttgttgttgaggttggccatgttgttgctactgctgaggtcaccctcaatgccccttcctttattttggctaagaggaaacgagataacgatgttggggtgtcgggccgtaagaagtcgagggcccccttaagccttcgtgccctgaggcatgttgtagggttgacacatccccagttgatcgaaatttgtgcccctactgttactgctcctgtcattccttctattgcttttgctttttctcctcttgttgcttctatttctgctcctttacctccttctgccgcccctgctaaggaggttgttcctattgcttga

SEQ ID NO: 47654 - DNA, 213 bp, Glycine max
  Peptide Sequence Number=SeqID_164432
atggaagattttcaaccactatttggcggtctgcctctggtccctggagtttgttgcttcaaaagcatagggacacctattagagtgtatacgaacactgtcaacatggatggtggtagattcgcttgcgtttatgttgagattgatttgagtgttcctgtggtgggcaagttcttcttgaatggtgcttggtatcatgtggaatacgaatga

SEQ ID NO: 47655 - DNA, 997 bp, Glycine max
  Peptide Sequence Number=SeqID_164433
agacatggagagtgaaagcaataagtctaagcagaagcagaagctagaagtatctgatatcctctgggaatctgttgtgatctatttcagaaacctcaacttcatcatcttcacctttctcacttctattcctctcttttgtatcatggtttactttgaaattttcctccaagaactcctggttgaaacctcaaatattgttaacctgccacatgaatcacatgatgactccatagtcttcactgactacgacttcatcgactatcgcaacagctacaggccagatcttatcatagacagattcaacaaggactatgtcctgaagttgattctaactggattcatttacatggtgccactctatgtcttagagtttgtgtcagcaattgttactatagctttggcttcaaagttgcattcaaaagagaagaaaatgactcttaaggagatggttcagaaaccctttgacctatcaaaattgagaggctcatttgtcacttctgtctatgttctcttcttgacaactactcaccagcttggattactgtttatagttctaaattaccatgtttacttgaaggactcgagtttttacttgttgttcgcggtaatttgcagcgcagcattcgcaaaggttttaaggatgtatttggagtggagtgctatgtggaacatgagtcttgtgatgtcggtgttggaggggatatatggtgttgatgcattagcagtgtcggcttatttcagcagaggatgccacaggagggggctctttttgatgctgattttctttgcttggggacatcttttgaggctttcatgctaccatattggaggctatgagcaaggaaatgcaatttttgtacaagttggcttgtactgcatggtaaatccgctgaaatgggtggcctgcatgatctatgtccatgattgcaaggagaggaagttggaaaagaaagctgatgaggaatctggcaaagatgttaagaatggttcgtga

SEQ ID NO: 47656 - DNA, 1182 bp, Glycine max
  Peptide Sequence Number=SeqID_164434
atggctgatgagagcgtcgttgagtccccagtgaagaggcagagagatgatgatgaagaaaatgaggtctctgtttccatggatgtggagggtggcaaagaccctcttagtaacggtttatcatctgtgattcctgggtggttctctgaaattagttcaatgtggcctgttgtgtcttttccttgtgttcttgttgctggagaggctcactccttgaaggtggaaaagattttgtttcaaggaaagtctgaataccagaatgtcatggtcttccagtcatcaacatatggcaaggttcttgttttagatggagtaattcagctaacagaaagggatgaatgtgcctaccaagaaatgatcactcatcttcctctttgctctattccaaaccccaaaaaggttttggttatcggtggaggtgatggaggggtcatacgagaagtagcacaccattcttcagttgaaaagatagacatttgtgaaattgacaagatggttgttgatgtctccaaacaatacttccctgatgtagctgttgggtatgatgatcctcgtgtgacacttcatattggtgatggagttgcatttctgaaggaagttcctgaaggaacttatgatgctgttatagtggattcatccgatcctattggtcctgctcaagagctttttgaaaagcccttcttttcgtcagttgcaaaggctcttcgtccaggtggagttgtgtgcactcaggcagaaagcatatggcttcatatggatataattgaggacattgtggctaattgtcgccagatttttaaaggctctgtcaactatgcttggactactgttcctacatacccaagtgggatgattggttttatgctttgctcaactgagggaccacctgttgatttcaagcatccagtgaatcccatagatgaaaatgagagtcagaagtcagtaagaccgctgaaattttacaactctgagcctttgtcttcgttgattaaaggaaacatcatcaacctgggaagcacagataaacactgtagcatagataagaactatgaagtcccgatccttcaaaaatggaagcatatgggtgtcatacccgtgtcagacactgatatgggtgtcatacccctcaagatgactagacacaattctgatacggctcaagctgtttccgatacggcttaa

SEQ ID NO: 47657 - DNA, 186 bp, Glycine max
  Peptide Sequence Number=SeqID_164435
atgtatgttggggtagaagtgtacaaagttgacgatgttcggggaatgaaggacttcacgacgtcaaggatatggatggtggcgaaggtgtcggtggccatgtcatcgttgagggtctacacggtgacaagagaacatgctgctatggccattgtgaatgaaagcgaggaagagctctctacctag

SEQ ID NO: 47658 - DNA, 2729 bp, Glycine max
  Peptide Sequence Number=SeqID_164436
cagaaggaaatatgtggttgaatgacaccattgggtttgttccaaaaaattcttgggccatagatccatttggatactcgtctaccatggcatatcttctgcgtcgcatgggttttgacaacatgcttattcagaggacccattacgagctgaagaaggagcttgcgtggcataaaaatttagaatacatatggcgtcaaagctgggatgcagaggaaaccactgatatatttgtccatatgatgcccttttattcgtatgatatacctcatacatgtggcccagagcctgctatttgttgtcagtttgattttgcacgcatgtcgggttttgcttatgaacaatgcccatgggggcagtatcctgtggagaccactcaggaaaatgttcaggaaagagctcttaaattactggatcagtacaagaaaaagtcaactttgtaccgaaccaatactcttcttgttcctcttggagatgattttcgatatattaatgtcgaagaagcagaagcccaattcagaaattaccaaatgctgtttgattatatcaattcaaaccccagtttgaatgcagaggccaagtttggtactttggaagattactttgtaaccctgcgtgaggaagcagagagaataaattactcatctcctggtgaaataggatccggtctagttgaaggttttccttctctatccggtgacttttttacttatgctgatcggcaacaagactactggagtggttattatgtttcacgacccttcttcaaggctgttgatagggtactagaacagacacttcgtgccactgaaatgatggtagctctaatacttggcacctgtcggagatcatattgtgaaaagttcgcaatggggttttcttataagttgacagctgctagaaggaacttggctctttttcagcatcatgatggggtgactggtactgcaaaagatcatgtggttatggactatggaatgcgcatgcatacttcattactggacttgcaaatttttatgtccaaggcagttgaggcacttcttggaatccgctatgataaactagaccacagtcctgcccagtttgagccagcaatagtgagatctaaatatgatgcccaaccattgcataaagtgattagtgttcatgagggttcttacgaatcagtggccttttttaatcctttggagcaaaccagagaagaagttgtaatggttgttgttgacagtccttatgttacagttgttgattctaactggacttgcgttcagagccagattttgcccgagttgcagtatcatagtagcaagatctttactgggaagcatcgactttactggaaagtttctgttcctgcaatgggattggaaacttattatatttccactagctttggtgagtgtgaaaaggccaggcctgcaaagttgaaaatgttctctaagtctagctcggttgcttgtccaacaccctattcttgtgtggaagtagaggctgatgtgactgaaattgagaatcagcatcaaaaactaacttttgatgtaaagtacggtttgttgcagaagattatctctagttccccaaatactataaatgaggaaattggtatgtattctagttctggtggggcatacttgttcatgccccacggcgatgcccagcccattattgaagaaggtgggcagttgttggtgtcagagggtcctttgatgcaggaagtatactcttatccaaggacagcttgggataaatcccccatttctcatagcacccgaatatatagtggagagagtacagtgcaagggtttgccattgaaaaggaatatcatgttgaacttcttggccgtgatttcaatgatagggaattgatagttagatataaaacagatattgataacaagaagattttttactcagatttaaatggatttcagatgagccgaagagaaacttacgataagattcctctgcaaggcaattactaccccatgccctatctagcattcatacaaggatcaaatggtcagcgattttctgtccattcccggcaatcattaggtgtggctagccttaaaaatggatggctagagataatgctagaccgccggttggtaagagatgacggtcgtggtctgggacaaggagtgatggataaccgtgtgatgaatgttgtcttccacctaaccatggaagccaatgtttctgcaacatcaaatttggttcccacaccttttccttacagcccttctcttttatctcaccgagttggttctcacttgaactatccaatacatgcatttgtttccaagaaaccgcaggatatgtctgtgaagccaccgcctagatccttttctcctcttgccacccccttaccgtgcgatttgcacatagtgaacttcaaggttcccaagcccttaaagtttttgcagcaaccacctgaaggtcctagattcgggctaattttgcacaggcgacattgggattcttcgtactgccggaagggaagatcacaatgcactaatctggccgacaacaccgtgaatctgttcagcatgttcaaggaacttacagtctcgaaggctaaagcaacttcccttaatctcttgcacgaagaccctgaagtaatgggattctcagagcagtttggagatcttgcaaaagaggggaatgtagccatatctccaatggaaatacaagcctacagattggaattgaggccacaaccacaatag

SEQ ID NO: 47659 - DNA, 198 bp, Glycine max
  Peptide Sequence Number=SeqID_164437
atgggtcatttgggtcgcatgttgttggagattttgcacatgtttgtggaagggttttgggtcgagaaggtgtataaggagaggaaagatggggggttggaagtgggggttttggtgtctaatggaggtgaagaaagaaaggttatcatgtgcaacaagatgtatgttgggaatgaaggctttgaggccttagagtaa

SEQ ID NO: 47660 - DNA, 498 bp, Glycine max
  Peptide Sequence Number=SeqID_164438
atggagagcagcctctacgacttttactattcagccacttactcagacgagtcaacaatggctccatttgcgccgtctaacaagcctgtctttgggaaggaagaggatgtttcaaaagtacttcgtgctaaagttgcttcccatcctctatttcctcacctccttcatgcctacatggattgccacaaggtgggagcgccgcaagatgtggcacacctattagaaggaatcaaaggagagcatacatctggggtgtgtcagatatctgaatctgaaggcttcttgggtacggatcccgagcttgatgatttcatgggaacgttttgcgatttattggtgaagtacaaatcagatcttttaaagccctttaacgaggcaacaatgttcctcaacctcatggaaactcagcttcactccatctgtaacaacactcctcctcaacctggtctctctctttctctctttcagatctctctcgacacttgttggctaatatga

SEQ ID NO: 47661 - DNA, 558 bp, Glycine max
  Peptide Sequence Number=SeqID_164439
atgtctcgtgtttacgttgggaatttagaccctcgagtcagtgagagggatctcgaagatgaatttcgtatatatggtgttctcatgagtgtctgggttgctcgtagaccaccaggatatgcatttattgagtttgatgatcggagggatgcacttgatgcaattcaggccttggatggaaaaaatggttggcgtgtagagctttctcataattccaagggtggtggccgaggagggcgtgggcgtggaggtgaagacacaaaatgctatgaatgtggtgaacctggacactttgctcgggagtgtcgattgcgcattggatcacgtggccttggaagtggaaggaggcgaagtccaagtccttatcggcgtcgtagaagtccaagttatgggtatgatcgcaggagttacagccctcgtgggagaagatctccaagacgacgtagcatatcgcttccccggggtcgcagctatagcaggtcccctccatatcgtccttcttgccatgattcaccttatgccaatgcgtatgtttatgttcaactcagttgttcttaa

SEQ ID NO: 47662 - DNA, 186 bp, Glycine max
  Peptide Sequence Number=SeqID_164440
atggattctcgacggaagttcatatgggaagagatgtcgtacttagaaagatggtggagggatgcatcagatgagatgaaggaatccttcatcaatttggtaaaaaatggacagctagaaattgttggaggcggctgggtgatgaatgatgaggccaattcccattattttgctataattgaacag

SEQ ID NO: 47663 - DNA, 548 bp, Glycine max
  Peptide Sequence Number=SeqID_164441
atgactccttcacagcagcacgatgcctccatggcaacacctaacgccccatttgctccgcaatggaatgtacccggagcaatacctgatatgggcgacttattaggtgttgatttgcgtcaggagttttctgcagaggctgagcaagcagaagcggggagacaacgcggcggcagaagaaatcctgatcgtcaagcgcgaagatgggatcaaccatggatagggtttatggattatggtaagggtttagggttagggttagaggttccgggtttaagggttagggttgagttgtttgtgttagggttaagggatatggttgagttggttgggttaggggtagggttaggtgtagggttagaggtttggggtttaagggatagggttgagggtttagggttagggttagatgttagaggtttggggtttaagggtttagggtttggattaggggttagggttaagggttataggttagagttagatgttagaggttgggggtttaagggtttagggtttggattaggggttagggttaagggttatag

SEQ ID NO: 47664 - DNA, 126 bp, Glycine max
  Peptide Sequence Number=SeqID_164442
atggcttcctacgggtcggcgttcgcttactcgaactccctcaggcggtgctttccatttgtccagagctgggcaagggacgatctatcagtcgtgaccctagcctctactcgcgtccatccctaa

SEQ ID NO: 47665 - DNA, 240 bp, Glycine max
  Peptide Sequence Number=SeqID_164443
atggtagcctggcccgagatccaaccttctcttcataaggaagacaaaggtcccaccgcccaggtacctaatcatatggaggacgagtcatctgaggccaccatcccagagccatttgatataggagaagaggcagaggagacacagattccagaggatccaactacaccagtcctagctatggacacttctcctcccactactccagttcttcagctaacagatgaggaggatggttag

SEQ ID NO: 47666 - DNA, 303 bp, Glycine max
  Peptide Sequence Number=SeqID_164444
atggatgaagatcactggatgcttgacaatataatgtctgaagaagttgatatgaatgtagaaaatgaagacgaacctggtgtgaaattagaacatgttgattgttctgatgtcttcaaatcttataaggtgtttgctacctatgataatattttgaatagggctcgagttgttgcttacgaaattgcttttgtagcagtgattatgaggtcagacacaaatactaatatgagagaaaggacattatttgtcttaattggttgtgaaaggagtggtcagtatagagtcaggaagaaagatttg

SEQ ID NO: 47667 - DNA, 510 bp, Glycine max
  Peptide Sequence Number=SeqID_164445
atgccgatgttggatcaatttcatccatgcattcatgattccattgaaaacattgttgatgtcaaagttgatggtaaatgtggatattgtgcaattgctgccttgttaggtatgggtgaagattcatggtctttggtgcacaaccatttgcttaaagaacttgcaaaatggtctgatgagtatatcaacctgcttggtgacatagacaaatttgagaaattaaagcggttgctactttcttccgtaatagtgtatgcttatgtaccttctgtgactatccttaggttgatcaaccgttctaaccttcagctattggttggcaagcctcatatgacattgacaacaatggaaaaggcacaacacatatctgacccatcggtgcaaggtattcagaaaactgaatacatctatcatcaatatcttatatgcataacgttgaagcagcagggtgtggaggaatggtctgcatatacccaaattgtgacacaaccctctctagtcggtgtatga

SEQ ID NO: 47668 - DNA, 438 bp, Glycine max
  Peptide Sequence Number=SeqID_164446
atggtccgtttttgcggtgctgtgtggaccggtgcctatcctctctctgccgttgtgtggcgcgcgcaacgaacttgcaattgcaagtggatgaatgaccgcaacgacaacgacacttccaaaacacattttttgttttcttcctcaagtttccgaaaaccaagtggaatcgccaattctgcaaaaaaagagaatgagattgcgtgcgacgacgtcgttttagcaccgccacccatgacgactaactccgattcttcttctgctcctctccactggaagttctcccaagtactcggccagcgacttcccaacgagcctctccaaaacggaatgaccgaagagaactggagcagcgggatttcgcgacttcgcggcatcccgaatttcgtttcaaaacggaatttcagagccacgagcccgaggcatgttcgtaattag

SEQ ID NO: 47669 - DNA, 518 bp, Glycine max
  Peptide Sequence Number=SeqID_164447
atgaagttactcatggatcacctggaaaagatcttagtagggtgaagaaagaggcaattgagggcaagaggatggaagttcaagagctgaaggataaccttctacgtagatatagcggttatattactaatctgaggcatgaattttccaaaaagaagaagaaagaaaaactaccaaaagaagcaaagcaaatcttactttcatggtggaatgttcactttaaatggccatacccaacggatgcggataaggttgccttagctgaatggactggtttagaccaaaagcaagtaaataattggtttataaaccaaaggaagcgccattggaaaccaacagaggaaatgcacgctgaaattttggatggtctctatggatccctggacgaatccggcaagttcaagattgttggagggaggaggagattcgacgatgatgaccaagagaaagaggtagcaaatggagtcaaactgcgagtccgcatggcgattgtggatgaagaagcagaagctgcttga

SEQ ID NO: 47670 - DNA, 405 bp, Glycine max
  Peptide Sequence Number=SeqID_164448
atgaggaaaaataggtttccagctcaacgaaaatgtaaattggctctaaggggagaaggaccatttcaagtacttgaaaggataagtggtgatgcatacaagatagattttcctagtgagtacaatattagttctacattcaattttgttaatttatcaccatatgaagcacgtgaagattcaaggatgaatactttagaggagagatgtgatgatgagaatcaagtgttggaacaaaaacactcaagcaacttatgggatccttttcaaattgctagtgggcctattataaaagcaataaccaagagattcaaggaagcattaaatggggttgttcaagacctttgggccaaccataattctgtccaatctgaatttgagcttaaacacgcttacactaattag

SEQ ID NO: 47671 - DNA, 447 bp, Glycine max
  Peptide Sequence Number=SeqID_164449
atggagaagcgtggaatgggtcatgtcagcgtgaaacggagaagtgtgaaatacatcggtattggtactgcattaattacgaaggttcacaccaagaaaaggaattgtttacagcaaaagacaatgaatgatgtggtgtttgtgatgactaattcaagattgaacaagaagaaggatgttaggaaagcaaaagactttaacattgatgatgctgcttctaatgatgaatggattgtggagaatgaagaaaattcagacctaaatgctttagatgaagacatcttagttgaattgggagaagatgctagaggtgaaggtgttggtggtgcacctatggatgatttggaggttcctcctattgatgatgatggtgatggaggagatgctattaatgaggaggaagactatcttcatttaactttgaatgatcttctaggcctaacctag

SEQ ID NO: 47672 - DNA, 222 bp, Glycine max
  Peptide Sequence Number=SeqID_164450
atgcatagaagatcaaagagaggggatagttttgtatgtgaacatcttgctatacagcatggaggtagaggtagcaatgttcacaacaatgggcggagggaacatgaagaagatcaaaatgaagatttgggtggttcgagaacaaaaaatttgaaaccatgggtgaaggtggtgacactcgcaacaacaacgtttgcagattgtgaggaccgaaggaagtga

SEQ ID NO: 47673 - DNA, 543 bp, Glycine max
  Peptide Sequence Number=SeqID_164451
atggcccctcctttatgctcagaaaatatgcttttggctgaaagaagtttcgtaccagggctggaaaccacggctaatggctatcatttggaatggatagagaagacacctaagaatcatttgctgcctcaagacattgatggcgagattggtggaatggaagaccctatccgtgcaaagtgccaaaaagtgtatgcttatgctcacagtttcaatattaactccatctcaaataatagtgattatgagaccttcatctcggcagatgaccttagaatcaatttgtggaatcttgaagtcagtgatcagtgtttcaatattattgacatgaagccatcaaacatggaggatcttaccgcttttgagaacttctctattggaaagataagttttactgctggatcactactgtcgggaggcctagaatcaggaaaagaagtgtttatacttggaattctttatctacccaggtttcacacaacccttgaaaaccaagttcttgatcaaatggttttcaaatgtaaattgatttcgattgggtaa

SEQ ID NO: 47674 - DNA, 240 bp, Glycine max
  Peptide Sequence Number=SeqID_164452
atgaggtacatcaagtctgaagaagttgggattggatggatggagaagagcagagaagatcaaacagaacaagaagaaactgaagagaagcccatgagcccttttgagaagatgatgttagcaaagatggatgagctcatgaggatacacaaagaagactatgttgagcttaaggagtgttttaagtctatcttagaaaggctaaatgctatgggagcatcacatgtggatgatatttga

SEQ ID NO: 47675 - DNA, 333 bp, Glycine max
  Peptide Sequence Number=SeqID_164453
atgtgggatttaatccaagtcacacatgaaggaacatcagaaataaggagagctcgaaagaattcgcttatccaagagtacaaaacctttagcatgaagttcaacaaattccttaagaaaaaaaaggactatgaaaacataacctttcagcctaagaagaatctcaagaaaggagaaccatcttcctccaatggatacacttgcttcgagtacggaaagaaatgttattttaaggtagacaaccccatctaccaaaagaagcaacaaggagataagaagaataaggattcattcaaaaagaagaaggcatatatcgcttgggatgatgattaa

SEQ ID NO: 47676 - DNA, 1290 bp, Glycine max
  Peptide Sequence Number=SeqID_164454
atgcagagggagtttgaaatacaaatgaagggagagctaaaatatttccatggtcttcaagtgaaacaaatgaaccatagaacttttctccatcaaaccaagtattgcaaggaactgctcaagaagtttgatatggataaaagcaaggaggctgcaactcctacagctacaaattgctacataagtgcatatgaaaaagggaaactcattaaccaaacaaagtacagagaattggcatgtgcttgcatgtgtgctcgttatcaatcatgtcctaaagagcctcatttctcaatagttaagacagttatgaagtatcttagaggaaccttagatgttggcttgtggtaccctaaaggtgttgagatctctctagtggaatacttagattctgactttgttggatgcatactagataggaagagaacaagtggtacttgtcacttattaggacatagcctagtatcttggaatagcaagaagcaagcatgtgttgccttatctactgttgaggctgactacattgttgcaaggagttattgtgcacaaattttgtggcttaaacaacacctttttgattttggattgcgtttagaacacattcctttaagatgcaataacactagttccattagtctcaccaaaaatcctatcatgcattctaggacaaagcatatagagattaggcatcatttcattaaggatcatattcacaagggtgattatgatatagagtttgttgatatagactcacaactagctgatatcttcactaaacctttagcaagggatacgttcttccatcttcataatgaacatggcattctaagagatgattcaaccgaagtatgtcagtttggcgtggctcagaagtggaggctttgctttgagtatcacaagttgaagaaattggtggagatgaaaggcacctattacatagacctggtaaaatttttctatactacagctcatattcatggtgatattgggttcttgtgtgctgaagtgaaagggcaacagattgtgatgacaccagaggtttggtttgacattgttgggttattattagaaggagttatggcgaaccagctgggtctcaagaaagctggatttgctttcaacaaggttgataagtacaagtccatgaggaagaatccttctacctatgttgttgttgttacaaaatctaagggaaaagaacgttttggtaatggaccactgatgcttgagcatagacttttggcctatgtgactactcagactattactccaagggggagcaatcatgcttag

SEQ ID NO: 47677 - DNA, 492 bp, Glycine max
  Peptide Sequence Number=SeqID_164455
atggaggccaatccttctcacactacaacccctcatcttgatcatgctctacaaactcccttgctgaaccatccatcaagagtgaacaatattagtcatagaccatcaaggggtatctttgtgatacttctttccattgtttttctagtgtcattggttgcattgatcatgattcagggccaaaactacatggaaaatttggagaatagcaacatagaaattacccttttttctaacatctctaagcaagaattgcctagaggagcggctcaaggggtttcagccaagtccaacccaccccttttccacaaagtttcatataattggaccaacgccatgttttcttggcaaagaacagcttttcattttcaaccacaaaataattggatgaatgaggctaatcaacaatgtctcgttgacccactggtgttcctgtttcgtgctgatgatgtctggttgaattggcttcagatcctgatgaaaaaaaagtaa

SEQ ID NO: 47678 - DNA, 1545 bp, Glycine max
  Peptide Sequence Number=SeqID_164456
atgacatgtccattgtttcacatggggtggtaccatttattttaccaatataatcctgattcagctatatggggcaacatttcatggggtcatgctgtatcaagggacatgattcactggttctaccttcccattgccatgggacctgacacgtggtacgatatcaacggtgtatggaccgggtccgccacgattcttccaggtggcaaaatcataatactctacacaggtgacaccaatgaatatgtgcaagtgcaaaaccttgcataccctgccaatctatctgatccccttctccttgattgggtcaagtatgcgggtaacccggtcctagtgcccccacccggtatcggcccgaaggattttcgtgacccaaccacgggttggatcgggccggatggaaagtggagggtcgcaattgggtcaaagaaaggaaaaaaaggcatttcattggtttacacaaccacagattttgtcaattttgagtccaatgatcactacttacatgcggttccgggtacgggtatgtgggagtgtgtggacttttacccagtttcaataagcgggtcaaggggtttggatacatcagaaaatgagccaaatgttaagcatgtgctaaaggctagcatggatgaaacaagggtggatcattatgcacttgggacctattttattgaaaatgatacatgggtgcccgataacccacttgaggatgtgggtattgggttggttttggactatgggagatactatgcttcaaagactttctatgatccagagaaagagaggaggatcctgtggggttggattaatgaaacggatacagaaagtgatgacttgagaaagggttgggcttctcttcagacaattccgagaacagtgctgtttgacagcaagactgggactaatttgcttctgtggccagtagaggaagtagaaagcttaagactaagcagtgatgaatttgaaggagtggtggttaagcctggatctgttgtgccactgaacataagcctagcaacacagttggacatgtttgctgaatttgagattgaaacattggaatccaaaagcattggcaagaacaacataggttgtggaagtggtggtgccacaaacagaagtgcttttggaccatttggtcttttagccattgcagatgacacactttcagaacaaaccccaatttattttcgcctttctaatactacccttggtagttcaaccacttttttttgtgttgatgaaacaagatcatccaaggctgctgatgttgcaaagccaatttatggaagcaaagttccagtccttagtgatgaaaaattatcaatgagggtgttggttgaccattcaattattgagagctttgctcaaggagggagaactgtgatcacaagtagagtttacccaacggaagcaatatatggagctgcaagattatttctattcaacaatgcaactggcataaacattaaggccaccctaaagatttggcaattgagctctgcttttatacgcccctttccctttgatcaaagtcaataa

SEQ ID NO: 47679 - DNA, 1257 bp, Glycine max
  Peptide Sequence Number=SeqID_164457
atggcattagaattcgttggtggcgctcttctttctgctttccttcaggttgaatttgacaggctgacttcttatcaagttctggactcctttcatcgaagaaaactcgatgagacgctctcgagcaagttgaaaatcaagctgctatccatcgatgctctggctcaccatgcagaacaaaagcagttcagagatcaacatgtgaaatcatggcttgttgctgtcaaggttgctgtgcttgatgcagaggatctcttggatgacatagactatgaactctccaaatgcaaagtggatgctgaatctgaatctcaaacctatacttgcaaggtactgaacttcttcaaatctcatgttagatcctttgacaaggacattaaatcaaggatggaacaactccttgacagcctagaatttctctcaaaccaaaagggtgatctaggtttgaaaaatgctagtggtgttggggttggatcaggattgggtggtgaactgtcacataaatcgccatcaacatcttttcttagtgaaagtgttttttatggcagagatgatgacaaagaaattatccttaaccggatgatatctgacactcacaattgtaaccagctatctatactttctattgtgggcctgggtgggttgggtaagaccatgcttgcccaacatgtataccaccactcagggatagagggtatatttgatatcaaagcttgggtctgtgtttcagatgaatttgatgatttcaaggtttcaagagcaattcttgatacaattactaactcagctgatgatagtagagagctagaaatggttcatgcaaggctgaaagaaaaattgcccggaaagagatttctccttgttttagatgacgtttggaatgaatgccaatctaaatgggaggaagtgcagaaagctcttgattttggggctcagggaagtaagattctcatcacaacacgcagtaagaaagttgcttctaccatgcggtcaaaagaacaccacctgaagcaattacaagaagattattgcaggcagttgttggctgaacatgcattccgggatgataattctcaaccagatccagactgcaaggagattggaatgaagattgttgaaaaatgtaaagggcttcctctagccttgaaaacaatgggaagtctattacaccgcaaatctgtttcggaatggaaaagtgtattgcaaagtgagatgtgggaattagaggatagtgacattgtccctgctttacattga

SEQ ID NO: 47680 - DNA, 456 bp, Glycine max
  Peptide Sequence Number=SeqID_164458
atgttccttgcagtcacagagggtctaattgtaagtgcaacactattcggctgcagacatatcttgggttatgcctatagcgatgatcgtatggttgttcattacgtggctgttatgacccctctgctttgtctctctatttttactgacagcttacaaggagttctttcaggggttgctagaggaagtgggtggcaacatctaggagcctatgtcaatctgggagcattttatctggtaggaattcctgtaggtatcgtacttggctttgttgcacatttaagagcaaagggcctctggattggaatagtcactggctccattgtccaatcgattctcctttcccttgttactgctcttaccaactggaagaaacaggcaatgatggcaagggagagaatctttgatgttaaaccaccagacgaaaatgaatcaaatcacatgacgagtgcttaa

SEQ ID NO: 47681 - DNA, 1641 bp, Glycine max
  Peptide Sequence Number=SeqID_164459
atgtcaatagacgagttgttctccaagttccagttcttatgggtcttatctctgtattgctattctaacctaacagaggtgcctgactctgtagccaatcttaaacatctctgttcattagacctttcccatactaacatagaaaaactacctgaatcaacatgttcactctacaacttgcaaatactaaagctgaatcattgtgcacatttgaaggagctgccatcgaatttgcataaactcaataatttgcgttgccttgaatttataaatactggcgttagaaaggtatcagcgcatttgggaaaaccgaagaatcttcaagtattgatgagttcgtttgatgttggcaaaagtaaggagctaaatattcagcatccctccgatgcatcagctgtggatttgaaaaataaagcacatcttgtggagctaaagttaaaatgggatgggattggggaccagaacactgatgattcaacaaaagaaagggatgtaattgtaattgaaaatctacaaccttcgaaacacttggagaagttgtcaattaagaactatggtggtatgcaatttccaagttggttatccgataattcattatggaatgtggtgtccttaagtttgaaaaactgtcaatcttgccaatgtttgccttcccttggacttttgccatcactcaaggaacttacgattgaaaggtttgacaggattatgggtattgatgctgatttttatgggagcagctcttcttcgtttacatccttggaaacattgaagttttccgatatgaaagaatgggaaaaatgggaatgtcaagttgtgactggtgcttttccacctcttcaacatctttctataaagggcaactgccagtgcatttttgaaaacagcacggaagcatggttccttgaattgattaggcaaatgatatctcttacttcttctcttgaacgcttgtatgttatttcttgcccaaatatgaatattcccatgagtggttgccatgatttctttatatcattgatgatcattgacggctgtgactctctaacgatctttccgctagatttcttcccaacactcagtaaacttcatctcagcgggtgtcttagtctacagaggatttcacataggcacacacataataatctcaaggagttggaaatttgggagtgccctcaattagaatctttgcccgaacgcatgcacatcctccttccatctcttgacgagctactgatagcagattgtccaaaacttgagtcattccctcacggaggattgccatcaaatcttaaagagatgtatctccataattgtttcaaactgatcacttctctgaaaggagctttgagagacaattcttcactggaaaccttaaatattggtaaactggatgtggagtctttccctgatgaagatcttaaaaaactggactacaagggtctctgccacctctcatctctcgaaaggttgcttcttgaagactgccccagcctccaatgcttaccagaggagggtcttcccatatccatttcatatttggaaatttggaactgtctgttgctcaaacagagttgccagaaaccagaaggcatagacaggggaaagattgctcatattgaaaaagtcattatagggtag

SEQ ID NO: 47682 - DNA, 237 bp, Glycine max
  Peptide Sequence Number=SeqID_164460
gcagtgatggaagaaggttcagagacaggaaagtggggatggatgaaaaggaggagagcaatgagggaagagctgaagaaggtgggtactatagcagctccaatggtggttgcaagtgtgttgcaatatcttttgcaagtggtgtccttggtaatggttggccatcttaaccagctctctctttcaactgttgctattgcaacctctctcaccaatgtttctgggtttagtgttttg

SEQ ID NO: 47683 - DNA, 807 bp, Glycine max
  Peptide Sequence Number=SeqID_164461
atgggccctacagaagttgtgtatttatctagtgatgatgaaagtgaaaaggaagttgctttcaaagctgttaagttggaggaagattttgttttggatgcaaaacaatataatgagactaacaaaggtcaactagccaagcacaagagatctcaaagtcatactactggacaagattctgaagaaaatttaagttctaatggtccaagtacaggtcatagtaactccagtgtgttggagcagggaccgtcgcctgttgatgacacaggcatttcttatgcatcatccattggtgtagcacccctgtgtaggcagttttggaaagctggaaactatgatgatggacttggttctaaagtcaccgtccaaaatgccaaaaattatctacatgtgcaccccatgttccttcactcaaatgcaacttcgcataagtgggcatttggtgccatagcagagcttcttgataatgcagttgatgagcatactaagctattgccaatgcctgttaataataaaacttcaaatccaagggatggaaatccagcattgttgattcaagatgatggtggtggaatggatccggatgcaatgcgtcgttgcatgagttttggattttcagataagaagtcacagtttgctattggacggtatggaaatggcttcaagaccagtagtatgaggcttggtgcagatgtcatagtcttcagttgccatctaaataataggtatggatcaactaatgaacataatattacattaaagttggttagtgcaacaggtctcctcctgtattggcaatcaccttga

SEQ ID NO: 47684 - DNA, 489 bp, Glycine max
  Peptide Sequence Number=SeqID_164462
atggggggagggagggcagccaagagacttcacaaagtagacatgactagcttagctcagttttggactgctttcatgctagacaatattatccctaactcccacaagaaattaagtcaaaaagataattggagttctgctcgcttaagtgtggcttgctatgaacttaagcaagccaagacaaaatcaattgaaggagacattgactggcctcgcttaagcacaactattgatgttcaaggccaaagggttgagcaagcagccgttgaggaaccatctgttgccacttctaccagtgcagagaaggaagcactcgagtctacacatactgatcctataccttccactgaggcaactaatgaagctgaagttgatgaaagaattaatgtcgatgatgatgttgagattggatatgatgattccaataacattactgggggtgttcttcaagagaacaaaaatggagaagagttggcgattgctaaatga

SEQ ID NO: 47685 - DNA, 840 bp, Glycine max
  Peptide Sequence Number=SeqID_164463
atggattttatcacgggtctaccggcttatcgtggcaacacatgcatcttcgtggtggttgatcccttttcgaaaggtctacatctaggcatgcttcccactcagcacactgcacacacgatggcccttctatttctagacatggtgggacacctctatggcatgcccaagagcatcgtttcggatagggacccattgtttattagcaaattttggagagaacttttcacgatgagtgaggtagcaaatcgcataatagaacaatatttacgagcttttgtgcatgagaaaccatcaacgtgggggcgctatttaccttgggttgaatggtcctataatacatcatgccactccaccccgagtatgactcctttcgaaattacttatggtcgaaaaccacccacctgccctcattacatttccggcacctccaatatagaagttgtagactcgatactcaatcagcgagaagccatttttgagatgttgcgtcgcaagttacttaaggctcagtcccgtatgaaggctaacgccgatcgtcaccgtcgtgaccaggaattcaaggtaggggattgggttctcgtcgaactcagaccacagagacaaatattagtaacgggcaccacttattcgaaactgagtaagaggtattatggccattttcaagttactgagtgcatgggtaaggtagcctacagattacaacttccagagaattcgtgcatccatccgattttccacgtctctcttctcaaaccgtataccgcaacatccatcgctgccaccgccatggaccttccacctattgatgcaatcctaccccgcaagggcattggatag

SEQ ID NO: 47686 - DNA, 471 bp, Glycine max
  Peptide Sequence Number=SeqID_164464
atgacatggatattcatgatgaagcaaaaatttgaagctttcaaatttttcaagcattcgacaattcttatgaagaatcaggcaggaaagatagtaaagtgtcttaggactaacaatgacttgaaattattttctattaaattcaatgaattctatagagatgaaggcatagcaacacaatgcattgtatgctatcctccacaacaaaacaaagtagctgaaagaatgaacatgacctcgttagaaagggctagatgcaagctatctaatttgggattgaataggagttcctgggttgagtcaatgctaaaagtgtttggatgtccgatatattatcacataagtgaaggcaagactaaggatgtcactaagcaggtggagtttaagaactccccaattagaaacattagtgatcaaaagcagtttgaagcacctgatgcgattgatcaagatcttcaaatgcacccttaa

SEQ ID NO: 47687 - DNA, 246 bp, Glycine max
  Peptide Sequence Number=SeqID_164465
atgtgtgggagtcaccaccaatgtttattcgaggaaaaagttaggaaaaccaaaaagaagggtgttgcccttgctcctatgtatcctcagaagaagaaatcgtcgatgatagatggtggaaatgaatatgcacaaaaacaacaaggagggcccctaagggaaatgacggcacttggtggtcttgcagctcgcccaggtgagctgatgcttcactctgaagtaaccttgctcgcccaggcaagctag

SEQ ID NO: 47688 - DNA, 1761 bp, Glycine max
  Peptide Sequence Number=SeqID_164466
atgtggggaatggtctacattcaacaacattctttcaccactgatttccatgtactacccttgtgtggggctgacgtagtattgggggtgcaatggttgaaaaccctcaggccaattttaacggactacgacacgttaacgatgaagttcatcattaggggtaaactcattgagctacatggagatcgcgagaagggaatggagcaggtatcgtcgtctcaactacgtcgattcgtacacacaaaccctactaataccttctttcacattcgtgttgaatcagcaaccaaacatactccttcaacaaaccatcccttacctgaaatcaaaacattaattgccaaaaacattttcctcttccaaccccccacgactctgcctccatcacggcccatagatcatacaatcaacctgttgcccaactcagctccggtgaatgttagaccttatagatatccctattttcaaaagaaagaaatagaagaacaggtagctaccatgcttgcaaaaggttttatacaacctagttcgagtccactttcttcaccagtattattagtaaagaagaaagatggatcatggcgattttgtgtagactatagggccctcaatgccataacggtacgtgattgcttccccgtccccacagtggatgggttgctcgatgaactaggaggggcacggtggttctctaaactggatttgatgcaaggataccaccaaatattgatgaacacaactaatattagcaagacgtcatttaggacacatcaagggcactacgagtttcgcgtgatgccctttggattgtgcaatgctcctttttcttttcaggccacaatgaaccagctgttccaaccatacttaaggaagtacatcattgtcttatttgatgacattctgatatatagcagaaccatgcatgatcatcttcttcatttggagacagctttccaggttttgatggcggggcaatttcctcttaagctctccaaatgtacgttcgcgcaacagcagttggagtatctcgggcacatggtatcggctaacggggtcaaacctgtaccagaaaaggtgcaggcaatacaacaatggccaacgccttgcacttcacaagctctgagaggatttctaggcctcgccggattttataggcgattcatccgagggtatgcagccttagcagcaccactcaccaagcttttgcgtcacggccaatttgattggagccaggaggctgatacggcatttcaaaacctcaagaatgctctcacggtggtgcccgtcctcgcgttacctgatttcagtacacccttcatggtggaaacagacacatcagggtcaggtatgggggcggtattgacactggggggtcaccctctggcttactacaacaagcaatttttccctaagttgctgaattcttctacctacgttcgagagttggcggcaatcacagcaaccgtcaagaagtggcgccagtacttgttggggcaccacttcataatattaacagatcatcgaagcttacgcaaactcatgaaccaaaccattcaaagacttgaacaacatcgatatctggctcgtttactaggattcgactataccattcagtatcgcgcagggagatccaatgtggtggcagacgcattatcacgagccatggagggtcaagctgcttctctttacttcctatcgatgtcacagttcgtcttccttgatgaccttcgcaaggaactagcttttctcgggacattctga

SEQ ID NO: 47689 - DNA, 1068 bp, Glycine max
  Peptide Sequence Number=SeqID_164467
atgaagatggttctgtctgggttctctctgctgctgcacattgctctgcttgcaagactctgttttggaggcgacccaactgttttcactgaacttcgcgtctcatacaccaccgttactcctctgggtgttcctcagcaggttatagctatcaacaagaagtttccaggacctgtcatcaatgttacaaccaataaccatgtaattgtgaatgtgttcaatgaattggatgaagatcttctcatttcatggtcgggggttcaaatgcgacgtaactcatggcaagatggagtccttggcacaaattgtccaattcctcccaattggaattggacatatcagttccaagtcaaggatcaaattggaagtttcttttacttcccttctcttggtttccaaagagcctctggtggctttggtccctttgttatcaataatagagaaattattccaattccttttgcgcggccagatggagagattttcattatggttggtgattggtacactcagaaccacacggccctaagagcaactcttgatggtggaaaagaccttgggataccagatggtgttctcatcaatgggaagggacctttccagtacaacactactcttgttcctggtggcatcaattatgaaacaattaccgttgatccaggcaagacttatcgaattcgtgtccacaatgtgggaatctcaacttctttgaatttccgaattcaagatcataatctactgttggtggagactgaggggcattacacaactcaaacaaatttcaccagctttgatattcatgctggccagtcatactcttttctgctttccactgaccaaaatgcaagtacagactactatattgttgcaagtgccaggtttgtgaatgaatcattgtgggagaaggttacaggtgttgcaattttacactattcaaattccaagggaccagcaattggtcctctgcctccccctccaagtgatttttatgacaagacagcttcaatgaaccaagcaagaagtgtcaggtttgtccctcagaattttgtatcagagagaattttataa

SEQ ID NO: 47690 - DNA, 678 bp, Glycine max
  Peptide Sequence Number=SeqID_164468
atggatctggaccgtgggattgttcagaactctgataaggtgaattggaggaaagaatcatggaaaacggtgttaactctggcatatcagagtcttggagtagtgtatggagagattagcacttcaccactctacgtgtacaggaacacatttgctgaagacattggtcactcagagaccaatgaagagatttatggtgttttgtctttggtattctggactctcacattggtgcctttggtgaagtatgtgttcatagtgctgaaagctgatgacaatggtgaaggtggcacgttcgcactgtattctttgctgtgtcgccatgccaaggttggcttgttgcctaattgccaattggccgatgaggagctctcggagtacaaaaagcacagctgtggcatggcaccggagagaagccttgccttcaggctcaagtccttgttggagaggcacaaggtcttgcagaggattttgctggttctggctttgttagggacttgcatggtgattggtgttggagtccttaaacctactatttctgttttctcagcagtgtctggccttgagctttcaatgtccaaggagcatcacagatttctcaagtttggaaggtttgtaatgaaagttataaaaggatatgcccgtgctctttcaggaagacctttatttgtaccttga

SEQ ID NO: 47691 - DNA, 762 bp, Glycine max
  Peptide Sequence Number=SeqID_164469
atgccattgagcagacaaaatacatctgctagtggtgctcgtcctaatcctcaaggatcctttcattatggctccatcaatgtaactgatacttatgtgttaaaggttatgtccctggcgccaatcaatggtacaaatcgagctactattaatgggatctcatttctcaagcctgaggttccattccggcttgctgacaagcatcaattaagaggaacatataagcttgattttcccagcaagccaatgaacaggaccccagtaattgacagatcaatgatcaacgctacatataagggattcattgagattatattgcaaaacaatgactcctctattcaaaactttcatctggatggttactccttttttgtagttgggatggattatggtgattggtcagaaaattctagaggttcttataacaagtgggatgcaatatctcgcagcacaactcaggtttttcctggaggatggacagcaatccttatatcgctcgacaatgttggatcatggaacctgagagcagaaaacctggacaggtggtacctaggtcaagaaacttatctgaagatcgtcaatccggaagaaaatggtgacaccgagatggctgcaccagataatgttctatattgtggtcccctcaagagcttgcagaagtcgaattctactttttctgcagcttctactttgggacatagcttgaaccttttctcattgctcctgggactttttgctattattctcttcctagctagataa

SEQ ID NO: 47692 - DNA, 2220 bp, Glycine max
  Peptide Sequence Number=SeqID_164470
atgcttgaaggagaaataccctcctctttggggtctctcaaatcattgagaattctgaacctggccaataacactctatcaggatcaattcctacctctttgagtcttctctccaatttgacatacctgaatttgcttggaaacatgttaaatggtgaaattccttcagagcttaacagtttgagccagctacagaagcttgacttatccagaaacagcctttctggaccactagccctcctcaatgtcaaattacagaatcttgaaactatggttctgtctgataatgctttaacaggtagtattccatataacttctgcctcagaggttctaaacttcagcaactgttcttagctaggaataagctttctggaagatttcccttggagcttctcaactgcagctcaatccaacaggtggacctttctgataacagttttgaaggtgaacttccatcaagcctggacaagctacagaacctcacagatcttgtgctcaacaacaacagcttcagtggatctctacctccaggaattggaaacattagtagcttgagaagccttttcttgtttggtaactttttcacaggaaaactccctgtggagattggaaggcttaagaggttgaacaccatttacctctatgataaccagatgtctggacctataccaagagagttaacaaactgcacaagattaactgaaattgacttctttggaaaccatttttctggtcccattccaaagactataggtaagctaaaggacttaactattctccatttaaggcaaaatgatctgtcaggtccaatcccaccaagcatggggtactgtaaaaggcttcagttattggccttagcagataacaagttgtcaggttccataccccccacattcagttacctttcacaaattagaaccattaccctttacaacaactccttcgaaggaccactacccgattccctctctcttcttagaaaccttaaaatcataaacttttccaataacaagttcagtggaagtatctttcctctgactggttcaaattctctcactgttttggacttgacaaacaacagcttctcaggttccatcccttctattctaggcaactccagagatctcacgcgtctcagacttggaaacaattatctcacaggaaccattccttctgaacttggccacctcactgagctaaacttccttgatttgtcattcaacaacttgacaggacatgtgctacctcaactctcaaactgcaagaaaattgaacaccttctactgaataataacagattgagcggggaaatgtcgccttggctgggaagcttacaagaacttggtgagctggatctctcattcaacaactttcatggaagggttcctcctgagcttggtggctgctcaaagttgcttaagctttttctccatcacaacaatctctcgggtgaaatcccgcaagagattggaaaccttacttcactcaatgtcttcaacttgcaaaagaatggtctctctggcctcattccatcaacaattcagcaatgcaccaagctgtatgagataaggctctcagagaacttcctctcaggtactataccagctgaactaggaggggttactgagttacaagtcatattggacttgagtagaaaccacttttctggtgagattccatcatctcttggaaatctcatgaagctagaaagacttgatctttcctttaaccatcttcaaggacaagttcctccttcacttggtcaacttaccagcctgcatatgctaaatctctcatataaccatcttaatggcctcattccctcaaccttttcagggttcccattaagctcctttctgaacaatgaccacttgtgtggccctccactaacattgtgcttggaagctacgggtaaggagcgaatgcagctatcaaacgcacaagtagcagcaatcatagtagccattgtccttacttccaccctgatatgcttagtaatgttgtatataatgttgagaatctggtgcaactggataaaggtagctgtttcaagtgaagatggtggcatggttgagcagcagaagacaagaaatggagagtactggaatatgaattctcctgagttgtttccttcaccagataaacaaatttcgccaacaatttgcatttgcagtctcaaaattgatgcagaagcccaggaaaataccttggtcagataa

SEQ ID NO: 47693 - DNA, 1093 bp, Glycine max
  Peptide Sequence Number=SeqID_164471
ggagaatatgaataatttttcccatgttccccctggttttagattccaccctactgacgaagaacttgttgattactacctaaggaagaaagttacctcaagagggattgacctcgatgtcataaaagatgttgacctctataaaattgagccatgggaccttcaagagctttgcagaataggagcacaagagcaaaatgaatggtacttctttagccataaagataagaagtatccaactggaactcgcacaaatagagcaacagcagcagggttttggaaggcaactggaagagacaaagcaatctactcaaagcatgacttgatagggatgaggaaaaccttagtcttttataaaggtcgagccccaaatggacaaaaatcagattggatcatgcacgagtatcgacttgaaacagatgaaaatggcgcaccacaggcaagtctcaaaacttatatttataaccaagaagaaggatgggttgtgtgtagagtattcaaaaagagactaacaaccatgcgtaaactgagtgagcatgattctccctgttggtatgatgaccaagtctctttcatgcaagacttggactcaccaaagcaaagctctcaacctaatttgccctaccagcagttccaatattcttgcaagaaagagttggatttgtcataccatttacctgtccagcttccattggagaaccaaaaattgctccaatctgcctccaactcaatgacaccatatggtatagaagaaaaccctaatgccatgcagccagcatcatcaatgatgcaacaagttcaacaacaaaattttcaggctgtagtgtttggaaacaatgccaatgatcaacaagtgactgattggagatctcttgacaagtatgttgcttcacaacttagtcaagaagatgcatccaaagatcacaatagatactcaaacacaggcaacatttttcaagtgaagaacaatagcaatattgaacagttgagggacttggacaaggatgaaatgatgcctgaaaatgcctcaacatcgaactcaagctgtccaattaacattacatgtgaattctctggcttcacttctagctag

SEQ ID NO: 47694 - DNA, 171 bp, Glycine max
  Peptide Sequence Number=SeqID_164472
atggagagggcagttatcttcggagatattcgaaggattcgaaggattcaaagagaaaataaggccagccaagggaacattctctttaggagttttttgccaaatgatgcttcaagtgttcctaatacacctttggatgcaagaggatcttctagtgctagcaacccttag

SEQ ID NO: 47695 - DNA, 562 bp, Glycine max
  Peptide Sequence Number=SeqID_164473
atggattccatttacatctgtcatttcattctactactgaccatagtgtgcactgttgttgttgcaactctaggagataacacaacagaatcctactggcttctaagaattaaatcagaactggttgatccattaggagccctgagaaactggtctccaacaacaactcaaatttgtagctggaatggactaacatgtgcacttgatcaggcacgtgttgtaggccttaatttgtctggctcaggactatcaggttccatttcaggagagttcagccacctcatttctcttcaatcacttgatttgtcttcaaactccctcacaggctcaatcccttctgaacttgggaagcttcaaaatctaagaacacttctgctttactcaaattatctctctggtgccattcctaaagagataggtaatttgagcaagttgcaagttcttagactaggagataacatgttggaaggtgaaataacacctagtattggcaacttgagtgagttgacagtgtttggtgtagccaactgcaacttaaatggaagcatacctgttgaggttg

SEQ ID NO: 47696 - DNA, 237 bp, Glycine max
  Peptide Sequence Number=SeqID_164474
atggagccaaacggaagaagaagaggtgcttaccactccatgactcaaccaaacaacatcaaagggagaggaaaatggtctcctttgatcaccaacactaaccttaagcttctagaatttggatctctcttggagaaggagaaggaaagagaaagagagccacttgcaaatgcaaatttgaattgtaagagtcaaagaatgatatatgatccttacaattctcctttccgcacccag

SEQ ID NO: 47697 - DNA, 275 bp, Glycine max
  Peptide Sequence Number=SeqID_164475
acgaagcacctaagaaagaaaagtctctagctctcagcagtcagaaggtcaagcaggccttgttgtctaaagagcaagtctccataagcttgtccaaatcccttgaagctgaaactcctctaatgaagattttgagtaagagtctaatgaagatgaactcaccttcatctcatgaaatattttcaagatgtggaagaacaaagggagatccaaatagaagaacttctcaaaaatgttgttcaaggaaaagaaagacaaagacaaaagctccataa

SEQ ID NO: 47698 - DNA, 642 bp, Glycine max
  Peptide Sequence Number=SeqID_164476
atgctactctcaaagatcaggccaaagcacatagatgatgctatgtttgatgaatactgcgtcaaagcaatgccagaagagttggaccaatttcaaaagaatgatgtacggaagcttgtagaactccccaatggaaaatcaactgttagagctaaatgggtgttaaaaaaaaagttagatgaaccaggtaagatatatgtgtacgatatcatattcggtgctactaatgactctctgtgcgaggactcttccaagcttatgtatgctaagttcaaaatgagtatgataggagaatcgaagttcttctttggacttcaaatcatgcaagcagacgaaggcatatacatacatcaaactaagtatgtgaatgaacttttaaagaagtttaagatggatgatgcaaagtatatgaaaacccctatgcatctaaccagtgtacttggactggatgaaaaatcaaagaaggtgggcaaaaagtcaaagaaggtggaagaaaagacatatagagaaatgataagatctattttgtatcttactacgtctagacttgacattatgtttagtgtatgcttttgtgccatattccaaaaagaactagggaagtttatttatcttctgtcaaacacatatttaggtatctaa

SEQ ID NO: 47699 - DNA, 771 bp, Glycine max
  Peptide Sequence Number=SeqID_164477
atggatgcaccttcgtctcaggatactcttgcaccaccacatccattgcccactctagttgcttctaaggcaacaggcgcaatggcccaagtgccaaaaaaggtagcaccaaagaagcaacaaccttcgtccactacaaaatgcctaagggcacttaatgagactaagagtgacgaagatgggttggtgtttagaaaaaagaaagttgcaccacctttggatgagaccactgcgcctcaaatgaataaggttaaaccaaatccacaggttattcacttcaagaaaaagaagaaaactgagtccactactggcatggacaatgagattcaacaccaagcacctctatcccccatccaccttgatcgcttccaacatcaaggacaacctaccatcgaacccaacctcactgttgaagacaccacaaggtacttcactatggaggctaagaagacggtcactctgaaactagacactaagttcgaccagaatgacgccatgcttttttacttcaaagacatgtatgaaaactcacgtctcatgtccatatcaaattacgaaaaggaagacacattcaatcatatgcgtatggtgcaaatcttgcgtccaacaaatatctacagattcaatgattggaaaatgtgtcctaaatctgcaatgcaaagagttgttgtcattgcttgggcaaggcatcctatactcaaagaacatccattctctccatatcataaaccttgggttccaaaacaaggaatggctactgaacttcaatga

SEQ ID NO: 47700 - DNA, 300 bp, Glycine max
  Peptide Sequence Number=SeqID_164478
atgtccttcattgttgcaaaagttaccttgaaggataaagaacccaaagttcacaccgaacacttctttgacattgaatcgttggagaatgttggatatgttatcaaggcacacctcatgttaggatatttcgttgaccatgttcttggaatcattgtgaaattgtcagtagagaccatcgctcaagctactgattatgagcgtagaggcaccaagttcatcaaacttgaagatcaaattgggaactccctatggggacctaactggccaacatgccaaggaaatatggcaccctgctga

SEQ ID NO: 47701 - DNA, 348 bp, Glycine max
  Peptide Sequence Number=SeqID_164479
atgatattgcacgagattagaaggcctaacactctaaaaacagtccctagcggagtcgccaactgtcgcgacctacccttcgacgggagggcgacgcgagactcacgagagcgtcttccaaggaaggaaaatgtgcggagtcaccaccaacgtttattcgagaaaaacgtcggaaaaactagaacgtgtggtctactaactttaagtgtgaaaggttcgggagttgtttttacgtatggggaaggggtggtcgacaaaagtggggtttttgctcctacgtatcctcgatttgtggtgaagaactcagacctacgtagttcttgcgaagcggtaaagtttatgtgttga

SEQ ID NO: 47702 - DNA, 159 bp, Glycine max
  Peptide Sequence Number=SeqID_164480
atggtgcttgaacaacccttctctagtttaattccagatcttcatggaatagatcgaactattttgaatcgtgcactgaaactattagaacagaagggaaaacttgtggtctttaaaggaacttcaactgatgatgaaggagttaaattttctatataa

SEQ ID NO: 47703 - DNA, 876 bp, Glycine max
  Peptide Sequence Number=SeqID_164481
atgtggaagatcattgggcattcacttggtggtggtactgctgcactgttgacatttatgcttagagaaatgaagcagttctcttcatctgcgtgtatgacattggagttagccggattcgggaagccctttatcacttccattataaatggttatgacatagtgcctacattgtcagcttcttctcttcacgatttcatttacaagggtcggattaaggataaaaacatcctaactgcagttggatctcgcttatcatttgcgaaagccatcacaggacatgcagtaactcgttgcacccaggttgtgaagaagcatcaacaaagaactcaatctttgttaccctgctcccaacgtgagaatattgaaacatcagatgacttggttaaggcttctcaatcatgggagacaagttgtgaaactcttttgactgaagaacacgtaatcatagagtctgtgtcggatgatgaagaatataattcttctagtgaaggatctgacggtgatgatgatgactcagatgatgataaagacaaattgtctaacattcatgctaaggacaaagaagcaaccacaacaaaaaacatcactgaagaagagagtgtttgtcctgttccaacatcagtcaacttggatagacatcctctttatcctccaggaaaaatcatgcacattgtccctgaaaataataattcaaaccgcaagtatcctgataagaaacgcatctacttatatgaaacacctacacaattttatggaaagctcagattttcaagagggattattctggatcatctcacgaagaagtatttgaagaagttacagcaattaatcaatcaactagagaaagagcagtccaaatttggcggattatga

SEQ ID NO: 47704 - DNA, 1818 bp, Glycine max
  Peptide Sequence Number=SeqID_164482
atgagtgggacatctgtcctttgccaatcccatcttttgtcactgccaaatagtccactccaaagctctgaattgaatgcaaagttcaatgagcagggatggttgtctttgctcaagagatgcaagagcatggaagaattcaagaaagtacatgcccatattctaaaattgggtctcttctatgattctttctgtggcagcaatcttgttgcctcttgtgctctatctagatggggcagcatggagtatgcttgctcaatcttcaggcagattgaggaacctggtagctttgagtacaataccatgattagaggaaatgtcaatagcatggatctagaagaagctttgttgctttatgttgagatgcttgaaagaggaattgaacctgacaacttcacctacccgtttgtgctcaaggcatgctctctattagttgctctcaaggaaggagtgcaaattcatgctcatgtttttaatgcaggtcttgaggttgatgtctttgtgcaaaatggcttgatcagcatgtatggcaagtgtggggcaatagagcatgctggtgttgtgtttgagcaaatggatgaaaagagtgtggcttcgtggagttccatcattggtgctcatgctagtgtggagatgtggcatgagtgcttgatgcttcttggggacatgagcagggaggggcgccatagggctgaagagagcattctggttagtgcactttctgcttgcactcatttggggtctcctaatcttggaaggtgcatacatgggatcttgttgaggaacatcagtgaactcaatgttgttgtgaagacttcattaattgatatgtatgtcaagtgtgggagccttgagaaagggctttgtgtgttccaaaatatggctcataagaatagatattcttacactgtaatgattgcggggcttgccattcatgggcgcggtagggaagctctaagagttttctctgacatgctggaggaaggtttgacaccagatgatgttgtctatgtgggtgtgttaagtgcttgcagtcatgctggtcttgtcaaagagggttttcaatgtttcaaccgcatgcaatttgagcatatgattaaaccaacaattcagcactatggttgtatggtggatcttatggggagagctgggatgctaaaggaagcctatgacctcataaaaagcatgccaattaagcctaatgatgtggtttggaggagccttcttagtgcttgtaaggttcaccataacttggaaataggggagattgcagctgataatattttcaagttgaataaacacaatcccggggactatttggtgctagcaaatatgtatgcaagggctcaaaaatgggctaatgtagccaggatcagaacagaaatggttgaaaaaaacttggtgcaaacacctgggttcagtttggttgaagcaaataggaatgtatacaagtttgtttcgcaggacaagtctcaaccacaatgtgaaaccatctatgatatgattcaacaaatggaatggcagttgaaatttgaaggctatacaccagacatgtcacaggtgttgcttgatgtggatgaagatgaaaagaggcagagactgaaacatcatagtcagaagttggcaattgcttttgcactaatacagacatcggagggatctcccgtaagaatatcaagaaatcttaggatgtgtaatgactgtcatacttacactaagttcatttccgtgatctatgaacgggaaattactgtgagagacagtaatcgcttccaccattttaaagatggaacttgctcatgtaaagattattggtga

SEQ ID NO: 47705 - DNA, 243 bp, Glycine max
  Peptide Sequence Number=SeqID_164483
gttttgatgatgccaagacaaaagcaacacaagttttatttcaagtccaaatcaagaccaagaagaaaacaaagtgtaaatcatgaagattttgatgatgtcaaaaagatcaagccttggataatgagcgtcatcataaaaaagggggagaatgtgaatcttgcatatcttgatgatgtcgaaaagaaatcacttgattatcatcataaaaaaggaggagaatgtgaatgtattaatacatga

SEQ ID NO: 47706 - DNA, 180 bp, Glycine max
  Peptide Sequence Number=SeqID_164484
atggaatggaagcttgaatcccttctccttctctctaacgtttgggaaccctatcggagcagtcagaggaaaaacttgaagaatctcaggaaactgttagagatgttgttatctctatcagaatacacatttgaagtcccaatgagaaattactgtgaaattgatgtgttcttgtgttga

SEQ ID NO: 47707 - DNA, 1086 bp, Glycine max
  Peptide Sequence Number=SeqID_164485
atgactcgtgaaaattcattcaaaacatggattgcttttacgcgagccttagagacagaatttggcccatcaccgtgtgaatgtcctagatctcagttgtttaaactcactcaaattggttcagttcagtcatattacgtgcagttcacggctttagctaatcgagtacaaggaattacacaagaagctctattggattgctttgtgggaggattaaaacctaatatcagaatggatgtcattgcgcaatcacctacatcactcctcaaaacagtttcgttggccaaactctatgaagagaaatatacacctaaactcaaacctttttcttcgagtttttcttccaaaacacaaacctcaaacacaaactcaaacctaaacacaaaccaaaacagccctcaatccctaaaatccacaagcttacccccactattacccacaccatacaccaaacctatcaatgttaagaaaatgacatcggcagaaatgcagttgagaagggaaaggggcctaagctttacttgtgatgacaagttttcccctagccatcgttgtcctaataagcaacattttgttctacagtgggaagaagaggatgatcctgcattacaaccagatccaccagacgaggttgagacagttggtgaccccagttttcaaattcatcatttgtcttataatgctttaaaaggctcatcaggtcttggaataatgaagtgcagattgggagtgcagattctactagatagtgggagttcagataacttcctccagcctagactagctcaatgcctgaagttacctgtagaaccaattcctaatttgcaggttttggttggaaatggaaatgccttgactgctgaaggattaattcaagacttggaggtgaaaatccaaggtcatacactgaagctaccagtttacctacttccagtttctggtgctgatctagtgcttggggctgcatggttggcaacaattgggcctgatctttctgattatagtactctgacattgaagttttacttgggtaatcaatttatcaccttacatggtgagagaccctccctaccacaacaggcttaa

SEQ ID NO: 47708 - DNA, 396 bp, Glycine max
  Peptide Sequence Number=SeqID_164486
atgtcttggaagaggacacattacttctcaatgccccacctagaaaaccatgattatgagcgggtgcaaaaaggagaaaaattgaaaagtgttgcagctagtgtctcgctaagcgaggcccttgagcttagcgagtctcatccgctaagcgagacatcagcccacttagcgagtaagaggaatctggaagcaaatctaccatgcaagcacgtgcttagcacgtcatcagctcgcccaatgagtcatctgccccttctggcgcttagcgcgtctggctcgcttcgccaaagatcacttacttgtgctaagcgcgaaaatggcgctaagcatgcctttaaggacagaaagtcctttttaaagcctgaagtgaaagaaaagagagagcttggcagatag

SEQ ID NO: 47709 - DNA, 162 bp, Glycine max
  Peptide Sequence Number=SeqID_164487
atgtgggatcgacacaagcttaaagcaacactcaaaccaagtgtatttacccctaagtttcaggccaaagaagagaaggttcaagcagctgatgactcgcttagtgaggtagatccgcttagcgagagacatctgcttagcaagacatccagctcgctttag

SEQ ID NO: 47710 - DNA, 273 bp, Glycine max
  Peptide Sequence Number=SeqID_164488
atgcacaccagtaaaaatgcagtagaagaggagagcatgcagttgcagagtttatacttgagcgcccgctataatcttctcgaagtatttgtcattggtcccagggggtttgggaacaagcttcaagtttcagggggtttgggaagaatggtgttagggaagcatttcacaaacatcgccaaggcgttcattcctaagaactcaatcataatgttattcttcgccaacttggaggggaatatattcctcttgtctataatatggaacatatag

SEQ ID NO: 47711 - DNA, 945 bp, Glycine max
  Peptide Sequence Number=SeqID_164489
atggcaccggtagaaacaagcataaaaagctctctgcacagtcgcagcaacagcttgcccaatgcaccacaccccattttatcacaagttgaggtgcatttgcacagattgaagaaggatcctgaagccaccacttcattgtcatcatcatcatcttcaataagtcacagactcaatgacttgcaggatctgcaagaaagtgctgataagttgctccaattgacaatctcccaacaagggttggcacaagaatgcagaagcaaacagattgatgaactattagataggtctctgaggctcttggatatttgtagtacaattaaagattgcctgctgcaatcaaaggatagcatgcacgaacttgggtcagttattcgcaggaagagagatgctgaaactggattcacaactgagggtggcaaatacctggcatgtaggaagaagatgaaaagggcaattgcgaaggccttgagagacttgaaggcaatacaaaataagttcacagtttcttcctcaaacaaagacgaggagacttcttccatgcttagcttcttaaaagaagcagaaatggtcactatgagctcattcgagtctttgttgatttttattattggccccaaaggtcagttaaagcagagcaggtggtcggtaatatccaagctggtgcagccaaagcgaatatcatgtgattctgaagtgtcagacactaataaattcaaaatggttgacaaagtgctgaagcttctcatcggttcaaagccttcatctactgagaatttccaaagccatgttcaaaatttagagttgtgcatccaagatattgaagttggagtcgaacgcctctcaagacaactaattagaaccagagtgactcaacattttgagccactagtcaaccgaactatgtttctaacccttctcatacttgtacataaatgtgattaa

SEQ ID NO: 47712 - DNA, 1029 bp, Glycine max
  Peptide Sequence Number=SeqID_164490
gctggcgcggcacctaaaggacgttacgcctatttcatcgatcgcgaccagggcggcaattttgccctgcatccgctgacctcaatctttaagccaggccagggcgattactatctgctgccgcagaaaagccagacagatacgctgatcgaaccttatagctatgcctataacggtgtgccaacgctgctgacctcggtggccgcgccaattatcagccagggcaaactgtggggcgtggtgacgtccgatatctcactggcgtcactgcaggaaaaagtgaacagcatcaaaccgtgggaaggcagcggttacgccatgctgctctcgagcgcgggcaatgtggtgtcttatccggacaaaagccagaccagcaaagcctggaagggcgacacgcataatttcagcagcacggtcaccgaacagcatgacgctattctgggcgaggatgcgctggtggcctggcggccggtggtgatcggtaacagcgatcagaaatggtatctcggcgtggtggccccggtgagcaaggtgatggaagcggcgcaccgtcagctgattaacgcggtgattttaatggtgatcagtatcctggtggtgtgcgcactgcttgggctggtatttagtcgcaaagtgctgaagccgattggcggtgagccactgaccgcagccaccattgcgctggcggtggccgatggcaaactggataacgctatcccgctgaaagcgcgcgacagcagcagtctgttcttcgccttgcacaccatgcaaaaccagctgcgcgaaattgtcgggcagattcaggatgccagcgcgtcggtgcgccagggcgcgggtgaaatcgccagcggcaacctcaacctcgcgtcacgtaccgaagagcaggcggccgcactggaacaaactgccgccagcatggagcagattaccgcgacggtaaaacacaacgctgctaacgcgcatcaggcgacgaagctgaccgataacgcaacgcacatcgccagccgcggtgagtcactggttgggcag

SEQ ID NO: 47713 - DNA, 165 bp, Glycine max
  Peptide Sequence Number=SeqID_164491
atggacgccttcaccgcgaagatgggacggaaaagtgccggaggtgggctatccggagggggcgaagctgtacaaatggacgacggcattgacgtcatcctcttcgacaggctcatccttgcgtattatgaccgggcagaaaagcgtattatccggatcgactga

SEQ ID NO: 47714 - DNA, 702 bp, Glycine max
  Peptide Sequence Number=SeqID_164492
atgaatgagatctgccaaagatggggatgccttcgctatgtctcctccatcttttcaggtggaaaagcagctctatttataaattccattaaacagaacatttttaattgtatatggcttgagaattgggaagcgggtgagggtataccttcatctttagacatcaaagattattcatatcttgatggcgatgtgtacgcaaaaacgcaatgttcccagagaatatggcagttgcagaaacaagcacaaagagctctcagcacaatcgatgaaacagcttgccctccgcacctaacccactcatatcacaatgaaagcatgcacgaacttcactctgtcatccgaaaaaggaaaggtgataaaactattttcacaattgagggtggaaaatacttggcttcaaggaacaagttgaagaagaaaattagaaaggccttgagaaatttgaaagccatgaaaagtgagtttcacaatttttcaatgcttagcatcttaacagaagcagaagaggtcacattgaggtcattagaatctttgttgttgtttatctgtgaccccaagggacaaccaaagcaaagcagatggtcagcaatctcaaagctgatgcatcctaaaagaatggtttatgactctcaagaatcacgcacaaatgaatttgacaaggtggatgcagctttgtactctttgataactgctaaataa

SEQ ID NO: 47715 - DNA, 255 bp, Glycine max
  Peptide Sequence Number=SeqID_164493
atggcatcctctcctttgaacccaaaatacagttcccacggtcgctcaaatagcttgccctctagaccacaccctctcattctcaaatgcaatgaacacttggaaagcttaagggcttccaaagcaacctcctcttcctcaacacttcttagacataaggtagaaggcttgcaagatctgattgagtgtgttggaaaattgattcagcttcccctcactcaagatgtccttctccacgagcgtcaagagaattgg

SEQ ID NO: 47716 - DNA, 549 bp, Glycine max
  Peptide Sequence Number=SeqID_164494
atgctgcagcaaatcgttgagtgggatcgcgtgctgcggctgcccccgctggtgttttccatcaatatcagcccgctgcagttgatgcaccgcgacttcacccatgacacgctgctgacgctgtcgcattacaaaatccgtcccgagcggctgaagtttgaaattaccgagaccacctttatttacgatcagcagcgcattggggatgtcattaaccacttcagccagttagggatcaaatgggcgatcgacgatttcggcgtcggttactcttcgcttaagtcactgagtgatttcgctattgatgatattaagattgataaatccctgatcatgcacatttttgaaaacgaatcggcggcgattgtggtgcaaaagaccattgagctgtcgcgcgcgatggggctgaacgtgctggcggaagggattgagagcgaggagtatttcgagcacctgcgcaataagggctgccatttattccagggttaccattttgcccgcccgctgcccgccgccgaagcattgcagtggataaaaaaagcaggataa

SEQ ID NO: 47717 - DNA, 303 bp, Glycine max
  Peptide Sequence Number=SeqID_164495
atggcacttgtagaaacaaacatgaaaagctctctgcacaatcgcagtaacagcatgcccactgcaccacgccccactgtatcacaagttgaggagcatttgcacaggttgaaggatactgaagccaccacttcttcgttgtcatcttcaataagtcacagactcaacgacttgcaggatttgcaagaaagcactgatgagttgcttcaattgagaatctcccaacaagcattggcacaagaatgcagcagcaaacagattgatgaactattagatgggtctgtgaggcttggatatttgtag

SEQ ID NO: 47718 - DNA, 885 bp, Glycine max
  Peptide Sequence Number=SeqID_164496
atggcatcctctcctttgaacccaaaatctggttcccacggtcgctcaaatagcttgccctctagaccacaccctctcattctcaaatgcaatgaacacttggaaagcttaagggcttccaaagaaacctcctcttcctcaacacttcttagacataaggtagaaggcttgcaagatctgattgagtgtgttgaaaaattgactcagcttcccccttactcaagatgtccttctccacgagtgtcaagagaattgggtaaaagacatggatccttaaggctcttagacgtgtgtactgcggccaaagatgctttactacgcacaaaagaatgcacacgtgaacttcaatcaaccataagaaggaagagaggtggtgaagtggagctgacagcagaagtcaagaaattcttgacatctaggaaggtagtgaaaaaggccatctccaaagccttggcaaatttgaacagcacttcaaagagttccaacatctcatctaatacaaacaaagatcaccgaacagtggctttgattagcttattacaagacatggaagtggctacactatcaacatttcagacactgctgcaatttatctcagggtcaacacaatcaaagtcaaacagctggctttcgatttccaagctaattcagcccaagagagtcggttgctcgctagtggcagatgaaagtgaatttgcccaagtggatgcagcattgcagtcctttgtatttaccaagacttgcaaatttgaagacataaacaatctgcaaaaccagttggagaaaatggagtcgtgcattcaagactttgaagaaggacttgagtttctatttaggcgtctgattaaaatcagagtttcccttcttaatgtcttcaaccactag

SEQ ID NO: 47719 - DNA, 510 bp, Glycine max
  Peptide Sequence Number=SeqID_164497
atggcagtcactgaagcaaacacaaaaagctctcttcatactcgttcgaacagcttgccctccgcacctcacccactcatatcacaacatgaggagcatctgcaaaaattgagggactctgaagccacttcttcaatatcatcatcttcgctaagccacaaacttaatggtttgctggatttgcaggactgcactgataagttgcttcaattgcctatgaaacaacaagctgtggcacaaaagttcagtgacaaatgtgttgatgacattctagaagggtctttgaggctcttggatatctgcagtacagccaaagaatgcctacagatatcaaaggaaactctgtcatcagaaggaaaagaacaagttgaagaaggcaatcagaaaggccttgagaaatttgaaagccataaaaagaattcctacgggggatttgaggacaagggtcactcttacaaaattgctgaaacattgcctacaatagcgggcatatgtggatgttttagctaa

SEQ ID NO: 47720 - DNA, 2506 bp, Glycine max
  Peptide Sequence Number=SeqID_164498
ccgaggctggaaactggatttcctgtttgtcgccgatggcctgttcatcaatgagaaatcgatcccgcactttcttaaccgctttgaaccgctgacgctgctgtcggcgctggccggcgtcaccgagcatctcggcctggtcggtacggtgtccacctcctacagtgagccgttcaccgtcgcccgccagttcgccagtctcgaccatctcagcggcgggcgcgcgggctggaatgtggtgacatcgccgctggagggctcggcaaaaaacttttcgcgtcagcagcatcccgagcatgcgctgcgctaccgcatcgccgacgaatacctgcaggtggtgaaagggttgtgggattcctgggaagagggcgcgtttgtgcgcaataaagccagcggtcagttctatgcgcctgacaaactgcacacgctgaatcatcacggtgatttttttcaggtacaggggccgctgaacattgagcgcacgccacagggccgaccgattatctttcaggcgggcgcctcggaagatggccgcaagctggcggcgcgtcatgctgacgccatcttcacccatcagccaacgcgcgaagaggcgcaggcgttctaccgggatgtgaagcagcagctggtggcgaacgggcgtgaaccgggcgatctgcacattttccagggcgtcagtgtgatcgtgggggaggatgacgcagacgtcgagcgccagtaccagaccaccgcggcgctggtgtcgattgaggatgcactcaactaccttggtcgcttctttgaccatcacgacttctcgcagtatccgctcgaccagccgttcccggacattggcgacattggccagaacagcttccgtagcaccactgacgaaatcaaacgcaaagcgcgcgaacacggccatacgctgcgccaggccgcgctggaagccgcgacgccgcgtccgctgtttcacggcacgccacagcaggtggcggatggtctgcagctgtggttcgaaaccgaagccactgacggtttcattattcagggcggcacgccggacaccttcgagcgttttgttgatcaggtgattccggttctacaggcgcgcggcctgacgcgtcgcgaatacccgggtagcacgctgcgcgccagctttggtctgaaacagccgctcaaccatgcggcactggccgaggacgtggccgtcaatggtcagcaggtgagccttgccgccaataaaacgcccatcaacacgccagagaatcctgccgccgtggcgcaaataccggcgggccacaaatttgccgtgccgggatcgttcaccgtggcggttgcggcactcaactcgccgccgctcacggtattcagcgacgacaataaaacgctgctgggcagtgaggtggatattgcgcgtctggtggccgacagcctcgggctgaagctcaacatcgtgcccacctcgtgggaagactggccgctgggcgtggcatcgggcaaatatgacgcggcgatcaccaacgtgacggtgaccaaagatcgtaaacagcgttttgattttgccacctaccgtaaagattcgctgggcttctatgtgaaaaccagcagcccgattacctcgctgagcaaggcagaagatattgccggcctgcgcatcatcgtcggctccggcaccaatcaggaggccatcctgctggcctgggataaagagaatcaggctaagggactgaagcctttcacaccggtttataccaaagatgacgctgcgcagacgctggcgctacaggccgggcgcgccgacgcttacttcggccctaacgtgattggcgcatggaaagcggcgctgaccaaaaagacccggctggtgggtagcgtggacggcggctggccgaaggcggcgcacatcgcggtgacagtgaagaaagacaacgggctggtgcagccaattaacaccgcactcaatggcgtgatcaaaaacggtgactacgacaaggtgctgaaccgctggggcatgagccagcaatttttccgcgaagtgtcaccggaagcgccggagctgcagccgattcttgacggtctgtttggtgaatatgcagcacgctacggcgatttcttcaggaaacacaatgaagttgagctgaccgagtggtatctgccgccgcgcgggctgttcatcgtgctggagcgcgacggtgagatcatcgccatgggcgcctataaaccgtgggatgctaccaccgccgaactgaagcgcatctggacgcggcgtgacctgcgccgtcagggactggcactgctgatcctgcaggagctggagcgccgggcgctgcgcgcaggctatcagcgcgtgtttctcaccaccggttttcgtcagccggaagcggtacagctgtatatcggccacggctatcagccgcagtttgagctgcgcgaagatatggagatttacggccagccgccgcacgatggccggctgcgttttctcaaagtgattgatgtgcacaacgtggcacaggccagctaa

SEQ ID NO: 47721 - DNA, 408 bp, Glycine max
  Peptide Sequence Number=SeqID_164499
atggagggaagtggaggtggcggtgcttcaccgtctgcaccgttgaagcaatacttacaggaattctcgaagctgtttcagtactatctggataaatccactccccatcccccctacaggtggattgggactttcgtcattgcatccatctacgttttgcgtgttgtttatgtgcaggggttttacattgtctcttatggcctcggaatctacctcctcaatctcttgattggctttctctcccctttggttgatccagaactcgatccctccaacgcccctatgcttcctaccaaaggctccgatgagttcaaacccttcattcgccgcctccctgagttcaagttctgtcccctttggataaacctcttcataagcgtttacaggaagaggagatacaatgattga

SEQ ID NO: 47722 - DNA, 324 bp, Glycine max
  Peptide Sequence Number=SeqID_164500
atggcctccagcactttgagcaaacaaaagccttatgattcgtgttggaccccaaaacagaacaaggtgtttgaaaaggcacttgcaaagtatgacaaggatacccctgaccgctggcacaatgtagccaaagcaattggtggtaaatcagaagatgatgttaagagacactatcagatactcttggaggatctcaggcacattgagtctggccatgttcccattcccaattacaaatcaacaccaactacctttcctctttcaacaacactccttatctgcttgccccaggcttctgaagtatctaaagctgaaatggtttga

SEQ ID NO: 47723 - DNA, 114 bp, Glycine max
  Peptide Sequence Number=SeqID_164501
atgtggcccttggctgaagagaactcggatggcggagaaagaagcggcgaccgcagccttcaagtgcgtttgactgcatttccaaccgatgctaacctacaggcaccagattag

SEQ ID NO: 47724 - DNA, 555 bp, Glycine max
  Peptide Sequence Number=SeqID_164502
agctacggcgggctggcggcgttatatgccggtgtgcactggccggaacgtttcggccacgtgctgagccagtccggttccttctggtggcctacggtgcaattcgttacccagttcgaaaaacgccacgaactggaggaaggctggctgatacgccaggttcggcaacgcgacgcggcggcgccagcgctcaacgtgatccaacaggccggcgatcgggaggcggatatcgaattcgtcaatcgccagatgcacgaggcgctgacggcggcggggcaccgcgccgactaccgcgtgttttccggcggacatgacgcgctctgctggcgcggcggcctggaacaacaaaacccgttcgatgacgaaagcctccgtttctccgttttggtcaacgcgcagcagcagtattcgctgtggccgcagtttgccgacgcgccgcaggggtggcgcgtgctgatggggccggcgtcgcgcggcgaatgcatcgactacatcgaaacgcactggcaggacatgcggccggcggccttgaaagcggcggatgcggcgcgttaa

SEQ ID NO: 47725 - DNA, 299 bp, Glycine max
  Peptide Sequence Number=SeqID_164503
atgtcagaaacgctttctttgccggatactcgggtcgagtatcgggattatccgctggttgcggcgcaaccggggatctggatcgccgaccaaatcgcgctgcggcgcaacggcttcgcggtggcgcactacaccgaactgcacggcgctatcgaccgctcggcgctggagcgcgcgatccgtcaggggctggccgaagcggatacggttcaggcgcagttctttgaggcgcaggacggccagccggtgcagcgtttgccgctgaacgccgatcctgcgcgcgtgcaggcgccggagtg

SEQ ID NO: 47726 - DNA, 420 bp, Glycine max
  Peptide Sequence Number=SeqID_164504
atggattatttctatgtaccctcccttgttctctttgaacaaccaagtggatgtaccctccacttgaattggtccagaagagatgtaccctctcttgttctcagttacaacaacccaagtagatgtaccctctacttgtatcacaaaggatgtaccctccaatgtgttaagacaaagtttcaggcggttagtcctttgaaactttgtgaaggggaaacaaaagatatctcaggcggagaagagagacacaaaagaattcaggcggttagtcctttgttcttttggaaaagggagaagagagtcacaaaaagaattcaggcgagcaaggtttggaaaccaaaaaacttagaaagcttttggcaaaggaagaagaagaagaagaagttcaagaagatgttcaaagagattcaaaggttgtaa

SEQ ID NO: 47727 - DNA, 309 bp, Glycine max
  Peptide Sequence Number=SeqID_164505
gcaatcatgaaacgcagctccaaactcgaaagtggaggacacatgaaccgcgctattcatggagctccaaaaaatgggggagaatggaggattgccttgagggcaatcatgaaacacagctccaaactcgaaagtggaggacacatgaacgaaaacgcaattcatggagctccgaaaaaaagggggagaatggaggattgccttgaggggggagaatggaggattgccttgagggtccgcacttgggaaatcatgaaatacaactccaaactcgaaagtggaggacacatgaacagtgctaggcaataa

SEQ ID NO: 47728 - DNA, 366 bp, Glycine max
  Peptide Sequence Number=SeqID_164506
atgatgcaccaaatccctatgataggtggtatgatgaatgtgttgagtggtgcaaccctcttttgtaaaatcactcatgcacccaacatcttcatgatttgtgtacatagggactcattaggtaggaataatcaacacaaaaataaagaaaaaggtatgttttattccattactttccttaactttttaaatagtgatcaagggattcccatggaccctaagagaataaaggtcatttctgagtggcctactccatcaagtgttgaggaaagaatcaatgagtttcaagaacctttggatttgaggtcaaatccctttcaagggggagggaatgatgcaatcctaccccccaaaggcattggatag

SEQ ID NO: 47729 - DNA, 390 bp, Glycine max
  Peptide Sequence Number=SeqID_164507
atgtacagggtagcaaacgcttccgaataccttgtgatcactggggttggaatcacagacataaagcttgcaaagaaagcatgggttctctcaggccactcatgcaccgtcttcgacctctctccggtcaactacaccttcgaagttcaggccatgaggttaaggtgtttgaggctgtggtggcagaggccaattcctcagcaaagcagagtgttgagtatgaaaccaagccaaagattagtattttggactaatggtggcattaaggaggttgctggtgtgtacaagatgttgccactcctttttaaggcagttcatgagcaaaccgtttgcccattggatgtggcgtattttgttaagaatgcagaaggacatggatataagatttaa

SEQ ID NO: 47730 - DNA, 384 bp, Glycine max
  Peptide Sequence Number=SeqID_164508
atggctgggactccatcaaggcttgaagattgcgatcatcaagacatggccatcactcattattgtggctgcttccgtgtgttctatgctcgatatgagtcgtgccgggaacagcaagaaacgttgaaagttcatcggaactggttgcagaagaagctgaagagggttgtgaaggcgttgtccgaaattttggtgtggccaaagaagagtttttccttgcagaggttgagtacgtgcattagtgaagtcaaggacaagaaaaggaaaatgcaatttcagtatgatcccaagagttatgcgcttaattttgatgatggatcaatagaggaggatgatggtgtttttctgggtttctcggctcggtatgcattgcatgtacattag

SEQ ID NO: 47731 - DNA, 2088 bp, Glycine max
  Peptide Sequence Number=SeqID_164509
atgagagggagaattgaagggagaagggattggacgcactgggaggaggaagatgtgcggatggggaaggaagagagaagtgtggaaggtgtaggaaaaagagagaagggaagaaggaagcgtttcagggtgattgtgagtgtgttggcaagaaagaagtttgattcatcattcatgtctttgtctcctcaggttggatacttggttccactaaatcgaaattttaaggaagaagcttcagttcccaagtttgctgtctcagatggcataaacgttattgggcgtaacaacattcctgtccccgacaagaggcttagccgcaaacaccttactttaactgcttctcccaatggctcggctagtttgctcgtcgaggggacgaacccaattgttgttaattctgggaataagagaaggaagctgaatcctaaagaagaagctaccatttgcaatggtgatataatcgagcttattcccggtcaccatcttttcaaatatcaggtgttgggtggtgatggaaaatcttcaacttgtagaaacaacgaagctcaatcatcattcaaaaacaaagcttcaggcaggagttcccaggataaggttgaaacaagcagccagaaacaaggaaggaatgcagacgcacggaagtcgtcgggtgaagacaatagtgtggaggccattcgtaatttccatgtccctagtgaccaaataccttccacttttcgacttttgcacgtgcaagggttaccaccttgggcaaatacttcttgtgtttctataggtgatgttattcagggagatattaaagttgctattctttcaaactacatggtagacattgattggttggttcctgcatgtcctgcactttcaaaagtgccccatgtgctagttattcatggagaaagtgatgggagggtggattacataaagagaagcaaacctgcaaactggattctgcacaaaccatcattgccaatttcctttgggacacatcattcaaaggctatgatgcttatatatcctcaaggagtgagagtcattgtgcatacagcgaacttaatttatgtagattggaacaataaaagccaaggtttgtggatgcaagattttccatggaaagatcaaaatagtctgagcaagggatctggatttgaaaatgacctggttgaatatctcagtgtgttgaagtggccagaattctcagttaaccttccattccttggaagcgtcagtatatgtccatctttcttcaggaagtttgattatagtgatgcaagggttagattaattgcatctgtacctggatatcattctggttctagtttgaaaaagtggggacatatgaagctgcgatctctgctccaggagtgtacttttgatgaagagtttaagaaatctccacttgtttatcagttctcttctcttggctctttggatgaaaaatggatgactgagctggcatcatcaatgtcagcaggtctctctgaagacaaaacaccccttggtatgggggagcctcaaatcatatggcctactgtagaagatgtcagatgctctttagagggctatgctgctggaaatgcagttccaagtcctctgaagaatgtggagaaaacatttttgaagaagtattgggcaaaatggaaagcagaccatactggacgctgttggttcttgttaacctcggcaaatcttagcaaagctgcctggggagctctccagaagaataatactcagttgatgattcgttcatatgagctcaaacccaagaattgggataaatgcccagcccgagaatcttctgagatgaagaaaacaaaactagtaaccctgactgggattaaaaaggagagtatgcattcatcatctgaagttattatccctttacctttgccttacgagctccctcccctgccttattcttcccaaggtcgtgacctgtcactcactttttttctcgtatgtctaagtggcatgactcttgttacatgtcttctaatattgtttccctctgcagatatcccctggtcttgggaccggcaatataacaagaaagatgtctatggtcatgtttggccacggatgtga

SEQ ID NO: 47732 - DNA, 1926 bp, Glycine max
  Peptide Sequence Number=SeqID_164510
atggtgcatgatttaacaggagtttcacccggggaaggtacgggagcgacaatgtctgatgaggaagatgaacaagtagatagtgatgccaatctgtttgatggtgctttggatggtcctgatagcatgggattcggtcctcttattcccacagagaatgagaggtccctcatggaacgtgtaagacatgaattaaagcacgaattgaaacagggttataaagagaaaattgtggacataagagaggaaattttacgcaagagacgagctgggaaacttcctggtgacacgacctctgtccttaaagcttggtggcaatcacattccaagtggccttaccccacagaggaggataaggcacggttggtgcaggaaacgggtttgcagctaaagcagatcaataattggtttatcaatcaaaggaagaggaactggcatagcaacccctcaacttctactgccttgaagagcaagcgcaaaagtgcatggctgattgttggtgattttaacgagattatcagtccttttgaagagaaacactcaacatggggtcattgtggaaaacgtttggatagatgcctagctaattctgattggagacttcattttcctaatgcagttgtagagctactccaacctcataagtttgatcataatcctctccttcttgctcaggaaattgctcatttcatgcacaaaaggaagactggtaagaaaggctacattctttttaagattaactttgaaaaagcctatgataatgtgaattgggattttatgcggctgactctcattaagtttggctttcctcctcctattgtgacattgattatgaattgcactactactacttccttgtctttcaagtggaatgctcttcttattcaggagaaagttcatgaacacaagtggcttccaattcaacttgttaaagaggtgttggatcagttttgtcttgcttctggcctcaagggtagggtgaccaatgccaatttctctcatatcttggatagggtgaatagtcgtctagcggggttgaagagtaagttgttgtgtagaactaggagagtaactcttgcccacaaatcgtccacgcattgggtgaacttggatactatcactcgatgtagaaagcttggaggattagggatctctgctaaatacttaccgggggagtctatattgaatgtggagagtaaagatggagcatcctacacttggcaatccatcatgaaggcggttcatgaacttaaatctggtttcaagtggattatggatagccatctttgtgcgaaggacttttacgacaatggagagtggtgctgggataaatcggctacttatgttcctattgctgaggatgtggtgatttggggagagaactattcagggagttatacttctgaatttgcttactggttgcttgttgatgactatcccactgatattgccaacttgagaacctggccttgggtctggagagcgagagttccagaaaatgttaaacactttggttggctattagcacatgagaatctcccaacttacagctttcttctgttgtttgatgatcttccaacggatttcttcaacctcaatgcggatgattggattttccacattatctctgctcctaatgctcagaatcttcttattgcttgctggttcatttggctttccagaaatgcagagatctttcgtgacaaagtgtggcctgcttggttagttgtcaacaagtacaagtcactgatggcgctagttcagtatactcaagtctcagacacgtcttcttcctctcctcgtcttggtaatcctggtgcatcaggctttggtgatctcattcgtgattgggttcttttatcattagtttctctggctactgtgggcataaggcgagccttcatgcctagctgtccggtaccttga

SEQ ID NO: 47733 - DNA, 168 bp, Glycine max
  Peptide Sequence Number=SeqID_164511
atggccgccgtttgcatttggcttgtgggtggttccgttccgtcatttgggaccgttccattacccgtgacgccgtttactatctccgttacgttcgtgcagttgctttgcgtgtggtgtcaggttggtcgacgtcgtgcagctggactttggaattgggaatattga

SEQ ID NO: 47734 - DNA, 696 bp, Glycine max
  Peptide Sequence Number=SeqID_164512
atggcttcctcgtcttccagaactaagtccagtgggcccgttctacgctccctctcaccctccagtagattctgctcatacaccacatccaaaacccctttctcttctccttcatccgcattcgcttcctccacaagctctggcttctcctcttcaaccttcttcaaccagccacgtcagcatcactctcaaagccatcacagccaccaccgtgccgcatcgcccacacgtgtcaatctatacagccccgcccctctctcttccggcgtccggttctctatcgacccccggtctatatcacccaaccggtccatatcgaaccagatcatcacgacgaagaacaaccgtccgatctctggccagaagaagacgtgtatgtgctcgcctacgatgcaccctggctcgttccgatgcagcctccacaagaacatcgggaacaacaaccaccactccgattcatacccctcgaatcggcttaacatgcgtagatctgctatgaagaactcgctcgtgagaatcggaggcgtggagggcgagtgggtgaaacgggccctgacagcactgattcggcccagttcgcatcaacagaggaggagagcggggttgttcttgattttgctggtttatataccataccacccatggcgccctgatctgccgccagagttggattccggcgaagcggttgggaggtag

SEQ ID NO: 47735 - DNA, 1007 bp, Glycine max
  Peptide Sequence Number=SeqID_164513
gggccatatatatgattatcggaaagggtgattcagttcgggtgtggcagcatagttggattccgaatactgcagacgggagaattcatgtggaccaacactttcaatcggattccaaccttcttgcatcagatctcattaaccaattttctagcttcaagggtttgatggttgacacaaaatgcacccgatgtggtgagaaagaggaaaatgtggtgcatgctcttctcctatgtgaagaagtttctcggatttggtttgcttcaaacctggggggcagaattcaagtgagtgaggatgattcttttgcaatttggttatatgattgtatgaaaattggtgattgggatttttggggaggatttgtgaattgccttgggtcacatggtttgcaaggaagcaatggacttttcaccagggagatagataaggaagaattcaagaaagttatgcaatcaatgcgatctcataccagacaaggtgttcaacacagggatggacgacgaactggcctaagggccaatgcttctgtagaaaatggagggctgatggaatacttatttggtaaagatggaaacggacgcctcacacacgataaatttgtgcggtttataagagacttgcatgatgaaattgtgaggctggagtttgctcattatgattacaaatctcgaaaaactataccggccaaggactttgcacactccattgttgcttctgccgacttgagtcatctgggcaggttgcttgaacgggttgatgaattgagcaatgatccacggtttagggatgtttgtggcttatctctctcagacaatgtggttgagattgttttccatttgtttgatgcaaatgaggatggaaatctgagtacggaggagtttgttagtgtgctacaacatagagaaagagacattgctcaacctgtggaaacaggaatcatgggtttcttgtcatgctgctggaaatgtaaggacacctctccatcttctcggttgctttcctga

SEQ ID NO: 47736 - DNA, 402 bp, Glycine max
  Peptide Sequence Number=SeqID_164514
atgacactagaagtatggttaaagattgttggattattttctaaaggagtgacggcaaacctgttaggtctcaaggaagctagaattgcattcaacaaggttaagaagtacaagtctatgatgaagaatccttctacctatgttgttgttacaaaagcaaagggaaatgagcattttgctattgtaccactgatgcttaagcacaggctcttagcctatgtggttgctttgattattactcccagatacttgattactttgaagttgatacctaagaagaggtctttgaccaaagtcttgaagcaaatgggtacatcaagtctgaagaagcgggagttggatggattgagaagagcaaagaggatcaaacaaaacaataagatgcagaagagaagcctatga

SEQ ID NO: 47737 - DNA, 1683 bp, Glycine max
  Peptide Sequence Number=SeqID_164515
atgagtataggactttgggatgttaattctggggagaaattgttctctgaaaactacagaatatggggtatcggagcaagctccatcaatttcaaggaagctcaggaaaaggactttcgtgtttcagttaagaaaatcaagtggagccctgacggttcactgtttggggttgcattttccaaacattttgttcaattatattcctatcatcatggaaatgacatcattagccaacatttacaaattgatgctcatgatggtagtgtcaacgatctagcattttcttctcttaataagcaattgttggtcataacatgtggagatgacaagaaaataaaggtctgggatgctgttagcggtgtcagatgttatacttttgaaggtcacgatgctcctgtttgttctatttgtcctcatgtgaagcaacatgttgattttattttttcaacttcaaccgacggaaagattaaggcatggttatatgattctttgggagccagagtagattttgatgcccctggttatggttacactacattggcttacagtgctgatgataacaggcttttttcttgtggaactgggaaagatggagagccgtatcttgtggaatgggatgaaagtgaaggatatataaaaagaacatacaagggacttaagaaaccatgcttttctgccatccattttgattcaactcagaaaggacttttggctgctggtgatggccacaaggttaaattttggaatatggacagtgttgagctctggacaagcactgatgttgatgctgaattactggaaaatccatgcattcgctttaacaagaagggaacattactggctgttgctgcaaaaggaaacaaaataaaaattttagcaattgatgacattttgcagaaacagaatgaaacacattcaattcatgtccccaataatcaacatgaagccttaaagtgtacacaaagtccaattttggttgatgctggtgctggagtcgcaggtgaaggcattgtcatgaatgggtaccaaaaaggcttggaggatgggaggtataattcaattgaagagtcccataacaactcaaagttttggaatgtctcagaaatttgtgagccatcccagtgccagttcttgcagcttccagttcatcccaaaataaacaagatagttagactgacttacaccaatgcgggaaatggcattttggcattgacatcaaatggtgatcatcttctttggaaatggcctcgtgataaccttaacttggatggcaaggcgactgcacaagtttcccctcacatctggcaatcaaggagtggcttgcaattgatgagcaataaactaacaagttcttacagtggagtcccagtttcctgtttttctttatcaaagaatgattcatatctcatgtcaacatctgggggggcaatctccttgtttaacatgttgacttttaagactgtgacgactatcatgactccaccacctatggcaacttgtctcaccttctaccctcgtgataataatatacttgctgttggtatggataattacagtataattatatacaatgtccgtactaataagattataagcaagcttgagggccactccaaaagagttactgcccttgccttctcaagtagttttgatcttcttgtttctggtgatataaatgctcag

SEQ ID NO: 47738 - DNA, 564 bp, Glycine max
  Peptide Sequence Number=SeqID_164516
atggagaagtctattctgaataaagagcttgttttcttaattttacagtttcttgatgaggagggtctcaaggaaactgcacacaagcttgagcgtgaaagtgggatatactttgacatgaagtatttcgaggacatgctacttgctgggaaatgggatgattctgagaggtacctttctggattcacgagggttgatgacaacagacactcaaccaaagtatactttgaaatcaggaaacagaaattccttgaagcattggatatggacgatcgagccaaggctttggatatcctcatcaaggatctgaaagttttttcctcagggcatgaagaactgttcaatgaaatgacccagcttttgataattaacaatataagggagcatgcatcactttcaacatatggagatacaaattctgtaaggaagattgtggcggatgatattaagaaagtcattgaggcaaatcctgtgttccatggaaaattgaaatgccctgtttttaaaagtcagaggttacgttatcttctgaaccaaaggtttcactctcttttcccaatttaa

SEQ ID NO: 47739 - DNA, 726 bp, Glycine max
  Peptide Sequence Number=SeqID_164517
atggtgaaggtggcgccgacggaaccggtgcgcttcatcgacagcgagcagacgatgcggcgcctcgtcaccgagctcgaggaactgcgcgcggcggtcggcgacgccgtggacatcgccgtcgacctgcacggccgattctcggtgccgcagtcgcggcggttcctcgacaggacggagcacctcgggctcgccttcgtcgaagagcctctccgtcccgagcactccgcactgatcggcgatctcgtgcgcggcacctcgaccccgatcgccaccggcgagcgcctgtactcgcgcacggagttcgagcccgtgttccgcgccggcatcgccatcgcacagcccgacgtctcccacgcggggggcatctccgaggtgctgcgcatcggtgcgacggcggaggtgcacgacgtgcagctcgcaccgcactgcccgctcggcctcgtcgccttcgccgcctgcgtgcaggtggacgccgcactgcccaacaccgccgtgcaggagtcgatgatcgacttctccggactcctcgacgacgacgagcacgcctacgtgcgcaaccgccacgagtggatgccggtggacgggtatctccgcgtgcccacagggccggggctcgggctcgatatcgacgaagagctggtgcgggcgcgagcgacggaggtcgcgccgtccgttgccctgtggtggagtgatccgcgggacgggagctacgtcgaatggtga

SEQ ID NO: 47740 - DNA, 300 bp, Glycine max
  Peptide Sequence Number=SeqID_164518
atgcccggtttgagttctgacattgtacaacaccgattacctctaaatcccgagtgttccccggtaaagcaaaaactgaggaggatgaagcccgagacatccttgaaaataaaagaagaggtaaagaaacaatttgacgctggttttttggctgtcgctcagtacccagaatgggttgccaacattgtaccagtccctaagaaggatggaaaggttctccggttacaatcagataaaaatggcaccagaggatatggaaaagactaccttcgtcagcctgtggggaacgttctgttataa

SEQ ID NO: 47741 - DNA, 405 bp, Glycine max
  Peptide Sequence Number=SeqID_164519
atggctgccgtcgttctgatgctggctgcgtgcggccgcgatgtgaccagcacgccgggtgatgcgccgaaccttgaaaagtgggtggaaggcgagcgtgcccgaccggcgcagccgctggagccgctgccggtgatgcagcagttcgaaaccttcgaatactccgcacagggtctgcgcgacccgttcaccgatgcctggaccaatccgcagcaggggaatggcggattgcgtccggatccgaaccggcgcaaggagccgctggaaggcttcccgctggatgcactggacatggtcgagcgacgggcgggtcacggcggtcttcgaggaccacgtggagctgatcgaactggtgccggatggcgcgggcggctggctggaacggccggcaacgctctcgcttga

SEQ ID NO: 47742 - DNA, 423 bp, Glycine max
  Peptide Sequence Number=SeqID_164520
atgattatgaggagccaagacatttatagtagccaagatgaggctactacgtcaccttcctctagtgaaagtgaagaagcaaaaggggaagaatctagtgaagaaatctacccccaagaagaaggacaacctttaatggttaaggaggagtgtaaggaggtaagtgtctcctccaagaggttagttaagaaggaaagtcattttgaaataatgacaaatattaaagaaacttcccctcttagacaacctccacatcttggggttcccacggaccctaagagaataaaggtcattcctgattggcccactccaccaagtgtcgagggaaggagcccagagtatgaaaaacctcgggatttgaggtcaaatcctttccaaggtggaggcgatgatgtaatcctaccccccaagggtattggatag

SEQ ID NO: 47743 - DNA, 414 bp, Glycine max
  Peptide Sequence Number=SeqID_164521
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctggacgaatcaaagcgacaagggctgaatctcagtggatcgtggcagcaaggccactctgccacttacaataccccgtcgcgtattaa

SEQ ID NO: 47744 - DNA, 549 bp, Glycine max
  Peptide Sequence Number=SeqID_164522
atgctcgagaaggaagctttcctgaccgacgaagacctgcgcgaacgcgtggtcgccgcggcccgcgacgtctaccaggccaaggtcgaccaggtcggcaccgaatcgtggtcgcagttcgagcgttcgatcatgctgcaggcgatcgacacgcactggcgcgagcatctgtcggcgctggactacctgcgccagggcatccatctgcgcggctatgcgcagaagaaccccaagcaggaatacaagcgcgaggccttcgaactgttttcgggcatgctggaccgcatccgcgacgacgtggtgcgcgtgctgatgacggtgcgcgtgcagtcgtccgagcaggtcgagcaggccgaggccgaagcggcccagtcgcacgtgcagaacgtgcagtaccaccactccgactacgacgaggcgctggcccagtcggccgacgacacgggcgcccagccggtgcgcaacgcgctgcccaaggtgggccgcaacgatccgtgcccgtgcggcagcggcaagaagtacaagcagtgccacggcaagctggtctga

SEQ ID NO: 47745 - DNA, 531 bp, Glycine max
  Peptide Sequence Number=SeqID_164523
atggcccacttggagctctcgaattccatggcgcggctcaacagagcagccgcaccgtcctacctatttaaatctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttga

SEQ ID NO: 47746 - DNA, 282 bp, Glycine max
  Peptide Sequence Number=SeqID_164524
atggcagaatcatcaaagaagcgaaaaggatctttcttcaccaccaccactacaggccaccgccgccaaggaacctctggaaacccacccgcaccagttcctccttctctttcatctcttagatcatccacattgttttccttggatgatcagcgtcaaagtcaaggtgttccttttgagggcacccttgttgatgactggaaatttgattattctagtcatgatgctcgccgcatagtctgcaatgaccgacatattacttactgggtcattaacttttga

SEQ ID NO: 47747 - DNA, 495 bp, Glycine max
  Peptide Sequence Number=SeqID_164525
atgccacctaccaggcaccatctagacccagataagtctaacagggccctggggtttccagcgttgatcacgggtctctgccagtcattcggggttcccgtcacacctagtaaggtgattcgaccgccgatcacccgggccttcattgagaagtattgcacgcctagacaggcgcaaggtgatgcaccgcaggccgcagatgcaccgccaccaccttgtcagactgatccagctgagtcatttggcatggagcagtatttacagcacttggttcaccagcaggcggccaaccacagggggcagagccagggtttcactctttttgcatgccctactccagatcagttcagggcagaggttgcatggcccggagattggcctgaggcccaggcaggggaggcgctcacagaggctcccggtgatgcagatgaggcccgcatggatgaggagatgacagatttactcgatttcttgggagggagcagggccacatga

SEQ ID NO: 47748 - DNA, 138 bp, Glycine max
  Peptide Sequence Number=SeqID_164526
atggccagcatggggcaacagacgcatcgccgccacctccagagcccctcagctcatctacaaaggctggagcgttgcctacgacccgtggccgaccagcaggcgaccaagtccaaagccaaagtaggacacacctag

SEQ ID NO: 47749 - DNA, 345 bp, Glycine max
  Peptide Sequence Number=SeqID_164527
gttgatggcgaacggggtacggcccgcaacggcaccggcggtggccagggtgttcttggacacggtcggcaggttgacggcgaagtccttgccgcccggggtcgagatggtgcaggtcttgtcggtcaccttgccgttgaaggtgatggtgccgtcggcggcgttggcggccagcggagcggcggccagcatcagagcggcgatgatattgatcttgtgcattcgcttttacctaaccctactgaagagatgagaagtagaggaggaagcaaggagcactgccgggctatcaagacccatccttgcgtctcacctgtggccggactcggacataccttcccctga

SEQ ID NO: 47750 - DNA, 168 bp, Glycine max
  Peptide Sequence Number=SeqID_164528
atggctttccagacagcaagggagagatcggcaaacatcaacccgccgagaacggctcccggtagcaataccccccaaccacttcccagcgccctgtgcagcatggttccacctcttacaatggaattgcctaaggtgataaattgcgcacctgttaacaacatctaa

SEQ ID NO: 47751 - DNA, 330 bp, Glycine max
  Peptide Sequence Number=SeqID_164529
atgaacacaatcgtaattattactgtattttcccgcatgcgcaattgttcgcaatctcaccgaaacacgacggatactgataacatgtggcttagagatcccttcaaaatattttacaaggatacagatttccaaatagcttgtgatgttttcaatggcaattcctctgacttaaacaactttccaaatggagggtttaagtatgtgaaatcaaataagcgaactatttggttctataagttctggttcaagtctaggaatgtttacccggggttgcatgagaagtctgtgctcaacaatatcaaaattaatgcaccccttagtttctag

SEQ ID NO: 47752 - DNA, 279 bp, Glycine max
  Peptide Sequence Number=SeqID_164530
atgataaagggcgcagaattcgtctatgcgcgtttaccacccaacttgttgttcccgaatgataaagggcgcagaatttgtatctgcgcgtttaccactcgacttgcgaaatttgaatgccaaagggcgcagaatttgtctctgcgcgtttaccactcaactcgttgctccagaattataaagggcgcagaattcgtctatgcgcgtttatcactcattgagcgtgcggatggccgtaatttgtctccgcatgtcatcgagcctgccgcctccggatga

SEQ ID NO: 47753 - DNA, 447 bp, Glycine max
  Peptide Sequence Number=SeqID_164531
atggaagggttagtggacctagcagtgattgacgctttcctcgcctttcatcatggcaaggaaagcccggtcgtcgccattttggccaagtatgacacgttcaaccggagatgtgaaaagagtgacacaagaattttttttgttgtgcactggctctctatgtgtggctggtttcacacccttttctccaagaaggtaggcctgtctatccgctacaaggaaggaagaatcaggattctatcttcatgcgaaggatgtccaaatgttcccttgatgggaacaaggggttgtattaattataatcccgtcctcgccataagacagcttggctaccccatgagaggagtgccatcagacgaaagcatcacgcctttcatcgcacggggtttcagtgaccacaacgcgagggtactccaaggagttcgcaaggcatgggatgcggcgtga

SEQ ID NO: 47754 - DNA, 318 bp, Glycine max
  Peptide Sequence Number=SeqID_164532
atggaacaaaaagaaaccacgggggaaatccaacaaagtgatttgatccccatttatttggagattaacgccacttgtagaaggcataatcaagagagaattaaaatttttttgcaggatttagaagcagcaacaattccagaggaagaacctcaatcttctgaggcatcttctagtcttcctattgcaagacattctcatttggatcatatcgaagaccacatcatggctgaagagccaagaagagtcaccctggaagattattcaagttctaatgtgccacaatttttcaccagcattgctcaaccagaagtttaa

SEQ ID NO: 47755 - DNA, 159 bp, Glycine max
  Peptide Sequence Number=SeqID_164533
atgggcctcatggccaaagactatgaaagcggagaagaggcaaacaaagatgtgtttttgataaggctggtgtcataccctaatttcgtccggggacctttgcttgatgacatgcgaccattctttggtccttgtgaggtgcttggcacccatcattag

SEQ ID NO: 47756 - DNA, 165 bp, Glycine max
  Peptide Sequence Number=SeqID_164534
atgactggtctccctatgatcttacttagtgagagtgacctgacaaacccattgtgtagtgtgtcttgttatgtactcctaagcgccccagggtggtttttcactgacatggtggatgactatgaagaacctcatgctagaggacacaggaacaccatgctctga

SEQ ID NO: 47757 - DNA, 321 bp, Glycine max
  Peptide Sequence Number=SeqID_164535
atggttcagctaagcgcacatcactgcgctaagcccaacatcttcactataagttacaccttaagcaatgggcttaacgtggatgatgcactaagcgccactccctctttgtgtaaatttattaaagttgcgctaagcgtgccatcctgcgctaagccccagatttattctgtagtggcgctaagcctgaatcactcactgctaagcgcatattgcagaaagatttttggtgttgcagaaagtgctaagcgccgctaccgcgctaagccccaaatgcttactggagtttacaacttcaagttgggcttagcgcgaggctag

SEQ ID NO: 47758 - DNA, 318 bp, Glycine max
  Peptide Sequence Number=SeqID_164536
atgtcattactcagccaatatcagcccttctcattacccaccacccaatcaaccacaaagcttgttgccgcacatccaataccaaacaccacccttaacacaaaccaaaacaccaaccgaggaaggaactttccagaaaagaagcctatagaattcaccgcaattctggtgtcgtatgctgacttgctcccatatctactcgataattcaatggtagccataaccccagccgtggttcctcaacctccattttttcgaggatacaactcgaacgcaacatgtgcttatcatggaggagttctagggcattccatttag

SEQ ID NO: 47759 - DNA, 453 bp, Glycine max
  Peptide Sequence Number=SeqID_164537
atggtgactatgggtttggtctggccgtggactggccctgcagcctccgcaactcttgctccataccttgttggtatagttgtccaatttgcatttgagcaatatgccagatatcgaaagtctccttcatggtctgctattccattaatctttcaacaaatgttagttgttaatatgttagtgagagggattcaaacccatgacctctccctctccctttcttccttcaaccaccaagtgtatagattgcaccaactaaatagagcagcacaactggtgacagctttatcatttactgttagaggagctgaaatgacctcacacaacatggctataaacagctctttgggtacccttctaaatgtcctacaattccttggtgtgatttgcatttggtccctatccagcttcctcatgagatttatcccttatgcttcaacaactaagcagtaa

SEQ ID NO: 47760 - DNA, 186 bp, Glycine max
  Peptide Sequence Number=SeqID_164538
atgccaagttcggttcctccttttcatgttcagcggcttctctttcttcttctcctttccaacgcaccagaactgcccaggacagtagaagttcctcttttaaacctcaagattcgaaagttgattttgttacatctttttaagttgctgagggagaatgtctttgctactattggacttagatag

SEQ ID NO: 47761 - DNA, 351 bp, Glycine max
  Peptide Sequence Number=SeqID_164539
atggtatctcaaaaatggcttgaaatacttctaccattgatcacatctatttccaaatgtgagataatctcaaacatcttgctgccactaaggcctgaacctagccacttcatctatttggctcagttggcaaccgaaactctatatgagcaactttgcaagaatcacctatggccattagaaatttacgtgggaattaggctcgcatttcaagggtgtggaaacatctcatggaaaaagaaaaaaaacctaggtagagagggtgagcaagtcaagactgctaaatttgagtactttacaaataagaacatcacagaatcaaagttggagcaatatgcaatattctcctaa

SEQ ID NO: 47762 - DNA, 231 bp, Glycine max
  Peptide Sequence Number=SeqID_164540
atggcaccgactttgaaagaagggaaagtgcagaatttgtggataaagcaaaatttgaaagaaaaaacgaaagaaagaaaggaaggtaccgtgtcgaagaacgatagtgcggtttgggtgagggaaggaattgaaatggttgaagggtgggtgggtgtgaaaggagattgcaagtgtagaaccctaacccaagaagatgaaagaatatatgatatgatattgaaggattga

SEQ ID NO: 47763 - DNA, 410 bp, Glycine max
  Peptide Sequence Number=SeqID_164541
tgcgttgtggcgatggagacattgtcaaggatggtgtcgactatgacgttggcaaggtacttctgctcgttgaaagggaggccgagcttgttgtagttgtggttgccgaggatttcgcggatcttgttgtcgaaggaagtggtggtggtggcgacggtggagatacaagtttcttggcatgcaaaccttccaatcttccaatggatcccaacttgaagctcaatcttcatgatggagacatactccttgatccctcagtgtataaaaggacaaggcttattttccctgctcataactctctcaaattcactgtctttgctgatgctgattgggccagctatgttgataccaaaaggtccgcttctagcttgtgtgcttttagggaacaaccttctctcttggagttctaa

SEQ ID NO: 47764 - DNA, 1494 bp, Glycine max
  Peptide Sequence Number=SeqID_164542
atgaaaaccaagagctactcttttgacactgataaggatacaaacatctataatggaaacacctcatatcttgtaacatgcacaacgagcgacatagatgatgatctttgcaaggctgctgagctactctatggatctacatactatggtttagagattgatctttggtcattgggatgtgtctttgctgagctattaacatcgaagccattgtttcctggaacaagtgatgtagatcaactcagcagagctgtaagtgtattagggaacattaatgaggaaacatggccgggttgttccaagctttctgattatggatcaatctcatttggtaatgtggaaaatccaagtggtcttgaaccatgcatgcccaattgctaccctaatgaagtttccctagtgcaaaagagacccacaactatggagttacttcaggacaagtactttagggaagaacatcttcctgttccaatttctcaattgcgggttcctttgactagaaatggacaagaccaggattcccctggtgggcacaatgaaatggggtctgattatgatttggaggagtttagcaccttgaatatcaccacaacttctgtgaaaggtgacaaggtttttgctaaatcagatggacattctgataaccataaatctgatggtaagaaccacaagtccaccaacatgcctagtgatttgacaagtgcaggggatcatggactggacaagaaaaaacaagaagcagctattgctgcagggaatggttctgatgatttctatgatggaatcccatggtttaatgattcttttccccacaagtctaggtcagtaaaatcaaggcatgttatggtaaaggccagcatattcgaaacacttggtgtaacatccctttccggaaaattctccccagtccctgcatttcaaaagggcagtgaatctggctaccttgataagaaaaatttggacacttgtggtcctgaatctgaatctgaatcacatccagtgagcaagatgaagtcttctaaagacataaatccttattgtgaagttattaggactcatgagaggaataattttccagtttctaaagacaacaaaaatagtttagatcagtcgaagcagtatgatgtaattgataactgctcagaccaccacttttttcatgagggggaaaagattgacatgatctcatataaagagagaggggtcacacttggagcaacctatgctgcaggatttgctattgggatttggaaagaagcttatcttttcaatactaaggacaagttcagacatggatacaagacatttatctacccctctatgtatgatcacccaataataggatatttcatttcatcagagcaggtcgatgaaggaggggtcggaggtgaggaaggtgtagatggtgtgttgaagggtgctacagttggggaggaacttagttgcacactgctttggtcttgctgtaaggcagagtcaacggcacgagtgtag

SEQ ID NO: 47765 - DNA, 177 bp, Glycine max
  Peptide Sequence Number=SeqID_164543
atgcaaggtcataggttcaaggaatggggatttgataaaggttggggcaacattgcaggaagggtggtatatattcttgatcaagtaagggccttagaggaagagctactccataagattgagctgcaagtccttcacgtgaagcctcagattcttgtgtgtcgtgagagattatag

SEQ ID NO: 47766 - DNA, 975 bp, Glycine max
  Peptide Sequence Number=SeqID_164544
atgatgatgatacaacaaccaaacaatgatgatgatgttgtcccagaacacacatgtgcacaacaacaacaacaagagcaacaaaaccaatctccaaaattggctgcttcttccacttcccaaaatgctacacctgtgctacctgcttttgttgccttgctgctccttgttacttcaattgccccagcagcactctgccaccctttgcaaggtagtaaccacacttttaggccaaatcatgagttgctcaagttgaggagaagtccagatggtgatttgatagattgtgttttatctcaccaacaacatgcttttgaccatcctaagcttagaggccacatagtattggatccaccagagagaccaaaggggaaccacaccaatggtgaagctgaaagggtaattgagagctttcagctgtggagtgattctggtgaagcatgcccagaaggaactgttccaatcagaagaactacagaagaggatattctcagagcaagttctatccaaagatttggaagaaaaccaagacctgtacggagagactctactggcagtggtcacgagtttgagttccaaaaacagcagggaacagacagtgaacggacatcactacatgcagtagtttttgtaaatggggatcaatattatggagcaaaagctagcataaacgtgtgggcaccccgtgtaactgatgaatttgaattcagtttgtcacaaatgtgggttattgctggctcctttggtaaagatctcaacaccatagaagctggtaagtccacaactatatggagacaactatccaaggttcttcacttattggactgctttatccaaatcaacaataggatagcaataggtgcagcaatttcgccaagatccgctttcaacagaagacaatttgatattggcttaatgatttggaaggtattaagaagttcaaaaataacttgctcacatttctcaatcatgtag

SEQ ID NO: 47767 - DNA, 165 bp, Glycine max
  Peptide Sequence Number=SeqID_164545
atgactggtctccctatgatcttacttagtgagagtgacctgacaaacccatggtgtggtgtgtcttgttatgtactcctaagcgccccagggtggtttttcactgacatggtggatgactatgaagaacctcatgctagaggacatgggaacacaacgctctga

SEQ ID NO: 47768 - DNA, 408 bp, Glycine max
  Peptide Sequence Number=SeqID_164546
atggcagaaatgggaaagttggattatctagaggaaaggcttagggccattgaaggaggcaaagattatgcctttgctaacctagaagcgttgttcctagtacccaatatcatcacccctcccaagttcaaggtgccagactttgataagtacaaggggactacttgccccaaaaaccatctagagatgtattgttggaagatgggggcatacacaaaagatgagaaactgctgatacatttattccaagaaagtcttactggggtagctgttacctgtattagtacaattctgatatggctctggataggatgcaactatagaacatgtgcaaaaaggggcatgaatctttcaaagaatacgcccaaaggtggagagacctggcagctcaagtggcacctccaatga

SEQ ID NO: 47769 - DNA, 1569 bp, Glycine max
  Peptide Sequence Number=SeqID_164547
atgttctcttcttcttcttctttcttcgtggttttctcggggcagaaccagaagcagaagcaggttgtgaagtgtgagagagggatgagtatgggtcccatcaacataaagggtgaaatagagagagtgaatgggaaggaactgagttacagtgaatttgtgaagagatatatggagaagaaccagccagtggtgctcactggcctaatggaccctcattattggaggtcttccactgattgggtcacccttcagggccaacccaactttcaatatttctccactcactttggtgcttctaaagttcaggttgctgattgtgacaccagagaattcactgatcagaaaagagaggagatgatggtatcagattttatagcacggtgccttcaacttgaggaggcttctgctgttcagtgttataatgaaaatagttcaagtaatggtccctctatatctgtaccgtatttgaaggattggcattttgtaaaggagtatcctgaatatgtagcgtacgtcactccaatgttcttttgtgatgactggctcaacctgtatctggacaacttcagaatacatattgattctgacacacaacaaccagataaggaaatatgttgctctgactatcgatttgtttacatgggggtgaaaggatcttggactcctcttcatgctgatgttttcaggtcctatagctggtcaggaaatgtctgtggaaagaagagatggctttttctagatccttcccagtgtcatcttgtatttgacaggaatatgaaaaattgtgtatataatatctttgatgaagtatcaaactcaaagtttcctggttttagcgaggctatctggttagaatgcacacaaaatgcaggtgaaattatatttgttccaagtggatggtatcatcaagttcataatttggaggatacaatatctataaaccacaattggttcaatgcctataacctttcttgggtgtggaatttacttttaagggactacaatgaggccaaggaatacatagaagacatcaaggatatatgtgatgattttgaaggtctctgccagcgcaatcttgctgctaacacagggatgaatttttatgacttctttactttcatctcgtactttgccttggccaacttggtgttgcttcgttatatgaataggagatatggaaatggcactggaagttcatcaacaatatctcagcatttttccatgaatcttgggtgtttaaggaagattgcatcagagatgaaaagcatgcatgctctagaaggaaatcatgattatgttgtggatatgattgaagcatttgaagatcctaggttttccaaattatgcatgcatgtaggaagaacatatataatgatacaagagcaatcttacttgtccttggattttgagtgcacttcaatgtgtgatttggtggacctcaatgatatgaaatcatacacatctcagatctacacacctgaagatctcattaaatttatagacaatggtgttgcagaactgggtgactgtttcattgaggagcaacctatactccatgttgcttga

SEQ ID NO: 47770 - DNA, 555 bp, Glycine max
  Peptide Sequence Number=SeqID_164548
atggcgattaatttttgtaatttcaaaagtgttgatttgttatttggggattcaaagaatgatattgaagaaaactatggtgttgtggaggatgatgcacaaaattttgatttttcaaatggagacaattattcggaggaggacggggacaatgattttgaggatggttgtgatgatttagaggatgagattgtgtgggagaacaaagatccggacaatctgaatagtgctgatgatatagacataggaaatttgatgcatgatgttattgacaagcttgattatgtggatcttgagactgcatatatgttctgcacttggtactctagaattgttaatttctccatccagaaaattcatgtagaaaaaattatagaggtgcgtcttcaagtggtagaaagcgcaaagcaagaaatggcattaggtgtgagcgttgttagacaacacaggaacagcttaaaaagagacaacagagaaatcaagttagaggtgttggagaattatctgaaggagcttaccgacctctataaatccatcatggacaagattggctaa

SEQ ID NO: 47771 - DNA, 516 bp, Glycine max
  Peptide Sequence Number=SeqID_164549
atgaattttgtggcgaaaaagcctatagatttcaccctaatttcggtgtcctatgctgacttgctcccatatccactcggtaattcaacggtagccataaccccaaccaagttttctcaacttccatttttcccaggatacgacttgaacgcaacatgtgcatatcatgaaggagttccgggacattccattgagcattgtagggccctgaagcataaggattcaacgcatgatagcattgagagactaacatcgtcttctgcaccctttgccaatcgcggccaacaagcccgtttacacgcggagatttacatcatcttccgcgcagacaacctctgtcaagcactaactagtgaagttagggggcaggctgaaatatccaagtggactcagcacatgatagcatgcagagacaaacatcgtcttctacgccctttgtcaatcgcggccaacaaggccgttgacacgcggggatttacgacgtcttccatgcaaacaacctctgtcaagcactaa

SEQ ID NO: 47772 - DNA, 2445 bp, Glycine max
  Peptide Sequence Number=SeqID_164550
atggcggatccaacctcatctaaccctgataaggatcaatcctctacggaaccgaaaagtgaaaagaaggattattccacagcaatattagaacgcaagaagtctcctaaccgacttgttgttgatgaagcaattaatgatgaaaattctgtggttactttgcaccctgaaacaatggagaagcttcagtttttccggggtgacactgttctgataaagggaaagaagcgaagggacacaatttgtgttgttcttgctgatgaacaatgtgatgaaccaaaaataagaatgaataaggttgttcgggctaatcttagagtgagacttggagatgttgtctctgtccatcaatgtcccgatgtaaagtacgggaaacgagttcacatccttccaattgatgacaccattgagggtgtaactggcaacttgtttgatgcatatctgaagccttactttatggagtcataccggccagtgaggaaaggtgacttgttccttgttcggggtgggatgcgcagcattgaattcaagctaatagagactgaccctggtgaatactgtgttgtggcacctgatactgaaatcttctgcgagggagagccaatcaaacgggaagatgaagaaagactaaatgatgttggctatgatgatgttggtggtgttagaaaacaaatggctcaaattcgtgagctggtagaacttccacttagacatcctcagctcttcaaatcaattggagttaagcccccaaaaggaatcttgctttatggaccacctggttcaggaaagactctgattgcgagagcagttgctaatgagactggtgcattcttctttttgattaatggaccagaaatcatgtcgaagctggccggtgagagtgaaagcaatctgaggaaggcatttgaagaagctgaaaagaattccccttctatcatttttattgatgaattagactcgattgctccaaagagagaaaagacacatggtgaagtggagaggcgtatcgtttcacaacttttgactcttatggatggcctcaagacccgatcacatgttatcgttattggagccacaaataggcctaatagtattgatcctgctttgagaaggtttggaaggtttgatcgtgagattgacattggtgtaccggatgaagttggaaggttggaggttcttagaattcatacaaagaacatgaaactttcagacaatgttgatcttgaaaaagttgccagagacacccatggttatgttggagcagatcttgctgctctttgcacagaggctgcattacagtgtatccgggagaaaatggatgtgattgacttagaggatgaaacaatcgatgctgaggtgttgaattccatggctgtgactaatgaacactttcaaactgctttaagttcttcaaacccatctgctctgcgtgaaacagttgtggaggttccaaatgtttcctgggatgatattggaggcttagagaatgtcaagagggagcttcaggagactgttcaatacccagtggaacatcctgagaagtttgagaaatttggcatgtcaccttccaaaggtgttctcttttatggacctcctggctgtggtaaaaccctgcttgcaaaagcaattgctaatgagtgccaggccaactttataagtgttaagggacctgagttgctgacaatgtggtttggtgaaagtgaggcaaatgttcgcgagatatttgacaaggctcggcagtcagctccatgtgtgcttttcttcgacgaacttgactctattgcaactcaacgaggcagttctgtaggggacgctggtggtgctgccgatagggtgttgaaccaactcttaacagaaatggatggtatgacagctaagaaaacagttttcatcataggggcaacaaacagaccagacattatagaccctgcattgctcaggcccggacgtctggatcaattgatttacatccctttaccggatgaaagttcacgtcttcaaatcttcaaggcatgcttgaggaagtcaccaatctcaaaggatgttgacctatcagctcttgcccgttttactcatggattcagtggtgcagacattacagaaatttgtcaacgagcgtgcaaatatgccattagggaagatattgaaaagggtattgagaaggagagaagaaaaagagagaatcctgaagccatggaagaagatgacactgatgaggtccctgagataaagcctgcccactttgaggagtctatgaagtttgctcgccggagtgtcagcgacgcagacataaggaaataccaactctttgctcagaccttgcaacagtctcggggatttggatctgagtttcggtttccagatcaaaatgagaacactgcagcaggtgcctcagaccctttctcatctgttacagctgagggagatgatgatttgtacagttag

SEQ ID NO: 47773 - DNA, 924 bp, Glycine max
  Peptide Sequence Number=SeqID_164551
atggcatcaatttgcgacaaagatatccctcttcgactacacaacatcgacgctttcatcgcttcttacagaaactccctccactcgctcagagccaccgcactcgaagccgcgcgatctcaatccgaattagccgaggttaaagctaaactgcgagaggctgaggatgaattggtaaaggcacttgcagttaagactcggagagaggcgaagcgaatggccttgaaagaggcgattgtttctgtgaagggaagaattgaggatctgaagacgagtattcagaagcagagaacccaaaacgaggaatgtgccacggttgtgtcgcatcaccgtcttggacacctcagtatgccattggtgctctgcccaatagtcttgggtgtcctcatgttctaccacttttattcagcacaaaaaaaatactttgatatgcacatgaaatcaaatgaaagcagtgaacatagagatgaagtccaggaggccatatcttggtacaataggatccttggttttcagattgaaggtggacgtggggtaaaattcagcttcaagaatattaatgtggacaacccaaatgaggagttcttttttaccatccgccacgaagatgacgtgtatacattgctaaattgtaaaccatctgtcaaagatactgacgagttgatccatgaattaaacaacacaaatgggctatttaaatttgtcagaacaatgaggaaaaagtttcaagaagtagtggcacaagagcttaatcagctggttttggttaaactggtaaactatttccaattcaacatgttgaagttagtgatgttgcagagtagcaggctatatcaggggaaaggatccaacctgtcacttattcatggctataagttgttatggctaccattaagtgtaatggcacccatggtagtgccatag

SEQ ID NO: 47774 - DNA, 222 bp, Glycine max
  Peptide Sequence Number=SeqID_164552
atggtggaaggccaaaattctgccatagaaacatgccattgcagtctatggcaccactatagcaggcctcccctcacaaattgcctatggcagttggcaaaaatccagcacgccgttccaccatggcgccaccatttaacaacattgtctaaaaccacaccagaaataacaggatatgaaatgattgtatacgaggagatatcggtgaggaaaagacaatag

SEQ ID NO: 47775 - DNA, 150 bp, Glycine max
  Peptide Sequence Number=SeqID_164553
atggcaatggtgaagtctcccaagaagcaagtgaacctcttctattcccttgacagtgaagaccttgcccagaacgttgctcttcaatcaccccacatcgttcttcagaacatcaaatggagattggctttcagtccaaattatgtttaa

SEQ ID NO: 47776 - DNA, 294 bp, Glycine max
  Peptide Sequence Number=SeqID_164554
atggaggaagttgtaccaatgttgcaagttccagggcattggatagaagactccaagaagattgggccagagatgcaagagaaggccctagggtgtttcactcaatttggagtgcttcttagtccaatagctcataaggtggttggccccttgcttcttgactcgaattcttcaagggatgacaccaatcctcctttccaatttcctatgtggcaactcacaaacaaggaaacaaagagacaaacaataaccaaagaccaaaaatatgaaatgaaagttaaaccaatagagtga

SEQ ID NO: 47777 - DNA, 171 bp, Glycine max
  Peptide Sequence Number=SeqID_164555
atgtgcagcaattttgtgaatgttgtattgtttgcaaaaaggccaaatcaaagaaaatttgatgatgctaatcatgtgacaaatttgttcttcaaagaaggggtgaaactccatggattaccaaaaagcattgttagtaataggaacttcaagttcctaagccatttttag

SEQ ID NO: 47778 - DNA, 564 bp, Glycine max
  Peptide Sequence Number=SeqID_164556
atgatgaccccaccgaaagcggaaaaacgcccttatcccatcaccatccacggcgacacgcgcgtggatgactattactggctgcgcgacgacgagcgcgcagaccgccaggtgctggactacctgcaggcggagaacgcctacaccgatgcgatgctgaagccgcagcaggcgctgcgcgaaaccctgtacgaagagatggtggcgcgtattccgcagcaggaacattcggtgccttacgtgcgccacggctatcgctatcagacgcgctatgagccgggcaatgaatacgcgatttccgtgcgccaaccgcaggccgagagcgagcgctgggaggtgcttatcgacggcaaccagcgcgccgagaatcacgagttttacaccctgggcgggctggacgtcagccccgacaaccagcggctgggggtggcggaggatttcctgtcgcgccgccagtatgacattcgcttcaagaacctggccgacggcagttgggcggacgaagtgctggagaacacctccggcagcttcgaatgggccaacgactcctcgacggtgtactac

SEQ ID NO: 47779 - DNA, 468 bp, Glycine max
  Peptide Sequence Number=SeqID_164557
atgtctgatttgttgttgccctccacgactcctgagtggaagagagttgcagaggttgagcctgaacccatggaattgtcgaaggaggagaaggatgcgaagcaaaaaaaggctttggagttggatgctgattatattttgtatctcactaaccgcgttgctgtctacttggaaatgggaaatgtatgcttcattttgtttattggcataatggttatactaaatttgcatttcgatgatttggtctcggtggggtggaatagtaataacgttgttgacaatgacaatgaaggcgcccgaatggtggggacgaaaatggtaatggtggaggcaaaaaaggtagagcgtggtggtggcaatgttggtgattatggtggaatggtggtgatggaggcaacaacaaaaacgatggcagtggcaagggcaagggcaatggcggtggcagaggcgttagctgtggtaaggtga

SEQ ID NO: 47780 - DNA, 609 bp, Glycine max
  Peptide Sequence Number=SeqID_164558
atggtgttactgccaaaagaatactcacatagaggaaccaagcacacattgattcatagccagggaaaagggtctgtagaagcaaccagaggaagtacatatccaaagtggttcgagcagtgcaaagttgcagcggtgttgcaatgggacaacacaatgatattgagtagaggggcagtgcaatgggatggtgcaacaacaagcagagggacaatggtgagtgcattgtataagggagggtgtgggatgtgggatgtgagtttatgggggtgccattgggacattttcgactcacaggatggagatgaggatgacacaactagaaaaagacctttttatgatgcactttcgacgaaaaaccgtcgtggtttgcgcgtcatttggtcacgtgaacccctatctttgactgagtcaacctcgtgcgctcagtcagtacatactaacccctatgtgcattacattgtggcatcactcaactcaccctctacgtcactcaccggccatcgtaggtatattttgcgctgccctgccacgtcgtcgaacatcttcggtcgtcgttcaattaccaccgtcatcatccaaggtcagtctctcatttcccctgtatga

SEQ ID NO: 47781 - DNA, 765 bp, Glycine max
  Peptide Sequence Number=SeqID_164559
atggccacttcactaaccctattcaaaacaatctttgttttcttaattatcttcactctcctcacaccccaagccacggctgattgtgaagccgaatccagaaacagttgcaacaacaaaaagaaagccctacctctaaaaatcatagccatattcaccatcttagcctcaagcataattggcatatccctacccttggtgacacgttcggtccctgccctaagcccggaaaacaacctcttcataatagtgaagtgcttcgcagccggcatcatcctcggcacggggttcatgcacgtgctcccggattccttcgacatgctttggtcggattgcttgaaggagaagccgtggcacgagtttccgttttcgggtctcgccgctatgttctccgccataatcacgatgatggtggactccttgtccactagtatttacaccaagaagtataggactactgaggttgttcctggtgagagcaaccgtgcaggtggtggggaccaattggagatggctgctgttaacttggggcatttccatggccaccaccatgctcatgagaccaagattgagggcaaagaagcacagcttctacgttatcgtgttgttgccatggtattagaacttggaattattgttcattcagtggtgataggacttggcatgggagcctcaaataacacgtgcgcaataagaggtcttatagccgccatgtgcttccatcaaatgtttgaaggaatgggtcttggtgggtgcattctacag

SEQ ID NO: 47782 - DNA, 687 bp, Glycine max
  Peptide Sequence Number=SeqID_164560
atgactgaggattactcccaatatcccaaacacctggttgctgttgactgtattattttcggttttgatggcgaaaatcttaaaatcctattggtaaaaagaaattttgaaccccagatgggcgaatggtccctcatgggtggattcattggcagtgaagagacatccgatgaagcggccaacagggttctgtatacattaactggtcttgaaaatatttatcttgaacagctgaaatgttatacggaaattaaacgtgagcctacagccagaatcatgtcaatctcctactatgcattgatcaatattgaaaaagatattcagatcaatgaacagtacagtgcagaatgggttgagcttcagaaagcaccggatcttattttcgatcataacgatatggtaaaggatgcggtagccagactgaggagaagagcttccaccggacctatcggctttgagcttcttcctgaaaaatttaccatgaaggatcttcagaatctttatgaagccatttttgacgaaaaattcgataagcgtaatttcacaagcaagatcaatagcatggatatccttgtcaataccaataaaaaggatatgacctcatccagaaaaggttcttttctttaccgctttgacgaaaaaaaatacaccaagaaaatatcgcgcgggtttatgtttaaaatgtaa

SEQ ID NO: 47783 - DNA, 138 bp, Glycine max
  Peptide Sequence Number=SeqID_164561
atgggtcggcgttcgcttactcgaacccactcaaggatactaggctgccttgcagcggcgttttccgcttgtccagagcagggaaaggacgacgatctatcggtcgtgaccctagcctcaatttgtgtctgtccctaa

SEQ ID NO: 47784 - DNA, 327 bp, Glycine max
  Peptide Sequence Number=SeqID_164562
atggtgggttacacaccttccaactttgtggatatggtcttcgccggcaaaaggatcgaagtgggtctgaaaagaggcaaatttgatcatcctgctttgataaaaactggggcaaatgaagagggtaaggatgaaggagaaacccatgctgtgactgccattcctatatggccaagtttcccgccaacccaacaatgtcattactcagccaataacaacccatctctttacccaccacccagttatccacaaaggccatgcctaaatcaaccacaaaacccaccttccacacaaccaatgctaaacaccaccttgagcacaaactaa

SEQ ID NO: 47785 - DNA, 285 bp, Glycine max
  Peptide Sequence Number=SeqID_164563
atgcaccgtttacaaaaatttcgggtagaaatttccaggatatcacagcaggcgtcatgcggtttcttcgttgccattgggcgaccagaacaccgtagtcatgtaggtgttgttggagttggtctcacgatcaagaaatactttgggctggctccaaggacctcccgtatgtcttcctccatggctcctgaagacctggagcaactaatgcaacaaattagggaccagttggaggagtcgatcactgaaaaagtgactcaacggctaatgttatccttcagctag

SEQ ID NO: 47786 - DNA, 246 bp, Glycine max
  Peptide Sequence Number=SeqID_164564
atggaaaggagtgccagaatggatgatgcagatttcgggtcatccccagcatggaagtctaataatgtaatgtcatggatatggatgcagcaagcgatgcatactgaattgaatgacaacagctgtttccgaaagaaatgggtttgttgtcatcaccatgcagatgccatggaagcagctcataccactgaaaagtgtcgcaataaaataaagatgaagagaaaagcagatcagaggtgcatgtag

SEQ ID NO: 47787 - DNA, 282 bp, Glycine max
  Peptide Sequence Number=SeqID_164565
atggcttctacaagtggagatgctactccattgagtagtgaagctttaagtgtgaggattgaaaatatagagcgaagaagagaggataaatcatctaattcttctcatggagaagatgaagggtatgaaaaggatgaggggggaaggaggaatgagaggtatagggagagaagaaatcatagaagatatggaggtaggcaaaaagaggaagggattgagggagtgaaggtgaagatccctacttttaaagggacttatgatctagaagtgtatcttgagtag

SEQ ID NO: 47788 - DNA, 408 bp, Glycine max
  Peptide Sequence Number=SeqID_164566
atgcggggttaccttgtggttacccacacctttcttcaaccaagggcaaacgagcccgttgacgcgcagagactaacatcgtcttctgcaccttctgttgtcctgacccgtgaatcgggtgacatgcggggttaccttatggttactcgcacctttcgtcaaccaggggcaaacaggcccgttgacacgcaaagactaacatcgtcttatgcaccttttgtcgtcctgacccgtgaagtcaggtgtcatgcggggttaccttatggttaccctcaggtgacatgcggggttaccttatggttacccgcaccttttgccatccagggacagcgagtcagaaacattcaagcccgacgacgtgcgagattcttctctgctgggcagggacgatcaagtgcaatggcgtag

SEQ ID NO: 47789 - DNA, 450 bp, Glycine max
  Peptide Sequence Number=SeqID_164567
atgacgaagcaaatggactctcgagcggtcaaggatgatgaaatcgatctgcgtgagctgcttggggcgcttattgatcgcaaatggtggatcgttggaacgactgccgcgttcttcattgctggtgttgcctatgcgctgctcgcacgcccggtttaccaggctcaggcgatggtgcaggtggagtcgaagatgccgagcatccccggcttggctgacctcgcctcgctgggtggaagcggcagcacggcagccactaccgaagttgcgctgcttacgtcgcgcaccgtcatcggtgcggccgttgacaagttgaatatggaagtggcaatcgaaccgaagcgccttccggtctttggcaacttctttgtccgtcgtttcaagccagaaaccgacgagcaggtggcgccgccgaagttcggtctggcgcgttatggctggggcggtgac

SEQ ID NO: 47790 - DNA, 180 bp, Glycine max
  Peptide Sequence Number=SeqID_164568
atgccactcatgatcgatttttccccgtctcgaacagtgcgcgatttcgcacgcggacgcggctgcgacgttctcctacctgaatgtcgggccgccagcctgccatcttcggagtacccgaagccgcctgtagtagcatcgccccccccggacaggcgtgggctcgctgctcccccgcct

SEQ ID NO: 47791 - DNA, 769 bp, Glycine max
  Peptide Sequence Number=SeqID_164569
atgaaaagcatctgcagcgcgacacgcgcgactcgaccgcccgcgttccacaggaccgcaaccttcgtacgcgacatgaggtctgccgctgaaccagctttgctctccaatttgatcgaccttagagccagtttcgaccagcagcgcgcactcatgatgcgttgccagggcccccggaatcttgtggagcgtgtagccttcgctgggattctcaaagaatgcttcaatgctgcgcatcagtgcacgcgcgcggtcgcgctccagcgccgttgcgggtgtcgactgttcggcggcagtgcgaagtgcctggatgatgtcgaagtccaagcagtaggggaccttctccatgaaaggactgttgcccagcagcagcctggatgcctcggcccggatggcttccacggccatgtatctgcgccgcattacatggtcgacccaaagaacatgcgcgacgccgcccatgtcgcccaggtctggtgcgtgacgcaggccgtacgcgatgcggaacagtttctgcagaaggtcgctgcggtaagcccggagcaggccagtacgcgggtccatgagggcgtctacggcatcgcgacagcccgcggccaggccggtgcggggcagcagctgtggaacgttcgcttccagggagaccaggatggaaggaacgccgccgatccagtggctgacccgccaattgtgctcggcaaggaggaaggtccgtccagccagaaccttggcatacagcccagggaagcgcgtgccgagcaggttcagg

SEQ ID NO: 47792 - DNA, 636 bp, Glycine max
  Peptide Sequence Number=SeqID_164570
atgtcgcgtacgaaggttgcggtcctgtggaacgcgggcggtcgagtcgcgcgtgtcgcgctgcagatgcttttcatccttctcatgggccgggtgctgggcccaacggaattcggaatcgtcacgctcgcactgattcccttccagattgccacgacgctcggaacacggacattcacgcaagctctaatccagaatcaatcctggatggatgggctccatcgtgaaactgcccgggccagcgttgtttcaggactggtcgtcttcatcctgattgctgcgtgtggtctcgccttcgggtacgtcaaccaatcttgggattacttcatcatcatcgccgcaatgggactgagcgccccgatttcatcaatggcggtggttgctcaggcgcgcctcagcaaggacatggcgttcgccaagatctctttggcggagaccatcgccagcatcgctgccgtagcggcgggactggcatatctgtacatttggcgcgacgtgtacgcggtcgctgtttatgcactaacccaacggagtgttgagactctcctcatctacaccacagcacggcgccgaagcctcccagcgccgaccgagaatgccacgctgcaaagcacacctggcgacatcaagccggtc

SEQ ID NO: 47793 - DNA, 2351 bp, Glycine max
  Peptide Sequence Number=SeqID_164571
acaagcactgtagtcatccgaacggaagccgcccggacggccagatatcttgaatggctaccctacggtcaggacgtcgacttcgccatccgcgtggagcgtgctggctaccggtggcatatgatcaacgatccgggcgcagtctggaacgatgtgaagagtggaagcaggatttcggcacggacagaccctgcggttcggctgcgctgggcggaggaggcggagccgcttcttaccaagaaggcgttgaggggattcaagggttggcgcgtggcgaaggcttacgctgagcacggccagacgctgaaggggctgactctctggttagaggcggcggtgacgggcacctatgcacccaagcacgccgttatcgtgttcctccaggttgcacttgccaacggttggtatcgcaaagtcgcggatgttggctcagagacattcatcgccgaccactacgatgccttggaaaagtcaggagttgagtgcacgttcgcctgcgaggaggccgttggcggcagcattgatcgattccggcacttaaagaatcgcggtgcgcatggtggaaagtttgcgcgcctgatgcagaagacactcttcaatctggcaccaaattggtcccggcttgcggtagaaatacgtgcacttgcccctgacgtaattcacgcgcactttgccaccgatgctgcggaaatcctccctattgcagagaagctgggaattccattgatcgtcactctccacggatttgacgtaacgtcgaaggcgagctacttcgcaaagaagctccccttcaaatggccctacgtgcttcgtgcgggccggctgcgccaaagagctgcggcattcctgccggtttcggacttcctgcgtgacactgcaatcagcaaagggtatccggcggaacggacacacacgcactaccttggaacggacctggatcgtgcaccagcggtcagctcagagccgcggaagaacatcctttttgtcggtcgcttggtagagaaaaagggatgccactatctcatcgcggcattcagaaagatggtggccaatggctttgagggaaagctcctgatcatcggctctggcccgcagatggaaccattgatgcgcagctctgaggacctccaggagcgcattgagttcttgggagctcaggatcgggagaccgtactcaagcacatgagctcagcgagcgcattctgcatgccatcgatgccagccaaaagcggggacaatgagggactggggatggtatacctcgaagctcagcttactggctgccccgttgtggcattcgatcaagggcctgtccgcgaggccgtctgggagggagactgggatcttctagccgaacagggagacattcattcactggcggagaagctttacctcgctattcgcgatgataaagcctctcatcatcttcaagtaatgaggcgtgacgcggtcattcgaacccactcacgactatccgtcccaatcattatttttacgattgccctagtctacttgtttatccaagacattccatttcaagatcgtggaacaagaatagacctggatgagggtggctctgggtcaattattcggcaaatattcttcattgctgttgcagcatatttttttctgaagggcattgtttcgagaaagatctcaagacacttcttcccttggtcgattgttgcacttcttctgtggtggtcgattacggtcacatgggcaacatcgccagaaatttcctttaggcgactagcctttaacgcgataatttttatctggatctattctgcaacagcagttatcggcccgaaaagatctcttcaaaccctcaaaaatgtatcgttcgccctagtattcgcaagcctgattagcggccttttgatacctaatgctatccatcaagcaggagaaatggattccgggcttgtgggtgcatggagaggcttcagctttaaatcgattcggctacgtaaaattttcctgccattgctcggcaccttgggcggatttgcattactcatactatcaaactcaaagacatcgattggcatgcttctgccggctctgctaatcgggtacgtgtgcactcatattgcgatgtctcgctcacgactactgggatacgcagccctcattctgacaggtaccgcggcagcatctgccgctattgcgatatttttcccacagatttcatcaatccttacaacgcctgagtccttcaccggtcgcgcgggaatgtgggcaatcctggtcacaatgatcattgaccgaccaatttccggctttggttttgggtcagtttttcaagcgggcgcggaatcggccatttccggatatgccaactggtc

SEQ ID NO: 47794 - DNA, 495 bp, Glycine max
  Peptide Sequence Number=SeqID_164572
atgaagattctgaagaacacacaatgctcaagtcaacaaggtgcagcttcacaacggagattacagcacaaggaacttgttggggagaacaaagctattacttcagagttgaatgaagctgtagaaaatggagacatggatagcttggttaacgtgttggctaaggtttttgatcaagtcacctggactggtgattcattgcttcatttggcagcaaatcttgggaaagaaaagactgtagagttgatttgtgatcactttcctgagcttcttttaagaagaaacgtgaaaagtaacactgtacttgatgctgctgtgaggtctaagaactctaccatagatcaggttcattctctccaattaagccatagagaagataaagagataacaaaagaaaagaatgaatatgggaacactcctttgcacgaggctgtctacagtggtgatgttggtgtgattaaagagattttacttgcggataatgatgtggtctaa

SEQ ID NO: 47795 - DNA, 337 bp, Glycine max
  Peptide Sequence Number=SeqID_164573
atgggaattgctaggcataaatcagttgctagaacaccccaacaaaatggcctagcaaaaaggtttcatagaaccatacttgagagggttagatgcatgctctcaagtgcaactgccccaaagactttttgggcagaagctatgacaaaaccttgtttcttgataaatagatgtccatctacaaccttgaacatgaaaaaatcaaaagaagtctggtctggtcatcctctaacatataacagacttatagtgtttgcttatgttacctatgcacacataaggcaagataagttggaacccagggccttgaagtgcatgtttatagggtatccagaag

SEQ ID NO: 47796 - DNA, 852 bp, Glycine max
  Peptide Sequence Number=SeqID_164574
atgcagctccaccgtgtctccgccgcatcgaaactgagcctcacgtgcttcagcttcgccttgaaattcgtgctgttgtacgctgcggaggcacagcttcagcaccgcggccccgacctacattggtaccccggaaccgccacctggtacggcgaccccgaaggagacggcagcaccggtggggcatgtgggtatggaacaatggtggatgtgaaaccattcagggctcgagtgggggcagtggggcccttgctgttcatgaagggggaagggtgtggtgcgtgctacaaggtgaagtgtttggacaagagcatttgttcgagaagagcagtgacagtgataattacggatgagtgccccggttgcccctctgaccaaacacactttgatctcagtggtgccgcgtttggtcgcatggctattgctggcgagaatggtccactcagagaccgtggtcaaatccccgtcatttaccgcaggataccacatgatctgcatctgagtttacccttgttgttgagtcccggaacgctgtgtaaatatcctggaagaaaaattgcatttcatgttaacgaaggctccacaccattttggctatcacttctggttgagtttgaggatgcagagggagatattggctccatgcatatacgagaagcagggtctactgagtggctacaaatgaaccacctttggggtgcaaattggtgcattattggaggacctttaagaggaccattctcagtgaaattgagctcctccactgggagaagcctctctgcaagagatgttattccaactaattgggttccaaaggccacttacacctctcgcctaaatttctacccctaa

SEQ ID NO: 47797 - DNA, 138 bp, Glycine max
  Peptide Sequence Number=SeqID_164575
atgggtggcgcgccgtcgcggttggagcgtaacgtgggcgttgccgacagtgtggtggcggcagatgcaacagggcgtgtagggttttaccttgtgctccattggttttgtggttatttacgcaagggtgccatttga

SEQ ID NO: 47798 - DNA, 627 bp, Glycine max
  Peptide Sequence Number=SeqID_164576
atgggtgttcttcagtatacacttctctacttgatcttactacaatcatgcaagattattgcttacaaagaccaggagtggaagaaagctactgcaactcatgcaaatgacacagagggatctcttattacagaaggagcatgtggttatggagacctccacagggccagttatgggaaacacagtgctggtttaagcactattttgttcaacagagggagcacatgtggggcttgctatgaaatcagcccttctgttgttgttactgttacagatttctgtgctccaaattatgggctttctgttgattatggtggctggtgcaactttccaagagaacattttgagatgtcacgggcagcatttgctgaaattgccaagaacaaagctgatatagtgccggttcagtatagaagagtgaagtgtgaaagaagtggtggcatgagattcacaatgagtgggagttctcacttctatcaagtcctgatttccaatgttggtctggatggtgaagtgtttgctgtgaaagtgaaaggatctagatcaggatggataccaatggccaggaactggggacaaaactggcattgcaatttcaacttccaaaatcagcctttgtcctttgag

SEQ ID NO: 47799 - DNA, 150 bp, Glycine max
  Peptide Sequence Number=SeqID_164577
atgactaatgcaaactctccgcaagaatcattgcattcagtctcaaacgggaatctaagggtttctgtgtgtgtcataaggaagggggttcgagggtgtgtgtctgtcacgaggggtttgtctgtgtgtctgtgggtgtctcatcagggg

SEQ ID NO: 47800 - DNA, 303 bp, Glycine max
  Peptide Sequence Number=SeqID_164578
actgaggtatcagtgtctccagcaatagacactttctggaagtggcttaaagaagaaggtgttgtctctgccaagaccccagtgaagcctagtgtggtgccagaaggcctaggattggttgcactcaaagacatttctaggaatgaggttgtcttgcaggttcctaagcggctgtggattaaccctgatgttgtggctgcttcaaagattgggaagaggctcttcgctatgcgaaggtatgggggagggatgttgtacgcagccttacccttgcatatgcaaagaggctgtttccggatttga

SEQ ID NO: 47801 - DNA, 631 bp, Glycine max
  Peptide Sequence Number=SeqID_164579
gatttccgtcttacagacagcaaaaaagaatgtttatacggataaccactcgggtatttccgcccgtcagcgtgactcaaaagtcagtatgacagatcttgtaagcgcggaagatgacacagcaaaaaagaatgtttatacggataaccactcgggtatttccgcccgtcagcgtgactcaaaagtcagtatgacagatcttgtaagcgcggaagataacgtaaatctccgcgtgtcaacgggcttgtcggccgcgattcacgaagggcgcaggagacgacttgagtctctgcgtgctctcaggcttttcgtcttacagatagcaaaaaagaatgtttatacggataaccactcgggtatttccgcccgtcagcgtgactcaaaagagacgacgctagtctctgcgggctatcaggcttttcgtattacagatagcaaaaaggtttatacagataaccactcgggaatctgcgcccgtcagcgggactcaaaagtcagtatgaaagatcctgtgagcgcgaaagatgacatagcaaacaagaatgtttatacggataaccactcgggtaaatccggctgtcagcgtgactcagaagtcagtatgacagatcttgtgaggacggaagatgac

SEQ ID NO: 47802 - DNA, 795 bp, Glycine max
  Peptide Sequence Number=SeqID_164580
atgaacaagtccatagacttcatacatgaatcatctaatgataaaggtaagaggttaagggaaccagagaagaaagatgactttaaagccatagggatgaggtgcggtcgcatgccagcattggcagctgcagctaatgaagatggggaccttgcaatgttaagactgattgtgggtgcttgcatatgcatggccactttccctttgctattcctaataggaagcccatatataactgcttctgattccaagtatgtggaaactcttgacaagtttagttcttgttaccctgtgtctggtgatgcagcactcaagaaaccattcagtgttgagtataaatggcaaaagaaatgttctggggacttgctcatgctggctcaccctcttcatgctaagcttctgtcatatgatcatgatgttactgtgctgaatgattttaagtatagaagcattgatggtgaccttgttggtgttgtaggagattcatgggtgttggaaaccaatcctattcctgtgacatggaattctaacaaaggtgtggagaaagagtcttatggcgagattgtcatggcgcttgttaagcatgttcaagcgttgaattcttcagcaataggaacaaattcatcttatttctatgggaagcaggttggaagggctgtgaggttggcgttgatagcagaagaagtgtcttaccctaaagtgattccaaaggttaagaaatttctgaaggagactattgagccctggttggatggaactttcaaagggaatgcttttctctatgaaagaaaatga

SEQ ID NO: 47803 - DNA, 1032 bp, Glycine max
  Peptide Sequence Number=SeqID_164581
atgaccggccctctcaatgagtcaatcttttgcattctcataagggtggacccttgggtactagtaccctcaccttcagagggcaacatgccctcaccttcagaggactacacgtcctcaccttcagagggctacacgctctcaccttcagagaactacacgtcctcgccttcagagggctgcacgccctcaccttcaaaggactacatgtcctcgcctttagaggactgcacgtcctccccttcagaggactacacgtcctcaccttcagagggctacacgctctcacctttagaggactacacgtcctcgccttcagagggctacacgccctcgccttcagaggactacacgtcctcgcctttagagggctgcacgccctcgccttcagaggactacacgccctcgcctttagaggagagggaggctatcgcacagctactatgcatatcggggcaagatttcacccaaccgctacaaggagacgagtgtggatcatgcataccaccacaactccgatctccccctgccgaagtgttagttggtctgtgccgtcatgacatagggatcgcgcccacaagacacccagtggacccggagaagtccaacagggccctggggtttccagctctggttttgagcctctgtcagtcctaccgggtgcctgtccccccagcaaggtcatgccatcgtgacataaggattgtgcctataagaaactcagtgggcccggagaagtccaatagggtcctagggtttccagttctgattacgaacctttgtcagttctacggagtgcccgtcgccactaacaaggtcatcaggcctcttactaatcgagctttcatcaggaagtactgcgtccctaggcaggcgcaaggcaagacaccacaacagcttggggatggccggcaatgggcaatagatgcaccgccgccacctccagagtccctcagctcatctacaaaggctgaagcattgcctacgacccgaggccgaccagcaagcgaccaagtccaaagccaaaggtaa

SEQ ID NO: 47804 - DNA, 516 bp, Glycine max
  Peptide Sequence Number=SeqID_164582
atgcacctccttcacgctacatcaaagttcgtcatggtcgccttttccgaccagcatgagattatggaaaagaaagacaagaccattgatgacttgatgactctcaggcgcgtaaagaagttcatcgcacattgctctggtgttgaaccaaaagacaagccccttacagatggttatcatgagaagattgaaagaaattataattacctttattgttggcatcaagctttcatcagaccatctgataagaatgcttttactccttggaagacaaggttttattatcaatctaacaaacaaagttcttattttgtttgttttccttactcaacctttttcttcatagtggtagaacctgctattattaagatccaagagaaattctacaagagtatgaatattagcccactcgtgatgactatgaagcttttatggatgagttatgggctactcatgatgctcattcaaagctattctcataagaaaaaaggcttggagatattcttcttcatttga

SEQ ID NO: 47805 - DNA, 228 bp, Glycine max
  Peptide Sequence Number=SeqID_164583
atggtgtcgaaaaatagaaacaattccaccaccgaagtttctttccaccaacaaacaaatctggccatgcacactaagtgcaaattccatcacgacatttgttgcccggcagatctcaatgatgaggaggagttgcatgattcgaaggcattcaatgacagtcatggcattcgtcgctacggcggatctcgacagcaaggaggagttgcacgttttgaaggcgtctga

SEQ ID NO: 47806 - DNA, 504 bp, Glycine max
  Peptide Sequence Number=SeqID_164584
atgttactacgatcccccaaatcaccacaaacacagaaacaatttcctctccagaaatcaaccaatgttacaaggaatcaacaaattgggaaggaacttgtttcaactgaacctcggctaaccttaacgcttcaagctttagacaacactctgcaacaaaaatcgattatatacatcaaaagtcagcactttatattaacagggagcaagtgcgtaacggaacaagcagcggttaacatacgctttcgacatcctcggaaccctgttattggtgataaatttagcagtagacatgggcagaaaggcgtttgctctcagttgtggccagacgttgatatgccattttctggaaatactgggatgcgcccagatctcattatcaatcctcatgcatttccttccaggatgacaattgctatgcttttggaatctgttgctgctaagctgagtggagtggcccctggattgctatgggattcaaaaagtggagatagtgaccattga

SEQ ID NO: 47807 - DNA, 195 bp, Glycine max
  Peptide Sequence Number=SeqID_164585
atgtataactccccaggaattttaattgcacttttattcatcactgtaggaattgggttcaagctttccccagccccttctcatcaatggactcctgacgtatacgaaggagtgcgatgctacatagttggttctcatccttcagagactacgagtataaataggagcatcccgtcaacaaaaggatcaccctaa

SEQ ID NO: 47808 - DNA, 282 bp, Glycine max
  Peptide Sequence Number=SeqID_164586
gaaaaactggaagattggctgcaaaagggaaaaaggcttcttctggatgagattgataaaaaaagcaagaaatttgatttcagtgacattgttcaggttaagaaagtcatggataaaaattcaccaaagcaagtcagtacagcagttgaaaatatgttgaaaactggaagattggttacacaaacgggtctagatctgcagcagcttacttataaggaaatgcatttaattagttattcttccgtattcattaagttgccaggacataataggaaaggctaa

SEQ ID NO: 47809 - DNA, 519 bp, Glycine max
  Peptide Sequence Number=SeqID_164587
atggaattggtgtttgttcacttaacttggttcttactttggttggataatccggtgctgtatccgccgcagaaggagcggatttcgaggacaatgcgggaggctttacttccgtttgaatgcagacaggcaaagatttcttatgcagggaagattactatagatgtttgctttcaatataatgatgggcctattattagagaaaatataaattttgggcagtttcccataatgctgcagtcaaagttatgcaacttgagaggtgctgatccccagaagcttgtgtcctacagggaagaagcatcggaaatgggtggttacttcatcttgaatggtcttgagagagttatccgactgttaattttgccaaaacggaatcatcaaccaatgagtatggtgcggaattcatttagtgaccgacgggaaggatatacagataaagcaattatagtacaaaaaatagttcatgatgaaggctactgcctagcctatggtgacagattacaggacagcttctaa

SEQ ID NO: 47810 - DNA, 693 bp, Glycine max
  Peptide Sequence Number=SeqID_164588
atgggggagacacatgaaattccccaccacaatctagccgacttcgagccttgcctcggatatgcaactaaagggcaaacagttggtggtatacccctgcaaaacactttggagggccctcagtatcaacctgcgctcctgaatgttgacttccaaaaccgttcaatcagagattactcgtcctgcacgttggtgagggtgccgcaaacaacgagtaaagcagaaaaagggctacacgccctcactgtcagaggactacacgtcctcgccttcagaggacttcacgtcctcgccttcagagggctacacgccttcgccttcgtaggactagacgtcctcaaattcagaggactgcacgtcctggcctttaaagggctatatgccctcgccatcagaggactgcatgtcctcgcctttaaagggatatatgccctcgccttcagaaggctacacgccctcgccttaagagggttgctcgccctcgccttcaaaggactacacgtcctcgccgtaagaggactatgcgtcctcacctttagaggactacacgtcctcaccttcagagggcttcaccccctcgtcttcaaaggactacacgccgtcacctttagaggactacacgtcctcgccttcagaggactacacgtcctcgccatcagagggctgcacgccctcaccttcataggactacac

SEQ ID NO: 47811 - DNA, 219 bp, Glycine max
  Peptide Sequence Number=SeqID_164589
atgaccttacaacttgctgaccgctccattaccagaccatatggagtaattgaagatgtgctggtcagagtgaaacattttatcttcccggtagactttgtgatatgcctgctccagaacaatatgtttgcttacagtccttttgctaagcgcaagcctcgcgctgagtgcatctttggtcatgcgctaagccgtgagtctcaagcgcttagcgcttaa

SEQ ID NO: 47812 - DNA, 357 bp, Glycine max
  Peptide Sequence Number=SeqID_164590
gtcgactctagaggatcccaccttcaaagtaacagcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 47813 - DNA, 285 bp, Glycine max
  Peptide Sequence Number=SeqID_164591
atgaaagaaagggaatggaaaatcttcagaccagataaattctcggcaagactgccattctcgactggcgatatcccaccccacatgaacaaagaggaaaagaccgaaacaccccgcttcctctccaaaaacactaccctcgagaaaatcctattggtggaaaaacccagtggaccgttcggtccagccaacctctttttttcggagccccatgaatgtcattgcctaccgctgttcatgtgtcctccaccttcgagtctggagctatgcttcatgattgcctaa

SEQ ID NO: 47814 - DNA, 762 bp, Glycine max
  Peptide Sequence Number=SeqID_164592
atgtctggagaatcagccagcgctattcacaagggtcaagtcgatctcttagacttcattgactggtctggggttgaatgcctcaatcaaagctccacccactctctccccaatgctatcaaacagggttatagagaagacgatggtttgcatctggagagtgatgcagacgagcagcttttgctctatattcctttcactcaagtcgttaaactttattcctttgttatcaaaggtcctgaagaagaaggccccaagacagtgaagctcttttctaacaaggagcacatgggatttagtaatgtcaatgattttcccccaagtgatgtggcaaatttgtctgaagaaaaccttaaggggaaaccggtacttttgaagtatgtcaaattccaaaatgttcgtagcttgacaatttttattgaggacaatcagtcaggttcagagatcacaaaagttcagaagatcgtgctgcatggtacaacatacaccaatacacacactgcacacacaagcaaacacgataaactgttcatcataccaactgttaaattgtgcaatcaaaatactgcgaatggaatcataccccaagttttacaaacagccagatcgaaggacataccgacacccaacggtagaggaagctacttgctggtcgccgatgtgctgtcaaacactagatctgcagagcctatagtctccggcgaggaatatgctgattgcaaaatcaactggtccacaactacggtgaccgactgcaaataa

SEQ ID NO: 47815 - DNA, 228 bp, Glycine max
  Peptide Sequence Number=SeqID_164593
atggcattcatgaaacaccaagctttgggaggagaaggacatgagcccatctgtagctttctcacaggccatacaaactctccatcaatggcagcacttaaattctgtccaccattctcaccaaaccaccacatcggacaacaacacacaatggacaccttgatgcagcaacttttaatgataccaacttgtttggggctgatatatatgctggagagacagcaatga

SEQ ID NO: 47816 - DNA, 306 bp, Glycine max
  Peptide Sequence Number=SeqID_164594
atgacgttgctacttaacaacattctgcccaacgaccgcaatgccgatctccccctgtggaagtatcagttgggatcgtgcccacaagacacccagtggacccggagaagtccaacagggcagggccctggggtttccagctctagttacgggcctctagggtgcccgttccccccagcaagggatcgcgctcgcaagacacccagtggacctggaaaagtccaacagggtcctagggtttccagctctgattacgagcctttgtcagttctactaagcgcctgtcgcccccaacaaggtcattag

SEQ ID NO: 47817 - DNA, 360 bp, Glycine max
  Peptide Sequence Number=SeqID_164595
gtaatggagaagctgaaaattcttaatctcagtcattctcattatttaacagagactccagacttttcaaatttgcctaatcttgaaaagctattactcgtagattgtccaaggttgtccgcgatttcctataccattgaacatctcaataaagttcttctaataaattttcaagattgtattagcctttgtaaccttccaagaagtatctataagttgaaatctcttaaagcactcattctttcaggatgtttaaagattgacaagttagaagaggatttggaacaaatggagtctttgacaacccttattgcggataagactgcaataacaagagtgccattttcaatagttagataa

SEQ ID NO: 47818 - DNA, 225 bp, Glycine max
  Peptide Sequence Number=SeqID_164596
atgtgggtgcaagccattgagagaagtgagttatcaagaataggagtcatttcacttaacccgtcaactgaaaaaattcttcaactatttctcgtccttgaaaaattctttttgcgagaatcaaaccgcctctttcattcttccttgctacaaggttttgaaaacaaaacaacgatggatacctcagagccatacactggggcaatgaaaaggcaccaagcataa

SEQ ID NO: 47819 - DNA, 298 bp, Glycine max
  Peptide Sequence Number=SeqID_164597
tatatctgggattgagagtgggaatggaatagattcatcaaattccaatataggcacatccacaggtgcagcaagcagaagcaaaaatgctccaggaaataggactgatattgggtggaagcatgagacagatgttttagggaatggtaaaaaagttaagtacaactactgctcaaagatcaacaatgggggaattttcatattcaagcatcatcttgctgggactagatgggattctgaaccttgtgcttcagtgcttgaagaagttaagatgcttatgatgaacgttgttggctaa

SEQ ID NO: 47820 - DNA, 444 bp, Glycine max
  Peptide Sequence Number=SeqID_164598
atggttcggtaccgaatgcataaggcattacgggccaatgcacctcttccttatccacatttgattactctgtttttgcgtcattttcaaattccggttgatgatgaaccctttgttcaagtcaagcgttcctttgcaattggtgctggtgcagtgacctcctttgggtaccgtaaagatcggaatggtcaatggctgaagaaggatgcactccctcctcaagatgaacgtactccttcacctcctcctcaacgcgaagattccgcactcatgaatgaagtccttaccgaattacgaggtcttcgttcttatgatggtgaacgtttcgactcattggatacgtgctttgccggcatggatattcgcctcacacaagttgaagaagatgtctccttcatccgtacttgctttgacccaccaccactgcctccatcatcctcttag

SEQ ID NO: 47821 - DNA, 465 bp, Glycine max
  Peptide Sequence Number=SeqID_164599
atgacgttgctacttagcagcattctgcccaacgaccgtaatgtcgatctccccctgcggaagtatcagttggggtcgcgcccacaagacacccagtggacccggagaagtccaacagggctctggggtttccaactttggttacgggcctttgtcagtcctacagggtgcccgtaccccccggcaagggatcgcgcccgcaggacaccccgtggacccaaagaagtccaacagggttctggggcttccggctctgattatgggcctctgccagttctacggagtgtctgtcaccccccagcaaggtcatcaggccttctactagccgagctttcatcaagaagtattgcgcccccaggcaggcagagggcgagacaccacaacagcctggggatggccagcaacaggcaacaaatgcaccgccgccacctccagagcccttcagctcatccacagaaaggttag

SEQ ID NO: 47822 - DNA, 780 bp, Glycine max
  Peptide Sequence Number=SeqID_164600
atgagatattttagtgaacaaaaccccggcgccgactataaaggcgtatggccctcggggccgcagttggatgatattaccgccattcagaagctgtacggcgcgaacaccaccacgcgcaccggtgataccacttatggtttcaactcgaatacggatcgagactttttgagcgttaaggcgtccacggacaaaatcgtggcggctatctgggatgccggcggcaacgacacgctggatttttcgggctacagccaagatcagcgcatcaacattaacgaaggctcattctcagatgtgggcggattgaaggcgaatattgccatcgcctatggcgcgcagattgaaaatatcatcggcggcagcggcgccgatatcttagtgggcaacgcactgaacaatacgctcaaaggcggcgcaggcaacgatatcatttacggtgccgacggcgccgatcagctctggggcaatgcaggtgccgacaccttcgtcttcagcacagccgacgacagccaggccgccgcgccggactggatccgtgatttccaaacggcggtggataaaatcgatctgtcgtggctcaaccagacggttaaggccgaggggggcgagttgcacttcgtcgataatttaagcggctcgctgtatgaagcggcgctgaattatgactcgcagcagaatgtcaccgatctggcgatcaatctctccggccataaccagcctgatttcctggttaaaatcgttgggcaggtcgacgcttccgccgatattctcgtctag

SEQ ID NO: 47823 - DNA, 273 bp, Glycine max
  Peptide Sequence Number=SeqID_164601
atgatttcatgcaccagatgcgcgcggaagaggcgcagatcctgcccatccggtgcagaacgtgctcaccggcgatttccgccaggcggcggccaaggccgggcgcggagagtttatgtcgctgtgggccgggcagggcgtgggcctggcgcggccgatgccgggggtggagctggtcgccaccctggcggcggagctggaagcggtgtgacatcgtctgcgcgatttattgctctgacagtgtgggggcagtgcagaaaagcgcaagggtga

SEQ ID NO: 47824 - DNA, 855 bp, Glycine max
  Peptide Sequence Number=SeqID_164602
atggatcctcgtagactttttggtcttcctcgaggtagcttaagtgcaaaggatggccagtctaccagaaatgatggatctatttgctctcaaatgcagtcagattcacctaaggttgcactagcttttcaaaaattaaaaaagatgaagatggctcagtcacaacaatcattatctcattctcaacagcaggagcaattacagcagcagagtaacagaaaaagaaaatctggagctgccaatagcactggtactggtaacactgctgctccgtcccctacttcatcaccatcaacacatacacctggtgatggattaaatacagcaagcagcttacagcatgttaacagtgtccaaaagagcatgatgatgtatggcacagagacaacaggaggccttgcatcatcgtcaaatttgctggacgacatggatcgatttggagatgttgatgctttagatgataatgtcgaatcctttctatcaaatgatggcggagatggtggaaatctctatggaacagtgaaacaaagtccagctgagcaactgaaagaatcttcgaaaggtacctttggtgaagttggttgcataagaacaaggagcagcaaagttacttgtagtcacttttcttcagatggaaagtggttagccagtgctggagatgacatgaaggttgacatctggaacatggacactttacaaatagagagcactcctgcagaacacaaatcaattattacagatgtccgttttagacctaattcatctcagttggcgactgcttcacgtgataagtctatgcggttatgggacacaaccaatattctagcttcttcaggccttgttccctgtgtttga

SEQ ID NO: 47825 - DNA, 258 bp, Glycine max
  Peptide Sequence Number=SeqID_164603
atggaaaagggatatgctgcttctagtgaagttgggcaggttcatttgtggatgaggaagatgctactggttaaggtctttgatattgctttcccgacctcaattggagaaatgtatggtttgcttgggccagcagtgatgcaatcctaccccgcaagggcattggatagaaaacttcaagtagattgggccagagatgcaagagaaggccctagggttcttatgagccttagggtagatttcgggcccatgggctaa

SEQ ID NO: 47826 - DNA, 588 bp, Glycine max
  Peptide Sequence Number=SeqID_164604
atggagaatggttctttggcacaaaatctctcatccaacacacttgattggagtaagagatataacattgctcttggaacggcacgagttttagcatatctgcatgaagaatgcttggagtggatactgcactgtgatataaagcctcaaaacatacttcttgatgctaattatcagcccaaggtagcagattttgggttgtccaagctactaaacagaaataacctcaacaacaatttaaggttttcagtgatcagaggaactcgaggatatatggcaccggagtgggtatacaacacaccaatcacctccaaagtagatgtttactgctatgaaattgttctattggagatgataactgggaaaaacccaacaactggtgtccatagcaatgctggagaagaatcatataatggaaggctggtaacatgggttagagagaaaaggggtgacgcatcttggctagagcacatcattgatcctgccattaaaacaaatttcgatgaatgtaagatggacctcttggctagagtggctttggattgtgttgaggaaactaaagaggatggtctgaattcaaatgaataa

SEQ ID NO: 47827 - DNA, 228 bp, Glycine max
  Peptide Sequence Number=SeqID_164605
atgaagattgttatctctattccactaataaattgtgattttgctggaggagaacattaccgggatagttgttatttctattctataaataaatccaactggagacaggagttggccatgtacaattatcatgagaaaggaagagctaatgatcttgaaagtgtattgacagacttcatgacatatcaagctagcttcaaagattaccaatgggagtcagaatggtaa

SEQ ID NO: 47828 - DNA, 426 bp, Glycine max
  Peptide Sequence Number=SeqID_164606
atggtggtgaagaaaatgaaaaagatacgtggaggaagaaagagagagttgtgctggaagtttttggagaaagagagagaagatttggcttttaaaatgcaaaaagggtccacctttacctttgacttgaccacatacttagccataaaagaagaaaaaaactggaccttttgggatgctaaaatcctgcctcagtttgtgtgccgcctctccggtttcagttcttcgcgtttctctgcacctgtcgggacccgttttcaaaggaagaccagtcagggtcagtgttttgcgagaatgcttcaaccatatgggatcaacataggcttaaaggagcactcaaatcgggtgacccccaaggcctacactccgaagagaccgtcagggcttctccctcctgatttaggtccaacccagaaaacattttag

SEQ ID NO: 47829 - DNA, 216 bp, Glycine max
  Peptide Sequence Number=SeqID_164607
atgactaaatatgacccggaaatagtcattgaattctacactagtgcatggccaatggggcaacattacaggttcagcgagaggaggagccaggctttggggtttgatgaggaggccatcggccagttgctatgcattctgggacaggacttcacacgcagcatgacaggaaggtgggtgcggatcatgcacactagcatgactaccctaacatag

SEQ ID NO: 47830 - DNA, 246 bp, Glycine max
  Peptide Sequence Number=SeqID_164608
atgccagctggtctacgccatcttgaaccagggatcatgcctccaagacacccaatggacccagaaaagtccaacaaagcactaggaaaagtactgcatgccaaggcagacatagcagcatgggcaggtccatcagtagcagctattcgcagatgcagcactgccacctctacaacagctaccatccctagagtccatctctgttcacatgcaatggatgaaactctatatgcagcatgtggctga

SEQ ID NO: 47831 - DNA, 330 bp, Glycine max
  Peptide Sequence Number=SeqID_164609
atgaaggaagcattcacaacggagaatggtcgtgggagtttgactcaaggacactctaaaaccggttctgattccgtgctacgacttattgagtacggtgccgtttttgttctcacaaatcttcgaccaacttcgactgcttccaagagtccaaagcaagcatcaaagcttgttggcaaaaactttggtgacgaaggacaagaaattgtaaccgacacgctcgaagaggtaccacaatgcggtggcataaacgagtactgcaaccgctccactccaattcatccacaacaccacatcaacagagaacacgatgaaaggatgagaaactaa

SEQ ID NO: 47832 - DNA, 219 bp, Glycine max
  Peptide Sequence Number=SeqID_164610
atgaagtttatctcttctgttttattctttgtgcttattctttccattggcattgaaaatgaaggtccattgagagtgatagaggcaagcatttgtgatgtaaaattggatgactattgtgaagaagattgtttcagtgattgtcccaagaagtatggaaagaaagcccaaggtatatgcaatgaagcaagtgagtgcatatgtcgttggcaatgttaa

SEQ ID NO: 47833 - DNA, 225 bp, Glycine max
  Peptide Sequence Number=SeqID_164611
atgatagccataatcccaacaaaggttcctcaacctccattttcccgaggatacaactcgaatgcaacatgtgcttatcatggaggagttccgaggcattccatcaagcattgtatgaccctgaaacataagccctacactagggcaatgagaggcatcgtgcatgagtctcaagcaaacctaggggcagataagaagttctcactcggtaggtcgaaaacctga

SEQ ID NO: 47834 - DNA, 306 bp, Glycine max
  Peptide Sequence Number=SeqID_164612
atgttgctacttagcaacattctgcctagcgaccacgactccgatctccgcttgccaaagtggattgcgcccacaagacacccagtggacccgaagaagtccaacagggtcctgggttatacggagtgcccgtcacccccagcaaggtcatcaggccccctattaacagggctttcatcaagaagtatcgcgcccccaggcaggcatagggcgaggtaccacaacagcctggggacggctagcagcgggcaacagatgcaccgccaccacctccagagtccacctcagctcatctacaaaggctga

SEQ ID NO: 47835 - DNA, 149 bp, Glycine max
  Peptide Sequence Number=SeqID_164613
gttttttcattagcttgaaaggaataagtgtggatgaagaaaatgtaaaggcaattagggaatttcttgtacttaagaatgctaatgaggactctaagccagttgcatactttagtgacatcgctatttgtggccaagggaattcataa

SEQ ID NO: 47836 - DNA, 419 bp, Glycine max
  Peptide Sequence Number=SeqID_164614
atgagcgaggattgcaattctggagccgcgtcgctgttgttgccctccccttcgaattccaaggtcggtcttttccacgctgttcgttcgattcttagtagtgttttcgaatctaaaaatccatcatctcattcgaggtttgtgtttcagattgttggagagaagcgtggaagcactcacaggggtcacagcgctcggaaacgggtcaagatgaaagatcttgacgccgttgttcactccgtggaaacgaatagccgttattcggagtttaaaaacgacaaagaaaacaccgtgcaatggtcgttgggtgctacggatgcttctcaacaagtgacaacgggaaggaatgcgatgccggaagagtttaattttgtggctcggcctctgattctcaacactgaagcgtgcaaaggtggagg

SEQ ID NO: 47837 - DNA, 414 bp, Glycine max
  Peptide Sequence Number=SeqID_164615
atgacatgccggaaattaaaaggaagtgttagtgcgcaattcgtaaagttctgtaacattctggaaggcaaaaaagggatgattatattttcaaccgttcttcgtcgttcgtcattcattcttcgtcgttcttcggtcttcaaccgaccacgtcttttccggtttttccgacattttcctcaaataaacgttggtggcgactccgcgcgtattcctttcttggaagatgcacccgtgagtctcgcgcgtattcctttcttggaaacccttggcgactccgcacgtattcctttcttggaagacctcccgccgaagggcaggttgcgacagtatgaatacatgattttgatgatgccaaagaagaatccaacaaagttgcttcaaaggataaacattgcttcaagattaatataa

SEQ ID NO: 47838 - DNA, 201 bp, Glycine max
  Peptide Sequence Number=SeqID_164616
atggtccatgaagatatagtcttacaacatttggtgtctagtaaagccttaaggtacccgttgaagaagcctgatgctaaactcagattgatcaggtggatgcttcttcttcaagattttgatattgagattagagaaatgagtggtgcaaaaaacgtggtggctgatcatttgagctcaattgagggagctattgtttga

SEQ ID NO: 47839 - DNA, 735 bp, Glycine max
  Peptide Sequence Number=SeqID_164617
atggaggcctttgcagatggctggttccattccggggatctggccgtgaagcacccggacggatacatagaaatcaaagacaggtcgaaggacataataatctccggtggtgaaaacataagcagtgttgaggtagagaatgttctcttctctcatcctgcagtgcttgaggcatcagtggtggcaaggcctgatgagaagtggggtgaatcaccttgtgcgtttgtgacactcaagcctgcaggaatggatggtgctgcttctactaatgagaaaattttggctgaggacatagttaagttctgtaggtccaagatgcctgcttattgggttcctaaatcggttgtgtttggaccgttgcccaagactgctactggcaagacacagaagcagttgctgaggacaaaggcaaaggagatggggcctgctctgcttatgatggaccatgttaaacaagagctacccttggagcatgcattaggaactaaaagctctatcttttccacagcctcacagtcaagaacttggccgatacttgctaaaagtgtagatgatggagaagttgcacctatgcctagcttacagcctcaagatgcagaactagagtcacaaagcagcctctccctccctccctccctccctcccaaattcgtgcaccgcattttgaacggaaattcaaacatagtcctagttattgcttttacgtttagaagcattagagttagtgctagctaa

SEQ ID NO: 47840 - DNA, 222 bp, Glycine max
  Peptide Sequence Number=SeqID_164618
atgcgtcccatagcactacaatgcaacctggtaatcgattaccagaggcctccacaacatgctgccttcatttctaagcctggtaatcgattacaccccttggtaatcgattaccagaaaccctccgagcttcctgacctcgttttcaagcatggtaatcgattacactcccttggtaatcgattaccagagaccatcttagcctcctgtcttcatttttaa

SEQ ID NO: 47841 - DNA, 366 bp, Glycine max
  Peptide Sequence Number=SeqID_164619
atggcaacatgtaatggagcaatcaaaataaattatcattgtggaggaacatatcaccttagttggttgagtgaagttgctaaaatcactcctattatcttttctgatatacttcttcaaggctccgaacgcccattgtcgcaacctacccttcggcgggagggcgacgtgagggctcacgggtgcatcttccaagaagggaaaatgtgcggagtcgccaccaacgtttattcgaggaaaacatcagaaaaaccggaaaaggcgtggtctatgaactttaagtgtgaaaaggatcaggagttgtatttacgcaaggggaaggtattagcactctacgcgtccgtcacaagggacgacaacctttaa

SEQ ID NO: 47842 - DNA, 756 bp, Glycine max
  Peptide Sequence Number=SeqID_164620
atgggcaataaatttatgaacttgggatttaccaattcgaacaacattgtgatcaacggagtgacctctctgaacagccaaatgttccatatagttattgaccgatgcaataatgtgaaactccaaggtatcaaggtatcagctgcaggaaacagccctaacactgatggcattcatgtgcaactctcatcaactgtcaccattctcaactctaacatagcaaccggtgatgattgcatctcaattggtcctggaactactaatttgtggatagaaaacatagcttgtggaccaggtcatggtatcagtgttggaagtttaggcaaggaatttcaagagcctggtgtgcaaaatgtgacagttaaaacaatgacatttactggaactgaaaatggtgtacgaattaagtcttgggggagacctagcaatggatttgcaaggaacatccttttccaacatgctaccatggttaatgttcaaaatcccattgtaattgaccaaaattattgcccccatgagaagaattgtccgggtcaggtttccggggttgaagttagcaatgttatataccaagatatttatggaacctcagcaacagagattgcagttaaaatcaattgtagtccaaagtatccatgcattggaataagtttggaagatgtgatgcttacatatgaaagcaagcaagcagtggcttcatgcaatcatgccggaggaatcacatctggtgtagttcaacccaacaactgtttctag

SEQ ID NO: 47843 - DNA, 285 bp, Glycine max
  Peptide Sequence Number=SeqID_164621
atggatcacgcaattgatgaggtccacgaacagcctgaagaagcaactgttgatgatgaagttgctgatgttgagggttttccaggcgaaccgcatgacacatcagttctgactagttatgttggtcatttgaagttatcctcccatggaaagaaggttcaaaaattcggcaggcttgctctagagattgaaggcttagttgctacctcaagattaagtcctctgtccgcatgttccttggatattggggattggggacttatattggctattgcggagaggtga

SEQ ID NO: 47844 - DNA, 867 bp, Glycine max
  Peptide Sequence Number=SeqID_164622
gtcctcgcctttagagggttgcacttcctcgctttcagaggactacacccccttgactttagagggttgcacgtcctcaccttcacagggttgtacctcctggccttcagaggactacacgtcctcaccttcagaggacttcaagtccttgcattcagaggactgcatgtcctcgccttcagaggtctacacgtgctcgactttagagggctgcacgttctcgccttcataggagggctacacatcctcgcctttagaggactgcacttcctctcttttaaagggctgcacgtcctcgccttcagaaggctgcacgtcctcgcctttagagggatgcatgtcctcaccttcagaaggttgcacgtcctcgccttcagagtactgcacgttctcaccttcagaaggctgcacgtcctcgccttcagagtactgcacgccctcgccttcagaggactacacttcctcacctttagacggctgcacatccttgccttcagagggcttcacgtcctcgcgtttagaaggctagatgtccttgccttcacagagctgtacgtcctcgccatcagagggctacacgtcctcgcctttagaggactacacatcctcgccttcagaggactgcacgtcctcgcctttagagaactgcacgtccttacctttagaggactgcacgtccttgcctttagagggatgcatgtccttcccttcagagggctacatgtcctcaccttcagagggttgtacgtcctcacctttagagggctacacgtgctcgccttcaaagggttgtacgtctttgcatttagagggctggacgccctggcctttagagaactgcatgtcctcgcctttacagggcttcat

SEQ ID NO: 47845 - DNA, 2280 bp, Glycine max
  Peptide Sequence Number=SeqID_164623
atgcacaagtttgcttttctgctttggtttatcagcatgcatgtaattatacatgggaacattgcagctaatgagagttcagatgataagggcataataggagctattttagataagagttctcgcattggccaagagcatgcagtggctatgaagctggcattggaagatttttatcaaaaaagcattcagagtttttctctgcatataagaaactctcaaggggatcctcttttggcagctattgcagctaaagatctcattgataatcaaaaggtgcaagccatcattggaccacagacatgggcagagacatctttagtggctgaaatcagtagccaaaagaggatacctttcctttctctagcagaagcaactccagaatgggcaatgaagaagtggcatttcctgctgcaatcctcacctagccaaataatgcagatgaaagctattgctgaaattgtaaagtcttggaaactctataatattactatgatatatgaagatggagactcatcatccactaaaattttatctcaactctctgaagctcttacagaatttgggacagaattaagcaatgctatagcaatcccacctctagtttcttcttcattgtcccaacaacttgagaaactaagagaaggacaatgtagagtcattattgtccatttatcctttcctttggcactaaacctctttgaaactgcaaaaagaatgaatattatgggggaaggtaatgtatggattactactggttcctttacaagccttgttcattccttgaatgcatccactatctccaatatgcaaggggttattggagtcaagagctatatcccaaaactatttccccagtatgctgacttctaccgtagatttcggaaaaaatttagctcggagaattttgaagagtttaattatgagcctgggatctttgcagccgaagcttatgatgctgcaaggattgtggttgatgcaatgagggaaaccaaccaaatagggggtcaacttttgctagataagattatgcttagtaattttactggcttaagtggaaaaattcagtttactaaacatggaagagctccggcacatacttttaaaatcattaatttgatagggaggagctacagggaaattggtttctggtcagatggacttggtttctcaaaatatttagatgaaaaggcttcttatagttcttcggtgaaggaattaggaaaagttgttaatccaacatgtgccatacgactgagaattggtgtcccttccatgtcaaacgtcaaacagtatgccgaagttattcaagatctttctcaaaatgttccttccttcaacttcaagggattttccatatgtctttttgatgaaatagtaaaaaaattgccataccgtctggaatatgattattttgcctttaatggtacatatgatgagctggtgaagcaagtttatttgaagaactatgatgcagttgttggtgatgtatcgatagtgtccacacgttatgaatatgcttcattcactcagccctatactgaaaccggactgatgatgattgttcctattaaatcaaagacaggggacagattgcatagcaatttatcaagggtggcaatggttgtatggtttttggtggctctaatcatttcacagatttacactgctagccttgccagcatgttgactgttgaacggtctgaaccaactgtagacagcattcagcagctaaagaacaacaatgccattgtaggatgtgatagaggatcctacttgcaaagatatctgcaggatgcattgggcataaatgccaataaaatcaagccatttaactctatggagagccttgcctatgcgctaagaaacaaagaaatagcagctgtcttccttgatgttccgcaggcaaaaattttccttgcaaagcactgcaaagggtttgttcaagcaatgcctacatacaaaattggaggatatggatttgtatttccaaggggatctccattgcttcatagtgtaaaccaagccctattgaacatatctgaaagtggcacactacgtgatctagaaaacagaatgcttgcatcagagaaatgtatagacataattgacccagatgcaaaatatactagtctcagccctaccagcttcatggtgcccttcttcttaactgggggcacttcaacaattgcactcttaatttacatattttcggcgaattatttatgtcatggacagagaacaatgtggggactaatgatggctgtaattaaacgttga

SEQ ID NO: 47846 - DNA, 204 bp, Glycine max
  Peptide Sequence Number=SeqID_164624
atggttcgatttggtgactggcttagacgagtaaaatggcggcgatggatccttagccttggtaatcccttgtatcgaaagtcttcctggtggtgtgtccaggcagcgtgtcccgcaaatggagcggcggtgcaagtaatggctatactcgtggatgacttccgctcgatggggaagctacatgtggaagagactcacacttga

SEQ ID NO: 47847 - DNA, 1164 bp, Glycine max
  Peptide Sequence Number=SeqID_164625
atggccggataccgctattcaactgacggctattacagcatgacagaggtgatggatacctatcgcagtaccacctatagccccttgaacgagcggcagcgcaatcgcgccgaaatttcgttaaaccagaatctaggaccacagttcggttcgttgagtctaaacctgattagtcaggactactggaacagcgacaaacgtatgcaatctatcgggatgggctacggcagcagttgggaaaacatcagttacggtttgaactacagctacaaccgcaacagccgctccggcaacagcagcggagaacgcagagtatacgataaagatcagattgttgcctttaacataaatatcccgtggggaaagagttccagcagcgtctatgccaactatggcctaaacagcagcaaaagcggaggcacatctcactcgatatctcttagcggtaacgcgcttgctgacaaaaaccttagctgggccgtacagcagaattacgccagcaatgctcgcggcaggagtggcagtctgaatagtaactatagaagtacattcggtgaaatcagcgccggatatggctacgcctctgcctctcaaaggtttaactatggggggcatggtggggtgatcgtgcatgaagatggtattactctggggcaatcactgggcgagacagtgggtttggtgaaagcacccggagcaggcggtgttgaggtttataaccagacgggagtgaaaacagaccggcgtggctatgccgttgtaccttatctcactccctaccgttctaatgatattacgctcaacacgtcaactcttgataataatatcgagattccccaagctagtctggccgtagtaccgacccgtggggccctgatacgagctgagtatgtaacacaagttggtcgcagagtactgatgacgttaaaaaaggctgacggaaacccggtgccatttggtgcaacagtaactgtgctaaatgcccctgaggtccagcagggtatcattggcgatggaggtgtagtttttctggcggggttagaagaagttggccaactgcagatcaagtggggagatgcgcagcatacgcagtgccgagcaagctaccaactaccagccaaaagtacgacatcgggcgtattgatgagcgatacgcagtgttga

SEQ ID NO: 47848 - DNA, 739 bp, Glycine max
  Peptide Sequence Number=SeqID_164626
atggtatacgcagctaggcctgtatgtacccctgaaggccaaagaacaccaaatcatacggtgactattagcgaaaagataactgttcccagagatctcccagtgggttctaagataggaaatgaagtaagcttagctataaatgaaaattttaaatgtactataagtggaggcgttactacaggcttgtatatgagaaccaccaccagtgattcaggtatcaaagatggagctttaggcatatataaaacaaacgtagacggtattggttttgctatggggataacttcaagttgtgttagttataagttgtgggtagccggaaatctaagattagttgatttggtctcaacttcacctgttgaagttcaacagtgcactgttaaaacaaaaaatgttacgacaaaaatgggaaacatctttgatagtgatttagtgacagtcggtagtaccagtgaaaataaaaccgtgaatatcgaattagaatgtgatgcaggagctaatgtctggggaatcataagtgctacacaagagacgcagggcagtcagcccggagcgataaaactctccggtgcaggaacagatggtgtcgcagcgggtattgcactgcagttactggataacaataataaagttgtcacggttaacgaaaagaaaaaattggtaacagcggcgaataaaggtgatgtgaaaattaactggaaagcccgttatatccgtactggagaaattaaaccag

SEQ ID NO: 47849 - DNA, 300 bp, Glycine max
  Peptide Sequence Number=SeqID_164627
atggaaatcgtgaatttaggtgttggcgaggaaaagaaagaggtaaaggttggcacgggcatgaccgcaccggttcaagataagttggtggttttgctacaaaactaccaatacatcttcgcttggtcgtaccaagatatgcccggcttgtaccccaatattgtacaacatcggttatcgctgaatcccggttgctccccggtaaagcaaaagctaagaaggatggagcctgaaatgtccttaaagatcaaggaggaggtgaaaaagcagtttgacactggctttttggtcatggcttga

SEQ ID NO: 47850 - DNA, 913 bp, Glycine max
  Peptide Sequence Number=SeqID_164628
gaaaaagaaagcctcaagaggctaacattaacctctcatacttccatgggaaggaaaatgtagaggctaacttagattgggaaataagggtagagcaacaacttaaaaagaagtctacttcaaaatcttatggctctcactcttatccaaagaaagaccaaggtcaaggcatgttaggggtgacaccttctaagcccaaagatgataaggggaagacaatagaaaagcaagcccctaaggctagtatacaagagaaaactagctttataaagtgctttaaatgtcttggaagaggacacattacttctcaatgccccaccacaaaaaccatgattatgaggggccaagacatttatagtagccaagatgagcctactacttcaccttcctctagtgaaagtgaagaagcaaaaggggaagaatctagtgaagaaatctaccccgaagaagatggacaaccattagtgacacttgctagcattgccacacctcttgggcttgagtttattcctcaattaaagaagttgttggatgagggtttggttcgcaagagcttaaatccttgtgctttgttggtgcccaaaataggggttcccacgaaccctaagagaataaaggtcattcctgattggcccactccaccaacaccactcattgagttggtgaggaaccatgttccctcatgggaagattcccaggaaatgggtgttgagggaagaagcccagagtttcaagaacctctggatttgaggtccatgggtgtcgcaacctacccttcggcgggagggcgacgcgagactcgcgggatgcgtgttccacgaaaggaatacgcgcggagtcgccaccaacgtttatttggggaaaacgtcggaaaaaccggaaaagacgagatctacgaactttttagtgaaag

SEQ ID NO: 47851 - DNA, 555 bp, Glycine max
  Peptide Sequence Number=SeqID_164629
atggattttgttatgcataattggtatttcaataaactcacttccttgatggttgaaaacattcttcctgaatatgaggttactggatttaatggtaaggagtggaggaaaaggcaaataagaaagataacagatcgagtttttgaccgagtaaagaatccagcacaaaataatttgagatttggagatctgtatattgctattttacttgtgtacaatgatatcaacaagtatattcccggcccccattttgatcctccgtcaaaagacagaataaaacaagtcatcacgttctgtgatgacaacgaggatggccaaattaaccgtgacgaattttttggtttcttcgagcaaatggcacccgaaacattcaatgttgttcgaagaaaacttgttgccactttggttgcaacaccaacagttgctgcagtaacaaagaaagctactgaacgagtcccagttgttgggaaactggtgcaatggttacccaaagcagtttatgctttccttatgacaattgcagctgtgttgtaccaagaggattctgcacactag

SEQ ID NO: 47852 - DNA, 171 bp, Glycine max
  Peptide Sequence Number=SeqID_164630
atgactatccacactgtccctttgtgtagtgatcaagtgaaggtcggtgttgaggaagttcgagatgctgatgcttgtgttcctatactcactaaagagggacttgagggacctccaaaacctgtagataggtcggatcccctatacctaatgacattgaccattccatag

SEQ ID NO: 47853 - DNA, 597 bp, Glycine max
  Peptide Sequence Number=SeqID_164631
atggtgcccaggctccctgtgtggagagcatcaggagcctcaccctcccctccaacaagggaagtttggactccgggtcagaccacccgctccaagaaagccttaagggtcatgaccagctctgttgggataggtggtggaggctctaggccaacatgcactacccgtgatgaatgctctacaacaaagggacgatctggtttggtgaagtggaggagaaagaagataatgatggccttgtgggtccccgaaaaagtgatagatggttcagtgaggagtactcaaggtaacgctgccccacctaaagaactacaggggtttccaggaaggaattcagtgtgtgaggagccgatgccagtggcggcactcaagctcatggagaaacttgttatagtgcgagtaggccagctcaacgttcctctctgggcgagaggtaacaacaaaaaaggaaatgaagaagctaaagaagaacaaggatgcttaaaaatcctcagaagagatatgaaggaaaagaaagaaatgagagtaaaggggagagttaggcaaaagaaaggggcagttgtcgaaactgcctgcagttatggattatgtgcttag

SEQ ID NO: 47854 - DNA, 636 bp, Glycine max
  Peptide Sequence Number=SeqID_164632
atgaaaaatgacatatacctacgcaggcttttgcctacccacatgaattattgtagaggtggagtctcactcctagacagacctagcaacaactcaagctccgtcctcgtgaagatctctcgctcctccatcgtcacccgcagcaaggaagccgccggtgacgccgcattcgttgccaagaagctcctccgcagcaccggcaaggccacctttgctgttcgaatacctgaagcggaaattccgaacttgataaagacccttcggggattcaatgatacaaaaattgaattcaagctggcaaatgttcagaaaatatggcaaagattcttgtatcgtgattctgttttgcttgaagctgaaaggcgaaaaactgctattggacatgttgatgattgggctgttgaattcttaaagctgacagaggatgatgcctttgccactttaatacagtattccaccccgacaggcgccccccgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 47855 - DNA, 912 bp, Glycine max
  Peptide Sequence Number=SeqID_164633
atgaagcacgaatctttatttgagggtttgttgcaaatatggggagaatatctgccatcaagcaagagcttagagtttctggatgaaataccagcaactcagaatattgctcctgggaaggtgccacctgtggctatcatcatctctcatcagaatcttagaggtgatgtaagttcaatttccagactcaaagctttgaagtggcttgacctttcaaatactgattttcatggactgattcctcctacttttggaaatttattttatctcgaatatctagacttgtcttcaaacaagtttgaaggttcaattcctcccaaattgggtgctctaaggagcctcaaaacattgaacctttccaataacttgctggtgggagagataccaaaggaacttcagggccttgagagtttacaggattttcaaatattcaacaatcacttgagcggtttgataccatcttgggtagggaattggaccaatctgagagtttttgctgcttatgagaataatttcgatggaagggttccaagtaaacttggatttatttatgagcttaaaacacttaacttgcattcaaaccaccttgaaggccctataccgggaagaatttttacttcagggaagctagaagttttgatcctcactcagaacaatttaagttgtgaccttccggttgaaattgggaattgtcaaacccttttcagtgttcgaattggcaacaataatctagaagctcttctcattcatcatcagtatctacccgatgaacattggctcaacttctttatgaatctacaatgctacctagaattcagcctgactggcctgctagactatcacaatgataaatcaaaagttcaatcaccaataggttttgagagcagcatgtacatacacacttgtgcatga

SEQ ID NO: 47856 - DNA, 660 bp, Glycine max
  Peptide Sequence Number=SeqID_164634
atggttaacgaattggggatgagaactttactgaggcttggaggggttgacggggacccggtgctgagaggaacgaggagaagggctacgggtcaggagaccttggggacgttaggtggggtcctatcgcccaaaactaagcttggccaatcccgacccaatccgggcatagtcagccagctccaatgtgcaatggctgttgtaatttgtttttgggcactgatcgcgatggcagcacagttgattcatgatcgtgtcgtgatggagtgcctagagggtgtttgggagaccctcgaaggcaatgagaggtgccgattccgtggcatagttcaactcactactacttcgctagtacatcctgagaaacccgcacgcacacttcagcagcctgtggagtggatactacctacgcctactccatatcgactagttgagcctgttcaattgatagaggtgtcaccctctgaagaggatcttgaagaggacccagaggagttacctcctgaaccagctatggatgcccctgacttaccagaggatgatgaggactcactccctgatgttgattctccagaggatattacgtcagcatctgaggcagactctacagaggagagtggccctggagggacagcgaatagtgacgacccttcatcatag

SEQ ID NO: 47857 - DNA, 524 bp, Glycine max
  Peptide Sequence Number=SeqID_164635
gatatatcctttgtggtacaagtagagggtacatctacttgggttgttgtaactgagaacaagagaggatacatctcttttggatcagttcaagtggagggtacatccacttggttgttcaaagagaacaagggagggtacatcccttgtagatctttgcttgtaaaggtttttacaaggttgaaaagaaatctcaaggaccgcaggctacttgatccaacattggcagctagagatctcattgaaaatcaaaaggtgcaagccaccattggaccacaaacatgggcagaggcatctttagttgctgaagtttgtacccaaaagagcatacttttccttgttagttttttttcacgtcaccgaatccactcctcctttcatatactaacaccatcaagtacgagtgagcaaggatttgcaaccacaatcagttacaaagttgccgtggagcaaaaccgcatgttgccgtggagcaaaaccgccacccccatgaacgttcataacaacaatagcaatggctggag

SEQ ID NO: 47858 - DNA, 467 bp, Glycine max
  Peptide Sequence Number=SeqID_164636
atggcggaatgcgcaataaattgcgccgctaccccccgtgcggttatcagcggcatcacatggcaggaatatcagtcaaccgtgcggttatcagcggcatcgcatgaaaggaatatctgcgcgatacgtcacgccatcatgattcattgcggatgggatatctgcattatcccgtcgcacaaaccggataatcggggtaagcgcttagcgcttcttctccagcacgcgataaatcacgctggaaagctcgttgatttcaaacttagcgacgtaaccgtcagcgcccactttgcgcacgtgatcttcgttggcgctgccggacagcgaagagtgaatcaccaccggaatctgccgcagcgcgtcgtcgcgcttgatgttgcgcgtcagggtaaagccgtccatctccggcatttcgaggtcggtcagcaccagcgggattttgtcgtgaatcgactcgccgttagcct

SEQ ID NO: 47859 - DNA, 196 bp, Glycine max
  Peptide Sequence Number=SeqID_164637
atggcgcgatttctcgcgcagatatccctttcatgtgatgccgctgataaccgcacgagtggtagcggcgcaatttattgcgcattccgccgcggtgcggggattgaaatgcgcgatgaatcgcgccgctacggtttgtgcgacaggataatgcagatattccttccatgtgatgccgctgataaccgcacgggtg

SEQ ID NO: 47860 - DNA, 693 bp, Glycine max
  Peptide Sequence Number=SeqID_164638
atgggcatagatgcaacagttttaatgtgtctaagagatattaggcataataaatttgaggactccttaattggaacagtcgaaaccagtttaggacaagctccagtatatttcaattgttatccgaataagacagtgagtttaatggacaagaatattcttgactctctgttcttaaatatcaactttcatggccttgacatgaaagaaggatcaatcccagcagctttgatctataggatccagtacaaggtcatgaatacttgtgcatctagagtcctattgcaaccacaaaagggagaaacgaccttatttatcactgatataacaaaagccaatgtttctttaaaaagaataataaaacaggatgatgtaactctccccgaaaaatgggacatggagaaggccacaccgtctgatccccgacccactccaattattgaaaaaatcaaacaagacaattcaggaaaggtagaaataaccttcaatagaagaaattcacatgaatggaacatagatgcacaaatggagtataacatcgtgaatgcacaccaacatatgatcatggtagctacagcctaccaaacctcccatgaatgttcgaaagaaaccattataggcattttagtggaaggattttccggacaattgaaaggatggtgggataattatctcacgaatgaagaaaaataa

SEQ ID NO: 47861 - DNA, 758 bp, Glycine max
  Peptide Sequence Number=SeqID_164639
atgggtaaagtagaggaggtgcaagagcagatgaaggccgacatggaggccatgaaagagcaaatggccacaatgatggaggccatgatgagcatgaagaagataatggaagccaatgcggttgcagttgtcgctaccagcgctgttgctaaggtgaacccgatgcccccatctggcctcaagcaagtgaatcatccaacctcagatatggatgtcaataactctgctcccatactcattgaaagccaacaacctcaatctgatcatgcacatgtctctcaacccatgggggagacacatgaaatgccccaccacaatctagccgacttcgagccttgcctcggatatgccactgaaggtatcacccacaaccacacccccttgcattccacaccgggtaaaaaccctcatgctatggcagaaatgggaaagttggatcatctaaaggaaaggctcagggccattgaaggaggtgaagattatgcctttgctaacctagaagagttgttcttagtacccaatatcatcacccctcccaagttcaaggtgccggactttgacaagtacaaggggactacttgccctaagaaccatctaaagatgtgttgtcgaaagatgggggcatacgcaaaagatgaggaattgttgatacatttcttccaagaaagtcttactggagtagctgctacttggtacactaacttggaaccttcccgagtccattcttggaaggacctaatggttgccttcgttaggca

SEQ ID NO: 47862 - DNA, 159 bp, Glycine max
  Peptide Sequence Number=SeqID_164640
atggcggaggtgtttggttatggtggcaaagaacacgtagtgacgcggacggagctacagggacaaggggtcacacagtgttgtagcggggcggtggtggctaggccaaggggtcgcacgtgcagatctaaagtgaagaacaacatgcgacgttgttag

SEQ ID NO: 47863 - DNA, 627 bp, Glycine max
  Peptide Sequence Number=SeqID_164641
atgttagtagagaaagcagagagaaaaagagttgctcgtggtgccgccgtctgttgttcgccgcaaacggagcggcgtgtgtctcacggcacggtggtaaaagccctcccggccaacgacgacatctacagcggaagcctctccggcaacgccccacacaagagcgacaagtacctctggtctgacgagtgcatgtacgagggagaatggacgaaaggcaaagtgtgcgacaagggtcagttctcgtgtccctctggcaccatctacgtgagtgagtttgcctctgggagaatgcacgaccacgacaccttcgttggcattgatggcgacacataccgcggcgggtgggtctccaacaaaaagaatggctttgacgaaaaacacaaaggcaacgatgatgaaggggaaatgaggtacacatggtgcaacgagaatgaatacgttggggaatggaaggtggtgctgtttctcggaagagcgtgttggtttggaagaatcgaacgggaaccgttacgaggggtgtttgggagaacggggttccgaaggggaaatgggtgggtgtttacttggcgcgatgggagcttgatggtgaagctcggtacattacttgtgatttatggtggttga

SEQ ID NO: 47864 - DNA, 270 bp, Glycine max
  Peptide Sequence Number=SeqID_164642
atgaggtcaaaaaaagaaacgctacgagagagaaaggaggagggaagcacccatggtggcgacggcgctgatccgaggacggggagtgagcggagaggcggaatggaggcggtggctccaccgcggaacggagcagaggagggaacgagcggtggcggagaaggaagaagtgcagggagtgaaagaagcgaagtttctagaaggagagggaaagaagagtttaggcggaatggaggccgttgttatataaaatattggccagaaaattaa

SEQ ID NO: 47865 - DNA, 201 bp, Glycine max
  Peptide Sequence Number=SeqID_164643
atgaaggatttcccctctattgttgtttcgggggacaattttagctccatgaactgtgacaacaacattaagatccgctccaacaacgacggtgcagtcgacgacactgaagtttgggcaatagagaacgggcttgggtttactagatggggatatggtgagatcattgattgtggttcgattatgtgttgctttgtgtga

SEQ ID NO: 47866 - DNA, 396 bp, Glycine max
  Peptide Sequence Number=SeqID_164644
atgtccttcgggtatgtctggactttgaatctccatcccacaccaagcatcactggttcacagtttgtagcaatccttccactggttgtggctcacacaatgggaaacctcttgaccaacattagtcttggcaagttgtgggaaattgaagattttgagcgcaagaatggttgttcctgtgtttgcctcaactattgtggttatataacccaaaggttcatagtaaatactagtcaatctagcataataatatcaaataccttgaatgatgtgaatatcaggaagaccttcccaaacttggatgctttttctgcattcgtgtttgtcttaaaccctcataccactaagaaatgcactggttcaagcagtatggcacgagaaacacaggaaatttaa

SEQ ID NO: 47867 - DNA, 795 bp, Glycine max
  Peptide Sequence Number=SeqID_164645
atggaaatgctcaaagttagagagcaagaatctgattcctctcaacaaatcgaggaggactggagaagacatagaagtgacacgaaaaacattttctacaacagcgaaacgacaacgggtttccaaaatggagcagccgtgccggttcctacttccacccagcccaaccggttctacgtccactccgccacctctcacggcgccatgaacaacgttcgcaaggacctcatccacgactttccccagaaaaccatcttcgacttcttcaacgagaatgacctctctttcgacgtctactaccagaacatgcttgccacgctcttctttaagtgtctgcacaagctcaagaatgcggtaaagctccatgactacgccttgaagttcaagaagcacgccctaaaggggaagctgctgaactatgttgtggtggagcagaggtactttgatgtggaggtttttccgacgaatgatgaccacccctcacaagacgtggcggtcgagcaaatgttcgtgaaggaggtgtatgaggttttgaggaagagtctgcagtgggaggagatggcggtgttgattacgtacgatgagcatggtggattttatgatcatgtgacgacatcggtggaaggggtgcctaacgccgatgggatcattgggccccgcccttattactttcggtttgataggttgggggtaagggtgcccacatttattatctcgccttggatcgacaagggtactggtatgtgctctaaagtttcctgctttttcatgttgtgttggttaactgagatttga

SEQ ID NO: 47868 - DNA, 225 bp, Glycine max
  Peptide Sequence Number=SeqID_164646
atggggacgggaaaagttaagagtgggatggttaaaacttcaagaaagcttagaattgaaatggcgaatttctcttctacggtggtgatgttgagctgcaatttctgcaagatcgctgagaagaataagatctgcaagcgcaaagacaatttctacaaaaagatcgtcttggacggattgttaaccctcggatatgatgcttcaatttgcaaatcttgcttgtaa

SEQ ID NO: 47869 - DNA, 243 bp, Glycine max
  Peptide Sequence Number=SeqID_164647
atggtctcggacacggaaactttccgtacactccagacatctctcaaagatcccaacggtcagatcgtggacaaatgtcttgtgaagctgcagacacaatttcgagaagagacaatggttaacgaaggctgcacagcatttttaccgaggcagcttcatgtagcttcctcaagaagcttcattaagaggcttcctcatggcttctttgagaagttttctcaagaggcttctttgagaagctag

SEQ ID NO: 47870 - DNA, 444 bp, Glycine max
  Peptide Sequence Number=SeqID_164648
atggagtattttgcactctttggacactcattgggtgcaagttatgatggggaaatacacgagggggaatctattttatctaatcccttaaaaccatactcttcatataattggagaagtattcttaaagctcgtgatgctctaggagatgagtttaaggcccagttgggagatggaaaaatttggcgtgctcatctaccagaaaaacttcattattttatgtggcaaatctgtcaaactgcatttccaactaataataagagggtttcttgtaaattggcgcaatctatagcttgtcctaggtgcttcttagtggatgaaacaacgctgcacgtgctaagggattgtcctcatcggcgagaattatggaatctgttaggaattctaattcctcctattattattatcacttatgttaaggagtgggttgctaatattatgtag

SEQ ID NO: 47871 - DNA, 663 bp, Glycine max
  Peptide Sequence Number=SeqID_164649
atgaccatcactactgccgccgtcgttgccagcgacagtggcgacaacaacagtggcgatcatgttggtggcaatgatgatagttacggtagtggcagcgacaacaacagcgatagtggtggtgacaacaatggtcatgacggtgataacgatggtggtgagagcaacaacaacgacggtcatggttccttgttgaaccaatctcagacttatcaaggtaatccttgtggcgtctaccctgacttatcttccctctctggaagtggcatcatccaaaactctgtaacctatatcaagcgatccgctcctacaaataggagagataaaacaggaaatagatatggcttcgttaggttcatgggtgttcaagatgctaaggccatagagaaacaacttgacatatgtattggaaatgtaaagatgaatgtgaatcggccaaatgacacatgcgcaacacaacatgaacttggttgggggaaagtagctatgcacaagtggtggcaatgcctcgcaatgaaccagttcgagtgtggtaggagaaaaatagaggtctcaataaggaagagggtgaatgagcttttcatttcagatgtggctagaaatgtcaagctaaaatacgcaggagatgatattgtacttatagaagggattatggaggattga

SEQ ID NO: 47872 - DNA, 246 bp, Glycine max
  Peptide Sequence Number=SeqID_164650
atggagctatgtcaccttgtatccctcaatgatctgaaattggttgacttgaagtctcatgattgtcacttcttaatacaacagctattacctatagcgattcatggtatcttgcatgaaaaagttagggttgcgataactcgtttgtgctttgtttttaatgctatctgtagcaatgtcatcgaccctcgacaattggatgatttggagattgagtctgccattgtccttttgtcaattggagat

SEQ ID NO: 47873 - DNA, 152 bp, Glycine max
  Peptide Sequence Number=SeqID_164651
atgaccactagtggccaccatgagcagccattgattaccactgaaccaccacttggagaagaacattttaatcagatcggaatcctcaaaatccacctcaaggattcggttgagaataagctatcgatcctttctttcatagcctctctgag

SEQ ID NO: 47874 - DNA, 468 bp, Glycine max
  Peptide Sequence Number=SeqID_164652
atgatgtgtgtaagagaagaagagaagagaaacaggagcagaataaccctcaaactccgtttcactctgagagaaagtgctgcagaaaacacacccaaacagagagaggaagaggaaaaaaacacacacccttcatctgagcctgaatttgtatcattgagaattttcaaaaaggattgtctcttcagagacacagatcttgaggttggagtcaaatccttcacactttggtatggagacagaagagaggaaccagaaagggtgcaaggcttcggagccagagtttttcttgcagtgggggaacaggaagaggctgagatgtgtgagggtgaaggaccctcggatttcagcgagactcaacggtggaatcagaaggaaacttggttctgcactggatcatcatcgctctgggttcactgtgcccgagaaagaaatctctcatcaccaccaccaccatcaacaacctaa

SEQ ID NO: 47875 - DNA, 549 bp, Glycine max
  Peptide Sequence Number=SeqID_164653
atggaagggtattatggccatttgggtgacgaaagggtaagaccctcgtcaatggcgtcaccatgctcttcatgtggtgtttctttgaggcaaatcgctaaccttcatggttgtggaaatcccaacccccaaggttgtaaacctgtttggttctcggaggttgtggttgaaaaacctcgttgtcccctgaagctcgtcgttggggatgtcgttcccatgaaaagaagttctttgtcgtacaccttggagcccagaagtcacatcatgtgtttgtgtaacgtagaggctccattggtgacatcgtggactgaggataatccagggagacgtttttatggttgtggtctatataaggttataggtagaaaatggtgtaactattatgagtggcatgatccacttgcgaacagttgtgaggagaggatcattgtaacattgatgaagaatgttgatgaattgaagttcagggaaaaagatttgcgaaccaagatcaatgacatgaagatgaagggaaattttttaggaattagattggttttttcttggtag

SEQ ID NO: 47876 - DNA, 663 bp, Glycine max
  Peptide Sequence Number=SeqID_164654
atggagaatttgggcttccattttagtcaaactcatagtcacctagtttatgaacgaggggaggtgtggaaggtttgttactttgtgcccgtgaggatcacgatagaaggagctgccttttgtttgcaggtgctggttgaaggggaggctcgtgttgaaggtggcatggaggctaagattcaagttgatgaacaaggtttgatggaggttcaagtgcagggtcaagatgaggctggggttgtaggtgagatggaggttgttgttgaggatgtggtggagaatgatgttgaggctggttgcacaatgtctttattaatgcacactcctgacatgaagctaaagaccttaattgcttatgctgtagaaaaatgggaaatcaggttgactatggatcagacatacagagcaaagctgatttatatggtattcaagaaagatgttgggcatttaatttctactattattcaatttattcactgttattttcaagagttggttgagggtaattggaaaaagaagtatctaggagcacatataaaagagttgatgtggatggcagctcgagcaacaactatccctgattgggagaaggccatgaatcaaattaagacttatgatgtagaaggttggaaggatttggaaaagttaaaccatgttgcttag

SEQ ID NO: 47877 - DNA, 408 bp, Glycine max
  misc_feature (238)..(238): n is a, c, g, or t
  Peptide Sequence Number=SeqID_164655
atgacagtcaggctgagggataacagtaactgcgacattctaatgactgtttgggaggactatgctattcagctacataatgctattgacaaaaaccttctgcttcaggaaccattggttgttatgttgaccctaggtaaaatcaaggatgctacagatatgatattttctttccgagacatggctacaacacagataataaagaccaccgggaatgacaaaaagaaagacaaatacngagaaaatagaaagcacattcaagcaggagcaaatagtgggaacaataccaacatcgaaaacctttttgtttttgcaaaaaacagtgacaaacaggagcaaataaggggaacaataccaacatcgaaaacctttatcttcagaataaaacaacaaagaacagggaaatag

SEQ ID NO: 47878 - DNA, 321 bp, Glycine max
  Peptide Sequence Number=SeqID_164656
atgaaaaggaatgaaaatacaaaagaaaaagctcagacagcaggaagcaaaacaaaaacccatgaacaaaaaccgaaaccgaataagaaagcaagcccaaaggagagaaagagtgaacggagtgaggacgacaatagaagagaagaaaaaatgggaaaaaaacccaggagagctggaggtacggagtgggaatggcaaaacaatgacaatatgggaaaagaagaaatggaaaaaaaacccaataggatagctgtaggtacgggcaaaaaaatggaaagcggaaaagcgaagaagcaaaaacgggcaggacacgtgggctga

SEQ ID NO: 47879 - DNA, 644 bp, Glycine max
  Peptide Sequence Number=SeqID_164657
ggacttgcactgcctccggagcctgaggttggtccctcagctgctcgtgttagcacaaaaggaagttgtgtcgatcccttattgaccgatccagagacgggtgactcagacaaatgcaggttgtacatcaaagcaaatccttcccacctagttgccctattaagagtttatgagggatccacaactgttcacaatgtccctttgttgcatggccaagtgaagattggtgttgaggaggttaaagatgcaaaggctcgtgttcctgtacccactgataagccttcagataggccagatcctgaggttgatgatcccctgtatctgatgacattgaccatcctacagcttttcttgaagcctctccaggttatgtgggatgttactgtgttcggggtgtttaatctagacttcccattgtacatcaagcacaaagatctctccgaaattgcacacggtgatcaatgtctcagcatatctgcatctgacagagacaagtatgcgagcagggattctgatgtatatggattcctcgagccacagtccattcagagatctgggcaatcgcagtttgaatcggaaagttacatgaagagttggatgcagagttcaaaacgcgatgtctaccttggagcctacctgaatgc

SEQ ID NO: 47880 - DNA, 237 bp, Glycine max
  Peptide Sequence Number=SeqID_164658
atggcacgcagcgtgtttgcttcgtgcccctatttaagggacctacaagggagagaactaactaggcttttagcaataatccccaaggtagttatatctctcttgatggcttctagagtccccagtggagtcgccaactgtcgcaacctacccttcggcgggagggcgacgcgagactcgcgggatgcgtgttccatgaaaggaatacgcgcggagtcgccaccaaagtttatttga

SEQ ID NO: 47881 - DNA, 309 bp, Glycine max
  Peptide Sequence Number=SeqID_164659
atgtaccctcccttgttctctttgaacaacctagtggatgtaccctccactagaattgatccacaagaaatgtaccctctcttgttctcagtcacaacaacccaagtagatgtaccctctacttgtaccacaaaggatgtaccgtccaatgtgttaagacaaagttctcaggagggaagaatcaaaagaattctcagaccgtgtcgttttgaattctttgacaagggagaagggaggcacaaaagaattcaggcggttagtcctttgttcttttggaaaagggagaagagagacacaaaaagaatttag

SEQ ID NO: 47882 - DNA, 255 bp, Glycine max
  Peptide Sequence Number=SeqID_164660
atggcaatatcaaggaaacaacacatagcatgtttgcttcgtgcccctatttcaggaacctattgggaggaactaaaagattgctatttaatgataattcccaaagtggttgcacataaatttcaaaggtttctagagatatcatcccctttgatatcaaacattgtggcagtagggactaccagcgacaacgtatcatcaaagagaaaaactctagatgaggtttcactgtcatcaagcaagtcggtgacttag

SEQ ID NO: 47883 - DNA, 705 bp, Glycine max
  Peptide Sequence Number=SeqID_164661
atgaaaaggaccgttgtcaaaaatcaccatggcagcggagggcatgatttgcgacattggctggaaggtcctacgtgttgccgacaactacaaagttaccggcgagaggatagtgcggagggtttcatagatgcagatctgaaaattattcatcattgttgtcctcttcttcctccgatgaacccaacacaaagaaacacttctttcctcttcatcttcgttgcattgtcacgtagactatccaacgtggcactaaagtatgaccatgaccacccagccccacttttatttccatttctcagcaaacttcaaagccttcttcacttccctctgtcgcgtccgcttcagcctctcgccatccacaaacacaacgttttggagtggcccagcgtcggctgcgacgatctcggtgattggtatcttccaccgaccccaagagggtcctccaaaacaccagattcgggttcaggtcaagttttccagttcaagaaagagtattacgcgttctacgacatggaatgtttgaggatcatggagcacgtgtacctggggagtgacacagtggcgaagagcgtcgagcttttgcggcggtgccgacgacctttctctttctctttctctttttcgatttcgcttaaaaatccattttttattttctgtgcatggctttttctgaaattaatttatacgcagatgaataattga

SEQ ID NO: 47884 - DNA, 528 bp, Glycine max
  Peptide Sequence Number=SeqID_164662
atgctcaatcctgctttcacattattgtcacctgaatttctgtattcattgcaaacatcaggtatacctaatcataaattaaaacttaaggtcggaactccaatcatgctaatacgaaatcttgaccagactgatggcctgtgcaatggaactaggctcattatcaccaaacttggatctaatgtgattgaggctgaagtagttactgggcctaatataggaaataggacatacatacccagaataaatatgtctccttctgaatctccatggccattcaaacttatcaggaggcagtttccattcatagtttcttatgttatgactataaacaagtctcagggacaatcattacaccacataggactgtatttaccacacccagtttttagtcatggccaactatatgttgcactttcaagggttaaaagcaaagatggacttcatattctcatacatgacaatgaccgtaatccaaaaaatattaccactaatgttgttaacaacgaagtctttgccaatttataa

SEQ ID NO: 47885 - DNA, 2427 bp, Glycine max
  Peptide Sequence Number=SeqID_164663
atggaagagactaaacagcgtgttgctcttcaagagagattgaggatggtgtcttctgaaattgttgaaaaaggtcaaagcagtgaaagcaacaagcaaattctgaggtcaacccttaaggataacgctgctgtggtgcaagagatcaagcaatacaacgagcacttgaatccacccagagaagaaatcaacaccctttttggagaaaaagaaaatgcagatgaagaatttgtttgtaaatggttctccaagtggtgtctatctttgtttctgtgcagatttgggcagaagagggatgattcatttgctggtggtgctgagaagcaaggtcttgtggcaaaagatattgaagagaaactttacaaaatgagagaaattcttgagcttctgagcaaaaggagttttgagaagaatcttggtggttttggaacacctttgaagtttccttttggtgttccagaaaacccaaaattcactgttgggttggatgaaccgttgagtaagttgaagattgaggttcttagagatggagtgtcagttgttctgctcactggtttgggtggaatggggaaaaccactttggctactaagctatgctgggatgaacaagttaaggatgacgtcatcatggctcatcaatcttttataacttcttcacatctgaagattattgtggagagattatttgaacactgtggatgtcaagtacctgattttcaaagtgatgaagatgcagctaatcaattgggacttttgctgaggcaaattggtagaagttcaatgttgttggttgtggatgatgtttggcctggctcagaagcccttgtccagaaatttaaagtccagataccagattataaaatattggtgacttctagggttgcatttcctagttttggcacccagtgtatattaaaaccccttgttcatgaagatgcagtaacccttttccgtcattgtgccctcttagaagaaagcaattcaagcattcctgatgaagaacttgtacaaaaggttgttagaatctgcaagggtttaccacttgccatcaaagtaattgggagatcactcagtcatcagccttctgagttgtggctaaggatggtggaggaattgtcacagcattctatacttgattctaatactgaactgcttacatgcctccaaaagatcttgaatgttttggaagatgatcctgccatcaaggagtgcttcatggacctagggttatttcctgaagaccaaagaatttctgttaccactctcattgatatgtgggcagagtcgtgtagtctagatgacaatggtacagaggcaatggccatcatcaaaaaattagactccatgaatctggctaatgtcttggtagcaaggaaaaatgctagtgacacagacaattactactacagtaaccacttcatcatccttcatgaccttctgagagagcttgcaatttatcaaagcactcaagaaccagcggaagagagaaaaagattgattattgagataaatcaaaataaacctcattggtggcttggggagaagtcaaaattgcttaagccccaacaggccactgcccaaacattgtctatatcaactgatgaaaattgctgttcagattggccccaaatacaactagctcaagttgaggttctgatttttaatcttcgaactaaacagtattcctttccagatttcatggaagaaatgaacaaacttaaagttctgattgtcacaaattacagtttctatccttctgaaataaacaactttgagctacttggctctttatccaaccttaaaagaatcagactagagcggatttctgtcccttcctttgttgcaatgaagaatcttaaaaagttatccctctacctgtgtaatataaaacaggcttttgaaaacaatgacatgctaatttcatacatttttccaaatcttgaagagttgaatattgactatagcaaagatatggtgggattgcctaaggggctctgtgatatcatctccctaaagaagctcagtattactaattgccacaaactctctgcactgccgcgagaatttgggaagttggagaatttggaactcctaaggctgaattcctgtactgatttggaagggttaccagattctattggaaggctttcaaatctacgacttcttgacatctcaaattgcataagccttcctaatttaccagaggactttggtaatctgtttaacctacaaaatctctacatgacaagttgtgcgaggtgtgaattgccaccctcaatcgccaatcttgagaatttaaaggaggtggtatgtgatgaagagacggctgcatcatgggaagatttcaaacctatgcttcccaatctaaagatagatgttcctcaagttgatgttaacttgaattggcttcatacaatttcctcctaa

SEQ ID NO: 47886 - DNA, 453 bp, Glycine max
  Peptide Sequence Number=SeqID_164664
atgccacctacctggcaccctctagacccagataagtctaatagggccctagggtttccagcattgatcacgggtctctgcccgtcattcggggttcctgttacacctagtaaggtgattcgaccgccgatcactcgggccttcattgagaagtattgcactcctagacaggcacagggtgatgcaccacaggtcgcagatgcactgccaccacctcatcaggctgatccagctgggtcatttggcatggagcggtatttacaacacttggttcgccagcaggcggccaaccacatggggcagttcagggatgaggtcgcatggctcggagattggcctgaggcccaggcaggggaggcgcctgccgaagctccgagcgatgcagaggaggcccgcatggatgaggagatgacagatttgctcggtttcttgggagggagcggagccacatga

SEQ ID NO: 47887 - DNA, 330 bp, Glycine max
  Peptide Sequence Number=SeqID_164665
atggcgatgaggcgtagtgacgaggttgatggtggttgtcgtccgcacaccgaccaaggaaaggaggtgtggcggtgcaaggatgaagaagatgaattggcttggtggtggtggaaggataaagaagataaattgggtgaggcaacgaggccagggttggattgtgaaagaggaggagaagagggaggcgttgttggggacgctattggtggtgatgacaatggcgactgtggtagagagtggagattcttgaagaagaattgggttgcgactatggtgatacaggtgggtttgacgagaggggagagaagagggtcgattgagatgtga

SEQ ID NO: 47888 - DNA, 525 bp, Glycine max
  Peptide Sequence Number=SeqID_164666
atggtggatgatgcatatggatggctccttcaacaggcacaggagcaaagttgggttcatcttggaaggacacaatggtgtggccatggcacaatccttatgtttcaaattcaagccatatgcaatcaggttgaatacgaggcactctttgtaggtctaaggctcaccaaagagaatcttaggggagaaattgaggaagtgcaagtgactcacataagtaaagaggtcagtgataaggctgacgagttggcttggttggctaccttcgctaagccaggacaacttaaaaccttcattattcatgcagtgcctaaacccagcgtctctagaaaagaatgtttacaagtggaagaaacccccctacggtggagaaaggagatactcgactacttgaagcatgagatactcccagccgataaaagccatgctagaaagataagaacactagccgccaggtacaccctagtgatcgaaaaactgtatatcagaggtttctcctcacctctgctcaagtgccttgactga

SEQ ID NO: 47889 - DNA, 198 bp, Glycine max
  Peptide Sequence Number=SeqID_164667
atgaggctgaagggtgtgtttggtttggatgttccaagtgttagttcggctaagccatacagttattcccttagcggttacaagcttttattgccaccaagtgacagttacatcatgaatgtaatgagactaaagcttgaagcaaaagccgttctgagagcttgcgatgagcttgtgagtgattgtgagattctagag

SEQ ID NO: 47890 - DNA, 231 bp, Glycine max
  Peptide Sequence Number=SeqID_164668
atggtgttgtttcctagtgaggtgtgtgatattacaatgctaaagaagctaagtgttactaattgccacaagctcttggcaataccccaagaaattgggaagttggtggtgatatgtgatgaagagataactgcttcatgggaaggatttgaagctatgcttcccaatctacagatagaggtgcctcaagtggatgttaacttaatctggttttgttcagttagctcataa

SEQ ID NO: 47891 - DNA, 1170 bp, Glycine max
  Peptide Sequence Number=SeqID_164669
atggctgagaagacaaataaaatactggaagaagctgcccagtccggaagcactgagggcatcattgaccctccatctcccatcagacgccacgtgaagtggaagctggcccgcaccaagaaaactgggcagatgacgattctttggatgagcaggcgtcacagggatcgttcgtccccccatggatgtcaagatgtcctaactgctgccattgggcaaccagagcaccctggccgggtccgtgccgctggagccggtgtcaccataaagcaatacttcggatcggctccacgaatgtcgtgtagttcttcctctatgcttcctgaagacctacagcagctgacccaagaaatcagggacctgcttgatgagtcgatcacaaaaaatggacttgcactgccttcggagccagaggttggtccctcaggtgctcgtgtcaacacaaaagagagttgtgttgctccctcagggaacgatccagagacgggtgactcagacaaatgcgagctatacattgaagaaaatccttcccgcctggttgctctaggaagactttatgagggatccatagtagttcacaacatccctttgttgcatggccaagtcaaggttggtgttgaggaggttaaagatgtggaggctctcgttcctatacccactgacgaggcagctgtgtctccagtaaaacctccaaaaagcccggatcatgaggtcgatgatcccctgtacctgatgacattgatcatcccacaactatttttgaagcctctccaggttatatgggatgctaccatgttcggggtgtttaatcaaaacttcctgttgtacataaagcacgaagatctctctgaaattgcacacggtggtcaatgtctcagcatatctgttatacagttgtgggttttgcatctgactgagacaagtctgcgagcggggaattccgatatgtatggattcctcgagccacagtccattcagagatctgggcaattgcaatttgaatcggaaagttacatcaagagttggatgcagagttcaaaacgagatgtctaccttggagcctacctgaatgggccagacaactatcttaagggaataattaacagtgtaatagacaaaaagaaagcactgagtgcggctattacgtcatgcattggatgtccacgataa

SEQ ID NO: 47892 - DNA, 486 bp, Glycine max
  Peptide Sequence Number=SeqID_164670
atggatgaagatcaacagaactggaaggaaatagctaacataatgatgaagattaacaaaaaagcagaggaaatgttcaacattgttcatgttatggatcaggatgtgccgagtaccatgtactcatttatgaaagctgcaagattcacccatctgaacatggaagggactacgaacctcgggactcaccattcgattcaaatcccatctcctctgcaccgcctccctattcccttcctcccttcatcaccaccctctcatctcctcgccgtcgcacttctccctccaccgcctcctctccacgacgagccgcaccttgctgcactcgaacaaatctgtcgacaccggcgcacgcgtgctagctctagacaaggcgcctctagacctacgcgctcagcttcggcggcctcaccggctttgttgtcattgttctcaacaaattccaagaccaggtcatgttctacgtcaccccaaccgaagccctaa

SEQ ID NO: 47893 - DNA, 312 bp, Glycine max
  Peptide Sequence Number=SeqID_164671
atgaacacagtaagggaaaggtttagcagtggggctgaacttagaattgcggtccaggcagaagtagctaatcgaaaaagtcctcaaagggggatagtaaacaaaaccacacaattggataactctgccaccactgatcatctaagcaaagacacaagcaacaataaaggtcatggaaatgccaatcatgccacagaatccacacaaaagtcagcgtcacagactagaatagatgttaatgttgtagactttttattcaacaagctttgttttttgaaccaaatattgactgaagttcaacactttgattaa

SEQ ID NO: 47894 - DNA, 261 bp, Glycine max
  Peptide Sequence Number=SeqID_164672
atgttgatatctctatctttaggttgtagacagagaagtgaagtggagcatcctccgttggagtccgacatcaacacaaggttttgcaaacccttttcacctaattgctttgtctcaactccgccgttcgtgggtggcaccatgacagggattcagctgaggttccacaaacccttttcagttgagtgctcgtggccagtgtcgctcccactcacggccaacctcgctctaggtggccactctcgaaagaaacatagatga

SEQ ID NO: 47895 - DNA, 504 bp, Glycine max
  Peptide Sequence Number=SeqID_164673
atggcatgccacgtcagaggtatccttatcgcgaccctaaccctcatccttacccctaaaacattgtcattttgctccacacctacctatgcgggctctaggccctccaaagtaggctctccctctacatcgacccctgagggcttccatcgcctcctgatcgacgtcaccagtggtgtcgaaggctccacacagtgcgatctcgacgagtccaagctccgcatcgtcacaatccttgatttgacattcttgatccacgtcatctttgttgtcctaatcatgttcctcacttatgcccttgtctactggagcgtcggtgggaggagactcaaatcctatgaggtgctccccgcctaccgcatcaatgagagaaggctcgaatctctgtcggctaccacagccgatagctcggcttcgtcaccaacgacagtggcaaccgcatcagagtgcatggattttcttcttcacttttcctttgagggtgcatttgttgatttttgttga

SEQ ID NO: 47896 - DNA, 1470 bp, Glycine max
  Peptide Sequence Number=SeqID_164674
atgcaggttgtgaaaagttgcaagggtttaccgcttgccattaaagtgattggtaggtcacttagtcatcagccttttgagttgtggcaaaagatggtggaggaattgtcacatggtcattctatacttgattctaacagtactgaattgctaacctacctccaaaagatcttagatgttctagaagataatacaatgatcaaagagtgcttcatggatctaagcttatttcctgaagatcaaagaatttcaattactgctctcattgatatgtgggcagaattgtatggacttgacaatgacggcatagaagcaatggccatcatcaacaaattagagtccatgaatctggtaaatgtcttaatagcaaggcaaaatacaagtgacacagacaattgtttctacaataatcatttcatggtgattcatgatcttctaagagagctagcaattcatcaaagcaaccaggaaccaattgaagaaagaaaaagactgattattgagacaaatgaaaataaaagtgaatgggggctttgcgagaagcaacaaggcatgatgacccgtatattgtcattttgttttagatattgtgctaaacagaaataccagcagatccctgctcacacattgtccatatcaattgatgaaacttgcaattcatattggtcacacatgcaaccaaatcaagctaaggttctgatatttaatcttcgaactaatcagtactctttaccagagtccatggagaaaatgagcaaactaaaagttttgatagtcacaaattacaatttccatctcactgagctgacaaattttgagctacttggcactttatccaacctcagaagaattagattggagaggatttctgttcattcatttgtcacattgaagactcttaaaaaattatccctctacatgtgcaatttgaatcatgcttttcaaaatggtatcttcctaatttcagatgcatttccaaatctagtagatttgagcattgactattgcaaagatatggtgttgttgcctagtggggtgtgtgatattacaacgctaaagaagctcagtgttactaattgccacaagctcttcgcacttccccaagaaattggaaagtgggtgaatttggaactcctaaggctcagttcttgtaccgatttggaagggttaccagattctatcggaatgctttcaaatctaaggcatcttgacatctcgaactgtataagccttcttaatttaccagaggactttggtaatttgtgtaatctaagaaatctgtacatgacaagttgtgcaaggtgtgaattgccttcctcagccgttaatcttgtgaatttaaaggtggtgatatgtgatgaagagacggctgcttcatgggaaggattcgaatctatgcttcccaatctgcagatagaggtgcctcaagtggatgttaacttaaactggctctattcagtttgctcctaa

SEQ ID NO: 47897 - DNA, 639 bp, Glycine max
  Peptide Sequence Number=SeqID_164675
atggaagagaccgcacaactagttgtctttccaatgaagagtgcatttggtgttcctgaaacgccagaattcagtgttggattggatgtaccattgagccagttgaagatcgagcttcttaaagaaggtgtctccattattgtgttaagtggttttggaggattagggaaaaccaccttggctacaaagctctgttgggatgaacaagtcatgggtaaattcaggaaaaatatattttttgtcaccttctcaaaaacgcccaagttgaagattattgcagaaagactatttgaacattttggatttcaagtacctaagtttcaaagcaatgaagatgcacttagtcaattggggcttttgctaaggaaatttgaaggaattccaatgttgttgattttggatgatgtttggcctggctcagaagcccttgtagagaaatttaaattccatttatcagattacaaaattctggtgacttcaagggttgcatttcatagatttggcatccaatgtgtcttaaaaccacttgtttatgaagatgcgatgacccttttccatcactatgctttgctggattgcaacagtttaaatactcctgacgaagatgtagtccaaaaggtgcttgttcttactttttga

SEQ ID NO: 47898 - DNA, 306 bp, Glycine max
  Peptide Sequence Number=SeqID_164676
atggatttttacaaagatagtgaaaaatctcaagtgggttgcttgaggactggacgtaggtccaacgagtatagattttattgtccatcacatagcactaggattgtagaattgagaaatgcaaaatttcttgagaatgatttgattggtgggagtggtcaatttcaagatattgcttttgaaaaggatcactatgaagctcaaccctctggctcaagtggcagattcattgccattcacacccctcatgcacaaatcaagtttttgatgagaaacaccaagttcctcaagaagatcacaaagtag

SEQ ID NO: 47899 - DNA, 468 bp, Glycine max
  Peptide Sequence Number=SeqID_164677
atgatgagagagaagaaagaattccctaaaggagagttctcaggctttagtggagttgggcttgcgtactcgcacttagcctgctctgctcgcttagcgcaagtgcctgtattcgtgcttagcgcctgtcagatctggcatgatgtcatccctagctctgacctcagtagtctctctgaccttagaggactcacccctttatcagtagagggttggtctcttggccaagcaacctattggatgaaggcctctggggttgtcagtggtgggtccatcttcagatggactaaagcatctgagtatgcgggtccatcgggactgaggtggatggcggctggcagcgtgcgacaggtggtggaggaggctgtgttagaggccaagttaatcacagggcttagtgacttaaagggtcacggaggaggaggaggagggagcagaggagaagcggagagatggattaacaaatag

SEQ ID NO: 47900 - DNA, 432 bp, Glycine max
  Peptide Sequence Number=SeqID_164678
atggtcatatggagagggattctagaggcaacagatgagaaagcgaaagatgaaaacaggatggattctgagattgatattgagcttgctcagttcatgaaaggatacttcaaagggcttattcttgaaaatggttggccacagttattgaaattgaaagattggccttcacctagtatggctgaagaatttctgttgtaccaaagacctgagtttatcaacaaactacctttacttcagtatattcactccaagtggggccttctcaatgttgcagctaaattgcctcattactccctgcagaatgatgtaggacccaagatatatatatgttatgggattagtgatgaacttggtagaggtgactcagtgacaaatctccacttcaatatgcgtgacatggtatattacttaaccctcattaacccatga

SEQ ID NO: 47901 - DNA, 288 bp, Glycine max
  Peptide Sequence Number=SeqID_164679
atgggtgctctgttcagggctcgtcaggtcacaatttggacagatgttgatggtgtgtatagtgcagatcttagaaaagacactgtcttatcaagaagcgtggggaatggtacagctagcgctatttttggtgtagtaaaagacgttggagctaatgttattatgatatctcaggcgaacataaatgtgcgtgctgcagcacaaggttcattccagattttttctctcaagaaccacaacaacaatgaccattattgcgcctggtttaattggaagcgcactgcttga

SEQ ID NO: 47902 - DNA, 240 bp, Glycine max
  Peptide Sequence Number=SeqID_164680
atggtttctcttcttcttattctgggaaagtggaacaagaaccacccacaaacgactcttcaacccatcatggagatcaaacttgccatatttccttcctccccttctcccttagccatcgaacccacctctggtgcacctgtagcagcaatttggttggaagagatggtgaagaagagaaaggagaaaggtgcacctaggacagtgaagaagaggaagaagaagacaagccatatgtga

SEQ ID NO: 47903 - DNA, 246 bp, Glycine max
  Peptide Sequence Number=SeqID_164681
atggctaagtttgaccctgagatagtcctggagttctatgataatgcttggcccacaaaggagggagcgcgagacatgcattcgtgggccaacaatgtgagttctgctagaggaggaatagggccgacgggtttgacgaggaggccattgcccaactgttatgcacacgaggcaggatttcgcccggaccactacagggaggtgggtgtggatcatgcgtaccagcatgaccactttgacccagac

SEQ ID NO: 47904 - DNA, 171 bp, Glycine max
  Peptide Sequence Number=SeqID_164682
atgggaattgctgattctattctaaggcatttctttctgtgtgggacgatgccgcaagcagagctggaaacgagctggcctgcgcctaagaaaaagccgttttttgacctctcccgttgttcgagctacttcgtaacctctccttcaaggatagaagctagaagcagatag

SEQ ID NO: 47905 - DNA, 216 bp, Glycine max
  Peptide Sequence Number=SeqID_164683
atggaatccaatcaggcgtcttccaagacaagtcctctaacacctcaaacagacgacagcacgatcagggttaccccatttcttaggtctccgaccgctgctgcttctgctacggcagaggatggtggaaaaaagactaaggtgtgtgagttcggctgtataagacgtcactgtgactcgccttgctgctcccatagtctaaagttctacaactga

SEQ ID NO: 47906 - DNA, 405 bp, Glycine max
  Peptide Sequence Number=SeqID_164684
atggaggccataaaagagcaaatggccacaatgatggaggccatgatgagcgtgaagaagataatggaagccaatgcggttgcaactgccgctaccagcactgttgctaaggtgaacccgatgcccccatcaggcctcaaccaaatgaatcatccaacctcagctatggtaggcaaagatttgggaagtacgggtggcccccattatgtgcaaagtcaaaacaagcacgccttcccgccacatggctttcctcccaactgtacaccacccaatgtagcgtacactcccggtgagaatgtcaataactccactcccatactcattgagagccgacaacccggactgatcatgcacatgtctctcaacccatgggtgagacacatgaaatgccccaccacaatctag

SEQ ID NO: 47907 - DNA, 324 bp, Glycine max
  Peptide Sequence Number=SeqID_164685
atgatcgtccacgtgtcccagggccctggggtttccggcgttgatcacgggcctctgctagtcattcaaggttcccgtcacccctataaagtgatccgaccgctgatcacccgagccttcatcgagaagtactgcacgcccaggcaggcgcagggtgatgcacatcaggctgcagacgcactatcaccacctcagcaggccgatcccgctggatcactaggcatagagcgttatctgcagcacttggttcgccagcaggcggccaaccaccatgggcaggtgcagatacatgagtgtctctaccggttcagcctcagtcagtag

SEQ ID NO: 47908 - DNA, 345 bp, Glycine max
  Peptide Sequence Number=SeqID_164686
gacccggatgttgactttgagaaactagtaaatcaagccaaggaggaagaaaatgaggattggggacttcccctgaatttgaggagaatggcgaagcaagaagaaagggaggtgaagccacaccgagaagagacagaggttgtgaacttaggcattgcggagagagaaaagaggtcaaggtcggcacttgatatgcctggtttgagctcggatatcatgcagcataagctaccactaaatcctgagtactccccagtgtcataccctaatttcgtccggggacccttgctcgatgacgtgcgaccattctttggtcctcgtgaggtgcttggcacccatcattag

SEQ ID NO: 47909 - DNA, 1098 bp, Glycine max
  Peptide Sequence Number=SeqID_164687
atgaagttcctctttgtaaagcttgtttctcaattgtctctagtcattctttggtcttttgccacagttattacctctcaacatgttagtgttgtgagtctaccaaacaatgaaagtgtcccagcagtgattgtgtttggggactctatagtggatacaggtaacaacaactacatcaacaccatagccaaagtcaatttcctaccatatggtaaagattttggtggaggaaatcaaccaaccgggaggttcagcaatggtttaaccccatcagacatcattgctgcaaaattgggagtcaagaagcttttgccaccttatcttgatccaaaattgcaacctcaagatctcctcacaggtgtaagctttgcatctggtggcagcggatatgatcctctaacatctaaaattgcatcagtgctgtcattatcagatcaactagacaagttcagggaatacaaaaacaagataaaggaaacagttggaggaaacagaacaacaacaataatatcaaaaagcatatacatcttgtgcacaggaagtaatgacattgccaatacttactctctatcaccatttaggcgactacaatatgacattcaatcatacatagacttcatgattaaacaagccacaaacttcttgaaagaactttatggactaggagctagaaggattggagtaattggtttgccagttctagggtgtgtgccctttcaaagaacaattcaaggaggcatacacagagaatgctcagattttgaaaaccacgccgcgacgctcttcaacaacaagctctcatcccaaatagatgcccttaagaagcagtttccagagaccaaatttgtctaccttgagatttacaacccattactcaatatgattcaaaatgcaactaaatatggttttgaagtaacagacaaaggatgttgtggcacaggagattttgaagtaggctttttgtgcaaccgtttaacgccgcacatatgttcaaacacctcaagctacatattctgggacagtttccatcctacggaagagggatataaagtgctttgttctcaggtgcttgataaaaatatcaaggacttcttctaa

SEQ ID NO: 47910 - DNA, 369 bp, Glycine max
  Peptide Sequence Number=SeqID_164688
atggacttgtttgacccatctactcccctacctccttggttctctgaggaagacctttcaacctatgcatcgttatatgaaaaatctggattcagatatgcattgcaggttccatacaggagtgctaaggtggaaactggcttaagtgacgtgaaagttactgttccagcacttcttatcgtgggtgagcaagattatttcttaaagtttcccggcatggaaaactatatccgaaaaggggtagtgaaaaattttgtgcctaacttggaaaccgtatatattccagaaggaagccattttatgcatgaacaaattccagagaaggtgaaccagctcatcattgagttccttgacaaacaaagtatctga

SEQ ID NO: 47911 - DNA, 168 bp, Glycine max
  Peptide Sequence Number=SeqID_164689
atgtgggatcaacacaagcttaaagtagcactcaaaccaggtgtatttacccccaaggcctacactccgaagagtccgtcaggatctctccctcctgatttagacaccgctcatgaattatacaatactcacgacctcccacctgtgttttacacacgttcaacataa

SEQ ID NO: 47912 - DNA, 984 bp, Glycine max
  Peptide Sequence Number=SeqID_164690
atggagaagatccagcacagtgaggtggaagtgaagggactgaagctgcacgtggcagagattggaagtggtcattccttgaagacaccctattataatactgttttgatatgctccaaggcagttgtattcttgcatggattcccagagatctggtacacatggaggcaccaaatgatttctgtggcaaacgctggttatagggctattgcctttgatttcagaggctatggactatctgagcaaccagtggagccagagaaggaaaccatgtttgaccttgttcctgaagtcgtgggtcttttagatgctataaacatcagcaaggctttccttgttggcaaggacttcggtgccatcccaggatatcttacagctgccgtgcacccagaaagagtagctgctgtcataactttaggcattccttttattcttcctggtccctctgctgtccaaaaccaccacctacccaaaggcttctacattactaggtggcaggaacctgggagggcagaagcagattttggccgctttcccgtgaaatcagtgataagaaacatctacactctcttctctaaaagtgagattccaatagcagcagatgatcaagaaatcatggacttgtttgacccatctactcccctaccaccttggttctctgaggaagacctttcaacctatgcatcgttatatgaaaaatctggattcagatatgcattgcaggttccatacaggagtgctaaggtggaaactggcttaagtgacgtgaaagttactgttccagcacttcttatcgtgggtgagcaagattatttcttaaagtttcccggcatggaagactatatccgaaaaggggtagtaaaaaattttgtgcctaacttggaaaccgtatatattccagaaggaagccattttatgcatgaacaagttccagagaaggtgaaccagctcatcattgagttcctcgacaaacaaagtatctga

SEQ ID NO: 47913 - DNA, 198 bp, Glycine max
  Peptide Sequence Number=SeqID_164691
atggcgaaaaggccaaaggtgtgtcttctcatgaagaaaatgcgtgaagttgtcaccaatgtttattcgatgaaaatgttagaaaaaccaaaagacgaaggtctacggattttgaaaatgagggttcgagagttgtttacgcatagggaagtcaacaagggtgttgcccatgctcctacgtatcctcaggtgcgataa

SEQ ID NO: 47914 - DNA, 1204 bp, Glycine max
  Peptide Sequence Number=SeqID_164692
atggctaacaatagggaaaagtctaccaaggagggtgttgaagagactcatcatcacaaggtgattggtgaaagtgaaggccaagattgggagattgagaaaggaaagggtcttgatttgagctcagggaggagacaatggaagccagtttttgatgatgcttccctgtcacacaggcctctcaagaaaatccgaagccccgaacgcgaaaacccgaatcaacaacaacaacaaccaccatcctctatgctgtctcttcagcctccttcatcaagaatagtgtttccttttgcttttgaaggctctcaacatccaatgccattcccacacccttttggaaccacaaacttgcctctttttcgtccaaatcttcatccaactcaacaaatgatatcttttgggtcccaacagaacatggggtatccaccattcctagccccagaatctaccatgccacaccaacaccaacaacaccttcaacaacatcatcaacagcttcttcattattggagtgatgcaataaatttgagtccaagagggaggatgatgatgatgatgaataggactgaaggaagacaaatgttaaggccacaagcacagcctctgaatgctaccaagctctatagaggagtgaggcaacgccattggggcaaatgggtagccgagattcgtctccctcgcaatcgaactcgcctttggcttggaacctttgacactgctgaagatgctgctatggcttatgatcgcgaagcctttaagcttagaggggaaaatgctaagctcaatttccctgaactctttctcaacaaagataaagcagaacaatccacaactgttgctcctgcttcttcttctaatgaaggttcaacatcaacatcaagccagaacacaaagcaaccagaaccaataccagaagagattaacactgagagtgaggacataccaccaacagagacaatagcagaagagaatgctgaaactggaaaaggaatttcacaacctcaggaattggtttggggtgaatggttcaatgcaattcctgcaggttggggtcctggaagtcctgtgtgggatgatttggaccccaacaataatcttcttttgcattcacaacttccctttgtgaatccaaatcagcaagagtttcatgatgatgctggtgcttcttctcagatacaacaagaagataacagcacagaaccag

SEQ ID NO: 47915 - DNA, 375 bp, Glycine max
  Peptide Sequence Number=SeqID_164693
atggtgagggtgttgagaagctgcattcaatcgattttgaagctggtgaactcggtgattgggatggcggggctagccatgattctgtactccgcatggatgattagggtttggcagaggaagatgggcgaacttccctttggtcacgattctgattacccacctccgtggttcatttacatgtttcttggccttggagttgctttctgtgtaatcacttgtttaggtcatgttgctgctgaaactgctaatggctgttgcctatatttggtatccttttctttagtctaccgttatatttcaatctatgatgcacgaatacaggcactagtatctgatatgtctgatgcaaagcaaggatataacatttcttaa

SEQ ID NO: 47916 - DNA, 402 bp, Glycine max
  Peptide Sequence Number=SeqID_164694
atgcatgaagcctatactaaaacctacccctcatcccctcacatgttgtactgttacacgcaccaacgggcgaagggaatctcgcaaatggcactggcggaaccaaccttagggaatcccgcaaatggcactagcgaaactagtctgcaccaatacctgactggcgaaaataaacacatggatgatgttgcactgatggatggatgcatggagttgatggtgggcatggggtatctcgctaatgggagtggcggaaccccatgcatgaagaacctgttggtgttgctggcgagataccttaaaaaaaagactccctacaaaaattattttcaaagaaatccttatgtaaaaaagttagtaaaaccaccccttacgtcattttgccccaagatgactaattag

SEQ ID NO: 47917 - DNA, 1396 bp, Glycine max
  Peptide Sequence Number=SeqID_164695
gagaaatgtaagaggtgacactccacttcatgttgctgcgaggtctaagaaatatgagacagtcaagttgattctctcccaatatgccacaaagaagtcaacatatgatgagatgaaagataaaaagatagcaagagaaacaaatgaatgtgggaatactcctttgcacgaggctgtctacagtggggatgttgatgtggttaaagagattttcgaccaggataaggctgtagcctattgtttgaacaagtcaaagagatcaccactgtgtttggcagtggtgaatggtaatgagcaaattctcgaacttctgttgcaaattccattacctgcggaccagccgctttcacagtgtcgtcgaagttctccactccacacagctggccgtcttcccgttcatcttgcttgcaaaaggggttgtgttgagatggtaaaagaattctttgaacctggatccggatggcccattaatccttatgttctcctcaatcaaaagggtcaaaacattcttcacattgcggcaaagaatggaagagataatgtggtagaatacctactaggaaattgcaacactgatgatctacatataaaccagaaagactatgatggaaacacatcattgcatttggcttccaaaaatttatttccgcaagttatcaagttgatcacagaggataataggactgatctgaatctcacgaatgaagacggtttaacggctggagatatcagtaagacctttaaacatccaatgttgcgtagaagagagcctgaaaaagacacctctgattttcaactccaatcacagcctgaaaaagacacccgtcaggcatttttgattgttgcagcgttgttgatgacagtgtcatttgcagctgcttttactgtaccaggaggtgtatatagctctgatgacccaaaccctaaaattagaggaactgcagttttggctcgtaaaccattattcgtgatattcaccatcttcaatatcataactatgtgtagctccgcaatggcatgtgcacttctgtctgtgggaatggttcttcagtctgaacttactcctacaattcaattttcgctcgtgtgtttgttatatgcctttttcgcagcaccagtggcgtttatagctgctgtagttatagttgtggccaataactatttactcacaattgctacaagcggcattggatgcgtgctcgctttctacaccgttacgttaatactaccttcagtactatcatatctacaagaaaaagcgaacactgatgcaattatagtgcatagtccaatacttcgacctctttattgctgttcgattcttttctcgacaataggtggtaagcccaaaattcttcttcattctcagaaagcaaacaaggacaaggacaattga

SEQ ID NO: 47918 - DNA, 339 bp, Glycine max
  Peptide Sequence Number=SeqID_164696
atggactggttcttccgcatctcccatcctttcatgacaccaagccacgcattagatcctctgccagatggtcatgccccacagccccgagttgtccctcaggccccacaggcagatatccctcacgtgccggagccaggagcaccgtcgacatctgcgaggcccgctgtggagaagcctagacatgcagaagttttccatgggattgctgagaggttagagcgccatctgagcctaggggtgatcacgctaggctcatcgacacatgaggtgatcgaagaatgcctcaggatggccatgagtgtcagacaggacctgctagtatatgttaggtcttga

SEQ ID NO: 47919 - DNA, 534 bp, Glycine max
  Peptide Sequence Number=SeqID_164697
atgtatgtcgaaaatgttttgttcgttcaacaacgacgagcaacagaaacacatagccgaaaaagcgttaaaagcaacgaatcaaagacagcgaagtcaaatgcagaaggaaagaagaacatcgaagtgagtgtgaacagtgcaaccgacgaaaacggagagaaatcagaactccgaagcagggatccgagggatcgagaatgtagaagggagaggagtcacaaagcggagaatgcgaagttgttgagcattggcagaggaggtgcaaaacgacaccgttgttcgggaagaagaagcagcagacgaagttgcaggagaagctctttcgccattatcgctcagaggaagaaaaggacaaatccagagagagattgcattgcagatttaggacgctcttgtttccggttttgcgaaaagaagcagaaaccgagggggaaagtgaagtattggaaggtgcctcacacccaggtcaatagtaatgtctttgcaactgctttattgggttttgtttcacaaatcacattatatctataa

SEQ ID NO: 47920 - DNA, 189 bp, Glycine max
  Peptide Sequence Number=SeqID_164698
atgggttcctccaagttattgggtattatggccatgcttttcatagtgcttctacccatggctgccaaaggggataatattactgatttctttgggctacaaagtggtagtaaattagtgtactataactttaaatgtgacataggatatgaaatattgcagataaggtttgtgaagaagtggaatgtg

SEQ ID NO: 47921 - DNA, 1905 bp, Glycine max
  Peptide Sequence Number=SeqID_164699
atggagcagtatgaaatacttgagcaaattggaaaaggtgcttttggttcagcgcttcttgtgagacataagcatgaaaagaaaaaatatgtgttgaagaagattcgccttgctcggcaaactgagcgctctcgtagatctgcacacctggagatggagcttatctctaaatttagaaacccattcattgtggagtacaaagattcatgggtagaaaagggttgttatgtctgcatcattataggttattgtgaggggggagatatggcagaagctataaagaaagctaatggtatcctgtttcctgaggagaaactttgtaagtggctcgttcaacttcttatggctcttgaatacttgcacatgaaccacattctccaccgtgatgtcaaggcatggaatagaagattgaaattttgtttacaagtgatcaatgatgaagcaggtgattttggacttgccaaaatgttgacttctgatgatcttgcttcctctgttgtgggaactcctagctacatgtgccctgagctccttgctgatattccttatggttctaaatcagacatttggtccttgggatgttgtatatatgaaatgacagcacataagcctgcattcaaagcatttgatatacaggcattgattaacaagattaataagtccatagtggctccactgccaacaaaatattctagttcatttcgaggtcttgttaaaagtatgctgcggaaaaatccagagctgagccccagtgcttcggagctgcttgggcacccacatcttcaaccttatgttcttaaggtccatctcaaactcaacagccccagacaaagcacattgccagttcactggccagaatccaactgtatgaagaaaactagatttttggtgccagaagattatcctgtttccatctatagggataagcgacattctttcaccaatgatcggactctaaatcctagtgtatctggagccgatcaagattctgtatgttctactctagaaatagattgtactcctgaccatttgaatcaaagactagcagaactacgtattggaaatagccatcaagtgaagtcaatccagaagcctgttgtttccagaacttctagcattattgttaagactccaaaattcacttcctcaaaagtctcagccaccaacaagaaatcaatggaatcctcaaagaatcataagatggaggagcttcttgatatttggtcaagcctcaagcttcccctttcacaaaataccacaaaatctgctaatactaatcgcagagcatcatttccactgccaacaaggggtggtattcggcagcctccttgcaggtctgtcagtttgcttagtcacgtgtcttcaccagatatctcagtcaattctccacggattgataagatggctgaattcccattaacttcatatgaagattctttgttccctatcaagagagcatcatcctctgcacgaggttcctcaggcttcccatcttatagcaaccattcaactgtgatagacaaatgcacggtagaggtgtatgatacagcctctaacaagcctggttgtatggatgcttggcagggaatcaagcagagcatgttaaaggagattgatgaggataaaagtggttcctctgatcaaaatgcaactgcaggtgcttcaagccacacctcttctgacttgcgccgtcgacaatttgacccatcatcattccaacaaagagctgaagctttagaaggcttgcttgaatttagtgcaagattgctacagcaggcaaggtatgatgaacttggggttctgttgaaaccatttgggcctggaaaggtttccccaagggaaactgctatctggttgagtaagagcttcaaagagaacactttcaacccagaagaatccatgtaa

SEQ ID NO: 47922 - DNA, 1265 bp, Glycine max
  Peptide Sequence Number=SeqID_164700
ggccagatgttcacgctcctgtagcagagctgacgtgtatggtggacacgtgtctctgggtgctacgtaggatttttgggtcctggaaactaaatgtgcccctaagctctgagccgggtgacgagtttgtcaagccctccaatgtggacgagtgttgtcctatgtcaggctgcttctgtcaagttgtccgtgatggacttgtctttggtgtgtcaggtgagctcccaccaattatcgaaaagtccttctctcctataaatggattggagtttgattttgggtcactgttcattgtccttcctccaacttctgaaggtacatccatccaccataacgcggttcctcgtctgaggatactcattgaggtgccattgatagcaagtcatcctcgtcaaaaagtgaggacctcgtgtcaaactggtgggggcacttctcgtcctcgtggaagggtgcgaccttctgcggctattagggagccagtctcggttattatgatcctccccccttctgcttctgggggtgcgatgagagctggtggagacgtgaggtcatctccctgcatccaacctagtgtgggtgctgggtcaccatcgtccaccctggccgttgttggctatgagtgggtgagggatgatgtgttgaagtacaggtcaaccttgacttcatcagcaagtttcgttgtgtttcagcgccaggaaaagctagcgaatgctaaggactcctgtaagttggctgttcagacttgcgggagtgatgacttcccgtttctgaggtgtgctctattggagcacttgaatgtggccctatctcagcttcacccgaatagttgggcgacggtgaaggcgtttgaaatcttgagtcctttcttcaacatccggcctagtgtgctggttttcttgtttttcttccaaatgaaactgtctggcaagattggatgggtcctggctactgatggcatgccactggtgttcaatagggatgcggagccccgctcctcgttttaccgacagtctaatcccactagattcaagtcgtatgacgaggatctgctgacccttgtggagaggttcgacaaagtgatcttcgagcaactgccagtctcgttggatgcgcgagccatgttgtctcttttgctggcaagcgatcctctcactgccttggatggaataataggtgacttcgcttggaggccactcgtgaagcaggtcagacttgtaggtgggaccgtgccaccatctgctgctgctccgtctgttggagaatga

SEQ ID NO: 47923 - DNA, 246 bp, Glycine max
  Peptide Sequence Number=SeqID_164701
atggcgaggattaaggaaaaagctgtcaaacttcaagcagccagaagatacaatacaaagatgatcaagggagacacgagggcacgaggacgaagaaggcgacgccaagctgccaagacaacagcagggagagccaccggagtagatgaaggaagctacatcatggaagcaccagtggtcttcacaccagcacttaataaagaagtcgcgacggcagaaggcaaaatcacaacagaaccaacttga

SEQ ID NO: 47924 - DNA, 1047 bp, Glycine max
  Peptide Sequence Number=SeqID_164702
gacttggagccaagttggagacttgtgttggcaacggttattgggtttcttggatcagcatgtggaaccgttggtggggttggaggtggaggcattttcgttcccatgctcaatctgcttcttggctttgatactaagtctgctgctgctctttctaaatgtatgataatgggggcatcagcatcatcggtttggtataatgtgagagtgccgcatccaacgaaagaggtgcccatattagactatgatctggctcttctgttccagcctatgctcatgcttggaatcactgttggtgttgctctcagtgttgtcttcccttactggcttatcactgttctcatcatcattctcttcatagggacttcttcaaggtcattctttaaaggaattgagatgtggagggaagagactattttcaagagagaaaagaccaagcaacgggcgacgttggttgattctcatggtgaagataagacaggcatgtacactttcacaataaatgatgtagaggcatgcagtccatggtattgggtgctttttggcttgcagtttccaattgcacttttggtgtttgggtatgaagcagtgaagttgtacaaggagcacaaaaggagaatgagcacaaggaacctagaatgcatctggggaattgttggaggcctacttggttctggaggtggatttgttttgggacctcttcttctagagattggtgtcattcctcaggttgctagtgctacagcaacatttgtgatgatgttttcatcatctctgtcagtggttgaattctaccttctcaagaggttccccattccttatgcattatacctcacctcagtgtctgttttggctggcttctggggacaattctttgtaagaagattgattgcatgccttgggagggcatcaatcattgtattcatcctctcaggtgtcatttttgctagcgccctcaccatgggtgtggttggcattgagaacagcattcaaatgataaacaaccatgagttcatgggattcttaggcttctgttccagtcagtga

SEQ ID NO: 47925 - DNA, 180 bp, Glycine max
  Peptide Sequence Number=SeqID_164703
atgactggcgctaagctagaaagtttctggcggtggagagactggagagaaccgagcttgaagaggaagctatcttgcgaagcattggatgagattttgagtgattgtgagtacttcatgttagtatgcttttgccttgatcacgtagatgcatgcttagctagggtcactcaacattga

SEQ ID NO: 47926 - DNA, 1071 bp, Glycine max
  Peptide Sequence Number=SeqID_164704
atgagatacgtggctttgaaagttcagaagagtgctcagcactacactgaggcagctatggatgagataacaattttgcagcagattgcggagggagatcctgatgataagaagtgtgtggtgaagcttttggaccatttcaagcattctggtcccaatggacagcatgtttgcatggtgtttgagtaccttggggacaatcttttgactcttattaagtactcggattatcgggggttgcctattgccatggttaaggagatttgctttcatattctggctggattggattacttgcaccagcagctttctatcatacatactgacttgaagcccgaaaacatcttgctcttgtcgacaattgatccgtctaaggatcctaggaagtctggggcgccacttattcttcctaatagtaaagataagatggcgatggagtcagcagggatgaaagatacgaaaatgttgaatggggatttggttaagaatcataagaaaaagattaagagaaaagctaagcaagcagcccatggatgtgttgagaaggaagcttctgaaggagttgagggtaatgctgaaacctctggggctgtggagtcatctcccaatgcgagttctgcgagagaacagacttctagttctgcaggaactagtcagttatcggatgctgatggaacaaagttgaaagagcagggtaacaaaagaggaagccgctctatgagacagaagctgctggcatcggttgatctcaagtgcaagttggtggactttggtaatgcctgctggacatataaacagtttacaaatgatatccagacaagacagtatcggtgcccggaggtgatccttgggtcaaaatattctacatctgcagatctttggtcctttgcttgcatttgttttgagcttgcaactggagatgtattatttgatcctcacagtggtgacaactttgatagggatgagcgaagtaagttgccagttttttggaaaggactacctatgaaggtgctaactggaaaggttaagttaagcattgcagtgtgcagccatcagaacatcggctcttag

SEQ ID NO: 47927 - DNA, 507 bp, Glycine max
  Peptide Sequence Number=SeqID_164705
atgtctcacaaagaaaacaagaatgtcattgagttccttgatgaacaagctttctattatgacgaggaagatgagcagtggtttaaggaaaaagatgatcagtgggcaaagaacataccatgctacaaagaagacgcagcaaaagttccttcccctccgagagttcatgctcctgcacctcagagggtttatacttttgccaatttggtttctgctacatctgcccctatagctcgggttcctgcgtctcaggagtcaccggaggagacattcaatgacattgcatctagtcaagtccatgcgccgatcagccaccaacaccacttgcttcctcagaatatgaagtctaatcgcgtcatgttagcaggtgactcatctcgatcgatcttattaggtggcttcttcatgttcatggttactagcttgtccctcgcgattggcgcttcatgtgttagcttagctcacaccatgcctacgttaagacttgtctattacatgccctattaa

SEQ ID NO: 47928 - DNA, 342 bp, Glycine max
  Peptide Sequence Number=SeqID_164706
atgatgaacgtgatgagtggaatgagtagttcacttgatgtccaaaaatgggacttttacttaatgattgatgctttggtaatgaagttgaagactatgctgagagagcaagcttctagaacccaacaacaagtgtcaacaggatacacagaaatctctggggatcaagaaacagtggaaagcacgtcagaggcactgcgttgctccaaacgcggaacactgcaccagcagcagcagaataataataatattggagaaggaaactgttccttcactttggaagatcattacaacacagtgccagtaccctattggcctggggtcccttattatcatccctaa

SEQ ID NO: 47929 - DNA, 1746 bp, Glycine max
  Peptide Sequence Number=SeqID_164707
atgttcgatggagtaccagaccagttccaccaattcataactccaaggacctcacaacctcttcacttacctttccctctccatgcttcaggaacccccaataccaccttcccttccaattttgatccttataacaacccttctcatcaattgccactccaacccaacaacctcttgcacccattacaccacaaagatgaagagaaggaagaaaacacaaccaccgtcccaatgaacttcgaaatccaaagagatcaaaggcaacaacttcctgaactaattgatccctggactaccgatgaagtgcttaccctcttgaggatcagatctagcatggaaagttggttcccagaactcacttgggaacatgtctcaaggaaactagcagagcttggatataagaggagtgcagagaagtgcaaggagaagtttgaagaagagagtagatatttcaacaacaacatcaattacgccaagaataacaataatagtaccagcaattatcggtttcttagtgagcttgaacaactttatcaccaacaagggagtagtggtgatcatcttgaaaagatgactcagccaccactgcagaaacaaggcaggatggaccaccatgcattagaattggaagaggaagaaggggattcgagaaacgttattgttgacgcatcggtgacaaaaatacaaagcgacgaggcacttgcggtggaaaagatcacaaaggaccgcaagaggaagaggtctgataggtttgagatgttcaagggtttttgcgagagcattgtgcacaagatgatgactcagcaagaagagatgcacaacaagctccttgaggacatgatgaagagagatgaagagaagttcaccagagaggaagcttggaagaagcaagagatggagaagatgaacaaggagcttgagatgatggcacgtgagcaggctgttgcaggtgatagacaagccaaaattatccaaatcctgaacaaattctcagccactacttcgtcccctgcaagccacaccctcaagaaggtaaacacccacatttcacaaaaccctaatccttcacaaacagaaaaccctactttaagtgttgcacaagacacactgattccttctacttcttctacttcaactccagctccagctcctccccagaaccctagttcttgttctctaaatagccagaataataatcatattaataataatattccagtagagaaaaattcgattttgaataaggggtcctcatcaaatgagaaagacgatgttgggagaaggtggccaaaggatgaagtgttggcactcataaacctgaggtgcaccagtgtgaacaacaacaacaacaatgaggagaaggaagggaacaacaaggtccctctgtgggagagaatctcacaagggatgtcggagttgagatacaagaggagtgcaaagaggtgcaaagagaagtgggagaacataaacaagtacttcaggaaaaccaaggatattactaagaagaggtcccttgactcaagaacttgtccctactttcatcagttgagcagtctctacaatcaaggaaaactcgttctacaatctgaaagccacttgaataatactccacctgatcagaatcccgagcaagtaaaaccagatcaaacaacacaagctcatgagtcttcttcgcaggtggggtctggtagtggtttcagtgttcagcaacagcaggtaccttctttggattttgatcagttttaa

SEQ ID NO: 47930 - DNA, 201 bp, Glycine max
  Peptide Sequence Number=SeqID_164708
atggtccgaattcatatgcgtagctcgtgggagccgcaacgaaccgaagagaagtggggttttgagaggaaaaacattgaattggggaatggggtggtggcgattgacggcagtggtggcacaacgtggtcagtagtggtggtttccgttggagaaggaaagaatgggagaaaaggaagaaggacaatggaaataaggtga

SEQ ID NO: 47931 - DNA, 297 bp, Glycine max
  Peptide Sequence Number=SeqID_164709
atgagggttagggctaggctttggggtttgcggaggggcttcgaactccgcgagggacggtggctccaaggagtggatgctggagaggtagatgatggcaaggactaccaggtggggatgtgggggtcaaaggagaagaaggtgtcgtatgactctcttcatagtcttgagctatcatctcgtgattgggtaaattcttctcaatggtggggggatattcattgcaacaacgacttccctgttggcagtaatggatggtttgaaaattgtatccaaagaaaggttagagatggataa

SEQ ID NO: 47932 - DNA, 141 bp, Glycine max
  Peptide Sequence Number=SeqID_164710
atgtgtgataaatgtgccttcggattcaataaatacggtgctttgaatgaactagtaccattgtgtaacaagtctgggactgggtcattagatgctatgtttagggttgctaggactgcttgtgctcgatcgtacatttga

SEQ ID NO: 47933 - DNA, 1104 bp, Glycine max
  Peptide Sequence Number=SeqID_164711
atgggcgagtcaagcgactctgtctccattgacattgatttgattcctttgggaggaaaggaatgcacggttaaaactagtaaaggttccgtgtctgtgcttgtttgtggggatcaagaaaaacccgctctaataacctacccagacctggctctcaattatgtgtcttgtttccagggtcttttattctgcccagaggcagcttctttgttgcttcataacttctgcatttatcacattgatgctccggggcatgagttgggagctgatgtcatttcttcagatgaaccattgctctgcgtggatgaccttgctgaccagattgcagaagtgcttgatttctttgggctaagggaggttctgtgcttgggtgtaacagctggtgcttatgtcctcactctatttgctatgaaatacaaagaacgagtgcttggattgattcttgtttcacctatttgcaaatctccttcatggactgaatggctttacaacaaggtcttgatgaatttaatatacttctatggtatgtgcggtgtactgaaggaatgtcttctgcagcgttacttcagtaaggtattcttcacattcttcccttcatccctcattatgaaggaacttaggtgcagtgttcagggagcagaatcagatataatactaacgtgccgaaggcttctggatgaaaggcaaagtttgaatgtcatgcgatttctccaagctattaatgtaaggcacgatctcactgagggtctgaaggacttgcaatgtagaacacttatatttgcaggtgagagtagtccattccatgctgaatctgtgtacatgagcacaaaaatgaaccacaaaatctgcgcacttgttgaggttcaggcttgtggctcactagtaacagaagagcacccaaattccatgatatcaccacttgagggtttcttaatgggttttggctaccacagacaaacacatgctgcttcctcatcaagcaattgttcaaatcccgcaagccccactagccattattcatgcatagcaccagaactgctctccccagagagtttaggaattaagctcaagcccatcagaacccgtgttgatgttcaattctaa

SEQ ID NO: 47934 - DNA, 840 bp, Glycine max
  Peptide Sequence Number=SeqID_164712
atggcaaaaatatgctgctggagtggaacacctccactacaacctttacaaaagcagtttcgaaggaatcacggcgtccaaaactgctcaaacactaacacactgaataggaggaagatatatgcatgcttgaacagagaaaaagaaagtgaaacacctcagatattgaaaatagcggtgagcggggtaacggaactcttgaggcttttctctccttcttcccatcaaacaagccttgagaaacagagagatcaaattgaattcccagcttcgagcgtcgatgatgttctaaggatcatcaagtctgattacgacaacgcttatttcgtaacagggaacttctcttcttcaatttatgctgagaactgtatctttgaagacccaactattaaatttcgcggtagggagttatatgcgcgcaacttgaaattgcttgttcccttctttgactctgcatcaattatactacaaaagattgataaggatgttgactctgacacaaattttgtgctggcatcttggaaactaaggaccaacttaaagcttccttggaggcctctaatttcaatcgatggaagcacagtttatgaattaaatgaagattacaaaattgttagacatgttgagagttggaacatttctgcagttgaagcagttttgcagattttctcctttaagtctaaaaatccagcactgccatcaagttcaagattacctttaccttttactagtgtctttatagttcaaaatgaaatttctcctttcaaacaggctaatagcccatctccagatttgcaatatagattccaaggagttcaagctaggatggaagtcatgtga

SEQ ID NO: 47935 - DNA, 477 bp, Glycine max
  Peptide Sequence Number=SeqID_164713
atgcacacatgtccagaagacaataacataactgttttcctcagactcagaccttattctagcctattattccaaaagagaacaatgagcgtagcagtagtgaacagcttcaccataaccgagttcgtaaatgacaaggctaagtttgacggtttcgtgaacgaatggtttgcgaggatagatgagaatggcgatgggaagctttcgcgtgacaaaatccgagggaggttagggatgcttctgcctttcggttcggaatcgccgccgcagcaagagaacgaagagatattcaagaggttcgatgaagatgggaatggtgcacttgatctgaatgagttcaaggccttaatgactgagattatgaatgccgctgctcgtagcattggtggctctcccgtcattgttgttcttggaaaagatagcttgctcatgaaggctgttcaacatgaattggcaacaccgtcttctcattcttag

SEQ ID NO: 47936 - DNA, 996 bp, Glycine max
  Peptide Sequence Number=SeqID_164714
atgatcccagcttgtttcagccaacccaacacaccttcaagctcaagcatcactcaagtgccacaaaacctagtaacctgcatataccaaactcaactttgcaactcttccacgtaccttacactcacctggtgcagaacccttctctctcactccttaaccatttatgcacctcacaccttctccatcaccattcctctcaacccttcaaccttctccttcttccgaactcgaccagaatccaaatccatctacctcactcgcccccacaaacgttctcagaaaatcaaacttcactgggacttctctgaaacactttttagtactcgaaactcagctgagcctgagtcatgcttctaccttgctatctgctgcaatggaagggttgaattctttctgggtgatcttgttcttggtcttcccgtgcagctttcaactcaccaacccagtgaccaaactcttgtgtcgagaagagaacatgtgtttggaagcaagagttacgtgtccaggggcgagttcatgggttcaaaacacgaattagagattgaattgtgcagtggagaagaactgagagtgaaagcggatggtcaagtttgtttggtggtgaaaaggctggcgtggaaattcagaggcaacgagaaaatattcattgatggcgttgaagtagagttctactgggacgtgttgaattgggtggttaatagtgaagatggcaatggcaacaatggccatggtgtttttgtgtttcaagtaggtgatggtggtgctgtgtggcctgaaatggtgggtccagagaagaagttaatgaagaagaggttggtgggacccactatggcaccatcgatcttcaggacatcgccatcgagctccagtgtgttgcagtgggcggaggagagcagtgatggtggcagaagttcgtgctcttcatctacaaggtcatgtgggagtagtaatggtggcttctctttgttgctatatgcttggtggagagactag

SEQ ID NO: 47937 - DNA, 333 bp, Glycine max
  Peptide Sequence Number=SeqID_164715
atgggtcatgatcatttggaaattcctatcgaattggatgatgcaagctggaaagagagatgcaacaagaggatggaggaactgaagattaccaaattatcaggtcaagattcaacaggttcacaagcgggattgctgcataaggaacttgttggcaagaaaaaaactatgatttctgagttatataaagcagttgaaaatgaaaatgttgataactttattgaagtgttgaagcaagaatgtatggaaaggaaattgcctttgtctgatattattattaatcaagtcactgcgaccaggggtgggaataggtcaggtcagaccaggctttaa

SEQ ID NO: 47938 - DNA, 609 bp, Glycine max
  Peptide Sequence Number=SeqID_164716
atggagacatggatagctttattaacgtgttgggtaaggtttgtagagaaaggaacctacctttgtctgctgtttttttatcaagtaacctggactggtgattcattgcttcatttggcagcaaatcttgggaaagaaaagattgtagagttgatttgtgatcactttcctgagcttcttttaagaagaaacgtgaaaagtgacactgtacttgatgctgctgtgaggtctaagaactctaccatagatcaggttcattctctccaattaagccatagagaagataaagagataacaaaagaaaagaatgaatatggggacactcctttgcacgaggctgtctacagtgatggtgatgttggtgtgattaaagagattttacttgtggataatgatgtggtctattatttgaacaaatcaaggcaatcaccacaatatttggcagttttgagaggaaataaagaaattctgaatcgtttattggaaattctagtccctgcagataagccacttccacaacagttcattggaaactctccattgcatgcagccgtacagaaacaggatcctgatctaatacaacatataatagagaaagacccgagctag

SEQ ID NO: 47939 - DNA, 1240 bp, Glycine max
  Peptide Sequence Number=SeqID_164717
atggaccaattgagaattgatgtggattttccaagtccagatgcagcttcacaagtgggactactgcataaggaaattgttagaaaagctatgatttacaagttgtatcaagttgatgaagaaggagatgctgataaatttggtgaggagttgaagcaacaatgtgaggaaaataagctacgtttgcctgatgtttttgataaagtcaccctaacaggtgattcactgcttcatgtggcagcagatttggggcaagaaaggatggtggagatgatttgtgatctctttcctgtgcttctaactaggagaaatgtaagaggcgacactccacttcatattgctgtgaggtccaagaacactagtatggtcaacctcattctttcccaatatgccacaaagaagtcaacacatgatgagatgaaagataaagagataacaagagaaacaaatgaatgtggggatactcctttgcacgaggctgtctacagtggggatgttgatgtggttaaagatattttcgaccaggataaggatgtagtccattgtttgaacaagtcaaagagatcaccactgtgtttggcagtggtgaatggtaatgagcaaattctcaaacttctgttgcaaattccattacctgcggaccagccgctttcacagtgtcgtcgaagttctccactccacacagctatacaacatcaaaaagaagaattcttggaacttgaatggcccattaatccttatattgtcctcaatcaaaagggtcaaaacattcttcacattgcggcaaagaatggaagaggtggtgtggtagaatacctactaagaaattgcaaaacttatgatctatctataacccagaaagactatgatgggaacactccattgcatttggcttccaaaaatttatttccggaaattatccacttgattacagagtattataggactggtctgaatctcacgaataaggacggtttaacggctcgagatatcagtgagacctttgaacatccaatgttgcgtaaaagaaagagtgtatccatggagttattaaaaagagctggagtccctgtaaatcacatgttgcattctcaacgccaaccacagcctgaaaaagacacctttgattttcaactccaatcacatgtacagcctggaaaagacatccgtgaggcatttttgattgttgcagcgttgttggtgacagtgtcatttgcagctgcttttactgtaccaggag

SEQ ID NO: 47940 - DNA, 321 bp, Glycine max
  Peptide Sequence Number=SeqID_164718
atggcatgtggatttctgtctctgggaatatttcttcagtctgaattaactctaacaattcaaccttcgttcttatatttgtcaagtgcctttttcacagcaccagtggcgtttatagctgctgtagttctagttgtggccaataaccgtttactcacaattgttacaagcgtcattggatgcttgctcactttctacaccgttcttttaatgctactttcactactagtatctccactagatggaacttcgacgactaaagcaaacaaggacaaggacaaggacaatggattagaagagcatgtgcaacaaggcaattga

SEQ ID NO: 47941 - DNA, 318 bp, Glycine max
  Peptide Sequence Number=SeqID_164719
atgcttgatccatgggaatttaaaagcattgatgggtgtacagtgaagaacatcattcaagcttggagatttgggatgacaacaacaaaggaggtgaagatcaaacaaggagtaacggatagtcatgatagctggggtgtgaagaggaagaatgtgatgaaggaaggcggtctaagttttatgaagtcatatacacaagttgcagtagaacataagaaacctataacactaagatgggagaaagtacaaactcaaggtgagattattaaggagggaaggtggaatggtgaggtaattaatatggaagaatgcaactaa

SEQ ID NO: 47942 - DNA, 1867 bp, Glycine max
  Peptide Sequence Number=SeqID_164720
tgacctacatggctaccttctttcaaattggacaggcggcgatgcttgtatcgccgcctggcgcggcgttctttgttctccgaatggccgcgtcaccgccctctccctcccttccctcaacctccgtggagccctagaccctctcactcccctcacccacctccgcctcctcaacctccacgacaatcgcttaaacgacaccatttcgctgttattctccaattgcaccaacctccaactcctctacctcagcagcaacgacttctctggtgagatcccgccggagatatcctccctaaaatccctcctccgccttgacctctccgacaacaaccttcgcggcaaggttgatgtgatatcaaacttaacacaactcataacactaaaactccagaacaaccttctctctggcgaaatccccgacctttcatcctccatgaagaacctcaaagaactcaacatgacaaacaacgagttctacggtcacttaccatcccccatgctgaagaaattcagttccacgacgttctctggtaacgaggggttgtgcggtgcaacaccattaccaggttgctctttcaccacaacccctcctaaggataatggtaataataacaacaatgaaaaggaaccgtcgtctcagacaacggttccttcaaaccctagctccttccctgagacaagcgtgatagctcgtccagggaaagagcaacgacacaggggtttgagtcctggcgccatcgtggccatggtggtcgcgaactgcgtggcactgctcgtggtggcgtcgtttgtggtggcgcattgctgtgctagagggaggggttcgagcttggtggggagtagagagagctatgggaagaggaagagtgggagcagctacaatgggagtgagaagaaggtgtatggtggtggtgagagtgatggaaccagtggaactaataggagtaggcttgtgttttttgatcggaggagtgagtttgagttggaggatttgcttcgagcttcggcggagatgcttgggaaggggagtttggggacagtttatagggtggtgcttaatgatgggtgcattgtggcagtgaagaggctcaaggatgcgaacccttgtgcaaggcatgagtttgagcagtatatggatgtgattgggaagcttaagcattctaatgttgtgagactcaaggcttattactatgccaaggaggaaaagcttcttgtctatgattatctctccaatggatgcttgcatgctcttcttcatgggaaccgtggtccgggaagaattccattggattggactacaagaataagcttggtgttaggagcagcaagaggtctagccaagattcatgcagagtacaacttcgggttatcactcctcctaaacccggttcacgccattgcacggttgggagggtatagagccccggaacaggaacagaacaagaggctatctcagcaggctgacgtatacagttttggagtattgttgttggaggttctcacaggaagagctccttcattgcagtacccttcaccggctcgtccccgaatggaggaagagccggagcaggctacggtggaccttccaaaatgggttcggtcggtggtgagggaagagtggactgcagaggtgtttgatcaggagctgttgcgctacaagaacattgaggaagaacttgtgtccatgctgcatgtagggttggcttgtgtggcggcgcaaccggagaagaggcctaccatggaggaagttgtgaagatgattgaggagatcagggtggagcaatcacctcttggggaggactatgacgaatcgcgtcattcactttcgccttccattcccaccactgaagatggtctagcttag

SEQ ID NO: 47943 - DNA, 1080 bp, Glycine max
  Peptide Sequence Number=SeqID_164721
atggcctcttgcgacgacgacgacgacttctctctcctccgcgatgacacccaccaccacctccaccagccctacgcgccgcaccaccaccacttctccccctccgccgtctccgtcgcctccgcctcctccgtgccgcctaaacccgccgccgccgcagacgacgacgccgaggacttctccaaccccttcgacgaagacgacgacggcgagaagcgcaaggagcgcgacgagatcggcgagggagccgcctcgtacggattcaacaacaagagatctaagacgacggctccgtcgaacggcgtcggcgccgtatccggcggcgccgagtaccgcaaggaccgggaggagtggagcgacacggcgattgtgtgcctcctcgaggcgtacacggagaagttcacgcagttgaaccgggggaacctgaggggaagggattgggaggaggttgcggcggtggtgagcgaacggtgcgagaatcaatcaaagagcgttgaacagtgtaaaaacaaggtcgataacctaaagaagaggtacaaattggagcgacacagaatgagcagtggctgcatttccaccagccactggccttggttcaagcaattggaacagatcgtcggaaattctctcccggcgaagttctccgacgaggataaagcggtcatttcagccggaacttctccccggcaatcgaaaagatatggagtggcaacacccagcactggaggtccagcaaatagcatgaagtccaaagcattgtcaaacagtagatggcggagggtagtcctcaaaattagtggggcagctcttactggatctgatacctgcaatattgaccctaaggtggcaatgttagtttcaagagaagttgccatagcttcccgccttggtgtggaggtggcaattgttgttggaggtcgtaatttcttctctggagaggcttgggtaaatgtgacaggtttagaaagatgtactgcgtaccaatgggatagaaagtacctaggttgtagtgctggagaaggccacagctggggagtgaactctgatttgacttgtatcagttgtaaggtatattggtag

SEQ ID NO: 47944 - DNA, 1446 bp, Glycine max
  Peptide Sequence Number=SeqID_164722
atggaacccattggactaggttgtggaatgttctctgggttggtaggagtggaaagccctttacaacagcaacaacaggaacaaaaccctcaccatttgcaacaccatccccaaatggttccctatgccacacaccatgacactgaaaaccctcatcatccacaccttcaccattcaatcaaacaagggtaccctccttttttatccaagactaaacaacaacagcaacagcaacagcaacaaagctctttcagtgatgatgatgagccagggtctgctgatgatgaccccaagaagaaggtctcaccatggcagagaatgaagtggactgataccatggtgaggctcttgataatggcggtttattacattggtgatgaagctggctctgaagggactgataagaagaaagcctctggtttgatgcagaagaaagggaagtggaaatcggtttcaggggctatgatggagaaggggttctatgtttctcctcagcagtgtgaggacaagttcagtgacttgaacaagaggtataagagggtgaatgatattcttggcaagggaactgcttgcagggttgtggagaatcagaacttgttggattcaatggacttgtctccaaagatgaaagaggaggttaagaagttgctcaattccaggcacttgttcttcagggaaatgtgtgcttaccataatagttgtggaaatgggaataacaatgctccacagcaaggagagtctggtggtgaagtgtctcagcctcagtctcagtctcaggctcaacctcatcatcaacagcagcagcaaccgcagcaacaacgatgttttcattcatcagaggtggcaaatttggggggttcaggtgtggagggtttgagggtgttgaaagtgggaaatggggaagagggtgatgatgatgaggatgaggatgatgatgaatccgaggatgattcggatgaggatgaagatgatttgggagaaggtggttcgaggggtcatgtggggcatggacatgaagacattgaggatgagaatgatggaaggacaatgaggaagagggcaaggaaagtaggaggaggggtttccaattctctgtcaccacagacgatgcagcaactgagtgctgaagtgactggcatgttccaagacgtaggtaagagtgcttgggacaagaaacaatggatgaggaataggatgaagcagttggaggagcagcgaataagctaccatacacaagcatttgagttggagaaacaaaggctgaaatgggcaaggtttagcagcaagaaggagagggaaatggagagagccaaacttgaaaatgaaagaaggaagcttgagaatgagagaatggttttgctcattcgccagaaggagcttgaattgatgggtcttcaaccccaacaacagcagcatcagcaacaacaacaacattcttccacctag

SEQ ID NO: 47945 - DNA, 396 bp, Glycine max
  Peptide Sequence Number=SeqID_164723
atgggtgccaagcacctcacaaggaccaaagaaaggtcgcatgtcaccaagcaaaggtccccggacgaaattaggttagagaagaataaattggttgacgaggtggagagtgctatcattgagaaggacaagattgccaaggtggttgatgacttaaaggcccagttgatagagtcggagtccaggctagaggtgtccaagatgagggcatccaggaagagggaggccaacaaagagcttgaagaggagttgttggtgcttaaaagggctatggagcagcatgaaaaaggatttaataaagccgccaggcaagctgggttcttcaccaaggatcttgacttgggtctttttgatccattcaacgacgtgaaggatggtgttttgcttgacgaataa

SEQ ID NO: 47946 - DNA, 207 bp, Glycine max
  Peptide Sequence Number=SeqID_164724
atgccaggcaaatggtcaacagggactgtcatgcatttgagttatccttccgttgaagccaccgatggagatcaattgaacaaagcaaacgatagtggaattaagatgatgccctcgatgaagatgaggaggcagtcgtcgtacgaacaagatgtgcacgtcgaggttgcggtgcctagtggaacactggttcaacaacagcaatga

SEQ ID NO: 47947 - DNA, 972 bp, Glycine max
  Peptide Sequence Number=SeqID_164725
atgatgaagaaggggttggtggtgtacaagttatacagagccctaacccacggcctatcgccgttaatccgcctccacctgcgctggcggcgcttcctcggcctggagcacccgcaccggtggctggagcgcctcggcctcccctctcagccccggcacgcgggtccactcctctggttccacgccgtttccttaggcgaaggaatgatcgccgttcccgtcatcaaacactgcattcggcgaatgcctcacttgaacgtgctcatgaccatcaccaccatgtcctcgtttgaagtattgagcaagtcgcttccgagtggaatcattttacagttttcaccagttgacacccctacttccatccattctttccttgattactggaaaccaaatgctattgtgctgatggaaagtgaactctggccaaatctcatcatggatgcttccagaaatggtataaaactggcactcttaaatgctcggatgtctgaaaagtcctttaaaatttggtcaagaccagtgcttctaccattaatttcattgatgttatccaagttttcgttgattgtcccattgagtacagagcagggtatccggtttcagctgctacaagcccctccttatatcataaacttttctggtgatttaaaatatgtaatagaagattttggagtcaatgaaagaggtagaattgatatagacaatctgagactagagcttacacaaaagaaggtttggatggcttcttccattcatagtggagaagaagaaataatattaggtgttcacaatgcccttatgcagcaacaacctaatacaatgactattattgtccctcggcatccacaggaaggacgagagattgccaaagtatctttcataggaggccatccttacttgagacagagtctgatactgttaggaaaccactttaataaggtttatattaggaagcggcagagggggaattga

SEQ ID NO: 47948 - DNA, 486 bp, Glycine max
  Peptide Sequence Number=SeqID_164726
atgtacgacacacctgttgagttgaagtgggatggcagcaaatttgggctttcaaatgttgatgcttcattcttcttgacattctctgatgtaaatgaaatagtagctggatacaaatgtttgaacatatctatactacagttatggatgttgtttttggatgagtggagctctactttgggtcatgcttccgtgtatggattccttgagccacaatcgatacacaatgcaaaggatcgacgtgctgaatgtgagcattacttacaagcatggctcaaggaatcgcaacgagaggtgtacctaggagcttacttaaatcagggccattggcaactggtagtactgtgtcctgcgaccaatgttgttgcatggttttgttcgttacatgttgatcatgctattattataagcagtgcaatgaagtcagcaaacacaaccgcggatggtacaaataatccagcaactcctaagtgggttgaagtcaag

SEQ ID NO: 47949 - DNA, 318 bp, Glycine max
  Peptide Sequence Number=SeqID_164727
atggcatacaccaccatacctgaccacaacattcagtcaacagagcaaggcatggcccaggccctccgcgccggcgagcacctccaccgcgtgatagttttatatgtccccctatgcccgtacctgattgatgctccgcgagctcagacggtgtttcttgaagaagaggattatcgacgtgagggaagagtcgcgagttcgagaacgagatttcatgaactttcatttggaagagaggataaaggttataaaggaaatacacaaacattttggaaggttcttctatcaacaagagaatttcaatttctcacattttag

SEQ ID NO: 47950 - DNA, 505 bp, Glycine max
  Peptide Sequence Number=SeqID_164728
atgggcaacctggcgtcactgggcgtcgagattggtcagattgcgggcggcctggcggtagcacttcccggcgcaatggtctcccttggtattgcggtgggcgtggcctatgccgcgcttagcgacttcggcaaggtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 47951 - DNA, 285 bp, Glycine max
  Peptide Sequence Number=SeqID_164729
atgaatcacaagtctggcgatcctggtcatacaactccgcctcctccaaggaagaagttcatcacaagtgctgggatcctggctttgccgataaaagctctcattcagtttgtcacaacctacccttttatgggcgagcgaggcgaggctcatgggtgcgtcttccaaaggaggaaaatgcgtggagtcgccaccaacgtttatttgtggaaaacgttggaaaaacctgatgagaatcctgaaattggccaaatgcaggctaaaggcccaagtggagaaggataa

SEQ ID NO: 47952 - DNA, 492 bp, Glycine max
  Peptide Sequence Number=SeqID_164730
atgtttatacggctaaccactcgggtatttccgcccggtcagtgtgactcaaatgtcagtatgacagatcttgtgagcgcggaagatgacgtaaatctccgcgtgtcaacgggcttgtcggtcccgattggcgaagggcgcaggagacggccaaaaaagaatgtttatacggataaccactcgggtatttccgcctgtcagcgtgactcaaatgtcagtatgacagatcttacagcaaaaaagaatgtttatacggataaccactctggtatttccgcctgtcagcgtgactcaaatgtcagtatgacaaatcttgtgagtgcggaagatgacgtaaatctccgcgtgtcaacaggcttgtcggccgcgattgacgaagggcacagaagacgacgtcagtctctgcgtgctatcaggcttttcgtcttacagacagcaaaaaagaatgtttatacggataaccactcgggtatttccgcccgtcagcgttga

SEQ ID NO: 47953 - DNA, 810 bp, Glycine max
  Peptide Sequence Number=SeqID_164731
atgcacgtcctcgccatcagagggattcccgtcctcacctttagaggactgcacgtcctcgcgttcataggattacacgtcctcgacttcaaaggactacacatcctcgccatcaaaggacaacacatcctcaccttcagaagaggactacacctcctcatcttcagagggcaacacgccctcacattcagaggactgcacgtcctcgccttcagagggattcaggtcctcacctttagaggaatgcacgtcttcaccttcagagggatgcacgtcctcgcctttagtggactacacgtcctcgccttcagaaggctacatgccctcacctttagagggctacatgccctcaccttccgagggttacatgccctcacctttagaggagtgcacgtctttgccttcagaggactggacgtccttgcctttagagggctacacaccctcgccttcagagggcttcacatcctcgccggctacacgtcctcacctttaggagactgcacgtcctcgcctttagagggctacatgccctcacctttagaggacttcacgtcctcgccttcagaggagtccatgtcctcgcctttagagggctacacaccctcgccttcaaagggcttcacaccctcgcctttagagtactgcatgtcctcgcctttagtggagtgcacgttgtcgcctttagagggctgcacgtcctcgccttctgggggctacacgccctcaccttcagggggctacacgccttcaccttcagagggctacatgccctcgccttcaaaggactgcacgtcctcgccttcatag

SEQ ID NO: 47954 - DNA, 201 bp, Glycine max
  Peptide Sequence Number=SeqID_164732
atggttatccgcacctttcgtcaaccaggggcaaacgagcccgttgacgcaaagagactaacgtcgtcttctgcaccttttgtcatccaaggacagcgagtcaggtggcaggcgaagataccttatggtcattcgcacctttcgtcatccaaggcgaacaagttcgacggtatcaggatgatgttggttgtccgattctga

SEQ ID NO: 47955 - DNA, 327 bp, Glycine max
  Peptide Sequence Number=SeqID_164733
atggcccgcacgaagaaaacatgggagatgacgactgaggccgcaaaggaaatcgctgagaagattggatccttcgtcccccatggacgtcaggatgttatcgccgctgctattggacgtccagagcaccttggacgtgtccgtgctgctggagccggtgtcaccatcaagcaatactttggatcggctccatggacgtcccgcaacgcttcctccttgccttttgaaaaattgcagcagttgacccagcaaatcagggaccagctaaaggagtccatcacagagaaagtgacgaggcaggtcatggcatccttcagccacatgtag

SEQ ID NO: 47956 - DNA, 876 bp, Glycine max
  Peptide Sequence Number=SeqID_164734
atgggacctctccaaaggcaagccttccgcaaagtgtacagaaagattctagatttgaccgcaacggaggtatttacggaagttgttgtatccctcgcccaatactatgaccagccgttgagatgcttcatgtttggggacttccaaatggtactgactgttgaagagtttgaggagatattaggatgccctcttgggggaagaaaaccgtaccttttctccgggtttcttccctccttgagtaagattgcagttgtggtcggagattcggcaaaagaattggatcgcatgaagcaaactcggaacgacgtagtgggcctgtcgcggaaatacttggaaggcaaggcaagggatatggcaagccaagagaagtgggtcccgtttgcggatatactagctttgctgatcttttgggttgtcctctttccgaacatagacggtttggtggacctagccgtaattgatgctttccttgcatatcaccatagcaaggagagtccagtggtggctatcttggcggacttatttgatacctttgaccggaggtgcgagaagaacagcgcacggattgtctgttgcttacccgttctctgtgtgtggttgatttcacacctattccaacaagatgtaagacacccgtgtccgcttcaaagttatcgctcgtgcgtcgaaaaaaggagagtcgattgggaccaacacttggctgggataggaggcagcgcaatcaattggtttcctcgatggaaggaaggaaaggagggagttcttttctcatgtggggactaccctaatgttccgttgatagggacgaggggttgtattaactataatcccgcacttgccataagacagctagggtatcccatgaggcactaa

SEQ ID NO: 47957 - DNA, 597 bp, Glycine max
  Peptide Sequence Number=SeqID_164735
atgggtcaacttcaacggcaagccttccgcaaagcctatggtaagatttgggacctagctagggtagaagtctccatggaaccgatttcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaagcgattgacgcttttcctcgcctttcatcatggcaaggaaagcccggtcgtcgccattttggccatgcatgacacgttcgaccagagatgtgaaaagagcggcgcaagaattgtttgttgtacaccggctctctatgtgtggctggttttgcacctttttctccaagaaggtaggcccgtctatccgctacaaggtcaccgctcgtgcgtcgaaaaaagaaagacgaattgggaccaactcttggctagcatagaggggcgtctgttaattggttccctcgctagaagggaggaagaatcaggattctatcttcatgcgaaggatttccaaatgttcccttaa

SEQ ID NO: 47958 - DNA, 351 bp, Glycine max
  Peptide Sequence Number=SeqID_164736
atggaggagaagaaaagcaaacaattggaggaagctactaaatctggaagcattgacaccatcattgatcctccatctcccattagacgacacgtgaagtggaagatggcctgcaccaagaaaacttgccaaatgatgtctgaggcagcaaagaaaattgctgataagattgtaaattcctttgttgcccatggacgtcaagatgtactgactgctgccattgggcaaccagaacaccctggtcgtgtttgtgctgctggagccggtgtgacaatcaaacaatactttggacaactccaaggacctcttgcacatctttgtccatggttcccgaaaacctggagtacctga

SEQ ID NO: 47959 - DNA, 579 bp, Glycine max
  Peptide Sequence Number=SeqID_164737
atggttaagttcgatcctgagatagtcatggagttttatgctaatgcctggcccataaaagaaggagttagagatatgtgctcctgggtgaggggccagtggattccctttgatgagcatgccatcaatcagtttctggggcatccgctagtgagttctaccagaggaggagtttggcctccaactttcatgaggaggatatcagtcagttgctatgcattttggggatggcgttgttgcttcgcaacattctccccagtgaccataactaggaccttcccttgccgaagttttgaagggtttatgcctctgagacaactagtggacccagagaagtccaatagggccctagggtttcttgctctgattacaagcctctgtcagttctatggagtggcagttgtggaagcaatgccttccaaggttattttgatgatgcaaaagaatcaagagttaagcaaagtttcaagcaaagattcaagaatcaaatttcaagattcaagattcaagaatcaagttgcaaagatcaagattcaagactcaagattcaagaatcaagagaagcctcaatcaagataa

SEQ ID NO: 47960 - DNA, 678 bp, Glycine max
  Peptide Sequence Number=SeqID_164738
atggcggcgatgaacggttcgcctgccttctttgataaagacggcaacagtaccttaacccagccgggggcgataaagggagcacagctgctggtcgatttgtatcagcaaggtggcgcgcctaaagacagcgtgaactggggctttaacgagattgtctcgggcttctattccggcaaatgcgcgatgctcgatcaggatccggacgcgctgatcgcgattaaaaatagcatggcggctgaggattttgccgtggcacccatgccggtcggaccgtccggtaaagccttcccgaccatcggctataccggctgggcgatgttcaaacagggtaaacaaaacgatgtcgcctggccgctgattaccttcctcagtaataagaccaacaacctggcgtgggcgaagtttgtcggcacgctacccatctataaaggtgcggaacaggacccgttctatcagacgccgcagtttgccggctggtttaaggagctgaacgatccaaattatgtgccgctcaccatgccgacccacctcaaaggctggggctatttcaattcagtgatcgtgaaagagagcagccaggagacgttactgggcgaaaacgacaccaaagatatggtgcaggactgggccagctatctgagtaaagagcaaaaagcctggctcgccagccagtaa

SEQ ID NO: 47961 - DNA, 378 bp, Glycine max
  Peptide Sequence Number=SeqID_164739
atggcggctggccagctatgtatcttgggtggtatttggaaattagcctctggtaatcgattaccaagggaagttaaattggcctctggtaatcgattaccaaggatcgcgatggcagcgcagttaatccatgatcgcgtggtgatggagtgcctagagggagtttgggagaccctcgaaggcaatgagaggtgtcgattccatggcacgattcaactcactgctacttcattggtgtcatcctctgaagaagatcctgaggaggacctagaggagctacctcctgaacctgttgtggatgacctcgacttacctgaggatgatgaagacccactccctgatgttgattctccagaggatatcatgtcagcatctgag

SEQ ID NO: 47962 - DNA, 402 bp, Glycine max
  Peptide Sequence Number=SeqID_164740
atggccacaatgatggaggccatgatgagcatgaagaagataatggaagccaatgcggttaccattgccgctaccagcactattgcaaaggtgaacccgatgcccccatctggcctcaaccaaatgaatcatccaaccttagctatggtaggcaaagatttgggaagtacgaatggccccatgatgtgcaaattcaaaatgagcacgccttcccgccatatggcttgcctcccaacttacaccagccaatgtggtgcacataaaatgccccaccacaatctagccgacttcgagccttgcctcggatatgccactgaagggcaaacagttggtgatataccccttaaaaacactttggagggccctcagtatcacccacaaccacacccctcacattccaca

SEQ ID NO: 47963 - DNA, 306 bp, Glycine max
  Peptide Sequence Number=SeqID_164741
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatccccctcatacctgtcgggacccgaaagatggtgaactatgcctgagcggggcgaagccagaggaaactctggtggaggcccgcagcgatactgacgtgcaaatcgttcgtctgacttgggctataggggcgaaagactaa

SEQ ID NO: 47964 - DNA, 261 bp, Glycine max
  Peptide Sequence Number=SeqID_164742
atggcgagcacaatattcgatgacgagtcttgtgaaggtactaataccgaggaccctgccgttgattttgaacgagaagcaaataggcttgaggttgaagaagatgaaggtatggaattccccgccgagctagaaatgatggttgctcaggaaggccgagagatgaagccgcaccaagaagaaacggaagtcgtaaacttagatgttgacaatgagaagaaagaggtaaaagtgggtacgggcatgaccacaccaatctga

SEQ ID NO: 47965 - DNA, 288 bp, Glycine max
  Peptide Sequence Number=SeqID_164743
atggaagtcgtagaggaatccttggagacatcctttcaagcattggaggtggtgatcaacgcttatgttgagtctcccccagtgcaaccccgcgcatttggtgccccattgatggtagcccgtgtgatgttagggcatgggtacgagcccagaatgggtttgggtcggaatggcgatggcgtagcgagctcggtggagttcaaagagaaccgcggaaggttcgggataggatataagcctacacgggtcaacccatgccctcctaagttcgagttgggaaattggtga

SEQ ID NO: 47966 - DNA, 357 bp, Glycine max
  Peptide Sequence Number=SeqID_164744
atgagatatcggagttttgatttgcaccagcttttatctcactttagtaagcatgggaacaaatcaaaccggcaagaggttctaccaagtcaaggtcaaaagcccagataccaccagcatcaaggaattagggcggttgatggaacccctccaaatgcaagccttccgcaagacttacggaaagatcttagagttgaccatagcagaggaattagggcggttgattgggtcccgtttaaggatgttttagctttgctaatttttggggtcgtcctctttccaaacgtggatggtttgatagacctagcagcaatcgacgctttccttgcctaccaccatagcaaggaaagtccggtg

SEQ ID NO: 47967 - DNA, 303 bp, Glycine max
  Peptide Sequence Number=SeqID_164745
atttatgtgtccagtattttcgggcaggatgtcctggacattgtatccgacatcgtggatcctgcacaatctgttaaagatataacagatttatgtgtccagtattttcgggcaggatgtcctggacattgtatccgacatcgtggatcctgcagcttcaattcttcatttgacttttatcttgccttgtgcattgtgcagcccgatctgaggaaaatgcaaggatcatgtatgagtaaacataacatgcgaacgatgaaaatagaatgtatgcagttggcaaaacaaaagcatgctaaatga

SEQ ID NO: 47968 - DNA, 501 bp, Glycine max
  Peptide Sequence Number=SeqID_164746
atggttgaggaaatacacatgcttgaaacaaaaggcgcaacagaagcccaccaacaccaaacctctagtaaaaatgaccagttagcttctgcctctgaaggcagcaacaaccagctcaaatctgataaccaacctgctcacgagtttggcgcgcatgcattgcattcacatgcaatccctgaaaagcaattccagtgtttggaaatggggtcatcttccttggctggcaacgaggaacaacacatgggaatggaagaagaccaatggagtcaagagaagaggtcaaaactggagtgccagattgcttcaacaccaagcatggatgggacagtgatggggtttatgccatatcgaagaagtggacttgagggtcttggatcagtgtcactcactttgggtcttaggcatggtgttgaaggtgtgcaacaacagcatttgcaacaagaggaggagcttaggcgtcaatttggagggcatatgatccatgattttgtgggctag

SEQ ID NO: 47969 - DNA, 1788 bp, Glycine max
  Peptide Sequence Number=SeqID_164747
ccgataatcgcttttgcaatcattgtagcactgcttagcttcattcacccttcttctcacttcccattccaaaccaacaccaccttctcaaccggaatcttcacactccccaccaaatctcatcaaaacctcttttcgatcgcacctaaggaagttgtgagtggttggaacttggaagcctctactagatccgctggagttggaggggtggagcaaaatctagggtttcacttgctgttgtgcttttacgtatcccgttttacgggttggggtgagttatgtgagtgggtgcttcatctccaatcttaccgacacatagattgggagggtgttgcactgttcggttttggtggttggaatattgtgacaaataaggtgatgatgattgtgctcgatgcaggagatattcattcacttgtgaaagggcttcttggcttaaggcccgaattgcatgttgcacaacaacttcggcgcgacaaattgaggatccaaaacagttcccaacaacacttgcaagagttctccaacaacaaccttgaacacttgtcgttacacccagggttcaacttggatctccttcaagtaagaaacgttcgaaatggcaacatgcttgacgaagctgcagcagcactttattcatcagaaatgatcactttttcgaaccctttatctgctcctagaaaccctttggagtgtcaagagcttatgatggctcagtatggttcaacttcgtttcctcattcatcatccacaaaggagcaacaatgtgaaccacgcaacttaggtgctagtgggatggtgaattataacggaagcaaccccaacaacaacaacagcaccttttactcttctgaactcaataacaatgtttctagtgaaatgggcaatagcgaaatccaaattcagaagcagtttggtgaaatacattaccctccttcgtcatcttcttcgccaccactttaccataatgctttgcaggacatggcttatggcgtttggggagggaataataataatcatggtgaatctgtgcttcattatggaaacaacgagttacgctttggtggtgctagtttatggacacataataatagtgcattgggtttcaagaagatcaataatgaacagttacatgacacgaatcatcctcatcagggtctatcattgtcactctcatcaaactcacaacaacaatcatccaagccgtgttttgaagaaaggtctgttgtgaaaccaccgtcctcccccatgaagctgaatgtgctttcaaacaacaacaacaacactgtttatcgaaatgttggtcctctcggtcctttcactggttatgccacgattttgaagagttcaaggttcttgaggccgtgccaacaactgttagatgagtggtgctgtcaatcgggttcaaaatttgcaaagagaggggtttgtgatgttccagagtgggtctctcgagatgtcagtgctgcttctacttctgctactgctcttaatgttgatgaaagtgctgctgcaaaaggtggtggcaattcgggtgcttcatcctctatgttgtatagttcaatcgaaaacaataataataataatagtaataataataataatagcgctgatggcggagccgcgagtagcttttgtctttcttctcggccagagtgccaaaagaacaaggcaaaactactgtacatgcaagaggagcataaggaaaaaaggccaaatgctttaaaacttctgcgggcaacaagaagtcatttttggtgtcggttaatgtggatgcaaagctcttga

SEQ ID NO: 47970 - DNA, 288 bp, Glycine max
  Peptide Sequence Number=SeqID_164748
atgctaaagaaaattaatccaattaccgttgaagagaataaagcttgtggtgattgcactactagtgtagtgttgatgctggcaagctcttctatggctgcaaataggatgaaattcacgcgaaaattggacgagagagaactaagtaatgaatctgatgatatatatcaccattcaatccctggaatgggtggacctggcgaacgtacagtcggtgaggaatttagtaaacattactggcatcacaatcctcacaatcaaggactaaggcacaccttaattagttga

SEQ ID NO: 47971 - DNA, 315 bp, Glycine max
  Peptide Sequence Number=SeqID_164749
atgtcatctactgtttgcaaggatcacgcccgcaagacacccagtggacccgaagaatttcaacagggtcctggggttctagctctgattacgggcctctatcggttctacggagtgtccttcacccccaacaaggtcatcaggccccctattaaccgagctttcatcacgaagtattgtgcccccaggcaggcacagggcgaggcaccacgacagcctggggacagccagcagctggcggcagactcatcgccaccacctttggaatccacctcaactcatctacaagggctagagcattgcctacgatacatg

SEQ ID NO: 47972 - DNA, 1914 bp, Glycine max
  Peptide Sequence Number=SeqID_164750
atgggaggaagggcctacttcccgagacagacaacacataagatattgaatatgattggtgcatgctcagctcaattgtcttacgaccaaaataattgtacttcaaatgaaattgggcaagggacaaggtacagttgcaagtcaacgaaggattcatgcagaacattcttggtgtatagagcaaataagcatttgaacaccatttcagaagtctcaaagctcttcaacacgaactctgatgaggtgcttctgaaaaacaacctcacacctctttctttgtttgatgaactcaaacaaggtaaagaggtgcttattcctgttaattgcacctgctctggagggtattttcaagccagtttaagctataaagtccttaacaacacgacatattccgagattgcttgtggtgtttttgaagggctgctgaaacatctcacactggctgaggaaaacatttcacaaggtaataaaccagaagctggttctgagcttcgtgtgcctctcatgtgtgcttgtcctgacagttacaatttcacaaggagcatgaaggtgaagtaccttgtcacataccccctaatactaggagatgatcctgacaaattgagtgaaaaatttggcatctcaactgaagaattctatgcagttaatagcttgaatcccttttcaacggtttatcctgatacagttgtttttgttccaataaaggatggtccaatcagaatacatgatattcctgattctccttctccacctcctggttttctttccacaaatccagtggttacgaccgaggaatccacacaatcatcgaatttgtacattgcaggatcggttataggattctttttgttcataacattgcttgctagtggattgtacatgaagagaatcaggaaaagtgatgatgtccattccattagtcaaacaaactccctcactttgtggtcaccaactagaagctctcatatatctacccaaaccggtaaaaactctactacttggtgcctttccccagatcttcttgttggaataaagtactacttactcaattacagcatggaagagctccaaaaggccaccaacaatttcagtgaagaaaacaagatcggtcacaaccggggtcgcgaaggtgactttgtctacaagggctcagtcaatgatcatgaggtgatgataaagaggatgaggttggaagacacacaacaggtgattgatttacattctaaaatcaaccacattaatattgtgaacttgcttggtgtttgttatgttggtaagagcaataaagatccatggtcttatttagtttttgagttgcctaagaatggatgcctgagggactgcttatctgatccatgcaatccaataaattggtacaaaaggacacaaatagcctttgatattgcaacatgtctttactatttacattgctgttcttttccttcctatgctcacatgaacattagtagtagaaatatattcataacagcaaattggaggggaaaactggcagacgttggaagagcattggctgctagtgtcacactcacacctaccaaaagaaatagtgtggaaattcccaaaggattggtggcaccagaatacctcttacatggcttggtttctgaaaaagtggacatttttgcatttggggttgttttgcttgagttgatctcaggaagagacaactttgatggaaaaccaatcaaagattcccttggatttttgttgggggaagccagtgaagggggttgttttgaagggttaaggagcttcatggatcctaatttgaaggattactctcttccagaggctttatgtttgtctttcttagcaaaggattgtgtggcagatgatcccctgcataggccatccatggatgatatcatgaaagtccttgcaaaaatggtgtag

SEQ ID NO: 47973 - DNA, 1044 bp, Glycine max
  misc_feature (62)..(62): n is a, c, g, or t
  Peptide Sequence Number=SeqID_164751
atgactgcgcgcgagtatcgtgctctctttgtaaacctaagagagagtggctatgaatcgtntcagatcagttgcagtgttattctaactggtggagttgattgcaatgacaagacaaatgggatggataggtcaactgaaggagattgccctgataagacaaatgggatggatagatcaactaaagaagattaccgtgagaagacaaatgggatggataggtcaactcaagaagattgccatgagaggacaaatgagaatgataggtcaactctagaagattgccatgataagacaaatgggattgattggtcaactcaagaagattgccatgagaaatcaaatgaggtggataggtcagctcaggaaggtgatgacgggggtagggacaagattgatgggtgccttaaagagaattgttttgattctgccaaggattataaggatattctgccacctgaagatgccaatggtaaagagatgagagctgagcctaagttgagtgggcctttgaaagaactattagataataatgtgactgtaaattcaattgtatcatctaatgctgcaacttgtgagccgcccagtggggcacctgaaagggttcagtctgaatcgtgcaaagaggagacattgcagaagctagggtcaagggattctatatcaaatgaaaatttgattatgaaatgtgtagagaatgataaaggtgaaaaatcgatatcttccaagagaaaaagaaatatggtggacatgcatgcaaatgcttctgctatgttggttgacaatgacaacagcaacttgattgaggatgctcacccatcaagaatatgtggcaatgttgtggagaccagcgggtcacgttccaaaaggataaggcatatctccttatcagaatcagatgtgaaaagggatgggaggaaaacggccaataatgttgatcagccttcttcaaaatcttatggtgataatttatctactaggaacaaggatgtgtttcttggaaaatatggagatttaatgagacaaggcaggtttcttggatag

SEQ ID NO: 47974 - DNA, 1753 bp, Glycine max
  Peptide Sequence Number=SeqID_164752
atgcttgctaagcagaacttgaattttgactgcaagaaagaagtagtggatgaaatcaattcaaggctctggactctgaaggaaaattttttaaaactcacaggaaactctaatgttgtcagctatccaaaagcttctgaatcatcaaatggggttttttcttatatagaagagacaacagaggttgaattagtaaaaaatgataattctaaaaatattaaaaactttcagaagcgtaaaagccagtggaacaagctacttctgatgcaacaggaagagaagcagaagttgaaaaaagatattgaaaatgaaaacgatgagttttggagaaggtaccaaatacacagggctgctattcaattatgttctcccaatgatgtaacgaaagagcaaaagctcaaggttttcaacactgaatacatgaaaataattagagaattggaaaggcagcatgaaatacgtctcaaggatcttgaggccaagcaattaaaaacaaggctgacattcccagagactttggcactggatgaattgttaaaccctgttgcttcaaacgaacctgggactaaggttgaccagacctgtgatcaagctcagcattctaatgctcctaaagcccttgtgtctgatcatgttgctgaaggagagggtttcaatgatatggttgaagtcataacaaggattggaactgggattggattatctgaagctcctgatgccaatgcctctgtagttgtaccatgcagtagcgcacttgaactgcaaactcctctggtcaaacatgctgatgctaataataaatgcaataatattgctgaaaatgaatatgatagtcaaggaaatattttctctaagcattccaattccagagaacaatgttctgatggagctattagcccgccagaggaaggtgtgtgtgtaaattatagttgtgaatctcatgattttgggcaggatgctataacccgagttctgccttcatgtaatgaagagatatgtgatgggaaaacattagatgttcaatgttctgatggagctattagctcaccagaggagggggagtgtgtaaattattgttttgaatctcatgattttgggcaggatgctataacacgagttcttccttcatgtaatgaagagatatgtgatgggaaaacattagatgttcaatgttctgatggagctattagctcgccagaggagggggagtgtgtaaattatagttgtgaatctcatgattttgggcaagatgctataacacgagttctgccttcatctaatgaagacatatgtgatgggaaaacattagatgttcccagtggagaggtggctcctacagtgtgtaacaccaccagttcaaatggtgatcatgttgaaatttcttctaggcaaggggaacttgatgggactatactgagcaatcctgtttgtggttcatcaatagaagttgaggctaatggttccaatgatggtgcaaagaatatggcccccgtgaattctcaatcatctgaagaagatatcccaagtgtaaataccatgtccacatcaaattgtgagaatgctgcacaaatccatgaggctgatgacaataatggttcaaaaaatgctgaaactctgaactcatctttgtctgatgaaagaatttcctcattgaattcaaaatcacctcaaggccatgtccgtaatgaaaatgccatgtgcatgcaaaattgtgaaaattttgcacagagccttgaggatgatgacagcaatg

SEQ ID NO: 47975 - DNA, 2184 bp, Glycine max
  Peptide Sequence Number=SeqID_164753
atggatcaaatatctaatggaggtccattattagatggagatttatcaccagggccttgtacttctagcccaagcaatggtcggaccctacctgatgaacaaattcctgtcttggagccagaaaatagcaataaagtggctgaatgtcaattaacagacagtgtggtggtgaataaaaatgccatatctgaccagctggaaggagtatgtagaactatgacagaaaacagtttatccctggagactccagtatcaagaccagttgatgatctcatggagcctctagaacaagtgcattcattatcatctgtagagtctccacctgacccggatactgctagagaaatgaagaacactttggtatctagtcctgttgatattgtaccagctaatcaatccattaatgattcactggtcatggagcctccagagcaggaggcgcaattaccttctgctggtttcctttcttccaaccaggacctatctaatttgcctttggtgactggaactgaagaccagccatccaatgaagatgatctccccaaccacattcctgagatgccaattgagattcaaaatcaagttgtgcaacatgcctcaaattcagaccggcaggaaggagtgtgtagaaccatgacagaaaacagtttgtccctagagactccagtatctagaccagttgatgatctcatggtgcctctagaacaagtgcagccattatcatctgtagagtctcctcctgatcgggatactgctagagaaatgcagaacattttggtatctagttctgttgatattgtaccagccaatcaatccatgaatgattcactggtcatggagcctccagagcaggaggggcaattaccttctgctggtatcctttcttccaaccaggacctagctaacttgcctttggtgactggaactgaagaccagccatcgaatgaagatggtctccccaaccacattcccgagacatcaattgagattcaaaaccaagctgttgtgcagtgtgcctcaaatgtggaacttgactcatgttctcgtcaagttgtacatccagcctcaaatatggaccttgattcacttcttcctggtggagtcagactacagtcttcagacacaagaaatttgtcaactctcacagagattaataaccatcctatacaacctgctagccaatcagcttccaggattattcgacatttgtgccttgatccacttaccaatgaattggaaagactacgaatactgacagatcaaaatatgaaagaatatgaaaacaagaaattgcagttgaaatatgattttgagaaggaactcgaggaactttacaggaagtatgacattaaacgtaaggaggttgaggttgaatttcagaatataaggaagaacctggatacacaacataatatagttcttgtaaataagatattggctgaggctttcagggctaaatccatggatcttaaagtatctggtgcttcaagaatgcagcaagatgcaagtgttccacagcaactatttcagcttgcaagtcagcaaaatgccactcggccctgtctggtcggtccatcatcttgtgggcctcctgcagacagcatgcagagttcctacgctacaactacctctcagactatggtatcaccaatacaggccacttacagtacaccaggaactttctccagtgtttctccaagggtacctcatatcaactccctttcttcacctttgggaaatgctcaaactgctggggagatacgtgcccctgcaccacatctccagccttatagacccccaacatccatcccagcctccagtccctgtacagttccgcatgggaggccaagtcagcctgcacctggtaatattcctgtaacttctcccccattttctcaccggacaccctggtcaatgccggcaaactttcagtctgttcctcatagggggcattggcttgtaagtacaggtgggctatccacacctaatttatcttccgtgaattcttgcgctgatgctaacagtcaacctggtataaatctgccaaatgttcggccacatatgccagatttgcctacattgatgaacttgtacctatccaaatttagtggtaatagcacaccagctaactcggcacatccagctacatcacctgatgtagtctgtttatcagatgatgaatga

SEQ ID NO: 47976 - DNA, 875 bp, Glycine max
  Peptide Sequence Number=SeqID_164754
ccttgcaacaagtcctagggaagtagacacggagatggataagaagatccgcagtattgtgagtagcattctgaaaaatgcttctgtccctgatgctgataaagatgttccaacatcttccaccccaaatgctgaagtcctctcttcatccagtaaagaggaatcaacagaggaagaggatcaagccacagaggagaccccagcaccaagggcaccagaacctgctccaggtgacctcattgacctagaagaagtagaatctgatgaggaacccattgccaacaagttggcacctggcattgcagaaagattacaaagcagaaagggaaaaacccccattactaggtctggacgaatcaaaactatggcacagaagaagagcactccaatcactcctaccacatccagatggagcaaagttgcaatcccttccaagaagaggaaagaaatttcctcatctgattctgatgatgatgtcgaactagatgttcccgacatcaagagagtgaagaaatcaggggaaaaagaactgggaagagatgccttggattgcaaggagaccatggacctcatcaaggcagcaggactgctgaagactgtcaccaagttgggagattgctatgaaaagtctagaaaatgtgttagattctcccctgctgtgatcaacaaatacctgggcagaccaacagatggagtggtggacattactgtttctgagcatcaaattgccaaggaaatcactgccaaacaaatccagcattggccaaagaaagggaagctgtctgcagggaagctaagtgtgaaatatgcaatcctgcacaggattggagctgcaaactgggtacccactaatcatacatccactgttgccacag

SEQ ID NO: 47977 - DNA, 291 bp, Glycine max
  Peptide Sequence Number=SeqID_164755
atggcagtgacagtggggcgcttccagttgttgtcaccgcagagggctaccagaaataccggcggtgtagtagatgaggacaaagatcatgccatcgaaggcccatgcgaagccgagaaggtcaatgccgtcgcatggtccggtttgttttttgtggccaatgacgatggcgatggtgacgtagaggaagaaaagtgtggcgataaactcgacaatgagggctctgtagaaggactatatagcttaatctcgaccaagttgatgaggggggctggtggagagtctacgtag

SEQ ID NO: 47978 - DNA, 312 bp, Glycine max
  Peptide Sequence Number=SeqID_164756
atggcttgtaggactagggtcccaagccttttaagttctttaacaattggttggtgcatcctggttatgtggggctcctggcgccgactgcttgtcttagagttctggaggaaagtgcgggcaaggaaagtgtgttggctcagaagttgcaagttaggtggatcagggaagagaaaggtctcggaggtactccttagtgggtctccaggtgggtggagcataggtgaaggatgtgaaggaggtgaagggaaaggtcgtgtgacatttttagtccttgtttacaaagccgatggaggagaggcatgtgcttga

SEQ ID NO: 47979 - DNA, 492 bp, Glycine max
  Peptide Sequence Number=SeqID_164757
ttagctttttcgcctggccggtgcattttggatgttgtggttgtggctaatgagttcctggacttagtgaagcggagtaaaagagagtgtttcatgttcaagattgattttgagaaggcatatgattcaggggacccgttggccccatttcttttcttgatggtggtgaaagggttacaaggtttggtcaagaaggcaagggaaataggagattttaggagtcttaggttaagcccaacgttggagttttctttgcttcagtatgttgatgattcgattatcataagggagcattgttatgtgtgtagggctaaagcgaatgaagggttaggggtgaagaacttagcagcttctaatgctagcccagtttgggtggcttggtggcaggatttcatgaggattgatgtaggggacgattggttttctagtaaggaggttaatgtaggggaaatgtcagtggagaccaacgatcatggggtagtgtggagttag

SEQ ID NO: 47980 - DNA, 677 bp, Glycine max
  Peptide Sequence Number=SeqID_164758
atgatgataaacaaaacgctttttctcacttatgtctacttgttcatctacatcctgctttcttccggcgtcattttgtacaacaagaaatcgaagtggtattttactaccattcacacattgtgttcaatgcgtgaacaaccaactgagctagaccctttgtgggttctgtcgccgaaatacttcaactttccccttcccataacgctcacgatgattcacatggccttttctggggcagtcgcgtttttccttgttcgggtctttaagattgtgactcctgtcaaaatgacatttgaaatatatgcaacttgtgtggtaccaataagtgctttctttgcatctagtctttggtttggtaacacggcctacttgcacatctctgtggcttttatccagatgctcaaagctctgatgccggtggcaactttcattatggctgttttctgcggtactgacaaagcaaggtgtgatgtgttcttgaacatgttgctggtcagtgttggggttgtcatctcctcatatggggaaattcattttaatatagttggtacagtttaccaggtcacaggcatatttgcagaagctttaagactgggtcttaacgcaagtcttctgcagaaaaaggggttgactctaaatcctattacaagcttatattacatagctccatgcag

SEQ ID NO: 47981 - DNA, 579 bp, Glycine max
  Peptide Sequence Number=SeqID_164759
atggctgagaacaagcatttgaaggatttgcaaaaagaaattcgtacacattcagatgatattcgccatcttggtcaaacgatggatatgcgttaccaagagaaaaatgataagatgcttcagatccaaaattctatgggtcaaattcagttagcgatgaatctgttattacggaatgcttctcaacctcctgaaagttctccaaacaatggctccccgatggtgcaaccaattaatgcttctttgcctgttaaagagatctcacttggatttcctcacttcaatggaacaacaccagtgatggagtggatcttcaaggcggaaaattttttcacatatcataatactcctgatgcgtctagagtggatattgcggcaatgcattttgataaggatgtagtggcatggttccagatgttgcagaaattatctctggtgtctacttggtctgagttgactcatgctctagagtctcaattcagtccttcaccttttgattgtctaatggttgagctcttcaagtttcaacaaacaggttcggtatcagcttattacctcaaagtttatgtctctagctaa

SEQ ID NO: 47982 - DNA, 201 bp, Glycine max
  Peptide Sequence Number=SeqID_164760
atgatgatcgcggcacactcctcggtcgtatgccggcaacagaatcacctgagagaaaggggtaaggtgagagaaaggaataacagggagaaggatcaagctctcaacagagaagaagtagagaacagaagaagggaatcacctcagaataatcctacaatgtgtaatcctccatccttatattccccctccttaacctag

SEQ ID NO: 47983 - DNA, 534 bp, Glycine max
  Peptide Sequence Number=SeqID_164761
atggattctgaaggattggagaatgggattgaagagttgaaattgaaggaagagaagggtaatgcacatgcacagccacagggtcaattgcagatcactaccttttctgaactcgtcaatgatgttaacctccattttcaaatcattcgctttcccaaacagatatatgtttggattggttacaactctgcaaaattgggacacatgtatgcagcagcttctactcgtcctaacaatatggtatctgtcacttccatacttggaggggtttctgataatacagggtctggcattgctcatcgattagtgttaaagactggtctcaacataattttggcttgcagtattccaaaaaatagccccattcttgagcacagggaagttatgctccttccaaatgattttcttactgctatacgttatactgaagtcaacttctcaaaacaaaaaagtgatatcctcagggaaatatatctaagaatttatattgttgttcaaactttctacttggagaggggggcatcagaaaattaa

SEQ ID NO: 47984 - DNA, 398 bp, Glycine max
  Peptide Sequence Number=SeqID_164762
gactctgccagtcgttcggagtccccgtcgcacctagcaaggtgattcggccgcccatcacccgagcttttattgagaagtattgcacacagagacaggcccagggggatgctccgcaggacgtagacgcgccgccacctcatcaggctgctccagccgaatcgtttgatacggagcagtatttgcggcatttggttcgccagcaggcggccaaccactgggctcttgcacttctctctctttcgaatttgcttggaaaaattgtttccgtgaagaaaatctatgccgaggcgcttccgaaacgtttccgtaacattttccgtgaggaatttcgcaaaggtttcgaccgttcttcgacgttcttcgttcgttcttcatcgttcttcgatcttcaacgg

SEQ ID NO: 47985 - DNA, 636 bp, Glycine max
  Peptide Sequence Number=SeqID_164763
atgatgaagaaagagttaaaaaaatcattgaaagtagagctatctcatattgcatcacatcagtcagcccctattaaggcgccagaaatacaagctctacttgggcgtgttagcacaaagggtagctgcgctggacctgaaggaagcggattacttaaagagcttttgagtggtggtgacgatctgatgggcttgttcgtagttgttggggaaaatactgtgtttgcgggcttgggaaaagtgtttgagaattcatccaccatacataatgttcattatgaaaatgatgttgttaaggttcaggttgtcagaacatacatgcctcatgctgaggtccctattcctacatcagaggttcattatcttgagcagaccgttggcacattcgtcgcatggccgacccatcttgttagggaagtaactaatgaggtggtcgtaggactcgataagcctccatcaaagtctgttggagagccgaacaggttaacatctgtggccacagatgacccactgggagaattggttaagaagtcatatgtggtttacacaaagccaatggagttggcatgggacggggcgaaatttgggttacctaatgcctcaaatggttttttcatcacacatgtttatgaatga

SEQ ID NO: 47986 - DNA, 216 bp, Glycine max
  Peptide Sequence Number=SeqID_164764
atgggggcatacgcaaaagatgaggaactattgatacatttcttccaagaaagtcttactggggtagctgttacctgcatcagtgcaattctgatatggctccggataggatgcaactacagaaagaaaaatggtggggtacgcgccttcaagctttgcaaatttggtcttcgccagagaaaggatcgaagtgggtctgaaaagaggcaaacttaa

SEQ ID NO: 47987 - DNA, 261 bp, Glycine max
  Peptide Sequence Number=SeqID_164765
atgagttgtacatgttcgctaagtgcactgctttatctctctaagcgcaccgcttcagttcatccgctaagtgagaaaggcgcgctaagccaaaaatcactaacgtgcgttaagcggtccatacggagtttggactgggattcagagctttgcatgtctagggtttctagagagagaaaggtccaagttccaaggagttttgagagattttgctgtgtgaagatttgcagagaccagagcttgaagcaagagccgatttga

SEQ ID NO: 47988 - DNA, 240 bp, Glycine max
  Peptide Sequence Number=SeqID_164766
atggtagactttgggcttgtagcaagtgtcaggtcgattttgggattgaatgttggtgttgggctattttcaggattgaatgttggtgtcgagtcgactccgccctcacctaatggtgttggactcgattattggtgcagggctttgactgctggtgctgggtcaattatgggctttgactattggtgtcgggtcgatttcgagcttggttgttggtgttgggtcgattctgggctttga

SEQ ID NO: 47989 - DNA, 1077 bp, Glycine max
  Peptide Sequence Number=SeqID_164767
atggtgactttattccatgacatgatgcataaggaggttgaagtttacgtggatgacatgatcgcaaagtcaaaaaagcggcttaggaagttcaaattgaggcttaatccagccaaatgtacttttggcgtcaaatttggcaaattgttaggtttcatcgtcagccaaagaggaattgaagtggatgttggcaaagcttatgcaatcttggaattgttgccctctcacatggaaaaggagattcgtggtttcttgggaagcatgggcaagtcattgcttaaggcagtatatgctgagtcacacaaattgcctgctcttacaggaaggattgctcattggcaagttcttttatcagaatatgacattgtatatgtgacacaaaaagtagttaaagatagtgctctagtagattatctagcacaccaacctgttgaagattatcagtcaatgcaatgtgaattcctcaatgaaggcataatggtgttgtttgacaatgaagattcgtcaaaagaaagaggatggatcatgtggtttgatggtgcttccaacatcacgggccacgggataggagttatattaccctccccagagaaaaagtatatcccaatcacagctaggctatgctttaatggtaccaacaatatagccaagtatgaggcatgcactttggggttacaagtggctgtggaatcaaaaataaaaaaacttgaggtttatgcacttgccactttatcatccatgttcgcattgaacaaggatgaggacatgccacttataaagatccaacgtcatgatcagcttgcatattttcacttggtagaagaagaatttgatgggaaaccatggtacttcgacatcaaagattatatcaagattcgagagtatcatccaaatgcctcaaagaatgacaaaagaacattgagaagactagaaatgagatttttcctaaacgtggaagtgttgtataagaaaaatcatgatatggtgttgctcagatgcgtagatgtcattgaagcgcaaaagatcatcagagaagtttgttggacaaatggcctcagttatcttaagaaagggtga

SEQ ID NO: 47990 - DNA, 618 bp, Glycine max
  Peptide Sequence Number=SeqID_164768
atggtttaccagttaggtctcaaggaagttggaatcacattcaacaaggttgacatgtacaagtctttgatgaagaattcttctacctatattgttgttgttacaaaagcaaagggaagtgagtgctttggtattggacatttgatgttggagcacaagcttttgggctatgtggttgcttggattatcactctcaaggggagcaatcatgctcaattgatagaggaggatcttctccttagttgtctcatgcacgggaaattgaagattaattgggtcaacattattattgataacatgatgaagaccaagatgattaggtcttttatgtgtccctatgcaatgttgatctcaagaatccttgattacttcggagttgatacccaagaagaagtctttgcttttgttgaagttgaatttaagaaaaacaaagaggatcaaacaacacaacaagatctagaggagaagcctatgagccccttggagcagatgatgctagccaagagggacaagctcttgaggatgcataaggaggactatattgagcttaaggagtgctttgaaactatctatggaaggttggatgttataggagcaccatatgtggatgatatctaa

SEQ ID NO: 47991 - DNA, 1596 bp, Glycine max
  Peptide Sequence Number=SeqID_164769
atgaggggcataacttacaccttaaagaaagccaagacttcaaacagatcctacaggaccttatggatatgctatcgatgcaaattgttcgaacatccaaaacccttagtgatacatcatacaaaatgcactactagctcggcctctagtgtaccaaagcccatcactgtacaagttttgaaaggttttccttacaaggataataaagtagtgccttggagatatgaagtcaaagtgtgtgttgatggttctgatgaaaaacaatccaagaatgacagctcagaagctaccaatgttacaaatattgctgggattggtagtatgattcggagttgccgaatctatagtcctagtgaatcaaggactgaaccatctaaagaaacaaatggtaaagaagttgtgaggagtctagatgaagaaaggaaagaaatttctgatgaagaggcttgcaaattcttgaagcttataaaacaaagtgaatacacaatgatggaccaactcaaccgaacccttgccaaaatatcacttttgtccctgatgttgaactctgaaccccataggaaagtattgttgaagatattgaatgaggcttatgtcgttcatgacatctctgatgagaaatttgaaggtattgtgggtaatgtcaccgtaagcaattaccttacattcactgatgaggagatgccaacaaaaggagcaaggcataataaagccctacatatatttgagaaatgcatggaccatgtcttggtaagagttctagttgataatggttcctcgttgaatgtcatgccaaagacaacattggcaaaactaccgtctaatgagtcatacatgaagccaagcactatggtagtacgcgcttttgattggtctcatagagaagtgattgggaaaataagtctgcctatccagattagtctaattacctttgaggtagtatttcatgtgatggacattgcgccatcatatagttgtcttctaggaaggccttggattcattgtgcaagagcggtgccttctactttgcaccagaaatggaaattgattgttgatgacaaactggtcattatttttgttgaggaggatctactagtcagggtccccatccgcgatatacaagagagcttttggagtgttgggtttgagtttcctaactcgatagctgttgtagaggaagacatttctgaaaacaagtccttcaacttagttcacgcttgtccaccaaacgtcaagctcaacaattggaagattatcgagctccctgtagttgtgaatttgaatttaaattttaaaaatgacacgcttgaaattgacaatgctactatcacatccggtggttttgattgtctcgataatcaatcagatgaagaaagcgaagatgaaaagggtatttcttcaacattattaagagaggttaaagctggcatattaataagcgaaaatgagtgcaacaagttgataatgctcttacatgaatataataatgtgtttgcttggtcataccgagatatgcctggacttgatgtcaacatagtggagcataagttgccactaaagccaaaatgtcttccagtcaaacagaagttaaggtga

SEQ ID NO: 47992 - DNA, 789 bp, Glycine max
  Peptide Sequence Number=SeqID_164770
atgcggcgcgttcagcctggcgacagcggcagcgaggatcaggcgtcttatgattacaacagccgaaaacaaagcctgatgatcaacgatctgcgccgttacggcattcaaacgctactggtggaggactatcggcaaatcaccgacctgctatatgccatcgaaacgcaattcaagaaaagcacggtgtttatctccggcagcgccgacaactaccacccctatgcccgtgaagagtccatccagttcatacaccgcctggcgcgcctgcttatccgcaaacagtaccgcatcgtcaacggcttcggttggggcgtgggcacggcggtgatcaacggcgcattggaagccatttacgccagcggggggaaaatcagcgaaagccagctggtgctgcgccctttcccccaattcgccagcgggggcattacgctgccggcactttggcacgagtaccgccagaacatgatttcgctcagcggcatcgcggtctttttgttcggcaacaagcgtaacgccgaaggcgaatgcgtgctggccgacggtttattgaaagagttccacatcgctgcggaacaaggctgcgtctgcattcctatcggttgtaccggcggcgcatccgccgagatctaccgaaaaatcaaggaggagatgaaagacaccctctatcaccgccatcccgtcgccatgaacctgctggatcaacttaacgagccgggcagcctggcggagaagaaaacatgcctgttggcacttatcgatatcattactaaggataatcctcgatga

SEQ ID NO: 47993 - DNA, 597 bp, Glycine max
  Peptide Sequence Number=SeqID_164771
atgacacagacgacggccaatcaacatccccgagatcgcatgcgcgggcgcatcgaccgcggcgtgcaggcggcagtgaccgccagcgggctgatggtgctgatgacgttgatgctgatcttcgtttatctgctgtttgcggtgctgccgctgttcaaaccggcctcgcttgggcaggcgcagccgttgccgatcgcggcgtcggccccggcgctggcgctgggcatggacgtgcagcagcgcgtcggttaccgcattgacgcgcagggcgcggggcaattttatcgcctgacgccgaccccgaacggccagccccaggcgccgctggcgcagcagacgctgttggccaagccggcgctgctcgcgcaggccgccggagagcgcgatctgtttgcgctggcgcaggccgacggccgcttggtggtggcgcgcgcggatttcgcgacggcggagaccggccggccgcagtggctgttcccgctcgggcagcagccgttggcgctggatccacagcgcaagccgctgaaactgctgtcgctggcggatgcgcatcgcgggcagtatctgctggccggggtgaccgacgatcggcgcctg

SEQ ID NO: 47994 - DNA, 393 bp, Glycine max
  Peptide Sequence Number=SeqID_164772
cgtgactcaaaagtcaatatgacagatcttgtgagcgcggaagatgacacagcaaaagtttatacggataaccactcgggtatttccgcccgtcagcgtgactcaatagagagtatgacagatcttgtgggcgcagaagatgacgtatatctccgcgtgtcaacgggcttttcgtcttacagacagcaaaaagtttatacggataaccactcgggtatttccgcccgtctgcgtcactcaaaagtcagtatgacagatcttgtgagcgcggaagatgacggcacagaagacgacgttagtctctgcgtgctattagccttttcgtcttacagacagcaaaatgtttatacggataaccactcgggtatttccgcccgtcagcgtgactcaaaa

SEQ ID NO: 47995 - DNA, 405 bp, Glycine max
  Peptide Sequence Number=SeqID_164773
atgccatgtcaccatttgatagatgaacaaggaaataccaaaaaggtttcgctaacaaaaccaagtgtatttgtgatgcctcgtggtgaacgtctagtcgtgccatttgatagtcaactaagagtctatggagaagcagctacacttctttcatcagcttgtggacgtattgccatggattcaaaaaacatcccaaataactttgatagttggtcaaatgttccaaaatcatacaaggatggttgctttaatattgtaaagtggtcttcattcgttgattatcatctaagaccagaatataaggaagtaaatcttggacgtgctgtgggtcgaggagaactgtacattgcgactcacaagaagaaaaatggatcatatgtcaatgaggaggcaaggtctattggg

SEQ ID NO: 47996 - DNA, 1218 bp, Glycine max
  Peptide Sequence Number=SeqID_164774
atgtcttcccaaaagtccagttcaaacggattattcggtcacgacgtccatggtagttctgaaaaccgtagggatatcaatattggtcgtagaagtagtagtggatggactattcgggtcaatgaagatgcaactaagttgcatcctcaaaggcggttggtcctccatgagatagggactattcctcttgttaatacaaattctagagttcgatcgcaggtcgatggtgctgggatagatatgatcaccaatttagaactccacgaggcacccaactcaatgtattttgttacctttatgctccttggcatgctaacaccttctaaggattgttgggataatctctttgccattgacaagggtgagagtggtgagcgatttaagtctcacttcgagctttactcgtcccctactcattataatgaatcagtcaattattatgggaaacaagaggaggagttatccttggaagagctcaccactgtgaattctattgttaagttggtcaacgagatcagggatgatattccttccatagggaaatcaatgaagaagcctatgttgcttgccactctttttgctgctagtggtggcgataagaagaaatcttcgagaaggaagcctctcccatccaaaaaagggaagagttctactactgagatctgctctagggcttttcacgacatgccttatcctcctttgaagaggaaaaaggagattgatcgtcttattttgtttgagaattgggatattgttctaaaaaacaatcataccagcttagattctaccatatcaatcttggtaggggtgaaagagtatctcacccatgtgagtcaattgactgagaagcttgttgaagctgaattagttagggatgagtggcatgagaatttcaaaaaacttgtcaaggattctttcaataattctttgagacaaatcgagtacatccatcctaaggttgatattaaaacatctctttgcaatcctcgttgtgaagtcgttgatgggcaattctatgtttgggtcgatggtaaactttgcttgagtcatcttgggggccttggtattgtgaatgatgattttgtaggactacaaattgtcgttctagagtcccctgatgaagaaatggctgataggtttattaagaccctaaagaccaatgctgatgatagaggtgtgagagcttctaacattgaaactgaccttgaaggatcttaa

SEQ ID NO: 47997 - DNA, 1293 bp, Glycine max
  Peptide Sequence Number=SeqID_164775
atggcggaatggcgctgcagaattttggaaaaacgccaccaaatagaggtggcgttgcgggttgcttatggaagcgctatggcgcggcacgaccagcaacagtctccagcgcgacgaacgacggcgcgggcatcggcaacgcacacgacaatcgcagatgacgttctcgagcgcgatggcagcagaccagcagacgatgcacgcgagagaccgacgaccaaggcacgagacatgcgaccgccgcatgacgcacgacacacgtcgacggcgacgacagtgctctggatgtcgatagagcagaaagatcaaggcggccaagaagacttggaacttcctttctttgatcttgctaccataattactgccactaataacttttcaattaacaataaactcggtgaaggtggttttgggccagtatacaagggtttattagtagatgaacaagaaattgcaatcaagaggctttcaagaagttcaggacaaggattgaaggaatttaggaatgaagttatattgtgtgctaaacttcaacaccgaaatcttgttaaggttcttggttattgcattgaaggagaagagaaaataaaggaaagactaatcaacctatattggataatcttgacagattctgttgaaagtaaatttttagactggccaatgcgtttcaacattttgaatgcaattgctcgggggcttctttatcttcaccatgattctagattgaggatcatacacagagatctgaaagcaagcaatattttattagacaatgatatgaatccaaaaatatcagattttggccttgctagattgtgtggaagtgatcaagttgaagggagtacaagcatcatagcaggaacacatggttacatggcccctgaatatgccattgatggattattctctataaaatcggatgtattcagctttggagtattattgctagaaattgttagtggaaagaaaaacaaaggactcacctaccaagatcacgatcataatcttattggtcatgtgttcaatgtcaaggatcactcattcaacctttgcaacaacttcctcagtgcataccattaccaggctgccaacaacatccatgacgattttttagtaagggctccaagacaagtcaaatacttggtggtagcagccaactatttcaccaagtgggaagaggcaaaaacacttgctaccataacatctaagaacattgagaactttgtgttcagtcaagtcgatagtaaactggattatcctgcaaggcctaaagaaaagggtaaaataggctaa

SEQ ID NO: 47998 - DNA, 144 bp, Glycine max
  Peptide Sequence Number=SeqID_164776
atgtctaagtgccccaactgtggggtatcaaggtacaaagtgaaggatgacgactgtagtaatgatgaaagcacaaagaaagacccctccaacaaagatcttttgatctccatgcttagtcaaacatccacaccaaaattgtga

SEQ ID NO: 47999 - DNA, 1470 bp, Glycine max
  Peptide Sequence Number=SeqID_164777
atggccattcctcttgtaatcctacttatttgcaagctattatcactcttctctcaaatctgctacgcaacgacggacaccatcaccaagggtcagccactccctgatgatggcaacaccttgctttccaaggacggaacctttgagttgggtttcttcaaccccgggagttcaaataaccgctatgtcggaatttggtacaaaaacattgtggtcaaaacagtggtttggatcgccaaccgtgacaacccaatcagaaacaactcaagcaagttggtcataagccaagacggaaacctcgttcttcttagccagaacgagtctcttatttggacaacaaatgcatcatcatcagaagtttcgagttcgagtccaattgtgcagctcttggatactggaaacttggtaattaaagatggtaatgacaaagagagtgtttttctgtggcaaagctttgactatccttgtgacacactattgccaggaatgaagtttgggtgggacttgagaactgggcttaaccggcgtcttacttcttggaaaagctgggatgatccatcttcaggggactttacttggggggtggaaataggaagcaatcctgacattgtgatgtggaagggtaacgttgagtactttaggacggggccttatactgggaacatgttcagtggagtatatgggcccaggaataacccactttatgattacaagttcgtcaataacaaagacgaagtgtattaccaatacaccctcaagaatagttcggtgattactatgattgttatgaaccaaacactttatcttcgtcaccgccttacatggattcccgaggccaaatcttggactgtttaccaatcattgccacgagatagttgcgacgtttacaacacttgtggtcccaatggaaattgcatcattgctgggtctccaatttgccagtgcttagatgggttcgagccgaaatcgccccaacaatggaacgtgatggattggaggcaagggtgtgtgcgcagtgaagagtggagttgtggggtaaaaaataaagatggttttcggagatttgctagcatgaaattgccaaacactacgttttcttgggttaatgaaagtatgacacttgaggagtgcagggcaaaatgtttggaaaattgttcgtgcaaggcctattcaaacttggacacgaggggaggaggtaatgggtgttccatttgggttggtgacctagttgatttaagagttatagaaagtgggcaagatttgtatgttcgaatggccacttcggacatggatggtaaacacgagcatcggagaaaggtagtcttggtggtttcaactatagcatcgttggtgcttgtgatgctagtagcattctgcatttacatgatcaaaaaaatatataaaggtaaatttcttggccaaaacacctttttacttcacaaagattataaacatctacagacacagtga

SEQ ID NO: 48000 - DNA, 501 bp, Glycine max
  Peptide Sequence Number=SeqID_164778
atggacatgaaattggggtatattatctcaagtcagatttctatgattgcacaacatgactcctcgaggctgggtttccctaccctcatcactgctttatgcaaagctcggggagtcacttctgattcattatcttttgagagtctcaatccagccattaatttggcttatgtgaagaaaaactgttggaacctcgatgacctctcgagattacagagctcgagcctacagcctatgatgagcgtggaggagttccttagccaggtggcttggccaggagtccagccttctccttcgggagggggtgaggcctccgcagcccaagagcttgtgccagagaaggacgagcccacccctcctgagccattcatttatgagccaatagcagagattgctcaggaggaggtagcatcaccagagcttgttcctcagtctcacccatcaccagctccagtccttgaagacccagagtcatctacaccagcaccagtgcctgactag

SEQ ID NO: 48001 - DNA, 1002 bp, Glycine max
  Peptide Sequence Number=SeqID_164779
atgtcaagagaggataaagacgaaggcagacaagaagatttggagcttcctttctttgatcttgctacaatagttaatgccactaataatttttcaatcgaaaataagctaggtgaaggtggttttggtcctgtatacaagggtacattagtaaatggacaagaaattgcaatcaaaaggctttcacgaagttcaggacaaggattgaaagaatttagaaatgaagttatattgtgtgccaaattacaacaccgaaatcttgtcaaggttttgggctattgcattcaaggagaggagaaaatgttactttatgaatacatgcccaacaaaagtctcgatttatttctttttgattcggagcaaagtaaattcttaaattggccagtgcgctttaacattttgaatgcgattgctcggggacttctttatctccatcaggattctagattaaggatcatacacagagatctaaaggcaaattttggccttgcaagaatgtgtggaagtgatcaagttgaagggagtacaagcatcatagttgggacacacggttacatggcacctgaatatgccattgatggattattctctacaaaatcagatgtgttcagctttggagttttattgctagaaattattagtggaaagaaaaacagagcatttacctaccaagacaacgatcataatcttattgatcatgcatggagactgtggaaagagggtactccagagcgattgactgatgcacatttggcaaactcatgtaatatatctgaagtcatacggtgcattcaaattagtcttctgtgtctacaacatcatccagatgataggccaaacatgacatcagttgttgtgatgttgaccagtgaaaatgctttacacgaacctaaggaacctggttttttaattagaagagtttcaaacgaaggagaacaatcttctaataggcagacatcttcattcaatgaagtatctatctcacttttaaatgctagataa

SEQ ID NO: 48002 - DNA, 828 bp, Glycine max
  Peptide Sequence Number=SeqID_164780
atggctttccctggtggtgccttgcttggatgcagcgcaggcctggtgaatgtgcctaaaatcaagggcacgcattacgccatgaagtctggcatgctggccgcagaatctgtgttcgaggctgtgcagcagggcgcacctgagttattgaccagttacccgcaaaaaatgcgtacctcctggatatggcaagatttaacggcagtacgcaatgtgaaaccctatttatcacgctggggcacctgggtaggtaccgtattgggcggcatcgaaatgtggttgtccggttggggtatcaccatgccctggacgctcaagcacaccaccgcagatcatgccacgttggcagaagctaaacaaagccgccagccaagttatgccaagccggatggtgtactgacatttgataaactcagttcggtcagcctgtgcaatattggccatgatgaccaacagccatgccatttgaaattgtctgtggctgatattcctgagcgggtgaatttgcctaaatatgccggccctgaacagcgttattgcccggcaggagtctatgagtttgttgagcaggcgggcaaggaagtgttgcagattaatgcgcaaaactgcattcactgcaagacttgcgatattaaggatccgacgcagaatattacttgggttccgcctgaaggcagtcgatggccgagaactcccgccaaccctgcgttgctcggcgcgtcagagggggaccccgaacaccatgcgagcgcaaccgtcatttgtttcaacaacagaattagagttttaaaccgtccatatttctgcgatgtgagtttggcgagataa

SEQ ID NO: 48003 - DNA, 489 bp, Glycine max
  Peptide Sequence Number=SeqID_164781
atgaccaaacaaacttcaggcctcactcatttcaacgcacagggccacgcccacatggtcgatatcggcgacaaagcccataccaaacgtgtcgccattgccgaaggtcgtatcgagatgcaagcagccaccttacaaaccatcctgcaaggcaacgccaaaaaaggcgacgtgctaggtatcgcccgcattgccgcgatccaggccagcaaaaaaaccagcgacctgattccgctctgccacccgcttagcctaagccgcgtcgatgtcagttttatggcagatgaaacgcaacacagcattacctgccgtgtgcaatgtgaaaccaccgggcagaccggagtagaaatggaagcgttaactgctgtgcaagttggcctgctgacgatttacgatatgtgtaaggcgattgatagagggatgaccatacaaggggtgagagtgttggagaaacatggtgggaagagtggggactgggtagcagattaa

SEQ ID NO: 48004 - DNA, 330 bp, Glycine max
  Peptide Sequence Number=SeqID_164782
atgattttcacccctttctctctctataacttcacccaaaccctagaaacccctcctccacaacccatgaccaccggtgaccgccacgagccgtcgcggcttgtcgctggaccaccacatggagaggaaaactttagccagagcaaaatcttcaaaactcaactcaaggattcaatagagaatggagcctcgaatcctcccttcgcagtttcttcgagtgacctattggatatccctggagagggaaggggatcgcttagaattttaactatccacggtcattgcattgatggtgcctatgtttcatacttcataattgcatggaaatga

SEQ ID NO: 48005 - DNA, 303 bp, Glycine max
  Peptide Sequence Number=SeqID_164783
tccatgatgattggatgtggaattacctggatgttggggaagcttgggaggattgatggggacccggtgttgagagaaacgaggatatgggctacgtgggagtacgtgagctcagttggaggtgggcaacaggggatggaagtgttgaagggtgaaacttcctgcttttattcgttgaccacagagtggtacctgaagatatgtcgcgggggtcaggagaccttggggacgtcaggtggggtgctattgcccaaaaccaagcttgaccaatcccgacccaacccgggcatagtcagtcagtga

SEQ ID NO: 48006 - DNA, 219 bp, Glycine max
  Peptide Sequence Number=SeqID_164784
atggtgcaaaagaaggacaaggaacttagaggaagtagcaacgagcccatcggcggctaccataggtggttgaaagcctatgcacaagctgttaggatccgaaaagagaatgccgaattgagagacgtcaacctagacaccaccaaggccttggagcaggagaccaagagggcccgcaaggaagaacatggctggaacatgttccgaggggctttgtga

SEQ ID NO: 48007 - DNA, 1191 bp, Glycine max
  Peptide Sequence Number=SeqID_164785
atgcttgctgaaaaaagtgcggcctccgcgcagccgggcgtcgccgtgaccgccaatctgcgctgggcctttatcctggtcaccagcctgttcttcatgtgggggctgtcctatggcctgctggacgtattaaacaaacattttcaggagacgttgcacgtcaccaaggcgcaatcagggctgctgcaggcggcctatttcggcgcctatttcctggtggcgctgcccgccgggtactttatggaccgcaagggctataaggcgggcattctggtcgggctgtgcctgtatgcgctgggggcgctgctgttcgtgccggcggcatcggccaacagcttcggcgtgttcctgtttgcgctgttcgttatcgccagcggcctgggctgcctggaaacggccgccaacccgtacgccacggtgctgggcgacgcgcagggcgccgaacggcggctcaacctggcccagtcgttcaacggcctcgggcagtttatcggcccgctgatcggcggcacgctgttcttctccgccagccagtccgccggcggcggcgatcagagcgcggtgaagatgacctatgtggcgatcgccgtgctggtgctgctgatcgcgctgttgttcagccgcacccggctgccggcgatccgtgaagaggagaaaccggtgcacggcgtgatagcgcagggcttatggcagcatccgcatttcgtcggcggggtgatcacgcagttcttctacgtggcggcgcaggtgggcgtgggggcgttcttcatcaactacgccaccgaacactggcgcgatgtgtctaaccagagcgcctcttacctgctgtcgatcgccatgatctgctttatggtcgggcgcttcttcagcacctggctgatggggcgagtcaaaccggcgacgctgctggcggcctatgcgctgatcaacatcgcgctgtgcggcgtggtgatgctgagtgtcgacggggtgtcggtggtggcgctgatcgcggtgttcttctttatgtcgatcatgttcccgaccattttcgccctgggggtgaaaaaactgggtaaacacaccaagcgcgccagctcctttatgatcatggcgatcgtcggcggcgccatcatgccgtactttatgggggcgctggccgaccgttacagcaccgcgctctcttatctgttgccgctgctgtgcttcgcg

SEQ ID NO: 48008 - DNA, 267 bp, Glycine max
  Peptide Sequence Number=SeqID_164786
atgactaatgcaaactgtccgcaagagtcattgcattcagtctcaaacgggaatctaaggtttgacactgcacaaactcttgtgtcaaggttccttcaggtttcttcttttttcaaggacgaggatgagagccccgtcgagtctgatgaaacaaaagtccaaagttggagtttttattcagcatatttgtggagcttttgcagggttgtagggaaaacgatggcagtggtggtggtttgctcttacttactcgatatggaagcatag

SEQ ID NO: 48009 - DNA, 273 bp, Glycine max
  Peptide Sequence Number=SeqID_164787
atgggtagcctggccaaggacttggccttctcttcacaaggaagacgaagatcacgctgcttagccacctctgaaaagtctcttgaagccactctagagcctccgacaccagcggcatataccacttctccgcagcaggcagtagacccttccactcctgaggatcaaaccaccctagtccagtctccgaacgcctctcctgtagctactcctgtacttcatttgtcgaaagaggaggaggttcagacacaggacacccaggaccaatcatag

SEQ ID NO: 48010 - DNA, 354 bp, Glycine max
  Peptide Sequence Number=SeqID_164788
atgcaacaactattgcttgttgcgattcacggaatcttgcctatcaaagttagggttgctataacccgtttgtgctttctgtttaatgttatctgtagcaaagtcattgaacctcgacaattggatgatttgcagaatgaggcttccattgtcctttgtcaattggagatgtattttcctccatcattttttgacataatggttcacttaattgttcatcttgtgagggagatccagttgtgtggtctggtggtaaagggttataccaaccagaagcttccattgttgaaagtgaaacttgtcgggcttctcgaaactcatcatgaccggacacgagaaggtaagggtacatga

SEQ ID NO: 48011 - DNA, 342 bp, Glycine max
  Peptide Sequence Number=SeqID_164789
atgcgaacatgctttagtaaagagacaaaacttccaactgatcagagcaacatatgctttttggatgaaaaacaatgtgtttatcggggaaggagacatttcgtttttaaacgaccatttagaggaaacactgggtccaacaaagataggagagaattactcaaagtgtatcaatctcacacaggattgacattctcaccctgggtcaaggtttatgataagttgggattttggctcaaggcttgtagaacggctggtcatgatatatgtcagggtttggccaacggttcggggataaaggggatgtcctacattatttccatgatacacatgcaacaatga

SEQ ID NO: 48012 - DNA, 1146 bp, Glycine max
  Peptide Sequence Number=SeqID_164790
atgtggttttcaactctgcagcttgctcatctagcagagatggaggtgaaacatagatgtaatcaagtactggaactcggctttccattaggtggactagccaaactgtttgctcaagactgggagggtgatgtaacagttgttatgcctgcaactcctgcccaaaacccttcttatgtagagcttcaaaaggcagctaaccaaggcagaagatgcacctgggagaagctttcggccatgaaagcaaattgtggaattgagcttgctcttgatgagtctgttgcaattctcaatcatatgagacgactcaaaagaaatgctgagagaactgctgctgcttctcatggtcttcccagtacaggcaaatttagtggttcaagaagaattccatcgtggaacatcattgcacgagagaattctacaggctccctagaagaccttcatgctgctgctgctgctacttcctcattgcatcaaggtgttattagtcccagtggagccactggtaaaaattggaagtcccaccgtagctttcatgatgcaagtgacagtgaatctgaaagtgctcatgacttgaattcttggaccagatctggtgggcctttgatgagaactacatcagcagatatgttcattgactttttccagaacatagaagttgataccgaactaaatagaggcaaggtgacaaacactaccactagccctcgtgattttcagcatcacatttcaaggcacacaacacctgatcataataggtggtgctctaagagaacagaaatcgatcagaaagaaaatggcaacaggatgattgccatgaatggatctaacataatggtaactgaaggtgatcttttacagcctgaaaggatccataatgggattgtgtttaatgttgtcaagaaacaagactttttgaccccttcaaataggaataatgattataatagttgttgtaacaatgaagttgctgaatgtgtacaaattgaatttccagggaaggaggtggatgctcttagttcagcttccgaaaatggcgatgatggttccacaatggccaggtccctaactgaaaaaccagattataattcaacaaatcatttcagcaaagattttggtgaagatcaaagcattgctgacaattaa

SEQ ID NO: 48013 - DNA, 1422 bp, Glycine max
  Peptide Sequence Number=SeqID_164791
atggatcatataaataacgaggctagtgttgacccttttgcgattggcccttctagcattcttggtagaacaattgctttcagggttctcttctgcaagtctatctcacaattgaggcatcatatacattttgtgttgttggatatcttgaaaagattttggggattttggggacccattgtgtcatggttgcatccaagaaacccgcaggggatattggcaatgatgacaataattgctgtcttgttgaaacgttacagcagtgtgaaggtgagggccgagatagcatataggcagaatttttggagaaatatgatgcgagctgcattgacctatgaggagtgggctcatgcagccaagatgattgatagagagacaccaaagatgaatgaatcaaaagacctttatgatgtggagttggtgagtaacaagcttcaagagcttcgccatcgcaggcaagaggggtctcttagagatataatattttgtatgcgtgcagatcttgttaggaatctaggtaatatgtgtaatccagagctacacaaaggtaggcttcagatgccaagactaatcaaggagtatattgatgaggtatcaactcaattgagaatggtttgcaactctgattcagaggagcttgcattggaagaaaagctttctttcatgcatgaaactagacacgcatttgggaggactgctttgttgttaagtggaggtgcttcccttggagcttttcatgttggtgtggttaaaacactggttgaacataaacttttgcctaggataattgctggttcaagtgtaggatccattatgtgttctattgttgccactaggtcttggcctgagctccaaagcttttttgaggattcattgcactcattacagttttttgatcaaatgggtgggatttttacagttgtgaagagggtaacaacatatggtgcagttcatgagatcagacagttgcaaatgttgttgaggaatctaacaagcaatcttacatttcaagaagcatatgacatgacgggtcgaattctcggaattacagtttgctccccgagaaagcatgaaccacccagatgtcttaactacttgacttcacctcatgttgttatatggagcgcagtcactgcttcttgtgcctttcctggccttttcgaggctcaggaattgatggcaaaggatagaagtggagagattgttccttaccatccaccatttaatttgggtcctgaaaagggttccacttcagtgcgccgttggagggatggtagcttggagatggatttgcctatgatgcaattgaaagagctcttcaatgtcaatcattttatagttagtcaggccaatcctcacattgccccattattgagattcaaagaaattatccgagcttatggaggtaattttgcagcaaag

SEQ ID NO: 48014 - DNA, 849 bp, Glycine max
  Peptide Sequence Number=SeqID_164792
atgaagaggattcctcctaggattcctctcagttcatttcaaagacagcatggcaccggtatcaagagaactttcatcttcgaaacatccttccggagaggaacatggagcttgctcccgtccaacgtttatgattcggaggatggatctccaaagatgtgcattgtacgcgggatgacgattcggtttgacgcggagactttgaacgagtttttggggacaccaatcaccatcgctaagggggagcaactgaccatgtacgcccaatacctccactcataccaagattatgaggccatcatggccaagctgtgcacccctggaggcgctccttcctctcatacatcagacattaatgtcaactgggctcgcctaatctatgcgctcgtgatgaagatgaacatagacatgggtagcatcatttcacaacagattactcagatagcccagcccaaagaactgctagaatctagcagattcttctatcacttttctaggtctgaggtgagttcaagcctgcactactcaggatgcaccaccgccaccaccgtcgccagtcatcctgcctccagctgcgcctttttctgtcggcccttcttcctcctcctcagcccagtaggagcctctcacctagatgatgcaatgtatctatcatggccagcgcctaatcatcgagaacatgcatcagttgtctctccacctcaccatagatcctccattgatgacgccagaggacttcatccaatgagtgtcgtcggagatgctgcagatgtcagagatgacattgaatatgttgtagatcttacaacagctcaaggcgagtgggacccatggcccacacaggattga

SEQ ID NO: 48015 - DNA, 480 bp, Glycine max
  Peptide Sequence Number=SeqID_164793
atgaagattttttctcgtttggcattaccgctaaccaagttgacccgaaaaggtcaagaattcgtgtggaacgaggcttacaagacgagtttccaagagttgaataagaggttggcttttgcaccaatcttgattttgcctgatcccgagaaaaagtttgaagtgtactgcgatgcatcaggacaaggacttggctgcgttttgatgacgagtcataattatgacacaatttgggtgattgtggatcgattaacaaagtcatcccattttattcctatcaacatgaagtacaagttcgagaagctcaccaaactgtacatcaaggaggttgtcaagttgcatggagtaccttctagcattgtatccgacaaagatttgcactttacttcaagattttggaagagtctacaaaaagctatgggaatgaagttgaagcttagttcaacttatcatctgcaagccgatggacaaatggaatag

SEQ ID NO: 48016 - DNA, 597 bp, Glycine max
  Peptide Sequence Number=SeqID_164794
atgaggattccattggcgatgccgccgccactggaggttggggcgataacgggagtaattctaatagcgtgtcgacgtcagggagcttgccatcgtgggaacagagtacggttgtgttgccacaattgcggttgcagaacggagaatcatcatcgaaagtttaatgttttcaatagagcttgggtaggatatgtatttggtggtgatgagattctaagagacgaggcagtggcaaggctttatgagcttgggaaggtgagtgatgctagcggttatttggagaggacattcttgagtcctgcatccatgagggcaatcaatcttattcgtaaatggatggaggatgctgttgggggtaccaaatgggaaatgtacatggcttttcatttgccggtggaattgaagcacagggcttactgggccttcagacgattgaacttttatgaatcctcatctggtgagaaacggagattgcagctactaaagctagaagatatgacattaaacgcctatgaatcagccaggatctacaagcagaagataaaggcataccattacatgaagctgcaaaagaagaattttcagcctggccagtag

SEQ ID NO: 48017 - DNA, 225 bp, Glycine max
  Peptide Sequence Number=SeqID_164795
atgagggggtttggcactttagcagctcgccctagtgagctgttgcttctacctgaagtaaccttgctcacccagggagctggttacttcacccctaagtcttttgggggcccaagcgagccagaggctagcctaggcgagccagggttcaaaaaaatgcctaaaatgacctttttgcccctccccttgggtatttttgcattcttgatcaaaacatttgaatga

SEQ ID NO: 48018 - DNA, 471 bp, Glycine max
  Peptide Sequence Number=SeqID_164796
atggcagagttctgcctagtgcctgacgtcgttatccctccgaagttcaaggtgccgaactttgataagtacaaggggacttcttgccccaagaatcacctgaaaatgatgcagctacagagcatgtgtaaaaaagagaatgaatctttcaaagaatatgcccaaaggtggagggatctggcagctcaagtagcgcccccaacgacagaaaaggagatgataacaatgatagtggacatgttaccggtgttctactatcagaagatggtgggttatacaccttcaagctttgccgatttagttttcaccggcgaaaggatcgaagtgggtcggagaagaggaaaaattgattatcctgctttgatgaatgggaagcctggggaaaatggagagaataagaaggagggaggaacccatgctattattgccattcctacacagccaaatttcccaccagctcaacaatgttaa

SEQ ID NO: 48019 - DNA, 186 bp, Glycine max
  Peptide Sequence Number=SeqID_164797
atgcatcaccaaaagaggaaaactctagatgaggcttcactgttatcaagcgagtcggagacccagcatgaccacagatcgacctccactccttatggctcacatagacccaggcaatttgtgaagttctgtgacatgccggaactcaaaaggaagcatcgttgcacaattcgtgaggttacgtaa

SEQ ID NO: 48020 - DNA, 144 bp, Glycine max
  Peptide Sequence Number=SeqID_164798
atgtcacaaaactttacggattacgcaaccatcccctctttgacttctggaatgttacgggactttacggattacgcaataatgcttgctttcgactcccgacatgtcgtggaacttcacggattgcctaacgatgggtgtcaa

SEQ ID NO: 48021 - DNA, 195 bp, Glycine max
  Peptide Sequence Number=SeqID_164799
atggtttccgaagcttccgaggctttgaatattttcgaagcagggttgcttcctctggaagcaagaggaagcaacccagctctcctgggcgagctgggtggcaacctcctccccctttttcctataaataggcgaaaggggctgttccaaatattcctaacccccgtggctatgcatttcagctgttttgggtga

SEQ ID NO: 48022 - DNA, 399 bp, Glycine max
  Peptide Sequence Number=SeqID_164800
atgcgtaaccctctaaaggcgagggtgtgcatccctctgaagtcaaagatatgtcgccctttgaagtcgagggcgtgcagccctctaaaggtgaggacgtgtagccctctaaaggcgagggcgtgtagccctcagaaggagaggacgtgtagtcctctgaaggtgagggcatgtagccctatgaaggcgagcacgtgcagcccaatgaaggagaggacatgtagtcctctaaaggtgagggcgtgcagccctttgaaggtgaggacgtgtagtcttctaaacgcgaggacgtgtagtcctctaaaggtgaggacgtgctgccctctcaagacgaaggcgtgtagccctgtgaaggtgagaccgtgtgtagaagtaagcttcatgatgaatcaagattga

SEQ ID NO: 48023 - DNA, 444 bp, Glycine max
  Peptide Sequence Number=SeqID_164801
atggctcaattgatttctgatgccatccactatttgccgggatcgtgcccacaagacacccataaggtcatcaggcctcctgctaaccaagctttcatcaagaagtattgcgcccccaggcaggcgcatggcgagacacaacagcagccagggaatggccaacagcgggcaacagatgcaccgtcgccacctccagagcccctcagcccatctacaaaggctggagcattgcctacgacccgtggccgactagcaggcgaccaagtccaaagccaaagctccctgcgaagtggtctaggaagggcaccattaaagaggattctagtgtgtccccacaagctgacacaggctttgacaaacaccaattctggagcgtggaacatcaatagcatttcgaggccatcaaaggatactcattcctcagacagagacaggggcagctga

SEQ ID NO: 48024 - DNA, 789 bp, Glycine max
  Peptide Sequence Number=SeqID_164802
atgaagaaccaggatttaaatgcttggaaggatgcacttgagcaggattgtaccacaagagattcattggtgtctggttggtgcctgggattgcacaaacatgttgatacattggcaaatgggagaaacaggctttacatattgatagacaacctgagagctacttcgttgttagttgatgaagggcaaagagatttggttgtggcgcttgatgtgtgttttatccgtgaaattcctgagattttagaatgtcccaagttaaagatactccaacttaatagtcaagacatagccattattggggaaatcacaagtctagatattctcaaccttgaaaaatctgagcttagagagctccttgtagaaattggaggattgagtaatctacggttgctagatttaacttattgctcaacactaggagtgattcctcacaacttgatatcgagcttgacaagcttggaagagctctacatgggaaacaataatgttcaagagaaggtcaagagaagcaaaagccaaagcatgggttcatgtttaagtgagttaaggcatttgaatcaactaacaactttgaacatgcagatagaagatacttcagattttctgagagactatcttggctatgggagactagaaagctacaagattttgattggggatggatggaaatggtctggggtggagtctgggaattatgtaacttcaagacttcttaagctgaatttgggtgcggatctaggcattgtaatggattatgggataaagatgttgatggcaaaagcttaa

SEQ ID NO: 48025 - DNA, 2553 bp, Glycine max
  Peptide Sequence Number=SeqID_164803
atgacattgacttttaggctcacatccttaacaacattgcttttcctatgtatgttttgcgtgaatgcaactacctacaaagaatatctgtggatggatcaatcactgggaacctcagacaccattctttctcgcagtgggaacttcgaactcgggtttttcccggcagtcagagagaactccaccaactactatataggcatatggaataaaaagggtggaagtgacaaaaacaagattatgtgggttgcaaatagagactatgcagttcaagcatcttcagcagctcttactattcaagaaactgaaggaaatattataatcatagatagacaaatgacgtaccacgtgagccagatttcaaacaattctattacctatgccaagctcttggattccggaaacttgttactgctgaacaacttcacccaagagattttgtggcagagttttgattatcctacggatacccttttacccggaatgaacctagggtatgatactgactcaggttacacttggtcattgagctcatggaaaagtgcagacgaccctgccccgggagctttttccctcaagtatgattttggcagggccactctaatcatcaacaacggttctaacgtgttctggattgatgaccgttccaatgatactattgacaatgttattagccgaagtggtgtgcataaagaaagatacaggagatatttcacttggccagttgattataactctatgctggtgctagaagtgtctggggagctgaaccagaaatattggtcagaggaagaaaaaggttggatttctattcagtcatcaaagtgtggaaccaacaatttgtgtggagctttttccatttgtaaccctcaagctcttgacccttgtgactgtctccatggtttcaagccctttgatgctaattcctggagtaaagggatcaaatccgctggctgtgtcaggaaaaaagagttatcctgccgtaacggtgttcattccaatgatgtattcatgccactcaacaaaacgcaattaccatcaactttgaagggagacagcaagataaagattgatacggaaagagggtgtgaaagtgcttgttctagaaagtgttcttgtgttgcttatgcttataatttgaatggttactgccacttgtggcttggtcagatattgaatctaaagaacatctcaacatatgtggacaattctgataataccaatccaatttttaacctcagacttgatgcctcagaattggttcccgctgattcaaacacagccaatgccaaagaaccagcaaatgattttcgcaaacatgaaaactggctgaggatacttctgattgttatactgatcacacttctaacgtttcttatatttggcctatttgtttactggattagaaagcaaaggaggaaaggggaagatttgctacattttaatgtgagcatgagcatgaaagctgaagattctgaacttactgaagcaaggagagcaaaagttaagaagaaggaagtcaaattgccattattcagttttgtgagtgttgcagcagcaactaataatttttcagatgataataaacttggtgagggtggctttggacctgtatacaagggcatattattgaatggggatgaggttgcagtaaaaaggctatcgcgaagatctggtcaaggatgggaagagctgagaaatgaagccttattaattgcaaaactccaacacaacaatcttgttagacttctagggtgctgcattgatcaagaagaaaagatgcttatttatgaatttatgcctaatagaagcttggatgtttttctctttgatgcaacaaaaagaaggatgctagattggggatcacgagttaggataattgatggaattgcccaaggagtcctttatcttcaccaatattccaggttccggatcattcaccgagatttaaaagctagcaacatattgttagacaccaacatgaatcctaaaatatcagattttggaatggcaagaatatttggtgagaatgaacttcaagcaagtacaaaaagaatagttggaacatatggatacatgtccccagaatatgcaatggaaggtgttttctcaataaaatcagacgtgtttagctttggggttcttttgttggagattataagtggcaagaagaatactagcttttatcaaacaaattccttatgtcttcttggatatgcttgggatctatggacaaacaattccgtaatggacctaatggatccgacattggatgatagtgatagcactagtagtcgaaatcatacagtgccaagatatgtgaacataggacttctctgtgttcaagaaagtccagcagataggccaaccatgtctgatgctgtatcaatgattgggaatgacaatgtggcccttccttctcctaaaccacctgcatttctaaatgtgagagtttttactagcaggggaattcgaacccatgacctttccctcagtcccttctccttttactaccaaaccaaccttataactcccgatagcatgcactgttaa

SEQ ID NO: 48026 - DNA, 306 bp, Glycine max
  Peptide Sequence Number=SeqID_164804
atgcgggtttacatcgaagaaaatcctccccatctggtttccctaggaagactttatgaggggtccacaaccattcacaacatgcctttgcaccatgatcaactcaaggttggtgttgatgaggttaaagatgcaaatgctcccgttcctatacccactgacgaggaagttgtgggaccagcaaaacctgcagataggccggattatgaggtggatgatcccctatatttgatgacattgactatcccacaactttttttgaagtcgttgcagtgcacattggcaaatggtcatcattttgcctaa

SEQ ID NO: 48027 - DNA, 819 bp, Glycine max
  Peptide Sequence Number=SeqID_164805
atggtagaaccatcaaagaagcgaaagggggcttcaacctctaccgcggccactggaactcaacgccatggagcctctggagcacagccagcatcaattcctccttctatatcatcttctatgttgttctcctcgaaagaacaacatatccgtcatgatgcccgtcggatggtttgcaccaaccaggtggatatgaccggtagattacttgtcggatcattggcctttgaataccgcatcatgcactacttgattgtgcaaatcctccttccccgatcatctaatcttgctcaggtctctaaggaagacctgatagttatttggtttttcttaatcggtcgtcaaatcgaatgggcccatcttgtcagatatcgtatgcataaggcattgcgatcaaacgctcctcttccttatccccatttgatcactctatttttgcgtcattttaatgttcctcttgactctgagccctttgttcaagtcaagagatctttttctatcggtgctggtgtggtttcctcctttagataccgtaaagagagggatggttcttgggtgaagaaggacgctcagccacagacagcagatgatcgctctccttctcctcctcctcagagggatgactcttcatcccttatgaaaaatgttctagacaagttagatggtctccacacctttgtcggtgagcgttttgactccttggacagtcgcattgatgccattgatgcatggtttgcaggaatggatacacgcatcactcagcttgaggaggatgtgagtttcatccgtcagtgcttcgaccttccacctccgccttga

SEQ ID NO: 48028 - DNA, 135 bp, Glycine max
  Peptide Sequence Number=SeqID_164806
atgggcatatttgtgcagtctatgctccatgccgaggtgttatccttcctattggctgtggatagaccattgatgaaatccatggagatgtcactccaactttggattagaataggcaatggctacaagagactg

SEQ ID NO: 48029 - DNA, 207 bp, Glycine max
  Peptide Sequence Number=SeqID_164807
atgaaggtagctgtaagcaatggagggaatgcactagctatggcgtggaatgagagtgagacaaagcagtgcaaactgaaattgtacggatatgcacgaaaaagcaaggtaggtctatttaggtttctctccttgggatgtttcagtgcgctttgggcaaacaatttgagtcattggagacattctggtccaaatgcacctgattga

SEQ ID NO: 48030 - DNA, 165 bp, Glycine max
  Peptide Sequence Number=SeqID_164808
atggctacagccaggtgggcactcaagcatcccgtttatggcattgtgatactacggttgggaatttacacagacagacccaacgtttccaagaaaacgttcctaaatgagaaattctacgcgattccagaatttcaacagacactattgacaacaacgaaataa

SEQ ID NO: 48031 - DNA, 213 bp, Glycine max
  Peptide Sequence Number=SeqID_164809
atggcgtgctttggcgggtctaactctcctaatactttagccttccattgttattgtacgttattacctctacatcttctgcttattgcaccgtatattttttacgcagcactctgtgccagtgacaacagacgatggcgtactcctaaggcttccattgatgttagcgcttctaagggttccgttgtcgcccagagaacatctatcatctga

SEQ ID NO: 48032 - DNA, 216 bp, Glycine max
  Peptide Sequence Number=SeqID_164810
atggcttcaaaatcatccgctgacttaacgaatacaagtagcagttttgattcatcaacagctacaagcaaggctttgtttcgtgcatgcactgtgtgttttgcagggactgttgtttcaacatggatttgccaaatactcgtaggctacaaacgcatcacagattccacgactaacttagcacatccacaatttaaaaggaaaagagtgcagtga

SEQ ID NO: 48033 - DNA, 186 bp, Glycine max
  Peptide Sequence Number=SeqID_164811
atgaatcgggggacagagaagacgacatacgaaattatcttggagatgaaaaaagaagacgcgtatccgatgtccgtgtcgttgtcgatatttgatagctaccctaagaagttcaagagcacaagcattggccactgcagaaacaagttggggaccagagatatatcagggcctaatggtccctga

SEQ ID NO: 48034 - DNA, 804 bp, Glycine max
  Peptide Sequence Number=SeqID_164812
atgggcatggtcagcgtgaagatcgaccatccggtcacgcactgcctgcatctggcgcgcgagatcgaacaaaagtttggcctgacgctgtgccgcgtggtgccgtcagccgggctggatgatgaggcgattcagcaaatgttggcggttgaaggtgcggcggtgatggcgcagtttatcaacgaagagacgccgcaggtgtttggcatcggttccggcaaaacgctgcgctcaatgattgatgcgctgccgtgggttgaacggccacagcatcagtgtgtgtcgatgatcggcgcgattgcgcgtgacgattccggtacccgctacgacgtaccgctgaaaatggcggagaagatgcagggcaaatatttcttcattccggcgccgctgtatgctgacacgccgcaggataagacgatgtgggtgcagcatcaggtctatcagcgcgtcacccagcgtgcgctgcaggcgaacgtggcgtttgtcggcattggcgaagtgatgccgggctgcccgctcaatgccgaaggctttatcaccgatgcgcaggtagaagcgctcaacgcgcgcggcgtggtgggtgagatgctggggcattttttcaatcagcagggagagcgggtgtacggcgaaaccgatgagctgctgaccagcgtgctgctggagagccagacgcagcgcaatatcatcggctttgccggcagcgcgcgcaaatacgcagcgattcacgccgcgctgcacggcggctggatctccgggctggtgacggatgaagacaccgcgctgaaactgctgcatgattaa

SEQ ID NO: 48035 - DNA, 654 bp, Glycine max
  Peptide Sequence Number=SeqID_164813
atgacgacgaaatcagtgtggatgcatatcggcgcaggctcttttcaccgcgcgcatcaggcgtggtatctgcaccagctgcgccagcagggcgatgacagctggagcatcgcgctcggcaacatccgcggcgatgcggtagcgctgctcaaccagctgcaggcgcaaaacggcgagtacgtactggaaaccgtgacgccggagggcgagcgcgcgtatgaaaccattacttcgttgcgcaccatcctgccatgggacgcggagatcagtgcgctggtggcacagggcgccagcgctgagacaaaagtgatcggttttaccgtgaccgaagccggttattacctgacgccggcgcatgaactcgatctcagccaggcggatattcaggccgatctccgtggtgaggcgcgcactatttacggcgcgctgacccgcattctgcgccagcgcgtggccagcggcggtgcgccggtcacgttgctcaactgcgacaacatgcgtcacaacggcgaacgtttccgtcacggcatgctggcgtttctcgccgcgcagggcgaccgcgcgctggccagctgggtgcgcgataacaccacttcgccaaacaccatggtggatcgcatcacgccgcgccccacgccggatgtcgccgaacgc

SEQ ID NO: 48036 - DNA, 542 bp, Glycine max
  Peptide Sequence Number=SeqID_164814
atggctacaccacccagctctcctcctcctcttcctcctactggtgtagcatcacagttgccatctaccttgaagcgcacaagaaacgtcacacggctaaaatcattggcgactagaccaattggggcagagagatcactggtccatgtcgatcctgcgaccgggaaggtcggcaatccccacaataagaagttaagaacatatttagggatcgccgctcgtgataaggtcgatgtcacatacgagaattggaagcaagtccctgctgctcagaaagatttgatatgggaggatattcaggatgtgcggaaaaaaacacaagccatccagaagcaaaacactgccccccatgtgttgtctcatcggggttatgaatatttacaaaagaagctgatggatgagaagacaaagaaaaaactggaggaagctgctcaatccggaagcactgacaccctgattgatcctctttctcccatcagacgacacgtcaaatggaagatggcccgcacgaagaaaactggccagatgacgtctaaggcaac

SEQ ID NO: 48037 - DNA, 270 bp, Glycine max
  Peptide Sequence Number=SeqID_164815
atgaagacccctaatgtccaacaagatcatatctttctaaaggcttttcctcattctctagagggagtggcaaaagattggctatactatagtgctcccagctgtcctcaccgccagatttctgagcaactccttcttcaatatttctatgagggacttagcaacatggagaggagtatgattgatgctgccagtggtggagttcttggtgatatgacccctactgaggctaggaatttgactgagaagatggcttccaactcccaataa

SEQ ID NO: 48038 - DNA, 177 bp, Glycine max
  Peptide Sequence Number=SeqID_164816
atgccccaaccacatgggatcaacatgggcttaaaggagcactcaaaccgagtatctttacccccaaggcctagactccgaagaatccgtttgggtctcaccttcctgattcagccaattcaattatccaacaatccctacacctatgaatttcatgacaagaaatcacccatgtga

SEQ ID NO: 48039 - DNA, 195 bp, Glycine max
  Peptide Sequence Number=SeqID_164817
atggtttggaaagagaatcaaggtctgatacgcatgtgcaagaaggaaacaacgacacatccttggaccaagaaaaaggtagagaagggtactactataccatgtgttatgcttatgctacccaggaatcctagggggattccgattccaccatccctcgtgataggtgggcacacgttgcaaatgatatattga

SEQ ID NO: 48040 - DNA, 510 bp, Glycine max
  Peptide Sequence Number=SeqID_164818
atgtccaaaaatgaagagtttggaaactgtactactgaaccagatgatatagagtttgcaaacgtgttcacttttctggccttgctcttcaatgatttgatatgctccgccagcgatgttcaaattcttaagaacaacgggatcaacaaagatgagttgggtatgagtaatcacgaggtggtggatttttttggttccatagctaacggagttgatcgtgaccatgttgattcgggtttcagaaacatcgttgatgccttgaacacttattcagcaacaatttttttcacgcgatttcccataattgcgtgtcatgatttgagccgaataactgaatggatttacggccttgaaaggtttttaaggcgtggttacaactttgcagcagcgttgataactcttgtcactgttgttcagacttgctatgcaatcctcagctatcattatccacacgaggatggcaacaacaaccagtttaacagcacccagattcatgctaaaataaattaa

SEQ ID NO: 48041 - DNA, 245 bp, Glycine max
  Peptide Sequence Number=SeqID_164819
ccaagggagagagaggagaagcagtcgacaaggtggaaaaggtggtcagtgttatcaaagacgttgcatttggtgctggagtgccacatcgcacaaacacgtgtaactccttagcatgggagacacgtagaattgcactcgctaatcaagggagcagtcgtcgctactcatcacgcgacggaggtgctcgccggcacggagggtttgggccatgtcttgcatcgttgactgaatgctgtagtcag

SEQ ID NO: 48042 - DNA, 678 bp, Glycine max
  Peptide Sequence Number=SeqID_164820
atggctggtgccaccaaaaattggcttacgttttcgttgactcccatggaaacgcagttcggtccatacgacatcaccactccctctcactgcttcaacgacaacaacttttatgggtgggcgaattcaaagggtgtgatggattcacagagtgagacccaacaacttgcggtgccgaaaatggaagatttttacttcggtgatcaccagcaagatctgaaggcgattgttcctgggttcaaagcgctctctgggaccaactcggtggatgactcggcccccaacaagacgacgactcgggttgcgcccgctgagttgactggtgctcactcaggcgagtcttgcaaaggatctgctttgtcgttatgcgatgttgctgcaaatggttctgatgatagtaatgataataaggccattgttgcggtggggtttgatactcggaagaaggttgcggttcagttgtcatttattgaaattgaggtcatggtcgtcatgaattttggccagcaccgatggacgggcagatatgaagcgcatctatgggataacagctgtaggcgagagggtcaggccaggaaagggcgtcaaggtggttatgacaaggaagataaggctgcgagggcttatgatttagcagctctaaagtactggggaccaaaagcaaccactaactttcct

SEQ ID NO: 48043 - DNA, 327 bp, Glycine max
  Peptide Sequence Number=SeqID_164821
atgggttggaataaaactggccaagaatgcatgcaagatcagaacttgttgaggattggcaatgaaaaacggtttcaattaagagagagaaaaaaaaaaagaaaaaggaaaaataagcgtagaagtgaagatgagttgagtggagagcaaggtgttgagttgcaaggggtgggtttagcggtttcagctgccaaccggcaacaaaactgtctgaaaagaaagaaggttgcgaaagatgcgggctggcggaaaattgaagaatttggcatggctcattgcaattaccaaaatgatctcactcttgtttcaggaaaaattattaattaa

SEQ ID NO: 48044 - DNA, 558 bp, Glycine max
  Peptide Sequence Number=SeqID_164822
atgctttcacctaattcatctgatccttacggttgtaatctatgctcaccacacgagatctttttccttcccatccctttcactttccatcctccaccggtctacaccgtttactctcctttcctcttttccattgtcatcatcaccgccacaacgaccttggtttcgtggcaaccaccgccatcacctattacatcctttacggaaagtgcgtctccaccatggactttttttgtgagatcgaaacccttggggacacagtcacgcagaatgagaatattgtgcgtcttggactttgatggcggtcgtgccctttgccaacgactatcgtatctcgtcggagtcgtatgtttacatggcaatagacttgtcgctccgccggaggcgttttacagagaagttttgtcagcaatgaggttgaggatcgtgccaaggatacaaaggaggacctccttggtggcttttggcagtgcggaagggaaactgacggcggcgacaacggtgtcgtcggggacgagattttcatctgcggtggatgacgatgacgaaacaatttaa

SEQ ID NO: 48045 - DNA, 1014 bp, Glycine max
  Peptide Sequence Number=SeqID_164823
atgcaaggagaattaccatatgtgcacaacattcttagatattgcttttacaagtttacaatttctgtttctgtagagaacttgcttggaaaaggtggtcatgctgaagtctacaaaggatacttagcagatggtcaagttgtagcagtaaagaggataatgaggaatgaaaaagaagccgaggacagagctggtgatttcttgacagaacttggaatcattgctcacattaaccaccccaatgcaacacgcttgattgggtttgggatcgacaatggtctctactttgttctacaattggccccacatggcagcctttcctctttgctctttggttctgaatgtttggagtggaagataaggtttaaagtagctgttggggttgcaaaaggattgcagtatctccaccacgattgcccaagaagaatcattcacagagacatcaaagcctcaaacattttactcaacgaaaataatgaagctgagatttcagattttggtttggcaaagtggctcgcagataagtgcgaccaccatgttgtgttcccaatagaaggcacattcgggtatttggctccagagtactttatgcatggaattgttgacgagaagactgatgtttttgcatttggggttttgttactggaactcataacaggtcgtcgtgcagttgattcaaatagtagggaaagtcttgtgaaatgggccaaaccactgctggatgcaaagttgatcgaagaaatagtagaccccagattagaagataaatatgatctcgcagaaatgaagtgtgtcatggcaacggcttccttgtgtatccatcacatgtcctctaagcggccatacatgaatcaggttgtgcagctactaaaaggggaaaaggtgcctaatgaactcaatcaaaattcatcagctccaagatcactcttgatagatgcatgtgacctagaagattatacttgctctaattatttgaacgacctcaatcggcacaagcaattactcatggagtga

SEQ ID NO: 48046 - DNA, 591 bp, Glycine max
  Peptide Sequence Number=SeqID_164824
atggttctatttccttctgtgagaaggtatggttgtgttgaggaagtggatgatggacaaagatacactagggtgttgtgggcagagaggttcgaagaacctaggggaaataacgagtggggtcggtgtacgatatatccgtatgtagtgattgctcccgactgtcattcacatgatttctacgacaaccaagacctaggaggattggtggcagtgattgggtcctatggagtggagaattcacccttgcaaccactaatttcagggggaggtcatggagcatcaatggaggatgccccatgttccactaatcaccatagaggcaaatgcttcatatcactaccccggttcttcgggcacgatgtcaatgagaaggctactagatctaccttctgtcaggacacggccattgaatgttacgaggatgtgggagattttagtgatgttgaggatcttgcaccgttcaagattgcctacagtcgagatgttatcggtgaagagatacttgagggagagatgctttcatctgacaagaaacacgattccttaggagatgagagcgacccttctgaagatatgactttgccctag

SEQ ID NO: 48047 - DNA, 594 bp, Glycine max
  Peptide Sequence Number=SeqID_164825
atggagagaatagagaggaggagcaagagggaggaaatgaaagagaagaaatggagccgaaagattgagttaacgttgatgacgatgggtggccagaaccagaagaaagaggtggttgcctgtgacgacgacgtattggcatcgccgagggatgtgtttggggttcctatttcggggacggattcagacagcacggggagcagcaactacggcggtgggccggggtcgccgggcctgggccagaaccaggcagcccaggctcagagccagcagtggagggcgatgattgatgttttgaggttcaagtccgttaggagattctcgacgatcccgttgctcgcagcgagctacgagatctcgaggaagagcctgaggaacaagttggcgcgtattcggcctgcgaatgaagacgatgacttcgatggcggtattaacattgatggcatttccactaagccttcttggaggaacttcagttacgctgaccttgccgttgccacggacgatttcagccctgggatgaggccaaattatgtgtctctagcaacagagaatgacagcaaactgattctgagacctaccattaaattataa

SEQ ID NO: 48048 - DNA, 411 bp, Glycine max
  Peptide Sequence Number=SeqID_164826
atgaaggttaattcttcaaaggaagactgcaaagaaagctctagggatgacgaagatgtagagaatttaagcttgatggtgaagaagtttggaaaatttctcaaaagatccaaagatagaaaattctctaaaccttcaaagattatagagagcaacaacaacacattcacatgtttcaaatgtggaaagcaaggtcacatcaaatttaaatgtcctatctaccttagaaaacaacttgttgaaaagaaaggaaagaaggatagaaaacagaaaaaggcctacatagcttgggaagacaatgcatccacatcctctgactcttctagtgaagaaattgttgcaaatatatgcttgatgggagattcaatgaataactcctcaaccattgaagaaactgagtggttgctctag

SEQ ID NO: 48049 - DNA, 1623 bp, Glycine max
  Peptide Sequence Number=SeqID_164827
atggggaagccacaagttcacaatttacaggaaaaggttaaggaactggcaacttgccagagtgaaatcaaggccttaagggcaactgaagctaaaaaggacaaggccatagaagagctgagaaatgaagtcggtaagctggacgataaacttagacttactgaggatcatctcaaacataagaagctagaaatcaagaaactgacagaggaaaagaaagatgcattggccgcacaatatgcggcagaagcaactcttagaaggttacatgcagatcaaaaggaagatgattttgttcctcttgagagtgtcattactcctcttgaagctgagattaagatgtataggaatgagattgcatcactacaagaagataagaaagctttggaacgactcacaaagtcaaaagaggcagcattgcttgaagcagagaagattttaagaagtgcactagagagagttttaatagttgaggaagaagagaacaaaatcttagagaaaacacatcgccaaaagattttggaagttgaaaaacttagccaaaccatccatgaacttgaggaggtcatcttatccagtggagtcaatgctaatgctgttcgcgattaccagcgacagatttctgaattgcaagaggagaaaaggacactggagagggagctagcaagggtaaaagtttcagccaacagagttgcaactgttgtggcgaatgagtggaaggatgagaatgacaaggtcatgcctgtcaagcaatggcttgaagagagaaggataatgcaggcagagatgcaacgattgaaagataagctagctatatcagagagaacagcaaaggcagagtcacaattgaaggtaacctatttgtcttcctaccatgataaactcaagatgaggttaaaaacactagaagaaggcttaaagcatttctcaaataacccagtcagttcaaattccgggtctgcaaaatcagaaaagtataagatcttaagcttcctaacgaccaatggtggactgagaaacagatgcacatcacaaccaaggggatctactaatggaagctctttgttccaaaagtcaaatgcaaaaagcaacacagagagtgttactgagagcctaataccaggcagcattatgaaaaagaaatatggtactgcagaaaatgtgttgaagaaaggtatatgggcatcaagacacaaagttgctgatagtgatgaaaaagaaaatgagatgcaggtgaacgcaggcatgaatttaaataaatgcaatgataaaaaagaagcagcagaaattaaaaccagtgttgatgttgatgacgactctaaaagcaatagctgtaatgatttaggcagcaatgatgtggtctcaggttttctatatgataggcttcaaaaagaggtcatcaatttgaggaaatcttgtgaaattaaagagagtaatttgtacactaaagatgaagaaataaagatgctcacaaagaaagttgatgcattgacaaaggctatggaaatagagtggaagaaaatgaaaagagaagcagctgctagagagaaggaggctgcatcaacaaaatcagatgataacaggaaactcagacgctcaaattcctctagaaggatgatatga

SEQ ID NO: 48050 - DNA, 2076 bp, Glycine max
  Peptide Sequence Number=SeqID_164828
atggctcagtctttccttctctgctgttcttcttcctcttttcctcctcatcctccttcttcttcttccttccattatcgtcaaaaaataaccaacgccagttctgtcccttcttactcttcccgccatttcaaacttcccaacttctcttcttcccatcaacccaaaacccttctacaagacgcaaaactcgatgacccaaatgcaaagtcttcgcctttatccaaaacttccatctgggtcaatcccaaaagccccagagccaaacacctttggaagaattcctatcacgccaggtcatcatctctcaccaaactcgccaagtctctcgattcctgcaaccccacccaggaacacgtctctgaaatcctcaaagtattgggggacagtgttttagaacctgatgcagtgtttattctcaattccatggtgaatccctacaccgcactcctcgctgttgagtacttcaagcagaaggttaaatccgttaggcatgttattctctacaacgttaccctgaagctgtttaggaaggtaaaagatttcgaaggagcagagaagctgtttgatgaaatgcttcacagaggggtcaaccccaatctcattacattttcaactatgattagctgtgcttccgtgtgttctttgccgcataaggctgtgaagtggtttgagatgatgccctctttcgggtgtgaaccggataacaatgtgtgctcgtctatgatatatgcttatacaagaactggcaatactgatatggctttgagactgtatgatcgtgcaaaagcagggaaatggcatgttgacacggcagtgttctcggggttgattaagatgtatggggtgtctgggaactatgttggatgcttgaatgtttacaatgatatgaaggttcttggtgcgaagccgaacttgacaacatataatgctctgttgtatgccatggggagagctaagagggccagggatgccaaggctatatatggggagatgataagtaatggattgtcaccaaattggcctacctatgcagctttgttacaagcctattgtagagcacggtttaacagagacgcgctgaatgtttacaaggaaatgaaggagaaggggaaggatttggatatacttctttataacatgctttttgacatgtgtgcaaatgttggatgtgtggatgaagctgttaaaatttttgaacacatgaaaagttccgggacttgcccgccggacagtttcacatatgcgtccttgatcaacatgtactccagcatagggaaaattttagagatggaagccatgttcaatgaaatgatggaatctggatttgagcctaatatcatagttctgacatcacttgtccattgctatggaaaagccaagcgaactgatgatgttgtgaagatatttaatcagctcatggatttgggcatcagtcctgatggtcgcttctgtgattgtcttctgtatgcaatgacccaagtaccaaaagaagaacttggtaagctatcaggttgcgttgagaaggctaatccaaagcttgggtctgtgttaagatatataatggaaaagcaagagggtggtggagattttagaacggaggcatcagaactttttaattcaacggaagctgatgtaaagaagtccatgtgcaattgtctaattgatctttgtgtgagcctggatgtgccagacagagctcgtgaccttctggacctggggctgactcttgagatatatccagatatacagtcaaggtctcaagccaagtggtctctgcacctaaagagactctcagttggagctgctctgactgccttaagtgtttggataagtgacttgtctaaggctttggaactaggggaggagcttccaccactacttggaattaatactgggggagggaaacacaggttttcagataaagttttgcctactgtatttgaatcatatctgaaggaacttaaagctccatttcataaggatgcaaataaggcaggctggtttttggctaccagtgaagcagccacatcatggctgcaatctaggggttcaacagtggctcttccccaatga

SEQ ID NO: 48051 - DNA, 3051 bp, Glycine max
  Peptide Sequence Number=SeqID_164829
atggctcagccttaccctctttgtccttccccttcagcttcttccttctcattccattctcgcatacccttcttcaccatcgtcccttctcattccaaaacccttctccacgccccacgcttctccttacaacccgttaatactctccaagacgcaaaactcgacgacccagatgcaaagtctccgtctttatcgaaaaactccatctgggtcaatcccagaagccccagagccaaacacctccagaagaattcccctcatgccaggtcatcttctctcaccaaactcgccaagtcactggactcgtgcaaccccaccgagcagcacgtctctgaaatcctcaacgttttgagggacaatgtttcagaacgcgacgctgtgtttattctcaacacaatggttaatcccaacactgcacttctcgctcttaagtactttcagccaaagattaaccccgccaagcacgttgttctttacaacgttaccctgaaggtgttgagggaggtaaaggattttgaaggtgcagagaagctgtttgatgaaatgcttcagagaggggtcgagccgaatctcattacgttttcaactataattagctctgcttccgtgtgttctttgccagataaggctataaagtggtttgagaaaatgccctcctttggggttgaacctgatgcgagtgtaggctcctttatgattcatgcttatgcgcatagtgggaaggctgacatggctttggaactgtatgatcgtgcaaaagcagagaaatggcgggttgatacggtggcattctctgtgttgattaagatgtgtgggatgttggagaattttgatggatgtttaagtgtttacaatgatatgaaggttcttggtgccaagcctaacatggtaacttataacactctgttgtatgccatggggagagctaagagggccttggatgccaaggctatatatgaggagatgataagtaatggattttcacccaattggcctacccatgcagctcttttacaagcctattgcaaagcacggttttgtgaggatgcgctgggagtttataaggaaatgaagaaaaagggaatggatgtgaatttatttttatataacttgctttttgacatgtgtgctgatgttggttgcatggatgaagctgttgaaatcttcgaagacatgaaaagttcagggacttgtcagcccgacaattttacttactcgtgcttgatcaacatgtacagttctcatctcaaacgcaccgactctttggagtcaagcaatccttgggagcaacaggtctccacaattttgaagggtctgggggacaatgtttcagaaggagatgttatatttattctcaataggatggtggatcccaacactgcatcctttgttcttagatactttcagaacatggttaatttcactagagataaagaggtgattctttacaatgtggtcattaatttgtttaggaagtctagggattttgaaggagcagagaagttgtttgatgaaatgcttcaaagaggagtaaaacctgacaacattacattttcaactttggttaactgtgctagcgtgtctggtttgcctaataaggctgtggagttatttgaaaagatgtctggctttgggtgtgaacctgatggcatcacatgctcaggcatggtatatgcttatgcacgtactaataatgttgacaaggctgtcaatctatatgatcgtgcaaaagctgagaactggagccttgatgcagtaacattctcaacattgattaagatgtatagcatggcaggaaactatgataaatgcttggaagtctaccaagaaatgaaggttcttggtgtgaagcctaatgtggcaacgtataacactctgttgggtgccatgttgagatctaagaagcaccgacaggccaaggctatacataaagagatgaaaagtaatggagtttcaccagattttataacatatgcatcacttttggaagtttatactagagcacaatgtagcgaagatgctcttggtgtttataaggaaatgaaggggaatggaatggatatgactgcagatctttataacaagcttttagctatgtgtgctgatgttggctacactgatagagctgttgaaattttttatgaaatgaaaagttctgggacttgccagcctgacagttggacattttcatccttgattaccatttattcccgcagtggtaaagtttcagaggtggaagggatgttgaatgaaatgatccaatctggatttcaacctacaatttttgttatgacatcactcatccggtgctatggaaaagcaaagcgaactgatgatgttgtgaagatatttaaacagctcctggatttgggcattgttccaaatgatcacttctgctgttgccttttaaatgttctgactcaaacaccaaaagaagagcttggtaagctaacagattgcattgagaaggctaatacaaagcttgggactgtggtaagatatttggtggaagagcaggagagtgatgaaggctttagaaaggaaacactagaacttttaaattcaattgatgctgaagtaaagaagcctttatgcaattgtctaattgatctttgtgtcaaactgaatgtgcctgaaagagcatgtggccttctggatttaggattgatgcttgagatatataaaaatatccagtccaaatcccaaactcagtggtctttgcatctgaaagaactctcagttggagctgctatgactgcattacatgtttggattaatgacttgtccgaggcattggaatcaggggaagaccttcctccactacttggaattaatactgggcaaggaaaacacaagtattcagacaaaggcttggctagtgtatttgaatcccgtttgaaggaactcaatgctccatttcatgaggctaaggctggctggtttttggttacaaaagcagcagccaaattatggctggagtctagggattcaaccgaatcaattgctggtttgaactttctggttttagatgttccaacaatggccctttag

SEQ ID NO: 48052 - DNA, 1432 bp, Glycine max
  Peptide Sequence Number=SeqID_164830
atgaacacagagtcgcgttctgaaacgttgtctcggagacccttgaggattgtggacacgtgttgcgcactgggggtgcacgagttcaacgactcggtgagtctggcgaggtgttgggctcgggggctgtggggattgacccaaacgcagttcttcgataaagatgaggaatttgcatctgggtcgggtttgtgggaggaagaggcgtttgggaatttgaaattgcgcagagaaaatgaagaggaagaagaagagattgaggtggaaacatattggagcgaagagtgggaagcgcaaatgcgtgaagcgattttgcttggctcttctcatactgatactgtgatgtgttgtgtgttgctttgcgcactgcggattgatgcatttgtggcaaggatagaaacaataagattggttgtagctatagcaattataagaggttggtctatgcaccaattagatgtgaagtctgctttcttgaatgaaccactagacaaggaagtctatgtcatccaaccgccaggttttgagattttggatcaagaagagatacttagattaaggaaatccttgtatgaccttaagcaagctccacgtgtttggaacaaaagaattgacaactttctaagccaaacaagctttgttaaatgcacatctgagcatggagtgtatctaaaggtcttgaaagtggtcattggtgcaaatttgctgatagtgtgtctttatgtagataacttactagtgattcgaagcaatgaaagagagattgaagagttcaagaagaaaatgatgaaggagtttgagatgagtgatccaaggcttttgtcctactttcttgagattgaattcaaaacaacagaaaatggtattgtgatgtaccaaaccaggtgtgtagctgacatgttgaagaaattcaacatgttcaagtgtaattcaactgtcacactagctaaaacaggattggtacttgagaagaaaaggattgaggaatttatgaatcctacttacttcaggaagatcattggatcacttagatatctgtgtaacaccatgcttgatttaggatttagtgttgggtttataagtagatttatggagacaccaagagtgtctcacttactagcagccaagaaaataatgcactatgtgaaaaggactctggattatggaattttatttcctaaagtgagtgacaacttagaagttgaaatgcttgggtactctaattcagattggtgtggtgacaaatttgattcaaagagtgttgcagctgagtatatcacactctcaatgaacaattgtcaagatgtatggcttgatacattgatgcaagaaatcaagggtgtctctttgttctattctgcaaccgagcgaagagacccagttaagctaaatgggaatgtgaggtatcttcctttcgttagggcagcacctg

SEQ ID NO: 48053 - DNA, 3099 bp, Glycine max
  Peptide Sequence Number=SeqID_164831
atggctcaatcttaccttccctgcaacacttcttcttcttcttcttcttcttcttcttcttccatttctcctattccttgttcttctgccttctattgtcgtaaacctatcaccacttataactccttctcttacttttcccgccatttcaaacttcccaccttccctctctctcataataaacccaaaacccttctccaagtccaagccgccaacactccacaggacccagatgcaaagtcttcgcctttaccccaaacttccatctgggtcaatcccaaaagccccagagccaaacacctttggaagaatccctatcacgccaggtcttcatctctcaccaaactcgccaagtctctcgattcctgcaaccccacccagcaacacgtctctgaaatcctcagagttttgggggacaacgtttttgaatctgatgccgtggttattctcaattccatggtcaatccctacactgcactcctcgctgttaactacttcaatcagaagattaaaccttctaggcatgttgttctctacaacgtcaccctgaagctgttcagggcggtaagggatttcgaaggtgaagagaaggtgtttgatgaaatgcttcaaagaggggtcaacccgaatctcattacgttttcaactatcattagctctgcttctatgttttctttgccgcacaaggctatcgagttttttgagaaaatgccctcctttggggttcaacccgatgccggtttaacctcctttatgattcatgcttatgcatgtagttggaatgctgatatggctttggaactgtatgatcgtgcaaaagcagagagatggcgggttgatacagcggcattcttggcattgattaagatgtttgggaagtttgacaattttgatggatgtttaagagtttacaatgatatgaaggttcttggtaccaagcctatcaaggaaacttatgacactctgttgtatgtcatggggagagctaagagagccggggatgccaaggctatatatgaggagatgataagtaatggattttcacccaattggcctacctatgcagctcttttagaagcctattgtaaagcacggtgtcatgaggatgcgttgagagtttataaggaaatgaagaaggaaaagggaatgaatgtggatgtatttctttataacttgctttttgacatgtgtgctgatgttggttgcatggatgaagctgttgaaatctttgaagacatgaaaagttcaaggacttgccagccagacaattttacatactcgtgcttgatcaacatgtacagttctcatctcaaacaaaccgagtctttggaatcaagcaatccatgggagcaacaggtctccacaattttgaagggtataggggacatggtttcagaaggagatgttatatttattctcaataagatggtaaatcccaacactgcatcctttgttcttagatacttcctgagcaagattaatttcacgacagataaggagttgattctttacaatgctaccctgaatttgtttaggaagtctagggattttgaaggagcagagaagttgttcgatgagatgcttcaaagaggggtaaaaccaaataactttacattttcaactatggttaactgtgctaataagcctgtggagttgtttgaaaagatgtctggttttgggtatgaacctgatggcatcacatgctcagccatggtatatgcttatgcactttcaaataatgttgacaaggctgtaagcctatatgatcgtgcaatagcagagaaatggtgccttgatgcagcagcgttctcggcattgattaagatgtatagcatggcaggaaactatgatagatgcttgaaaatctaccaagaaatgaaagttcttggtgtgaagcctaatgtggtgacatataacactctgttgggtgccatgttgaaagctgagaagcaccgacaggcgaaggctatatataaagagatgagaagtaatggagtttcaccagattttataacatatgcatgtcttttggaagtctataccatagcacattatagtgaagatgctcttggtgtttataaggaaatgaaggggaatggaatggatatgactgcagatctttataacaagcttttagctatgtatgctgatatgggctacatagatagagctgttgaaatattttatgaaatgaacagttctgggacttgccagcctgacagttggacatttgcatccttgattgctatttattcccgcagtgggaaagtttcagaggcggaagggatgttgaatgaaatgatccaatctggatttcaacctactatttttgttctgacatcacttgtccattgctatggaaaagctaagcgaactgatgatgttgtgaaggtatttaagcaacttctggaattgggcattgttccaaatgatcacttctgctgttctcttctaaatgttctgactcaagcaccaaaagaagagcttggtaagctaacagattgcattgaaaaggctaacacaaagcttggttctgtggtaaaatatttggtggaagaggagggtgatggggattttagaaatgaagtctcagaatttcttaattcaattgatgctgaagtgaagatgcctttatgcaattgtctcattgatctttgtgtcaaactgaatgtgcctgaaagagcatgtgaccttctggatttaggattgatgcttgagatatataaaaatatccagtccaaatcccaaactcagtggtctttgcatctgaaagaactctcagttggagctgctatgactgcattacatgtttggattaatgacttgtccaaggcattggaatcaggggaagaccttcctccactacttggaattaatactgggaaaggaaaacataagtattcagaaaaaggcttagctggtatatttgaatcacatttgaaggaactcaatgctccatttcatgaggctaaggctggttggtttttggctacaaaggctccagcgaaatcatggctggagtctaggggttcaattgctgatttgaactttgaactctatggttttgggtgttccaacaatgaccctaagtatcgataa

SEQ ID NO: 48054 - DNA, 633 bp, Glycine max
  Peptide Sequence Number=SeqID_164832
atgtatcaaatttcctacagacctatatctatgggtaaacttccatcgtcaggaatccaaccttttgtaacactatatcattgggatcttcctcggatgctagaagataaatatgaaggatggttaagctcacaaatcataaaaacgattgaatttcatattcaacctctacttgacagaaaagattatgagcattatgcctatacatgcttcaaagcttttggagatagagttaagcactggattaccttcaatgagcctcataactttgcacttcatggttatgatttaggcattcaagcaccaggaagatgttcccttctggtgcatcttttatgtaagaagggaaaatcatccactgactcatacattgttgttcataacattctcttgtcacatgctggtgcctatagaagctaccaaatacatttccagggacaacaaggaggtcaaataggaatagcactagatgtcatttggtatgaacccataacagaacttatgaagacaaagacgcagcagcaagaggtatggacttttcacttggatggtaacctttcttctagcataatgatgattatcataaaatgtcattgcttagtgacaacaactaagaactcatcttccacataa

SEQ ID NO: 48055 - DNA, 249 bp, Glycine max
  Peptide Sequence Number=SeqID_164833
atggcggaaatatcttggcaaaagttttgtggccccaagaggaatggcgggcgttttgggttaggattcttaaagacaagtatggttgtggggagaagagaaatgcttctacaacatggaggagtgtttagagattcaaatggaaatctaggcgcttgtagtgtcttcatgatacaattatcaactatccttatatctcttgatttggcttattacagggaagctccagcagtctcaatcttatgctaa

SEQ ID NO: 48056 - DNA, 306 bp, Glycine max
  Peptide Sequence Number=SeqID_164834
ccaacaatagtttctaacatggatgttgtccatttgggaagttttgaatccccagagaatgttcctcttggggttgaagaacaagtgaagttacaagaggaatacaatgaagaagtttcagaagagggtgaatatcaagaagaagccatcttgtgtagtaccaaaaccgaaggaaaagagagtgaagctcacattacagaagaagaggagattgaggaggaggatgaagaaggagaaacaaaaagtgaggttgagattgcacaagatgatgaactagaagaaataactagcaataacaacaaatga

SEQ ID NO: 48057 - DNA, 375 bp, Glycine max
  Peptide Sequence Number=SeqID_164835
atgcggaatcgggagaagaaggtaaagccgattgcttgtcacgtgatcccttggcgaagccttggtagtggagttggaaggatgtttcgacaccagtatttgcttgtgaagcagaagatcaagaggcccgagttttcggggtccgaaggaggaggggattgtgatgatgatatgtttggggatgttgcacttgttgttggtggtcatggtgggaatgaattgatgaggattggggatggggatggttttcttgctggtggtggggggttgggcaatgaggtgatcgggttggggtttgagtatgaggccgaggaaggggaggtctgttattctcctatgggattccgcatgtgtatgagtaacctgtccaactaa

SEQ ID NO: 48058 - DNA, 258 bp, Glycine max
  Peptide Sequence Number=SeqID_164836
atgtggggtgaacaaagaattgcttacttgccgcagacacgttaccttgtagcagcattgagcattgcaacattaaagaattttttgtttttaatgaaactcttgaggattcagagcatgtggctcaaaattttaaagttgattcccttactatcagcactgtcacaaccctcagcttggtcacacttgattaagaccagttttgactacctcttgaaaaagaaagtgaggaatataaaagattttgaagttaggtaa

SEQ ID NO: 48059 - DNA, 1068 bp, Glycine max
  Peptide Sequence Number=SeqID_164837
atggcacatcgttacccaaaacccctcttagacaccctctactgcttaaaagaccatattcattgggaggaagaacaagtagaagatgatgagtacagtagtagcacaaccacaacaatcacaaacacaaacacagacacctcctctgtggtctttttagaacacgacctcttctgggaccgcgaggagctatcttctcttctcgccaaagaacaccaaaaccaactctcgaatactctccaaaaaaacctcgttttagcctcatctcgacaagaagcagtggagtggattctgaaagtgaatgcccattattccttttctaccctcaccgcggttctcgctgttaactacctcgataggttcctcttcagcttcagattccagaacgacagcaacaacaatccttggctcacacaactagccgcagtagcttgtctctctctcgctgccaaggttgaagagacccacgtgcccctctttgtagacctccaagtggaggagagtaagtacttgtttgaagcgaaagcggttaatagaatggaaatcttagtgctttcagcacttggatggcagatgaaccctgtaacacctctctcgtttcttgattacatcacaaggaaacttgggttaaagggttatctgtgtttggagtttcttagaagattgatgggttatctaccttaccaggcagcaactgctacagtgatgcgcgtggtcaatattgtggcgtctcgtctaggagtggagtaccaagatcagctcttgggtattctgggaatcgacaaggagaaggtggaagaatgctacaagctgatgatggaggttgtgtctgggtacgatgaggagggaaaacgatccaagttgaagaaacgcaagtttgagtcgattattccttgtagcagccaaaactgcgtaaaggaagagtcatttagctgtgatagtagttccaatgagtcttgggagttaggtgcatcttctgtttcatcctccagcaagaagactaggtctcaagatcagcttctattgaaccattcaaactcatcagattttctaagcattcctcgctag

SEQ ID NO: 48060 - DNA, 348 bp, Glycine max
  Peptide Sequence Number=SeqID_164838
atgcaaggttaccttatggttacccgcacctttcgtcaaccaggggcaaaggagaccgttgacgcgcagagactaacatcgtctcctgcatcttctgtcgtcctgacccgtgaagtcagggcaaacgagcccgttgagacgaagagactaacatcgtcttctgcacctactgccatccaggaacagcgagtcaggtggcaggcggatataccttatggtcatccacacctttcgtcaatggaggggaatgaattcgacgatatcaggatgatgctggttttaccctcgtcgtctggaaacattcaagctcaacgacgggcgagattcttctctactgggcagggatga

SEQ ID NO: 48061 - DNA, 1176 bp, Glycine max
  Peptide Sequence Number=SeqID_164839
atgggtcgtattgaggaggctctagccaagctcctgcccagccagccctctttcacttccaaactcgatgatgttttgcagaaaatggctaccctcgaaacgagtcagtcatcgtcaccgacttcatccgccaaccagcactccgtgagcttctctcccaccgcccaccacatgaaactagaggatccaactggcacattgttcaagttgaaccaaaagggttccgtcaacgactacttgtcgaaatttgaagttttagcaaatcgtatcatcggtttgcctgaggaaaagctcagtgactctcgctggttttttcgtcctcgacttcacttatcaacctcctctagtcctttatccactcgccagaccaccattccgtcttctacatcattgttactagcacctcctaagccatcatatgttcccaataagcgtttctcatcggaagaaatgacgttcaacagaggtcataagtgctctttcaaattcttcttgttgatagctgaagaagatgacacaatgatgggaggagctgaccttgggcaacttcattctcacccatctgaagacgtggaccagtcaccagcccaaatcagctttcacgcattatatggtcatctagcaccagagacactacgtttggtgggtcaaattaccaaccatcaagtgatgatcttgatcaatgggggtagtacccataactttgtcggagagttcctggacatggtaggcaacgataatgaaatctactgccaccaactgtgtgttggcgtagccattcatgtccagtccttttggccggtcctcattgactacaatgatctctatatgaagtgcatgcgttctggcaaggtgatagaactcaagctcccttcatcacaaacttctttatcagccattattcatctgacaatagctcctcttattcagaagtttgaccacctcttccaggctccgaccatcttgcccccacaacgtgacacgaaccatgcgattcatcttcttccttactttagccagtcaacatttggccatatcgttacccatacttccagaagcaaaagcttgaagcccagtgtaataaccgtcaaggatcgcttccctattccaaccattgacgagatgctggatgagctcagtggagttggatggttttcaaagttggacctcttgtag

SEQ ID NO: 48062 - DNA, 405 bp, Glycine max
  Peptide Sequence Number=SeqID_164840
atggactcaaaacattttcatgcttccaccactgctagaaaaaagagaaaccatatttgtgccctagaagatgatggaaggagtatatatgacggctttgtaggagatcacaaacatgttgttgagaaagtagcgcccaaaataacccaacaggagaatgacagactgatcagatggcttcggatggcaaagcaagagggaggtttgttgttgggttggcctgatggaatggtttcggcatggagcagtggaaaaacggatgaatgtgtgatccttctagtagctgaaacttataagctacatgtccaccctgttcaaaaatttgaaatgggtcatagtagcactttgcaagctttgagaaagatgatccagcaaccgatatttgacaatgagggtgcagtttga

SEQ ID NO: 48063 - DNA, 465 bp, Glycine max
  Peptide Sequence Number=SeqID_164841
atggagagcttgcaggaacgtgctcccaactcgtgcaaactagcgtactcaagtcacattcttgccacatgctctcaaagtatcatatgttggaaaactataggtttggaccttattttgttgcgccttttcgaccagttgaagtctgaggatcagtcacgcgtatctatgctcctttggagcctttggaggaaaagaaataaaaaggtctgggacaataagttgctatccgaatctaaggttattcaacaagctggtgacatgttttatcaggattggatgtctgcaaaagatctttctgttacacggggccatgagcagcacaaccattatcgtgttcaatgggtacctcccccaacggtgcttgtatccgagacagtcttggaaagctttttatggcaaggtcagaatggaggtagcctcgtctgtcagtgttggaaggagaagcatgggccttatggttag

SEQ ID NO: 48064 - DNA, 252 bp, Glycine max
  Peptide Sequence Number=SeqID_164842
atggagaagagggtagcaatattacaggaatggtttgaccgcgttgactcggagaaaagtggaagcataacagcggtgcagctaaagacagctcttgctgtgggcaacctggaatttccgctctcagtggttcagcaaatgatcaggggtcgtggttttcttgtacctgatgatgtatttgaggctttggtaaaaattggtttcatgctggattctcctgctttttactctgtctgtgaggaacctgtttaa

SEQ ID NO: 48065 - DNA, 1116 bp, Glycine max
  Peptide Sequence Number=SeqID_164843
atgctagtttatcaacgacagaacgttaatccccgcaaactgcaccgccacaagcaatcctctccgctcggcttgccccagattcggtggcaccgcaatcactgcgtcctttataggaaccttcgcgtgaaactccgccaaactcgccgtgtgacccaacatcatggccaccagttcctcgggcgagtatacggcgtccgcgacgaaactcacgccgcctctggaatcttcctgatcagaagtaggaagagagaaagagcaatgaatatgatgaaggtgtgggatgctgctcaaggtacccacaaccacaacgacatctggcactgcccaactgcaatggcggtgcagtgtaagtgtagcaaccaccacactggcgtttccggcggaaagaggagaatggaattggagggtgaaatgcagcaggggcggcgagttttgggcctgggaaggcagattgtgcgacgggcacttgacgaaggctacgacgttagtaaaccagaaaccattcctgctaccttggtcggcatacacactgtcattgactgcgccactggccgtcccgaggagcccatcaaaaccgaaggtaaagtggctcttatacaatgtgccaaggcaatgggaattcagaaatatgtcttctactccatccataactgcgacaaacatcccgaggttcccctcatggagatcaagttttgcattgagaagttcctccgagactctggcctcaatcacgtcattatccgcttatgcggtttcatgcagggccttatcggtcagtatgcagttcctatcctagaagaaaaatctgtttggggtactgatgcccccaccagaattgcttacatggatactcaggatatagctcgcttgacatttatagccatacgaaatgataaattaaatggtaaacttcttacatttgctggtcctcgtgcctggacaacccaagaggtgataaccttgtgcgagaggctagcaggccaagatgctaatgtcactactgttcctgtctccattttaagactcacttttttgagtggacaaatgatgttgctgacagactcgcattttcagaggtactatccataccttccttcatctttgctaaactga

SEQ ID NO: 48066 - DNA, 729 bp, Glycine max
  Peptide Sequence Number=SeqID_164844
aattcgagccgtgtctctccaaattacatgaatagtcaatttgacattaatgaaaggatgagggctattcttattgactggcttgttgaggttcactacaaatttgagcttttggaggagacgttgttccttactgtcaatctcatagacaggttcttggagcgtcaggcagtgatcagaaagaaacttcagttagttggtgtaacagccatgctaatagcttgtaagtatgaggaggtctcagttcctaccgttgaggattttattctcataacagacaaggcatatacaagaaatgaagttttagatatggagaaattaatgatgaacatcttgcaattcaagttgtctgtgcctactccatacatgttcatgagaagatttcttaaggcagctcattctgataaaaagctggagctcttgtccttcttcttggtcgagctttgcttggtagaatgcaaaatgctgaagttttcaccatctttgctggctgctgcagccatttacacagctcaatgtagtctgtaccagtttaagcaatggactaagactaccgagtggtacactgattactcagaagagaaacttcttgaatgctcaaggctgatggttactttccatcagaaagctggatcggggaaactcacaggtgtatatagaaagtacaatacatggaagtatggctgtgccgcgaaaatagaaccagccctgtttctactggataattaa

SEQ ID NO: 48067 - DNA, 2943 bp, Glycine max
  Peptide Sequence Number=SeqID_164845
atggaaggattggcgctaccagttgcgcaatcgcaatcacaacagttgccgtttccaaggccaaagctgtccgccattcccgcaggcacagcttatggatttgtctctctcaaacgacaccgtggaagcgggtttcgttttcgcacttgcttatgttcgcaggcacaggcacaggcacaggcacaggcacaaggcgttcctcttcccgagcaagtcacagtcacagacccagacaactctgtgagtggggattccatacggcagagatttctgaatttctatgcttcccgtggtcacaaggttcttcccagtgcttctcttgtcccagatgatcccactgttctactcaccatcgcagggatgcttcaattcaagcctatcttcctaggcaagattccaagacaagtaccttgtgctgctactgctcaaaggtgcatccgtactaatgatatccacaatgttggcctaactgccagacatcagacattctttgaaatgcttggaaacttcagctttggtcattacttcaaaaaacaagctattctttgggcatgggagctttccaccgcagagtttggtttgccaccagacagactgtggattagtgtttatgaagatgacgatgaggcttttcagctctggtcccacgaggtcggtgtcccagttgagcgaatcaagaggttgggagaagaggacaacttctggaccagtggagtgacaggtccctgtggtccttgctcagaaatttattatgatttctatcctgagaggggatatgtagatgccgatctcaatgatgatacaaggtttatagagttctacaacttagtattcatgcaatacaacaaaaaagatgacggttctcttgaacctctaaagcagaagaacatagatactggccttggactggagcgcatggctcgtattcttcaaaaggttccaaacaattatgaaactgacttgattttccccatcatagagaaggcctctaaattagcaaatgtttcatatggtattgccgatgatcagacaaagagaaatctgaaaattataggagatcacatgcgtgcaattgtatttctcatctctgatggagttgtcccatcaaatgttgggagaggttatgtagttcggcggcttattagaagggttgttcgtacaggcaggttgcttggtataaatggtgatggtaggggtgaccttgaaggagcatttttaccaatgattgctgagaaggtagtggaattaagtacacacattgatgctgatgtgaagaacaaagcacctcgtatctttgaggagttgaagagagaagagcttcggtttgtgcagactctagagagaggagaaaagttgcttgaggagaaactctctgatgctttatcaagtgcagaaagaaatggaactgtgccttgcttggctggtgaagatgtgtttcttttgtatgatacttatggatacccaatggaaataacaaaagaagtggctgaagaacgtggtgtgagtattgatatggatggttttgatattgagatggagaagcaaaggcgtcaatctcaagctgctcacaatactgtcaaacttgccattgaaaatggagaaaatattgcagagaatgtacctgacactgaatttattggatatgaccgccttcattgtaaagcaatgatagaaagcctaacggtaaatggaaatccagttccacaggtcagtgaagggagtaacgtggaagttttactgaacaagactccattttatgctgaatcagggggtcaaattggcgatcatggttttctatatatttcagagggtgagaatcaactaaaagctgttgtggagatattagatgttcagaaatcttttggcaacatatttgttcacaagggtacagtccaaaagggtgtagtagaggttggcaaagaagtcaaagcagcagttgacgtgaaactgaggcagcgagctaaggttcatcatactgctactcatttactacaagctgcacttaaaaaagttattggtcaggagacctcacaagctggttcactggtggcatttgatcgtctcaggtttgatttcaacttccatcgaccacttcgtgacagtgagcttgctgaaattgaaaaactaataaatggatggattgaggatgcaacgctacttcaaaccaaagtgatgcctcttgttgatgcaaaaagtgctggggctatagcaatgtttggagaaaaatatggagaagaggtacgtgttgtagaggttcctggtgtatcgatggaactttgtggtgggactcatgtccgtaatacttctgaaattcgtggttttaaaattatctcagaacagggtattgcatctggaatcagacgtatcgaagctgtagctggggaagctttcattgaatatatcaatgcccgagacttttatctgaagcagctatgttccactctcaaagttaaaccagaagaagtgacaacaaggatagaaaacctattagaggagttacgggtagtgagaaatgaaaattctgctgtgcgtgcaaaagcagcaatctacaaagcctcggtcattgcaagcaaagcattgttggtgggaaattcaaaacagtacagggtactagttgagtgctttgatgatgttgatgctgagtcacttaaaagtgccgcagaatatttactggaaacactaacagatccagcagctgtgatactaggctcatgtccaggtgaagggaaggttagtctagttgctgcttttactccaggggtggttgatcaggggattcaggcaggaaagtttattggacaaatagcaaaattatgtggtggtggaggaggtggaaggccaaattttgctcaggctggtgggaggaagcctgaaaatttggcaagtgcccttgataaggctcggtcagagcttatagccactctatgtgaaaaagggaattga

SEQ ID NO: 48068 - DNA, 1383 bp, Glycine max
  Peptide Sequence Number=SeqID_164846
atgatgttgggtcacacggcgagtttggcggagtttcacgcgaaggttcctataaaggacgcagtgattgcggtgccaccgaatctggggcaagccgagcggagaggattgcttgtggcggtgcagtttgcggggattaacgttctgtctacctatgcagcggttgtgtatttctcgtcgtgtgggaaggtgaacccggagcttgggggtcagcatatggaattgcgattggtggagtattttgctgatgagttcaatgcacaagttggtggtggaatagatgtcaggcattttcccaaggccatggctacattgaagaaacaggttaaacgaagaaaagaaatgcttagtgcaaacacagttgctcctatttcagttgaatcgcttgatgatggcgtcgacttcgggagcacaatgaaccgtgagaaatttgaagacctctgtcaagacatttgggataaatctcttttgcctgtgaaagaggtgcttcagcattctggcctgtcattggacctaatatatgcactgcagttgattggaggtgctaccagagtgccaaaattacaggctcagcttcaacaattccttgggagaaaacaacttgacaggcatcttgatgctgatgaagcaatagttcttggctcagctccgcacgctgcaaatttaagtgacggaatcaaattgaaaagcaaactaggaatacttgatgcttccatgtatggttttgtggttgagttgagtgctcctgatctttccaaagatgaaagctctaggcagttacttgtaccgcaaatgaagaaagtccccacttatgaaagtgagcatcatttgcctcctggtgttacctctcctgaaattgctcaataccagatatctggtttgacagatgccaatgccattattgaaataacagagagggtggaagttccaaggaagaatatgaccatagagaattcaaccatttcatcaaatgtttcggctgaatctgctggtagtaatagttctgaggaaaacatgcaaactgatagtgagattagtaagacatccaacggtagtgcagaggagcaagctactgctgctgagcccgctacagaggaaaagctgaaaaagcgaacctttagggaacgccagtccttcattgagaagcttgatcaggttcaagattggttgtatagagatggtgaagatgccaatgccacagagtttcaagagcttctagatcagttaaaaactgttggaaatccgattttcttcaggttgaaagagctgacagctcgaccagcagcagttgagcatgctcatagatacattgatgagttgaaagagtggaaagcaaacaagtcttggtttccacaagaacaagaagcccgcatttatctctga

SEQ ID NO: 48069 - DNA, 99 bp, Glycine max
  Peptide Sequence Number=SeqID_164847
atgaaggtgaattcacctgatgaaggaaaaggatccaaggattctaagacagttagttaccaagaggtttccactatcaaattgaagctatacgattga

SEQ ID NO: 48070 - DNA, 285 bp, Glycine max
  Peptide Sequence Number=SeqID_164848
atgggtgttgcttctaatattggtggtttcaagactaaccaccatccttacaaactcatatttcaatttagcaccaaggtcatattgttagaggatggtgcagtcccaaacattgtggtgaggatagagtgtactctattcggagaatatgttgacaagttgaatgcttccttgcttctagagaaggttaatggcttgatttgttttgggagtgtcgggtatgtgatcttaggttctgatttaatttatctcgacaacatgaggctaaaggaaacaatggtgtga

SEQ ID NO: 48071 - DNA, 378 bp, Glycine max
  Peptide Sequence Number=SeqID_164849
atgggctcaaaaatctaccctaaggttcgtgagaaccctaaggccttctttatcaactctagcccaatcctcttggagcctcttgctcatgactttggtaactggtcctttcctaaggaggattgcatcataagggagcagagaaagattcagctcttggagctagaggaaatgaaactgatagcttatgaatcttcaagactttacaaggagagagtcaaggcctatcatgataaaaagcagttgaagaaagacttcgaaccaggacaacaggtaaagtccaaatggtctggacctttcatcatcaaggaagtccggccttatggtgcaatagagttgtatgatccacaatctcaagaccctgacaaaacatgggta

SEQ ID NO: 48072 - DNA, 399 bp, Glycine max
  Peptide Sequence Number=SeqID_164850
atggaagcatcaatgaggagattgaatggttgtggaaaagggaacttgggtattatgggggttcctaagtcccacattgggcagtatgggatgatcaatggaatatttaagtgcttggtgataatgttaatacaaacttctgtccttagttcagttgaagctggtctatgttatgtatctgatgatgggaaagatgttctatgtgatcggatgcctagtggtgaaacttggcaggtgggtctgaaatgcaataagtaccctcttgactggtgtagaaaagctgaaccagtagaagaagataaaaggaatgctgatgatccttacagatcaagctgtttagttagctttggtcagccgtcaactgctagtataatgacagaaaatactacacctaatatg

SEQ ID NO: 48073 - DNA, 270 bp, Glycine max
  Peptide Sequence Number=SeqID_164851
atggtctctggtaatcgattaccaggggatagggatgggtcactggtaatcgattaccagatcgcgatggtggcacagctaatccgtgaacgagtagagatggagtgcctagagggagcttgggagaccctcgaaggcaacacgaggtgccgatttcggggcaccattcgattcacggctacttctttggtgcatccagatgaacctgcacggacgcttcagcgcacggtggagtggacagctctttggattcgttttgtatacttttga

SEQ ID NO: 48074 - DNA, 453 bp, Glycine max
  Peptide Sequence Number=SeqID_164852
gttatccggaagaacccttcttctgaaattcttccggaagaactacttcttccggaaagtatccggaaaaggtgttccgggagacttccggaagaagtgttcttccgaaagacgtttggtatcttctggaagaacacttcttccgaaaagtttccagaaaatcttcttccggatgttccgaaagaacccctaacgggtcttccggaagcctccgccgtgagccccctttccccattttttccggcgtcttctactctcgtcttctacccaaagcaatggagagttagggagactaacctcgaaggctcttcgcggagaagaagaagaagcttggctcgcggtgttgcggagaagacgaagaagcttggctcgcggtgtcacaaaggagcagcaggaattggaagaagaaaagaagctgcaagtggtcttccgggaagaggagcgcgtttttaa

SEQ ID NO: 48075 - DNA, 852 bp, Glycine max
  Peptide Sequence Number=SeqID_164853
atgaagaagaggagctgcagcagtagtagttcagtttttgaggaggcgaatggagtggaggatgaggccgaacctcaacaaccttcatcttgtgcagcagcagcacttgatgagttgcataaagagaaaaatgagaatggagaagaaaccctcgtgcctcccaatcccaatcttgacgatggcttctatgaaatcgaaacaatacgccgtaagaggctacgcaagggtcagctccagtacctaatcaaatggcgtggatggcctgagactgccaacacttgggagcctcttggaaatctacagtccgttcctgatctcattgatgcttttgaggaaagcctcctcaagtcaggaaaacatcacaagcgcaagcgcaagcatgctgatgtggttcaactcacccaactcaagaagcgctctgaacgttctaccacttcttacagccttagacatttcccaccccaagttcccacccttacaaatgattacgatccaaagctcagtgaacttaaggaggcaccaacgaacactggggttcagctagataaccttgcaatacatttccagcatccaattccaagcagaggagcaaaaaggagaaaatctgcttcttctgtcaagaggttcaagagagacccagatgcagctgcaattcaaccaattgctgctcctatccacatgcctgatgctactaatactgcctgcaatattgtcaagattatcaagccaataggctattcagcttcattatctgacaacatgcacgatgttttagtcacctttatggctatgaggtttgtcactcaaccaacaactccaaattttgctcttacacctttcataaaaaaataa

SEQ ID NO: 48076 - DNA, 261 bp, Glycine max
  Peptide Sequence Number=SeqID_164854
atgacatctacaaaggagggaaaaatgatgatgaagccaacaactaaaaaggaggagagaagagggaggataatgtgtcatccctatctttcatttcaagccagtgacaaatttttaggcttccgtgatgcactctacttgattgatattggacaaaatgaccttgctaattcatttgccaaaaatctatcatatgcgcaagtcatcaagaaaatcccaacagttataactgaaattgagaatgttgttaagctaaaataa

SEQ ID NO: 48077 - DNA, 165 bp, Glycine max
  Peptide Sequence Number=SeqID_164855
atgttgggttgtgtgtgtggggtgcgtgatcaagacaaggtgatgaacattagggtggagcctggggcggaggcgcccaacactggcacgttggatggtggctgcgcatgcagggtgtttttcaagaacgtgatggctgatgcactctattccccaaaatattag

SEQ ID NO: 48078 - DNA, 549 bp, Glycine max
  Peptide Sequence Number=SeqID_164856
atggttcgcttggacaaagttcttgtagatgatgctccttttgatatttgtagttgccagtttgcattgcattactcatggtctatagaggcccgtgcccggcaagcattggctaatgtgtcagctttacttcacccaggaggcattttcattggaactatgcctgatgccaatgtgaatatcaagaagcttagagaagctgaaggattaacttttggtaacagggtctattgggtgcgttttgatgaagaattttctgataataaatttaaatcttccagcccttttggaataaagtacacgttccatttggaggacgctgttgattgtcctaaatggattgtcctcttccacgtattcaagtcattagctgaaggcatatttataagtgtcatttgtattgagaaaggtcagtatccaaagcacttgagttggctgcttcatgctgacaatgaaaatgatagcaacagtagcatacagcagagccaagtcattaccagaccaatccgaaaccgcaacaaaccagcatacctgaatgattatgcttga

SEQ ID NO: 48079 - DNA, 594 bp, Glycine max
  Peptide Sequence Number=SeqID_164857
atggagattgttgaattaaattttcagcatggtaagaatttgtttgattcaattgtgggagtagaggttcctatctacttctcaaaggttttaaaaaaggtggtgtacaactttcttgaggatgaaatcaccaagattctgaaagtagcagatcattacagtgcaagatccaaccagactttgaaagaacgggaggctagtccgataattcatttgaagaaactcaataactggttgttgtttatataccaaaagacattctcagtttcttggctaaccatagagtccatccttttttgtttcataatgtttaccagggtggtgatcttatcaaatgggactaggccaaaattggatattatgttggtattgacattgctgaaggctcggcaacaattacacttattgccaatgaagcatcaatcttgcattttcttcatgtatccatatcggatatatattggatacgaattgatgcaatcctatcccgcaagggcattgggtagaagactccaagtagattgggctagagatccaagggaaggccctagggttctcatgagccttagggtagatttcgagcccatgggctaa

SEQ ID NO: 48080 - DNA, 207 bp, Glycine max
  Peptide Sequence Number=SeqID_164858
atgtcttcctccgaaatgtgcatcgaccctcggtcccttctgccactcggttgggttttgtcagagacaagtaggctaggtgatctgagagcacccagttctattcacagagccatgtctatcacaaagctcaaccttcatagatcagaacgtggatatgatgaagatattggaaaaagatcatgggttgttgatgaacgtggatag

SEQ ID NO: 48081 - DNA, 888 bp, Glycine max
  Peptide Sequence Number=SeqID_164859
atgtcgggacaacaattatacctctccaagctgcttggacgctttatccaggatccccgagacaccaactctgcaattactgttatccattcccaattcccttttaatggagtaaccccgacaagcgtgtcaggcgaactccacatatcaggagctcctccaccagacatcatttgcaagctccatggctccccaggaagtttagtgttcgatcgctgcctcattttcatcagctccttctggagagaattattcttcctgagtggcactaagttttgcatgagtatggcttaccacccccagactgatgaccaaacaggggttcttaacagaagtggtcgtataacacctttgtacatgccagcacgggcttcactccatttgaagttacatacaacaaaccctcgccttcacttccattatacctccaaggttcttcaacagtggaagccatcgattcactccttacctccaaggttctgcatgagtatggcttaccacccccagactgatgaccaaacaggggttcttaacagagtattcgaacaacacttgtgctcatttgtgcacgatcagcccaatcattggtacaaattcttatccttggtagagtggtcatataacacctttgtacatgccagcacgggcttcactccattcgaagttacatacaacaaaccctcgccttcacttccattatacctccaaggttcttcaacagtggaagccatcgattcactccttacttcacgggctgccattcattcagtcctccaacaacgattgcaaaaataccaaacttcaatgaaaactcaggctaatgctcaccaccgagacctcaaattcaccgtcggcaactgggtttatgttaaacttcgttcatactag

SEQ ID NO: 48082 - DNA, 444 bp, Glycine max
  Peptide Sequence Number=SeqID_164860
atgagggcgagccctggtgcagcggtaaagttgtgccttggtgacttgttggtcatgggttcgaatccggaaacagcctctttgcatatgcaaaggtattggagccttaaagaagcatatgttaaagctatagggagtggacttactgaagggctgaataaagtggaattttctcacacaagatggacaaatatatcagctaaagtggatgggaagaccatgacagagtggagattttggttgttcgaacttggggatagacattgtgtttcaattgcgagagttcacccaatatcagctactacgagttacaaaacaacattgaaaaaagtggactttactgaagaggaatatactctaggtcttcatcttccaaacgtaggcattgttaaactagatgtagaacaactcatttcaattttacagaaagcatctgatttttag

SEQ ID NO: 48083 - DNA, 540 bp, Glycine max
  Peptide Sequence Number=SeqID_164861
atggaagaaggcgtaaggagatgggtagtggacatatcaaagtgggacccacacccctctcacttctccttcgctctctccctccttccttcccacgagcactcctcggtcaccaggtttgttaaaatggaagataggaaacgtgcacttgttagccgcatgcttcagtatgttcttgtccatgatgtgttgcaaatcccatttcctgacattgtcataaaacgaactttggaaggcaaaccctatttggattattatgataaatttgatcttagattcccaaattttaatttcaatgtatctcatcatggtgactatgtggccatagcatctgaacctgtatgtcttgtgggggtagacattgtctcctatgatgttccacagggagaaacaactacagaattcattcaattcttctcatcatacttttcaagtctggaatgggataacatagtcaattcaggcactttgaatgatgtattgacggaattttacagatttaattcctctcgatgctgctgttccagcatgcagaagtag

SEQ ID NO: 48084 - DNA, 1055 bp, Glycine max
  Peptide Sequence Number=SeqID_164862
gaccatccaaactacgctatcatacaagatttgataatgcacaaagggagtatttggcttccaaaggaattgggttttatcacaagtctgcttaacaagttccacacctcaccaacagggggccacatgggagtaacaaagaccttagcacgcattggtgaaaattttacttggtctggaatgaagcacaacgatatctcccttgatcaattctccaaagggatacacctaggcattctccagacgcacttcactgcttacacagttgcactttttttcatggacatcatggacaaaatccatggaatgccctatagcttaatctcagatcaatacccgttgttcatatgccacttatggcaagaattgtttaagctcagtggcacgaagcttcgcatgagctcggcctatcatccacaaacggatggacagaaggagtacttagcggggacctccaagcttgaagtagtggatgacttcttgataaatcgcgagataatgtttgcaagtctgaagaagaaaatgattaaggccaaagaaacaatgaaaagattcgcagacaatcatcgccgcgacatcagcttcaaggtaggagactgggtccttgtcaaattacgaccccatcgccaaacttctgtgaaaggtgaatcctattctaaattggctaagtgcttctatgggccataccagatattagaaagaattggaaacgtggcatataaaatcaaatttccagacaattctcatatccaccctgtgttccactgctctcttttgaaaccgtgtccctattctttggcaactgcttttaagggggttgaactaccccctactactgttaatgattatcctatcatttctctcttagtcattcttgactcgaagtgggaacattctgaaccagaagttcagttgatggttttagttcattgggaaggtctctcactagacgacacttcttgggaaaattggaataaattgaaagctgactatcaccttgaggacaaggtgttgcttgatgtggggcggaatgttatagaccaacaagcacacca

SEQ ID NO: 48085 - DNA, 258 bp, Glycine max
  Peptide Sequence Number=SeqID_164863
atgggtcttggagattttgcgttgattatcacgcccggaacaccattacagaacccttttcccattcccaccatagacgagttactggatgaacttggcgaggcctcctggttctcaaagctcgatctcctccaagggtatcatcagattttaatgaaggaagaagatatcagcaaaaccgccttcagaacccaccatgaacactatgaatttagggtcataccgtttgggctttgtaacaccccgtccaccttccag

SEQ ID NO: 48086 - DNA, 620 bp, Glycine max
  Peptide Sequence Number=SeqID_164864
atggtctggagggataagtctcagttatttgagccactggactccaagaaccaaatctgccccacacagtggaagaacataaaggtcaacggtgaaactctggccctaaacatgaacggtgaccactgcataaagatggtagcattcaatctcattaccattgcccaccatcactcgaagagggtggctggggtggaacgggtaaaagtggaggaggtggggttacgggttggggatatggtgatggtggaagaggggaaggttgatgggttcggccccggaaattccgacattggtcaagaagcttttcttcctaaagtcgagccaaggttacggcctggaccagtagggttccgatgggatcatcatagtgggacggggcaaaacaagcctcaagggcctaaaggaatcctggccatgaagagatttggccattccggccagaggggttcgttccatcaaatcgtggaacttccaacttcactcgcggaagatgtgatgaggaatgggactggttcacagatgaagaagaaggtggagaagagtgtggtggggattgctgttgttgttgagtggtttccagggtggtcattcgctggagtagctcgtccaatttggag

SEQ ID NO: 48087 - DNA, 312 bp, Glycine max
  Peptide Sequence Number=SeqID_164865
atgtctggtggtggcggtggcggtgtctttgtgacgcttatggatccacacaacccatcaatgctttcaaatggagggcaaggagagaggttgtggactggctcacttgtttggtttcacgcaatcagtcgcaccatgcagggttgtttgttatgcccaactaatgttttggaaaaattatctgcgactgatttcggccagagctttgaggtttttggtatatccataatagcaattggagctagccccatttgtcaacaattaccacaacatcaatgtgactgcgatttcagaaaccttgtcccggcctaa

SEQ ID NO: 48088 - DNA, 433 bp, Glycine max
  Peptide Sequence Number=SeqID_164866
gggataaccgggttccaaacggtggaggtcaaagccgtgaccaatccgaaagggaagaagcttggagggagtggcggagaccggggatttgtcgacttggatggaggaggggtggctgatcttggagcagcaggaaatactgaggaattggataagttctcaagttgtacttctgaaacagttgaatcccctgaaaaattgggagtgtcagctgagtctcacccgggaaatgggattttcgatttcatggatcttctacagaatgtaaagctaaccgttattgaattggtaagtagggtgtctggtttccttcagaacatattcccaccacctgatgctgatgctatgaaagagaagatgtctggtgatgtcgatgggaacactaaagcaagtttcatggatagtaaaattagcatgggaggaaccttcacag

SEQ ID NO: 48089 - DNA, 2049 bp, Glycine max
  Peptide Sequence Number=SeqID_164867
atggatgtcttatacagtgtacagctagaacattcagcacaagccgatgaatctctcaagactttaacgcctgggatcaatgtcaataatagaattttacctgataaaatgatttctaggaaactaaaattccaaagttcagatattgaatggtcaggcttttcttggttttgtgctaaacagctgaagcactactcagggttttgcaggaatggaacaaccataaatgttcattcatttgtatacattatggctgaagaagaaaaccactatcttggttacttggaagatatgtatgaagacaagaagagacaaaagaaagtgaaggtacggtggtttcaccgtggtcaggaagttaagcatgtgattgcacagctgaagctgcaagagggagaggttttcatcacacctcatgtgcaggtgattagtgctgagtgtgtcaatggtcctgcaacagttttgactcctaagcattatgagaaatacctagctgctgtgtctcatacctctttatctgagatccatatgtgctttaggcagtttaaaaacaataagcttaagccctttgcacttacaaagttgcgtggatatagtaaccaatctgttgtttctagtttgaatagttctactcactccaagagaaaagcaaagttcgaaaaatcgcacacagatgatgatgagaacttcactcaagatgatcctttaaggtccagcaataagagggttagaagttctaaggatcatgtacttgaaaagggtttttctggtctgcaaatctctcttcctacgaaagaaatggcaaaatgtgaaccaaaataccctagtttaaaattaaaactatcgagaaaaacaatgggtattaaggttattggaccaaagcctcaactgtcttttcaggtcggtgcaaagatagaggttctctgtcaagatagtggcatcagaggatgctggtttagatgtaaaatcttgagtatgtctccgaggttgctgaaggtccagtatgatgatttgctggaaatagatggaccacagaaactagaggaatgggtccctgcgtctagagtggcagctcctggcaaattgggaatgcgatgttcaggccgcttaacagtacgaccatgccctcctgaatataatacaggtcatacttttgaaattggagcaccagtggatgcatggtggtgtgatggatggtgggaaggtgtcataactgcagttaatgtcagtggagatggaatcctgcaggtttatacccctggcgaagagaggttcctaaaggtcgagaagaagaacattcggatttcacgggattggatcaataacaggtgggttgatatacagggaaagcctgacatttgcagctatttatcttcaaatgtcaggtccagtatcaggatgtcagctaattctgcagcggtagatgcatctatgtctgattgctctgcaatattagaaagtaaagcatcgacaattgccaaagttgaagttgctaagaaggttgagccagaattatctggtttggaagcacctgttgacctggaaaataagaagggaataactttgagggagccactctatgccattcatgaagacaaggataacaactctggtggtatcaggatgtcagctaattctgcagtggtagatgcatctatgtctgatggctctgcaatattaaaaagtaaaccatcaacaattgccaaagttgaagttgctaagaaggttgagccagaattatctggtttggaagcacctcttgacctggaaaataagaagggaataaccttgagggagccactctatgtcattcatgaagacaaggataacaactctggtggtggctgtgatgacgacgaagctgacaaggctgtgaagacacttctggccttaaatgaacacaaggataagaactcaggtggaggcagtgacagtgacactgacaatgatgatgttgacattgatactgacaatgatgatgaggatagtggggaagattttaactgttctgaaccaaaactcaatgcagcagaagcaatacaagttgcatga

SEQ ID NO: 48090 - DNA, 846 bp, Glycine max
  Peptide Sequence Number=SeqID_164868
atggcgtccggtactgtgaaaccttcttctcggtaccgttcctacgattcacgctcctccacttcctctcatttctccgacccttcctcctcccatgaattcaacaatctcaaaaccaaaacctcttcttcttcttctcgcgctctcgtcaaggccaaaccctcaaacaccgccaagctggaccccaccttcaccaccatggtcaagaagttcatggacaggaaacccaaatcctcctcctcggccgccgccaccgccaccaggttgattattccctccgattttctcgcgaaggatttgaagaaggacgcgaagaaagtggcggggttctccgcgctgcagaagaagctcttcggaaagggcgcttccgagaagaaggagaaggtgaaggccttgaccgaggtgaagaacaacaccaggacattggccatggtgctcaggagcgagagggagcttctcagcatcaacaaagagcaggagcagcaggtttctcagctcaagcaaatgcttgaggacaagaacaaagaggtggagaagttgaaggatttgtgtttgaagcaaagggaagagatcaaatcgttgaagagtgcgatactgttccctgatgttatgaattctcagcttcaagagcttctagagaagcaaggttcggagctgaagcaggcaaaacaggttattccagctctgcagcagcaggtttcttctctcactggccagcttcaaagccttgcggaggaccttgctgaggtcaaggctgataagtattcagcaaaagcaggtcttccaggttatggaagttctccaagaacaccaacacatgcccgggaagatgcttctaacttttgg

SEQ ID NO: 48091 - DNA, 1665 bp, Glycine max
  Peptide Sequence Number=SeqID_164869
atgggtcgctctcgtgggaattttcaccacgccgacgaggaccccaaccagaggtcaaggagaaaaaagaatgctgccagtggagagaattcagaatctggagctgcaggccaaggagcaggtgaagggaaaaaggctctgtaccactgcaattattgtaataaagatataacaggaaaaatccgtattaagtgtgccatgtgcccagattttgacttgtgtatagagtgcttttctgttggagctgaggtgacacctcataaaagcagccacccttacagggttatggataatttgtctttccctcttatttgcccagactggaatgcagatgatgaaatcttgcttctagagggaattgaaatgtatggcttgggaaactggacagaagttgctgagcatgttggaaccaaaaacaaagagtcatgcatagaacactataggaatgtatacctgaactccccgttctttcctgttccggacatgtctcatgttgttgggaaaaacagaaaagaacttcttgccatggccaaagggcagggtgaagacaagaaaggaatttccatgggggatcttagtataaaggcagaatcttccttttctccatctagagccaaggttgaagattcgcataaagctggctcctctaatcgcttggcatccggtttgaattcagagtccgatggccccttgggtaacacacatgctgcaaaccaaaaggcatctaatgtgggccgtggaaaaggtggtcctggaatcattaaaatggaagattctcaactagacagagattttggaggaaaaaagcctacttcctctggaaatgaaggtccttctttagtagaatcgagtggttataacgccaaaaggcaggaatttgatcctgaatatgataatgacgctgaacaactactcgctgaaatggaatttaaggacactgacactgatgatgagcgagagctgaaactacgggtgttgcgtttctatgcaaaaaggcttgatgaaagaaagcgtaggaaggatttcatacttgaaagaaatttgttatacccaaatccatttgagaaggatttaacacctgaggagaagacaatatgtcggaagtatgacttattcatgcgctttcatactaaggaggagcatgaggagttgcttagaaccgttatctctgaacatagaacccgtaaaagacttcaagagcttaaggaagcccgggctgctggttgccgcaattcagctgaagctgatagatatctggcgcaaaagagaagaagggaagctgaagaaagtggttgtaggacaaaagaaagtgctcagggcggcccaagcaatcaaggggttcctaatgcattgatgtctccagactctgctggcaaggatttgagtggaagacctccagggcctgctacttctagttctgtcaatgaaatggatgtgacgggatactatggggcagatttactttctgaaccggagaaacgtttatgctgtgagctaaggttgcctccagccatgtatctaaagatgcaagaacaactgtctctgcaaatacttgccggcactgtcgctgcaaaatctgatgctcatcaattgttcaagatggatgccatgaaaattgacagggtgtatgatatgctcattaaaaaggggattggttccccctga

SEQ ID NO: 48092 - DNA, 819 bp, Glycine max
  Peptide Sequence Number=SeqID_164870
atgagtagttatttgggtgtaggtgttagtcctgggaatgtcccagtttaccacagcacaaatgtgaaagtgttagataggaagatcaagataacagaattggtgttgaggtgtgtgatccttggtttaggggttcttgcagctgttcttgtggggactgattccgaagtcaaggagtttttctcatttcagaaggaagctaaatttacagacatgaagtctttggtgttcctggtggttgcaaatgggttagctgctggctactccttaatccaagggttgcgctgtatccttagtatgatcaggggaagagtactcttcagcaagcccctagcttgggccattttttctggtgatcagtttgaacatttgatattttcttttctagaatttatgctctctacatgtgtcagaggcccaacttgggtcggtttgagattaaggctcaaatttagacagcaaaacataagaatctcaagtttgtcttgtcaagcaagggtaactggtaccgtgggggacccttttagggaaccgtacctgattgatgttaagacttgggcattattcaccgtaatggcctatgtaacagtggtggcattggcggcggcagggcaatcgggtatgattgcaagggttggccagccagaactgcaatggatgaagatatgcaacatgtatgggaaattctgcaaccaagtgggagaagggatagctagtgcttttgtggctagccttagcatggtggtcatgtcttgtatttctgctttcagcctcttccgtttgtatggtggtaacaaaaccaaaaatgtgcattggtag

SEQ ID NO: 48093 - DNA, 1188 bp, Glycine max
  Peptide Sequence Number=SeqID_164871
atggcaaacccaacaccaaaacctagtcctagtcttattatccttcgtgtgatcttaggttgttggttgtgttcatccgtggcattgggagccacatacaatgtggtcaattttggtgccaaatcggatggcaaaacggactcaaccaaggcatttctcaatgcatgggccaaagcttgtgcttcgaccaacccagcctcaatttacgtgccacaaggaaagttcttgcttaaaagtgcaaccttcaatgggaaatgtaacaacaagggtatttctataacaattgatggcactttggtggctccttcagattatagggtcaccgaaaactccggtaactggttggaattcgagcgtgtcaacggagtttcgattcacggcggggcgcttgacggccaaggcactgccttgtgggattgcaagaactccggcaaaggaaactgccccagcggagccacgacattggcgttcaccaactccaataacattgccattggtgggttgacctcaatgaacagtcaactgtttcacatagtgtttaatggatgccagaacgtgaagctgcaaggagtgaaggtcttggccgatggaaacagccccaacaccgacggcatccatatccaaatgtcatcacacgtcgccatcatcaactccaaaattcgaacaggcgatgattgcatctccattggtcctggaaccactaacttgtggatcgaaaacattgcttgtggaccaggacatggaataagcattggaagcttgggaaaggatttgaaggaagctggtgttcaaaatgtgacagttaaaacggttacattcactggaactcaaaatggtgttagaataaagacgtgggggagacccagcaacggatttgtgaggaacgtccttttccaagacgcaatcatggagaatgttgaaaaccccgttataattgaccaaaactattgctcagataacaagggttgccccggcttctggagtcagagtgatgtgacataccaagacattcatggaacatctgcgacccatgttgctgtcaaatttgattgcagttccaagtatccatgtagtgggataaagttagaggatgtgaagctcacttacaagaaccaaccagccctggcttcgtgcaaccatgctggtggagcagcattgggttcagttcaacccgagagttgcttttag

SEQ ID NO: 48094 - DNA, 336 bp, Glycine max
  Peptide Sequence Number=SeqID_164872
atgttgattgggcaatctaaccgagtttttagcctgtgtatgtgggggaaggaggcacaagcatatctttcctttttttgggtacgaagaggcaaaagcattgctaaagcagaaaaggacaatgacaaaaaaccaaggggaatgtcggaagtagcacatggaagggatgtgaggaaattagcaacatacaagcataagaagttgatgaggctatacaggttaagggactacacttcacagatccatttatctgaaacagtggcgctgagactgatatatatgtctcaacttccgaaagtgctaaccacactgctcattctgaaacctgagatctaa

SEQ ID NO: 48095 - DNA, 293 bp, Glycine max
  Peptide Sequence Number=SeqID_164873
aatcacagtcacagcctttcaaccacgcttttaaccacactgacttacaagcagcaataggtgacatgagagcaaaatcttactacggattcgtgatgcttttgcagatgctgaatggaacatcacagcctaatagagacttaactttcttgatgccagatgataaagaactatctgcttcatccatttctactgatgaagtggaagagttctttctaaaacatgcccttccaatgcctctatactttaatgatttatctcattttccaactgggacccacccaactgattag

SEQ ID NO: 48096 - DNA, 486 bp, Glycine max
  Peptide Sequence Number=SeqID_164874
atgatggaggtcaacacggctacagtcgttgccgcaagtactaccactgaggtggacccgactcacccatctggcattaatcaagcaagtcatccagtcccggatatggtaggtcagggaggtggagcattgggaagtacaagcggcccccattttgtgcaggtccctcaacccatgggggagacatatgaagcaccccgagaccacactctagccgactctgagcctcacctcggatatgccactgaggggcaggcttttggtggcatacccctgccaaacactttgggggggccctcggtatctgccacaaccacaacccttacattttgtggtggaaagactacttcctaccatggaggcagaaattatgcctttgctgacatggtagagttgtgcctagtgcccgacgtggtcattcctctgaagttcaaggtgccggatttcgataagtacacgggactacttgccccaagaatcacctga

SEQ ID NO: 48097 - DNA, 441 bp, Glycine max
  Peptide Sequence Number=SeqID_164875
atgagtgttgcgtttagcggacgctcactaagccagacaaattggcttagcgagaaggttttatacacaaaagttagtcgtattgatcgactaacaattgcccaatctaactcttgcagacttaggtttcctgctttgattatcgctttatgccgagcccgaggggttgtctctaacagcctcacatttgagcgcctgagcccggccattaacttggcctacatcaggaagaactgttggaacgttgatgatctaacagttgctttccggggggctaagagggcgagggcaaggccagctgatattccatctacttctgcagctccagcacctactccagcatctacttctgcagctccttcagtcccagctcatgttgactatgagcgctttaaagccatgcttcaaagtattcatcagggacaaattcttttgctatag

SEQ ID NO: 48098 - DNA, 459 bp, Glycine max
  Peptide Sequence Number=SeqID_164876
atggccttgggtcctcgtgaaatgagagagaagaaactattaactgatctatacacttgtagagaaggtgttttaactcgaaatccagctagaactaaccctttaaatcctgtgatagacttgggacctgaatttgaaaagtttggtgactttcaaagtcgcttcagatccattccaagcatcattgagttggacagtttgatggtgagaggtgatgtgtggtttggggctaatattactttgaaggggcaagtgactattgctgcaaaacctggcttgaaattggaaattcctgatggggtgacgattgagaataaggttggatgcgtgttgggagaatttgttttgtttggactgttttttttatcagcgtttggacttggtataatgggagatcaacgaccctgcagatatctaaggatgaatgttgtcgaagttgctgagatttggttccagtga

SEQ ID NO: 48099 - DNA, 804 bp, Glycine max
  Peptide Sequence Number=SeqID_164877
atggaagttaatcaagctcagtctccaaagatctctgaggctcaccttttctgctcaaggttaatgatgagtctcagtttgattcagaaggatagagggaaatggagagatacttgcaaaggcactttaatgcctacgccatctttggctgtgagtcacagctacggcagccaagtgtggccattaggtaatcctcatagaatgtggattcccctatttgctgaaccccttcttttacttgctgtgggcactaagctggggcacgtaataacccaactagctcaagaagtagctgaaaagcatgcagccatagaaggtgatttagttgtgcagccatcagatgaacatttttggtttcatcggccccatgttgtcctctttttgattcactttatccttttccaaaatgcctttgagatagcattttttttctggatatgggtcacatatggatttgactcctgtataatgggacaagttcgatacattgttccaaggcttgttattggggtatttattcaggtactatgtagctacagcaccctgccactgtatgcaattgttacgcagatgggaactcactataagagggcaatatttaatgagcatttgcaacaaaacattgttggttgggcacagaaggcgaagaagaggaaaggactaaaagctgatggcaatcctggccaaggaagttctcaggagagtgctaatacaggaatccagcttgggtcaattttcaagaaggcatctgctccaggaggcagttcttctgccaccaaagctgatgggaccaactcagtgtag

SEQ ID NO: 48100 - DNA, 849 bp, Glycine max
  Peptide Sequence Number=SeqID_164878
atggtgaataatctccaagtgcgagtgaagaaatcactccaccatgttgaggtgaatctgtcagagacaaagggatatgaaaagcatgtaattgttgatttattcaaggaaacatatggccagctcataaataactcggagccttgttgcccagagaactgcaaagagaagtacaaaggctgtaataaggtattcttttgttgctctgatgaatcaaagctccaacctgtcaagccactttgcatcactgtccgcctttcatcaccatcaacccaagagcttgttcagattttggaaaatattggaaaagaggaaggaataaaattatcacgcaacttagtggagaagataatcttgaggtccaaaaacaatctacgccaagccattcgatcgttggaggccacttgccgaaataaggatgctgtcaaagacgacgatttaattctaactgggtgggaggaagatatttttaatattgccaaaaaagtagccgaagagcaaagtccacgacagttgtacgtcattcgtagaaaacttcaaagtcttatgattcatgatgttcctcccgactttatttacaagtcattggtaccagagttaacgaatctagttgatgaatcgctacgggcaggggttgccaaactcgacaaggagttcattagacctagtgacatcaaatttcaaactatgaagcagttcggtcatgctcaaaacaaacaagcggaatcggatgagaagaactatgattcaaccaatcagaataggttaacttacttaaaagtcgaagagtttatagcgaaattcatgagttggtacaagaattcgtctgaaaaaggcaataaacagtag

SEQ ID NO: 48101 - DNA, 1767 bp, Glycine max
  Peptide Sequence Number=SeqID_164879
atggaaattgatctggagctacctatatgtgagcatgagatgcttaagagtggatctagtggaaatgatgttacagatacagcatgtgatatataccttgaggagcaaagcatcaatccttcgtcaatgactgaacactctaagaaagttttaagtgaaaatgctttctgttgccaggatcaggaggctgcctattcgttctacagagaatatgctcgttcagtgggatttggcatcacaataaaagccagccgacgctcaaaaaagtctggtaaatttattgatattaaaattgcttgttccagatttggaagtaagcgtgagtctggtacagtggttaatccacgaccatgtaaaaagacaggctgtaaggctggtatccatattaagaagaagcaagatggtaactggatcatatacaattttgtaaaagagcacaatcatgggatctgtcctgatgattttttcaggggtagcaaacaaacaagtattgtagcttctcagaagaagggtatgcaattggctctagaggagggagatgtgcagtcaatgattgaatactttgtctctatgcagttcaaccatcacttccagtacattttacttggatgtgcactggttggggaggagactgtttcagcttttatatggttaatgcgagcatggcttaaagcaatgagtaacctacctcccaaggttattattacagaccaagagcaattcttgaaagaagctgttatggaagtgtttccagataagcatgagcagtttgaaaagagatggtggaaattgattaatagatttgaactaaagaatgatgaatgggttcagtcattgtatgaagatcgtaaaaagtgggtgcctacatttatgcaggacatttctttggctggattgtcaacaactgtaaggtatgaaagtatatcatcatccttcgacaagtatatctgtgttgattctacctttaaggagtttattgaacagtataaagttttctctatagacagttttgacatggaagccaaagctgactttgaaacaaaacaaaagcaacctgcattaaggactgctcatcgagttcaacgttttaatgacctttgtaggcaggccattatattaagtgaaattggatctttatctgaagatacttaccgtgttgcatcccaggccttggaagaaatctataaacactgtgtgaatgcaaacaattttgctagaagcactttagagtccaacaagttggttcttaatggttttgatgttgaagagaaaaatgatggttgccacagggcaaagcctactaagaaaaggaagtcatttaataaaagggaatgctctgatccagaaagaatcaatatcaagatgctggacgatttccaaaagagggaacagagaaatacaagagcacacaactttgataactgttacatttctcagcaggacattcaaactgtggacttggattctagagcttcgactcttgatgtctattatggggctcaacggaatgtgcttggagatctgaactcagtttctgtcatgcgtgattgctattatggtagtcaactggccattcttgggctggggcaattgcattccatgccaagccgtggttcacattatgaaatgcagcacagcatgcaaagaccgcttcaaggactgctcactttcagaacgccaaaagctatggaacaacctattagggactcgcagttccatggcattacatcaaagcaactagatgttgataaatcactttcctcttag

SEQ ID NO: 48102 - DNA, 186 bp, Glycine max
  Peptide Sequence Number=SeqID_164880
atggcgataaaattctattccctaagtttctacatgtacgaagaagcgaaactgtttatactcaattctgtgctggaacttctagtggtgtccaaagtttctgaaacttctggaaagaaagacaatggcatcataagagtagcaggactccaagtcacagtcaataatccgaatgtgagcatatga

SEQ ID NO: 48103 - DNA, 492 bp, Glycine max
  Peptide Sequence Number=SeqID_164881
atggaacggaaagtgacatacccaaatccaatcctgaccctacttcccaagttagaaagaatccaacccccacctaggtcaaagcaagttttttccgtgaaaatgaggcctggatcttttccaactacaatccagaaacacgaatatgcagtagttgtaagcacttcctcttcatccctcagagcccagaggcaaaggtccttcacttaccagtcagttaccacatttgacctcttcttgctgtgctcatggaatggtgggaataaacatttacttagttattcaattgttgtgcatgcacttgattatgaaatgatagtgtgccctttgtacttagcacatgcctcagaccagtgtgcagttgcatttcgcacaccatcattaggatcattcccaagtagatgctttggccttagagccacaaaggatgtgagttactctcttatctttgcatgggctgttttaaactatgcgcaagctttttatgactga

SEQ ID NO: 48104 - DNA, 543 bp, Glycine max
  Peptide Sequence Number=SeqID_164882
atggaaaaaaatttcaaggagttgataggaaagaatgtagaagtatatgtagatgacatagtggtgaagtcattatctattgaacaacatgctcgtaactcggccaagatctttgtagagctcataaagcacaacatgagactaaaccctaaaaactgtacttttgaggttggtggaggtaattctctagtcttacaaaagaaaagaaaacgattccatgacactggtggtcggctagaattgaaccttacaaatgaaataaaatttaccaatgataaaggggagaaggaaagagccatttggggcaggggaagcttgcctaagcgagttggttacttagccctgaaggaatttcacggcccaggcgagctagatgctagcctgggcgagctagactccagaaatttccagaaatggccatttcatccttttccttgtggtttttgtcctggatcgaacaatcaatttgagcgatccctcgaccttgcgttacaatgggtgtcgaatgataaaaagcattccccggacgaaattagggtctaa

SEQ ID NO: 48105 - DNA, 609 bp, Glycine max
  Peptide Sequence Number=SeqID_164883
atggaggaaggtaaagaatggagcgtgaaagagaagaacgaaactacgacgcgaccatccctaaaatcggatgttccattcaacaaatatgaactatggaaacacaagttgagggacaattgctacaaaagggtgcgagaggacagaactcgcttactctggaaatttagatacaaccaacaggaggaggaggacatcgtcaagtgtgcattccaggatattgtatctgatgaattgaacaaaatcaaacgcacggatgagctgttatgggagtatgaaggtcctcaccaggatttagaatgtgatattgaaacttgggaagatgaagtggatgagtacctggctcgtgcagtttttgagcatatgcagctaaatgaagatgaggctcatgggaaagagatttggtgtcctatatgtaagcaaggagagcttaaagacagtcacaatcttatacactgcactcgttgtgaacttcaactaaacaaagctagtgaggggtatttatgggttgaattggtttggattttcccactattggagaacatggaagtggtttttgtgtatttattcttgaacttgtttgagaatcaaggggcaatgatgctatag

SEQ ID NO: 48106 - DNA, 477 bp, Glycine max
  Peptide Sequence Number=SeqID_164884
atgtgggacttgaatttttctcaatgcacctcctcacgcccaacacttttgggtttggtgcgtggaaaacatgatcggcttgatcggacaaacagtatcgggaatgacttagaaaagaatcaagttgcttattcaagaagtgttcacattccagatcacggagatgctggtagcagtaatcttcttaatgagaatcactattcaagattaatagctttagaagggtgtagttgtagtgcagctgcccagctgcttaatgatcgttggacagctgcactacaatcctacaataatcccaaagattcatctgaaaagccagttatgtattcgagtgggacatcaggatggactccgttcagaccccctcaacagattatggccccagctacaagtgcttcctcttctgtgtcacaacaggacttccttggagaacttcgtcgccaaatgcacagtgctaatcctagtttcaccacatga

SEQ ID NO: 48107 - DNA, 1509 bp, Glycine max
  Peptide Sequence Number=SeqID_164885
atggggatctgtactatctctggtgatttccctgtcctcctggatctgcattatgaaaattctgcatcatataaaaatagtgactgttatatagatcatgctggatcagttgttgaaaaaaggaaatctggtgacatgagaagtaaaaagcaaaatgttactgcctatgataaaaaggcccaagattgttatttgttgatgtcttatccactacaaaatcaacttgttcagaagagatgttactatcgtggtattgagcatgactggaaggtttttctcagtttggaatcaactcctgatgcagtatttcgaacagatgctgtaaggtatgcacttgttggtttgatgagggaccttagaggaattgcaatggccacaaacagccgccgaacatatggatttctatttgattggttgtatcctgcacacatgcctctactcttaaaaggcatctcacattggacagacaccccagagatggctgaggagacaagggtggcttatggggcaaaccccaagctccttagatgtccttggccatctcaatacaaaattggcagccatttacaacttggagagataccacacctcaaggaatgcgttacgaccccattgttgaagttcatggctgagtttgtgctaaataaagctcagcgtttgacatttgactcttcttctccaaatggcatacttctcttccgggaagttagtaaactgattgttgcttatggatctagagttctgtctcttccaaatgctgctgatatttatacatacaaatataaaggaatatggatttgtttaacgatactgtcaagagccctttcaggaaattatgtcaactttggtgtgtttgaactatatggtgacagagctctatctgacgctcttgatgctgctctaaagatgacactgtcaattcctatgtctgatatattggcttataggaagctaacaagggcttattttgccttcttggaggttttgttcaacagccacatcacttttgtattaaacttggacacaaacacctttatgcatatggttggctcccttgaatctggacttaaagggttggatacaagtatctcatcacagtgtgcatctgctgttgataatttggctgctttctatttcaacaatatcactatgggagaggctccaaatttacctgcatctgtcaatcttgctcgacatattgcagagtgtcccaatctgtttccagaaattttgaagaccctatttgagatcatattgtttgaagactgtgggaaccaatggagtctgagtaggccaatgttgagtttgatactcattaatgagcagatattctcagatctgaaagctcaaatcttgtcatcacagccaatggatcagcatcagcatcagcggctctcttcatgctttgataaactcatggcagatgttgctctaagcatagattctaaaaacagggataagtttactcaaaatctcaccatatttcggcatgaattccgtgccaaataa

SEQ ID NO: 48108 - DNA, 420 bp, Glycine max
  Peptide Sequence Number=SeqID_164886
atggattgcggaggccgccattacaccttcgtaaggtcgttatggcatcgtcataaccgccatgtgacaatactgcttagaatatggatttttggtctaactcaatcccagaagctagctcaaaggagatatggtgagataagcaaacaaagactagatagggcaattcttactttctttcagcatttccgaaagtcttatgtaggagatcaggctattcattcttccaagcagttatacgcccggttatctgaacttcttggcctacatgatcatctattactgttgaatgtgattattggcaagattgtgactaaccttaagtgctacacagagagtgaagaagtcattgaccacgccttgagtttgtttttggagcttgcatctgggttagttttagttggattaaagagtatttag

SEQ ID NO: 48109 - DNA, 558 bp, Glycine max
  Peptide Sequence Number=SeqID_164887
atggtagatggagcgaacatggacttggaagctatgttcttctcccttgttgttgggtttagtgtcttgattgagcatgtgacctcaactattgaacttccttccttgtggagtgctgacttcaaggcatccaagttcattgtggctgacaaactacttacaaaagtagatactaagacgatggattatgttggagccaataattcctgggactctaccaagaggatcaagtatgttgagttagaggtcaaatttaagatgatcttggaggagaggaagaaactgatcaaagccatcaatgagaagaacttttggttgactacaaagattgaggtcattgatggccttcaacaaaatattttcgatcataaaaagatggtttttgcaaaagctattgaaaatgaaaaatttatcaaggatgtgaagaatggagagctagtgatagaatctcaaatgaagagttttgaggaggcttctagaaatggggagacctccaaggaaagagatatagaagcaacttcaaggcctgcaccaacctccaatgctctaactacttag

SEQ ID NO: 48110 - DNA, 591 bp, Glycine max
  Peptide Sequence Number=SeqID_164888
atgatgagtgaaatagaggaggtgcaagagcagatgaaggctaatatggaggccatgaaagagcagatgaccataatggtggaggccgtgatgagtatgagaaggatgatagaggtcaatacggctatagatgttgcctcaagtaccaccacaaaggtggacccgactcatccacctggcttcaatcaagtaaattgtccaaccttggatatggtagggcaggttcagaacaagcatttcttgccatcatgtggattgcctcccaactatacaccacccaatgttgtacacgctcctgatgagaatgttaacaactctgcacctatagccattgagagccaacaaccccaatctaatcatgcacatgtctctcaacctatgggggagacacatgaagtaccccgagaccacactcttgccgactttgagcctcacctcggatatgccactgggggggaggcattttttaggcctcctgctatggtggaaagggagaaatttgatcatatagaggaaaggctgagggtcattgaaggaggtggaaattatgcctttgctgacatggcagagttgtgcctagtgcctgactag

SEQ ID NO: 48111 - DNA, 125 bp, Glycine max
  Peptide Sequence Number=SeqID_164889
caggtcttgcagatcatgataattaccatgagttttgtcgtcttcttggtcggttcagagtgaattatcagggagatggggttcatgctgtggaggctaggtacatactttggcttagaagttag

SEQ ID NO: 48112 - DNA, 120 bp, Glycine max
  Peptide Sequence Number=SeqID_164890
atggctggcggtagtgaatttcatccaaaaattgtctatcggttagctgaaggttgtttggtactcgaatgggcaccggagtggaagtttggaagtaaaccccactatcattgtgaataa

SEQ ID NO: 48113 - DNA, 123 bp, Glycine max
  Peptide Sequence Number=SeqID_164891
atggaagatgtgaccaagacacgtatctccggtgcgtgtgatgggagcacaagtcgaggcactaacagtttcacggtgttgcgattagtacacgtgattgagatttggatactaaatggctaa

SEQ ID NO: 48114 - DNA, 459 bp, Glycine max
  Peptide Sequence Number=SeqID_164892
atggctgcaccaccagatttctttacttcctctcctttggcaattcttcctatacctcctcctctctcacacaaaacaaccttgcctcagaaagttggtagcagagttggagaaaaatcagaaggctggaaaatagattcatcgtcaaattcttgcccatttcctagctttgttgttgctgcaatgcttttgttgataatgcttgctccaactatgaggatccaaggcgctccattaactatggagccaaggagagggccagagtttcctacaacacaacttacaaaaattcccttctacattgccacaaatgtgcctatagcaatgctttcatcaaaaaaagaatttggctttctcgagctgagggatattggtaatacatctattccatcctccacagctgcatccaatgcaaccaatatatcactctctcgaaagcctttaaagcataccctgtaa

SEQ ID NO: 48115 - DNA, 300 bp, Glycine max
  Peptide Sequence Number=SeqID_164893
atgctggttattgctaaacttgccattggcctaggtagaattgcctttttgttctgggtcctaggtttgatccaggcagaaaaattggttaaggtggtgtggacatatgcaaagaagaccatcaaagatgccaatgaggagagtacatcacatgtaattaaaagagcagaggcaaccattgatgaggaaggacatgggactcacagaacaagcacagttgttggtgcttttgttgatcatgcagaagtacttggaaatgttgaaggcacagtagcaaggattccccttatgctcacctag

SEQ ID NO: 48116 - DNA, 384 bp, Glycine max
  Peptide Sequence Number=SeqID_164894
atggagaccaatacattcctgccaccagccacaaagtccgaggccaagtactcttatgacaaagagatccaaaacgggaagacaaataccaagcggctctctgtacctagccaggaagcatcttttggaaaggacatccccaacaacatgaagcagagaaaatataaaagcaagaaaataccctcccgacaaaaaataaaaatatggaatttttgcctaacaaaacaaaaattagtacatttttttggtggggtgaacccaaccgatgcagcctcttcttttgctggtgcctctatggtgtcgtcatcggcggctactgctttgattgttctggagaacttgaggggcttcaagcgggagaaggagaggcgcggtcgaaattag

SEQ ID NO: 48117 - DNA, 183 bp, Glycine max
  Peptide Sequence Number=SeqID_164895
atggatggtgttcttcgatctgttagaagtgattctgcaaccagaagtgtcatcgtcattgcacacaggctttctaccatacaagcagctgacaggattgcggtgatggatggtgggcaaattgttgaagttgggataagactacccttcctagacccacttggtgggaacctcgtgcattga

SEQ ID NO: 48118 - DNA, 670 bp, Glycine max
  Peptide Sequence Number=SeqID_164896
atggcctgcacgaaaaaatctggtcaaatgacgtcgaaggcgacaaagaaaattatagataggattgtaagtgactctcatttgtcaatgggaagctttgtcacccatggacatcaggatgtactgactgctgccattgggcgaccagaacactctggttgtgtttgtgctgttggagccggtgtcacgatcaaacaatattttggactggcttcaaggatctctcgcacatctacgtccatggctcccaaagacctggagcaactgacacaaaaaatcaaggaccagctggagaaatcaatcacacaaaaaggactcgcactacctcttgagcttgtggttgatccttctactacccatgtcagtacaaaggaaagttgtgtcgatccctcaaggcaggatccaaacacggctgactcagagaaatgggtcaaccactgtccacaacatcccttaggcaatgatcaagtcaaggttggtgttgaggaagttcgagatgttgatgctcgcattattgtatccactcaagagggtaaacagggagctaagggaccagcgaaacctgcagataggcctgatcctgatgttgatcctctatacctgatgacattgaccatcccacatcttttccttaagcctttgcaggccataggatgctaccgtgtttggg

SEQ ID NO: 48119 - DNA, 1215 bp, Glycine max
  Peptide Sequence Number=SeqID_164897
atggaggaaagggtagcaagcaagaccgagttcacagaatgctggcgcagaacaactgagtcaccttacatcatgcgccttgctttatctgctggcataggaggcctcctctttggttatgatacaggaaaccattgtgagtgtggctgttgctggagctgtaattggtgtgcatttggagggtggatgaatgacaaactagggagaaagggaactattttggtggctgatgttgtattctttattggtgctttggttatggccattgctcctgctccatgggtcatcatacttggaagagtgtttgttggtttgggagtaggaatggcatctatgacagcccctctatacatctctgaagcttccccggctaagatcagaggtgctttagtcagtatcaatgcttttctcatcactggtggccagtttctgtcttacctcatcaatttggcattcaccaaggctcctggaagctggcgttggatgcttggggtggcaggagttcccgctgtgatacagtttgtgtcaatgttgtccctccctgaatcacctagatggctctatagacagaacaaggaagaggaggcaaagtacattctgtcaaaaatctatcgtccaagtgaagttgaagacgaaatgagagccatgcaagaatcaattgaaactgagagggaagaggaaggtttgattgggcatagtctagcacagaaactgaagaatgccttggctaatgttgtagttcgaagagcgctctacgcaggcatcactgtccaagtggctcaacagtttgttggcatcaatactgtcatgtattacagtccaaccatagttcagtttgctggaattgactccaactccacagctcttgccctttctctggttacttctggattgaacgctgttggctctatcttgagcaaggttttcagtgatagatatggaaggagaaagttgatgctcatatccatgattggaatcattgtttgcctcataatgttaagtgttacattcaaccaagcagctcatcatgctcctgccattagtaaccaggatacccttagctttggtgctaactctacatgccgggcttacacaaaggccccaaatttctcctcatggaactgcatgcattgtttgcaagtggactgtgccttttgtgccagtagcaagcgtgatgtaagtgttactaaagatttgagtttacttttgatatag

SEQ ID NO: 48120 - DNA, 681 bp, Glycine max
  Peptide Sequence Number=SeqID_164898
atgcagagagagcaagagagggagaggaggcgcatccgtgacaggcagaggagacaatcaatgactcgagaacaaagggaaagacatcttgcaagacgccgcagaaactatcagcttcgaagacaaagagctgcaaatgctcaaattccatattctcctgttcctcaacttcaacttctagaatcaagtgcaggtgaagccagtaccagtgatgagcttcaagttgtcacttcttctacctttctagactatggagtcctttctcaaggcattgtttcccctcatcatggcctcaaccaaggacaagaaacattacattttggaaccaaagttcttgaaggatcatcacttccgttggaaactctagtttataaaccagccaattcaccaaggaggatgcgtctgaatcatattaaaggtcttatgcgaaaccggacacattcaatagatgatcctgctgttactcaccagttggcagcagagttgatagctaaggaagatcaagatgtatcacttggtaattttggaagcacaccaaaatccatgcgtttgaactgtgtgaagcgtcttgcccggtcaaaaaattctcctcccaaagagactgcagatcaaaaagaccttaaattgccaccagaaggaattcaagtacttggtaacgagagcttcatagcctctaactaa

SEQ ID NO: 48121 - DNA, 162 bp, Glycine max
  Peptide Sequence Number=SeqID_164899
atggccttaaaagtgcagctatgcagcagttctttgatatctgaaacaatcaggcagaagcacaagaccctgaaaggaccaagtactaggaggtataataaaagcagcgatgttgaacacgggaagattgaaactgggatagcagtgacaatagagtggtag

SEQ ID NO: 48122 - DNA, 1230 bp, Glycine max
  Peptide Sequence Number=SeqID_164900
attcttagagctctgttggttcctccctcccctggctttggtggggttgaatggagcaactttgtgtatatcaggaaccattctccatcatttggtgttggggttaggcaagataagtttttggaggttcctcagattgtgtggggattgaacaaccagaagattgcatttgcaagggcttgccataccgctagaacgatgaatcgaattctgttgatgcctagtcttagtgcctccttgttttacaaagaaattgacctcttgcaacccatttcctttgacagggtgttccaatatgacaagtttaatgcactgtgcagcgggtttgtgcaactgggtcggtactcagatctctcgaaccaaactcgggtgcttgagatgcagaaagggagtggtaggaagtggacagtggagagggatttggatcaattgagagattatagtaaaggggagtttgaggaccacgaggtgattaggatagtggggaagaaccctttcttgtggcatgatcattggcctgtgaaggactatgcaaaggtttttgagtgcttagttttgatagatgagattggtcgagaagcagatagagttgtgtctaggattagagcagttggaagagaaacacaaagcaatagtgaatcagtggaattggagaatgatagttcttcttttcagcctcttccttatgttgctgtccacatgagagtggaaattgattggatgattcattgcaaaaaattggagcagagattgaacacaaaccaaatttgtagtagcaagaaagagataatggaaagagttgccaacatcaaaggtttgaagactccatccgttgtttatcttgcagtagctgataaactccttcaaaattcttcagtacttgaaggttgggaagaaggctttctaccttatgagaagaagaaacttggtgttgatggaatttacaagaagtatccatatctaattcaatcagcaattgactatgaagtgtgcttgagggctgatatctttgtagggaacagcttctccacattttcgagccttatagttcttgaaagaacacaaaagattatcacaatgggtgtgaacatgtgtggaaaagatgtaacatggccctcttatgcttacaacatacaaggagaatcaaatggccctatgagatgggtcacaaatatgtctcattcaacccttcaagaaatcagctatggcaccaaccacatttcttgttga

SEQ ID NO: 48123 - DNA, 1659 bp, Glycine max
  Peptide Sequence Number=SeqID_164901
atgcaaacttctcagaagcacccaacttcagctggtatccatttataccaccagcctgcacaagatattgatccctacactcattaccaaatactacaaagcaattcatgccatgaaatccatgataatagcagcagccagggaaccactatttcttttgaaaccagcaaggatcaatactttacccttgaatcatccccagtaatcaatgatctcataggttgtgattctccttcctatgctagtgtgtcatctaataggagtcctttttctccacaagcttctcattcataccattctgaccagcatcagtcatcagacaacacatatggatcaccaacaagttcacactctactgctgatgacagctacgaattgaagaacaagcttagagaactcgagatttcgttgttggggcctgattcagacattgttgacagttgccactgctcctacaagggtggttgccacggagcatctccaatggctaaatacaattgggatcagattgtggaaatgattccaaaattaaacttgaaagaagtcctcattcggtgtgcacaagccgtggctgatgatgatattgaaacagcagtgggatttatgaacaatgtattggcaaagatggtatcagttgggggtgatccaattcagaggttaggtgcttacatgttggagggtctaagagcaaggttggagtcttcagggagcataatctacaaagccttgaaatgtgaacaaccaacaagcaatgatctcatgacttacatgcacatcctgtaccagatttgcccatattggaagtttgcttacacatctgcaaatgctgtcattggagaagcaatgctaaatgaatcaagaattcgcataattgacttccaaattgcacaggggactcagtggttgttgcttattcaggctcttgcatctcgtccaggtggaccacctttcgttcacgtaaccggtgttgatgattcccaatcatttcatgcaaggggtggaggacttcacattgtagggaaacgcctctcagattatgccaaatcttgtggagtgccatttgagttccacagtgctgcaatgtgtggaagtgaggttgaactagaaaaccttgtaattcaaccaggggaagcactagttgtgaacttcccttttgttttgcaccacatgccagatgagagtgtgagcacagagaaccacagagacaggctattgagattggtcaaaagcttgtcacccaaggttgtgacacttgttgagcaagaatccaacaccaacacttctccctttttccaaaggtttgctgagaccttgagttactacactgctatgtttgagtccatagatgtggccctccccagagatgataagcaaaggatcaatgcagaacaacactgcgtggctcgcgacattgttaacatggtagcttgtgagggggatgagagggtggaaaggcatgaactcttggggaagtggaggtcaagattttcaatggctggttttgcaccatgccctttgagttccttagtcacggatgcagttagaaatatgttgaatgaattcaatgaaaattataggctcgaatatagagatggtgctctctatctaggatggaagaatagagctatgtgtacctcttctgcttggagatgttactga

SEQ ID NO: 48124 - DNA, 1371 bp, Glycine max
  Peptide Sequence Number=SeqID_164902
atgaagtctcttctgaacccaaagttctcagctttatctcccaaagcctctccttttgctctgttctcacttccttctcaatccacaactcgattctctttccgcagcaacccgcgtcgaatccccaatcgtctcctccgcctcaacccaccacccttttcgtccaataatttcatttgcgccattcaaaatcgaagcttgcaaacggagccctcgccgcctccctccggcgagattcacgtcattgtggggcccatgttcgccggaaaaaccacctcgctccttcgtcggattcagtcagaaaccgccaacggcagacacctaataagaagtgcccaacaagtgttgggatttgtcagtattggaaatgtgtccaacacggcagcgacacttcgtataagagaggtgtctgtgcttcatagtgtatatctcaaaggttggagaaggaacgcttattctggaaatagtataaggggtggaggttttagattgttttcaaagatatctgaagattttaaaccaaattatgttacttttcttacagttttggttggcgaaaggcatagatgctggatattatgttgccttggcaatgcttatgcctcctctgggttctgggacaatgttaaggaggttagggctacaaaggagcctggtcacagcaggattgctggtccacatcctttgggtatgagtctaatctctccccaagcattggaatgttgtcttggccctgagcttaaggtgctttggtgggttttgaatacctataatgtatctttaacctgcttgcttggctctgagcataaggtgctttggtgggttttgaattcctatactgcattaaaaaatgtagcaataattaaatcaagcaaagatacaagatatggattagactcaattgttacacacgatggtgcaaaattaccatgttgggcactggcaaacttatcatcattcaagcagaagtttggaatggatgcttatgagaagctggatgtgattggtattgatgaagctcaattctttgacgacctatatgaattctgtcgtcaagctgctgatcatgatggaaaaacagtaatagttgcaggactagatggtaactatttgaggaggagctttggttccgtccttgatataattccccttgctgattcagtaaccaagttaactgctagatgtgaaatatgtgggaagcgtgcttgctttaccctgaggaagacacaggataagcagattgagctgattggtggtgttgatgtctacatgccagtgtgtcggcagcactatgctagtggacaggtagccatggaagccacaaggcatgtccttgaatctaagaaggttgaatgtggctcccatacatga

SEQ ID NO: 48125 - DNA, 654 bp, Glycine max
  Peptide Sequence Number=SeqID_164903
atgaacgcagtgaggcgtagattgttgcacactcttcgcagcgacgccccctctggaacactgaagagaagggcgttggaattggagaagaagagaaagactcggcactcgaagagcaaggaccagttcatcgtcacagttcccgaatccctctcctacctcgacaccgccaccatccccatgtacttcgccgccatcggaatcgctctcttcgccaagctcctcatgacgtacgatgattcgaggtcccaagagctgctggagcggaagataaagaatgcccctgaagggcaaggcagtgttagaatgctcactcgagaggagtgggatgagtttcgagaagtcaggcccagaactccgtttgagtccacgcttgcgcgccccaattccagaataagaaccggcgaaccgttgcgtctgtttttaatctattttcgtccttggcatccaaaattgtggagtctagaagggattaaaaagtatatagggacaatgttatcaatgacggatggcgaaacacggcagaaggccaaaattctgccatataggcatgctattgtggcctatggcaccaccatagcaagcctcccttcacaaattgtctatggcagttggcgaaaaaacctccacgccattccgccatggtggccatag

SEQ ID NO: 48126 - DNA, 432 bp, Glycine max
  Peptide Sequence Number=SeqID_164904
ctcgccggagatgtcgctgctgcaggcggagaagtcgctgaaggcctgcgacaaatcgaggagctcctcctccgtcggcgagtatttcaccgatttgctgttccgcagcgccagctcgccgagacggaggtcgacgacggagtcggtgaggttttccgagagacacgtggatttctcggtgaaggagcagctgctgctgttgtcgtcttggaagaaattggagcgtatagtgcgcatggaccttccaatttgacgctgcgttttggacgaaaccgaggagtggtactggcggtgatgataaggtgggaccctttgaatcgacgtgacaaatgtgttggaaggattctggtgctgggaaatacagttgtcaagtataaggaacgagtggcacgtgttgatggaatcagagcatgggtgttgcactttacctga

SEQ ID NO: 48127 - DNA, 288 bp, Glycine max
  Peptide Sequence Number=SeqID_164905
atggaaaaagaattttctaaaacattcgcgtatttcctttataactgtcatcttctcttccacctgaaagttcccgaaatcccgttctcagacttgcgactcttccctcactctgatgatcctcttcttcaagaaacatcgtctgagctcgtggaacatcaatcaggtgtgggcgtatggggacacgtagaactgcatctgtcagtcaggggagcagccttcgctatgcatcacgcagcggaggtgcttgcctgtgccgagggcctgggtcatgccttacgccgttga

SEQ ID NO: 48128 - DNA, 480 bp, Glycine max
  Peptide Sequence Number=SeqID_164906
atggttggaaagttgttggtgatgaggcttgtgttggtcatctatatgttgagcactgtcattttgaaatcctcagcacaagcatgcaagaacaagaccttcaatgacaacaaggtgttcgccaaatgtcgtgatcttcctcagtcatcctcatatctctactggacctatgatcaagccacagggaagttggacatgacattcacacatgctggaatcactgcaccagaaaggtgggtcgcatgggctatcaatcccaacaacaacctcaaaacagctatggttggagcacatgcaggctctggtggtgctccaagggcatatactacttccacaaccaattactcaactcatttggaagaagggaacatttcgtatcctcactcaggcttggcggctacccgtcaaaacaatgagatcactatctatgctatcctgcaccaaagttgttcacctttggcaagatggtcctctctctag

SEQ ID NO: 48129 - DNA, 162 bp, Glycine max
  Peptide Sequence Number=SeqID_164907
atgacggcacaaacgattgaaaacaggtggaagaggaaggttggtgccgtggtgacgggcaatcgagcgttcggggaggtcaccgtcatcgtcggtggcacgtgtggtggaggtgccgctattcgttgcaaagaaattaagaaaggtgcaagctttgcgtag

SEQ ID NO: 48130 - DNA, 618 bp, Glycine max
  Peptide Sequence Number=SeqID_164908
atgtccaaatcttgtggatttgggatgaccggccctctcgatgagtcgatctcttgctttctcataaggatggacccttggttacttgtacctatcacctttagaggactacacgtcctcgccttgagaggactacacgtcctcaccttccgaggactacatgtcctcaccttcagagggctacgcgccctcgccttcgtagggctacacgccctcaccttcagaggactacatgtcctcacctttagagggctacacgccctcggctccgaggactattcgtcctcatcttcagaggactacatgtcctcaccttcagagggctacgcgccctcgcctttagggctacgcgccctcgccttcgtagggctacacgccctcaccttcagaggactacatgtcctcacctttagagggctacgcgccctcgccttcgtagggctatacgtcctcacttttagggctacacgccctcaccttcagaggactacatctccgaggactatacgtcctcatcttcagaggactacatgtcctcaccttcagagggctacgcgccctcgcctttgtagggctacacaccctcaccttcagaggactacatgtcctcacctttag

SEQ ID NO: 48131 - DNA, 114 bp, Glycine max
  Peptide Sequence Number=SeqID_164909
atgagaatgatgcgtgatttcgggttaggtttatggggtggacttaaatatctaggaagtgatcttaggtcgtctcccaacgagcaatggtcaaccaacgttcataatagatag

SEQ ID NO: 48132 - DNA, 453 bp, Glycine max
  Peptide Sequence Number=SeqID_164910
atgcctgcaacaaatcatcgaagggttgcttgctcgtttagggaccaatatctttttcagatatttcagatatctttaacatcattgggtcaactgaagaatgatgttgtcaatcaattgcaagaattggcacttgctctatctttgaaatgtttatcatttgattttgtggggacttctgttgatgaaagttcagatgagtttggcacagttcagattccatcaccttggaagcctgttttggaggattcttcaaccctacaaatattttttgattactatgccattacaaagccccctctttcaaaggaggctagctatttgagagttgagattggcaatgatgaaaaagcctttagaatggaaatgtgttggccaaagaatgataagaggatgactggcaaattctggtggcacaccttcttggttgttgcagagatttcttatttttaa

SEQ ID NO: 48133 - DNA, 972 bp, Glycine max
  Peptide Sequence Number=SeqID_164911
atggaccggtttaaccgagtgagaattaagttaggtgctcctcctcctataaagctggacaagaaaaagaagttaggttcaaaaccagaaccccctgttcttgacagtgttcctgcctcaaaagttggggcaatttacctatctgatgcttcatcaccaatatcacagtattccgagaagaaaaaggtggagacagaaaacaatgagcacgtttctcctcagacaaatatccaagctgtaaagcctgtcaataacaaagaccaaccaattaaggagggtgagcagcacgttgggaacccaatgctaacaaatgatgatgaggacaaaattgcttctaataaaattgttccaatcagccttcctatttcagaaagtgatgatgatgagtctgtgatgagttctgaaggccgtcttcaagttggaagatatcaaataaaagaaagttttggttccatcttgcaatctatccttgacaagtacggggacataggagaaagctgtcagttggaatcggttgccatgcgctcatattacattgagtgtgtatgctttgtggtgcaagagttacataattcctcatcgataatgcaattaagcaagtccaaagtcaaggaattattggctattcttaaggatgttgaatctgcacaacttggtgtggcttggttgcgtagcgccctcgatgaactagctcaaaatattgaactcattaataggcaccaggaggtagaggcacaaaaggataactctggtcgccaagtggagtcattgagacaagagctagaaacagagttggaaagtttggctcagaaagaacaagaggttgccaatattaaaacacgaattcctgagatcagaggtcgtttgagccagctccagctcaagtcagaagaactcaacagaagcatgctatctatcaagtccaaggttcataatttgcatatcaaatctttggtggatgaactattataa

SEQ ID NO: 48134 - DNA, 1320 bp, Glycine max
  Peptide Sequence Number=SeqID_164912
atgtactatattcctagaaatctgggacaaagacaagttggggtaggggttgggccaatgagctggcgccacgctgtcaaagacattgagcagcataagcatcttatgatatttgtggattatgctgcttccatcttccccatcattgctcatgccccctggaatgggattcacttggctgatttcgtcatgcctttttttcttttcattgctggaatttctcttgccctcgtttataagagaaggcctcatagaacccaagctacatggaaagcttttgctagagctctcaacctctttgctcttggtattcttcttcaaggtggctattttcacggagttacttccttgacttttggtgttgacattcaaagaattcggtggctgggcattttacagaggatatctattggatacattgttgcagctttatgcgagatctggcttccagctccacgatggaaagaattaggtttcgtcaaaagttactactggcaatggtttgttgcagtaatattgttggcactttactctggattactgtatggtctatatgttccagattggcagtttgatgtatcagcctcgacctcttcattgcctcctattggtggtggtgatatttacatggtgaattgttcagtgagaggtgatcttggacctgcctgtaattctgctggaatgattgatcgctatattcttggtcttgaccatctgtatagaaagcctgtttacagaaatctcaaggggtgcaatatgtctgctaagggtcaagtttcagatagttcaccttcatggtgtcatgctccttttgacccagaaggcattttaagctccataacagctgcagtttcgtgcataattggacttcagtatggtcacgttcttgcccatctacaggaccacaaagggcgcctatacaactggatgtgtttttccctttcatttttggctcttggactgtttctggcattaataggaattcctctaaataaatcgctgtacacagtcagttatatgctactaacttctgcagcttctggtctcacattcattgctttatattttctggtagatgttcatggtcacaggcgtttgacagcgttgttggagtggatgggaaaacactccttgagtatatttgtcatcgtatcttcaaacttggccgtgattgctgttcaaggattttattggactaaacccgaaaacaacattgtaagatgctttatgctagaaaacgttcccgtgagccttggtagtgcaatagtcctcacgctcacacccttttctgttgggctggcccaggtcgtgttgtcctaa

SEQ ID NO: 48135 - DNA, 273 bp, Glycine max
  Peptide Sequence Number=SeqID_164913
atggatttgaaatcacgaacaacaataatcttcactatcacatacccattatcttttcgtcgttccgcttcttgttgtcgatctaaaaagatcattgccctgcctccgcttctatctctaccacaaccactctactcggctggaattgcagtctcatctaacgacaataatcgtctcactgtcatcgccgacaacaatgtgttggcaaaggcaaagaagaagagcgatagtgcccgattatggatgagatttgatcgattgggtcagtcataa

SEQ ID NO: 48136 - DNA, 1160 bp, Glycine max
  Peptide Sequence Number=SeqID_164914
atgggatttgtgcacaaattcgccatcaatatcataagatctggtgaaactctttccagatttgaaatatcacctgggaatgtgaaagttagggatttatggataccgagaaggttttctgattcatggaggaagtttacggtagctggtgaaatcgaggaagaaaaaggcgatagaatcgacgctgaaagggtggggccagaaggattgagtgaaggaaatgggaacgaagtggaggaactcgaggacgacggactttgggcacagatcgatggaatcgggacagttagaggatgtcagaagcacgtcggggaggacaacattcagctgaatgaaggaaggaatgaagcaataacagctcggacgcttgtaatactttctgctcttgctatgatcttaatccaaccagctattgcaccagcagcttttgctacctttcaaactgctgccaagaccggtggtcctgctgctgcagttggtagaaaactaatccatactgagctcctaagtagtgcttggactggtttcttagctggctgcttgcacaccttatcagggcctgaccacctagctgccttggctccattgtcaatcggtcgaacacgaatggagagtgctgctgttggagccctttggggttgtggccatgatgctggtcaggttctttttgggttaatatttcttatcctcaaggatcaactccatattgaaattatccgaacttggggcaccagagtggtgggtcttactctgctaataattggtgctttgggaattaaagaagcttcagaagtacatgccccaattgttgcattagaaagtgatgaatgcaatgtcaacgtgtatgaatcacttgataatccaacagtaggcaaaaagaagataggttttgctacttttgcaacagggatagtccatggcctgcaaccagatgcattgatgatggtgttgcctgcccttgctttgccttcacgtttagctggtgctgcatttctcatcatgttcttaattggaactgtaattgcaatgggaagttatactgtgtttataggctcgtgtagccaggcactgaaggatagagtacctaggataaccgagaaactcacttgggcttcttcccttattgcaatagccctcggattggctatcattattagcca

SEQ ID NO: 48137 - DNA, 177 bp, Glycine max
  Peptide Sequence Number=SeqID_164915
atgcataagaagaagaaaaagaagaagcaggaagttgagtccttgcacgacatagatagcaccgttaaatttggagtgagggaagctgatggaaagcatgttagttctaggaaccctagaattgagaaatgtagttctatgttagataatcttgtgggctcactagattttcctaag

SEQ ID NO: 48138 - DNA, 480 bp, Glycine max
  Peptide Sequence Number=SeqID_164916
atggagtgtcttctcttactccaacttagctcccacatcccacacctcagatttgaagatgtacaaagccaggttgtggctccaccaggaactatcttgacagttgagcagttcatggggaaggtggaggtcccagtgctcaagcacctcagcagctacatgatgcatcttcagaggcctccatccctgagccatttgtttttgaggcaggaggctgctactccagagaggtcaccacagatttcactagatccaccctcgccagtggtggatcaatcttctcctcagcagctagcagaccctcctacaccagtgcatgagatgccagcagacctttctactccattattggagattctagaggacctttccacactagtcttgggactgactaccactcctccagccactcctatgctacattttatagatgaggagggcactcaggatcaggatacccagcaggatgaccagtcatag

SEQ ID NO: 48139 - DNA, 309 bp, Glycine max
  Peptide Sequence Number=SeqID_164917
atgagtcatgcaaataaaaagaaagaggttgttatcatgcgaagccactatgtaaagaggatgttattacatgaagccactgtgaaagtgtacccttacatagtctttgtctattttgaagttgatttggtcacagaaactgataaagcatgtgaagaactcatatttaatcatctgaaacagctttatcccactcacaagttcattggggaagagaccacagctgcctatggcactacagaacttacagatgaacccacatggatagttgatcccctggatggaactactaactttgtgcatgggtaa

SEQ ID NO: 48140 - DNA, 1635 bp, Glycine max
  Peptide Sequence Number=SeqID_164918
atggtcggagaacacagtacgacgtcaccagcttccggtgatcacaaaataccacttcttcccgttcacgagccagtggaaggaacacatacaaacatctccttcagcaccaaatcgattctaacactacaaaacttctacgtgattctgggacctatgctgtctcttttcatatgcctcttcgtgaaactcgacgcgccacccaccagccagaaaatgcttggtgtgattgcttgggtcttctcttggtgggtgacgcaggccgtgccacttcccgtcacctccatgtgtcctctgtttctgttcccaatttttgggatagcttcagctgatagcgtggcgcactcttacatggacgacgtcatcaccctcgttttgggaagcttcattctcgctctcgccgtcgaacgctacaacgttcaccggagattggccttgaatgtaacactgctgttttgtggcgacccggtgaatccagcgctgttactgttagggctatgcgcgacaatattcttcgtgagcatgtggctgcacaacgtggcgacggcggtgatgatgatgccggtggcgacggggatcgtgcagcggctgccgccggcgcacgagcagtcggaggcggtgaacaaattctgccgcgcggtgattctcacggtggtttacgccacgcccatcggtggaataagcactctaacgggaacgggtgtgaacttgataataatcggaatgtggaagagcctcttccctgaggcaaagccaataagcttcaacacgtggttcttctacggtttccctgtggctgttctcatcctcatttgttattggtgcatcatttgcctcctctatgtgcccaaaggttcggctcgggctttgtctgcttacttggatagagctcacttgaagagagacctcgaagctctcggtcccatggcttttgccgagaagatggtgttgtctgtgtttgggttgctgatcatactttggatgacaagaagaataacagatgacattcctggatggggatctttattccatgaccttgttggagatggaagtgtcagtgtaagtactgtacctactatagagattatggtggctgttttattgttcataatcccaaacatgaagcaagagggggagaagctaatgagctggaatgactgcaaaaagctaccttggaacctcattttgcttctaggagctggttttgccatagctgatggagtacaatctagtggcctggcagatgtgttatcaagagccttggatttcttggaagatgctccatacttggcaattgttcctgctgttagtctaatatgtagtattatcactgagttcatcacctctaatgatgctactgccacccttctagtcccacttctttatcacatagcaagaacaatgcatgtgcaccctcttcttcttatggtccctggaggaatagcaaccgagtttgctttctggcttccaacttctacaccatcaaatgtagttggctttgccactggacacatagaaattaaagacatgctcaaagttggcgtgccactcaaggttgttgggattgttgtgttatctcttctcatgccatcactaggaactattgtttttggaacaaacaatgatactcaataa

SEQ ID NO: 48141 - DNA, 1329 bp, Glycine max
  Peptide Sequence Number=SeqID_164919
atggagccttttgattacactcctccacaaactgagttagaagctaaaacacaacaaaatcctcttcctgacagtcacacatcagatgcaatagacacatcacataatcttataccagtaccacaatgtccaactatgagaattagaaagcctccttcatatctacaggattatcactgcaaccttgctactgccactgatgtgccacatcaatcttcaggcaaaggtaatctctatcctctttctcaagtgttttcctatgatcgtttgacaccttcatatcagtcttttgttatgaatatcaccaccacacctgaacctactaattattctgaggccgtcaaacatgaatgtttgaggatagccatggatcaagaactagaggcactggcgaggaacaatacatgggtcctagttgataaaccacctgataaaaacctaattggtcgcaagtgggtctacaaagtcaagcacaaacaagatgggacagtagaacgatacaaagcaagactagttatgaagggttacactcaaatagaagtggttctacaccaattagatgtagataatgctttcttgcattcaaatctagaagaagaaatctatatggctttaccgcaaggtctatcgacttctaagcctaatcaagaaatgacatttctctgttttaaggcagcaacaacacctatggatacctccatcaagctgggagctgctattggcaaaccactttttgatattagctcctatagaagattgataggaagactcctttatcttaccaccacaaggccaaatatagcttttgcagctcacatgggtgtggccttttctacccagcatcaaacgctcacagcctacagtgactctgactgggccggttgcattgattctagaaaatccattgctgggtattgtttatacattggttcttctttaatctcatggcgatccaagaagcaaactactacaacaaggtcctcctatgaagccgagtatcatgcaattgcagcaacagtgtgtgaagttcaatggatttcttatctatttaaggatctgcaagccgctgaaccttctcccgtgtcactcttctacgacaaccgctcaacaattcatatttctcacaatcctagcctccatgagcataccaaacatattgagttggattgccacattgttcgagagaagctcaaccaaggccttattcatcttttgcccatcccctcagcacaacaattggtcgatatttacataaagcctctaacacttgcaccatttagatctattttttccaaactgggaatgattaatatacattctccggtctga

SEQ ID NO: 48142 - DNA, 1116 bp, Glycine max
  Peptide Sequence Number=SeqID_164920
atgaggatccgtaagagacaagtgcctttccctctcttgccggtgactcactcagatcccaacctgatcaaccggtcaccggtgatggtgcaactcaacgatgacaccaaagcttcttcttgcactacttatcatggttcaaccatcactgcaccctcacccctcttggatcgccctcagccggccgatcagcctctcccaccgatcgggaagcccaccaacggctctgatgagtcctccggagaatggcacaaaaagcaagaagagtctttggtggaagatgggagaaggaatgaagagggagagggacataagggtaatgatgccaggaaaggaagcatctcgtgttcagaaacgctagctgaaacattttcatctccaagccctcctaaacaagatgggagatggttcgagggagataaagcttttcctctcaagaaacgaagaggggccttcgagaatgcaacggaagatgataacaataataatgacaatgatgacaacgacaacaagaatttgaaaacaaaggggaagagaatgaagacaaagataaaccagaaatgttcgaggcaagacgacagcaaagaaaaagaagaggaagaagaggtaagagagaacgaggaagaggtggcaacaagagcaacaaaacccgaacaagaaaacgttggtaagaagagggtaaggggtggtgcactaatggaaggttcaaggtgcagtcgtgtaaatgggagaggatggaggtgttgccaacaaaccttggtgggttactctctttgcgagcatcacttagggaaaggaaggttgagaagcatgacaagtgtgagaaacaagtccattggcacaacaagtgttgcaccaaagaacaatatcaatattgtgcctcaatccgagaatttattcgaaaaacaaacaacaaagtctagtactacaagtcgtgtcactcatgaagagtaccctttgggaaatgatgctgaaaacaatgatgagaaaaagcaagtgattgtcacaaagaggaggatgaagcttggaatggtgaaagctcgatccataagcagcttgctggggcaaaccaacactgaaattgttgccatagctgaggataatgataagaaatag

SEQ ID NO: 48143 - DNA, 189 bp, Glycine max
  Peptide Sequence Number=SeqID_164921
atggtggctgaaactaggattccattgggtagggacactttgataggtgatgtgattcgtggcaccaattaccattgcttgtcggagttgaatgagtacaagcgtttacatgggcaatgttctgtgtggagtccctctgatcttgctgtggcagtagaggcatcaaattttgatattggctcgcagtaa

SEQ ID NO: 48144 - DNA, 660 bp, Glycine max
  Peptide Sequence Number=SeqID_164922
atgggagacaagttactggaattaattgtatacaataatgggatacaagcttgcactactagaaaaagtattttctacgacagcgaaacgacaaggggcgaggctcacaggtgcgttttccaaaggaggaaagatgcgcggagtcgccaccaacgtttatttgtggaaaacgtcggaaaaaccgaaggaaaccggtcaaaaataaaaattctaagttcgggagttgtatttacgcttgaggaaggtattaacacctcttacgtcgacaaaagcgggacttttgctcctacgtaccctcctttggagaggaaatcagacctacgtagttctttcttatgcatggatcaaggaccaaggccacctcgccgtgaatgcctccaagaccagatccaccaagatgacgtgctcgtgctgatctcacactgtgctgcgagatcctcaagaccattcgatgctctctcgttgattccgacaactgtgcttcgcaaccttgttgacgagctctacgagaagcgcaaaaatactgctcttgatgtgatgagaatcctgaaactgtccaaatacaggctaaagacccaagtggagaaagacgaaggtccaagtggagaaggacaaagcccccaaatggagaaggatgaaggcctaagtggagaaggatga

SEQ ID NO: 48145 - DNA, 1371 bp, Glycine max
  Peptide Sequence Number=SeqID_164923
atggctgatgaagctacatacccttatactatgcaagatgcacaaaatgcatcaaatcccctatacatccacccaaacgagagcccatccaccatccttgcttcgccactgctctcagatgggaattatcatagttggtctcgtgcgatgaagatgagcctgttgacaaagaacaagctaggattcgttgacggcacgattgcagaaccacctaagaatcatgcagttttacctttctgggaacgaggtaacatgcttgttcttagctggctgataaagtcgatgagtgtggagattgcgcagtccattctttggcgtgagaaagcctcagacgtgtggaaggagcttcatgagcacgtttcccatgctgatctgtttagaatctcagaaattcaagaggaaatcttcaacgagaggcaaggtgataactttgtctcgaaattttacactgcactgaaaaccctatgggatgaattagatgttttgaatcctcttcctaaaattgaagaggagcgaaacaagaatcaagtggttagattcttgcgagggctgaaagatcaatattcagaacaacaatttgccactgagaatgcttctgtgccaaaggctcttcttgtggtaggtgatgatacatcaaactccaagagaaatcaagggagtggtaatggttggaataacagatacacttccaagaaatgttcctggtgtggaaaaatgggtcacatagttgacatttgttataggaaacacgatttccctgctggttttaagttcaagaattctaaaaacaatgctccaagatctgcaaatatgttgatggctaagaaaaatgagaccaactgtccagatgattcatcaagaaaggatacacaaggagatgcatgggtatacaacaagacgaagagattcgaaggattcaaagagaaaataaggccagggaatgtagtagcttgcaatttgacatgcaagtgcttctctgagtaccccaggttgttgcctgtttacaatgagtattccattgatgttgtggagtgcaatggggagatgctagttgttttgctatcagaattcttggaaatcgcaacccttagggtgtggaaatatgatgaggctaatagagggtggcatcagattgtagcaatgcctgcagcaaattctcatgagtggtatgggaagaaagtagatattaactgtgttggtgttggtaaccaaatcttcatatgcttgaactccactgagctatgcacttatgttatgtgtgatttggagaccaacaagtgggttgaattgccaaattgttgcataaatggacaagtcatagactttatgtctgccttttcatttgagcctcagatagaggcttcagtgtga

SEQ ID NO: 48146 - DNA, 210 bp, Glycine max
  Peptide Sequence Number=SeqID_164924
atggcatttctattgaagattggaaggcacataccaagtacaagggttataaagagactgatcgtcatatatcatggttttaggagattgttgggagaatcagctttaacccaaaaccttaagactcaggtttatggatcttctcctcacttatatggtgttcaacctttccatttctacccgatgtgggacttcatcccacacttgtaa

SEQ ID NO: 48147 - DNA, 381 bp, Glycine max
  Peptide Sequence Number=SeqID_164925
atggctccggcattaagggatcatcgatctatcgcaattcagacgcagacacatgttttgctaattgccattggtgaaagatgggctaaaggggtcttttctatggttcatcaaggccacttggcagcaaagaaagttcaaatatgcctaaaagtttttgggggacccaaacagcaaagcaagtattggcaattgcatccctttcctttcccttaccccagtgagataagatattcaatggcatgtggccaaaagacccaccaatgcgacaccaatctagctattatatgtatgttacttcacagttcacagcagaaaggtcaatgtggcactgggttagtttataatgctcatgcaaaagcaaccgtccagcacgagtag

SEQ ID NO: 48148 - DNA, 438 bp, Glycine max
  Peptide Sequence Number=SeqID_164926
atggcatccttttcaatcactggtcccataaaatgcaaaacatttgcctcattttccccactgtccttttctgctacctataattcttgtaatattaccatttctaataatctaacaagaaaagttcgtgcacatagcaattctctatcttcattttcataccaatcctcgtgtcataggagcttgtattctgagaagctgcagagaggccaatccctgattgcctttgatggcaataactcagaatcagaagcggaagatgatcatgccctggactcagtaatgaaactgtactctgccttcaagaacaaaaacacacacgaattatctgcagatgagcgccgacgtgtgagcaatttcctctcattcttcgaaaccttccaaggaagaacggtatcttttcctccctgcttaggtaggcttagtttccgtttttga

SEQ ID NO: 48149 - DNA, 768 bp, Glycine max
  Peptide Sequence Number=SeqID_164927
atgtctctgggcattgcgaaagacatgggttttgatgacaaattgaaagacaatgagggtgcaggggatgatgatgcctctcgggtgcacgcgggaaaagctggtactgatcatgaagaaagtgaagatgaaggaggaggaggaggaggaggaggagggaccctcagcagatacaggagtgagagttccattgctgctaccgaggatgaagatgatgatgatgaggagaggaagattgaattaggccctcagtacactttaaaggaacaactcgagaaggataaggatgatgagagcttgaggaggtggaaggagcagcttcttggaagtgttgacataaattctgttggagaaactctggagccaaatgtgaagatccttagccttgcaattaagtctgctgatagacctgacattgttcttgcaataccagagggaggaaatcccaagggtttatggtttactttgaaagagggtagtcgttataggctaatgttcactttccaggttgagaataacatagtttcaggtctcaaatacaccaacactgtgtggaaaactggtatcaaagttgacagcagtaaagaaatgattggaaccttcagccctcaagcagaaccttacacacatgagatgcctgaagagacaacaccatctgggatgtttgctagaggacaatattcagcaagaagtaagtttgttgatgatgacaacaagtgctacttagagattaactacacttttgatattcgaaaggaatggcagtag

SEQ ID NO: 48150 - DNA, 690 bp, Glycine max
  Peptide Sequence Number=SeqID_164928
atggttatcatattagccgctctgattcctatatacgggaaaaaagagtattttcacccaaagtttgtacttttcttgtatggcctccacatgtacattggattggagttcattttcgccatgatctccgcattaactacaaagcttatcggggttcagctggagccgcagttcaacgagccatacctatgcacatccctacaagacttctggggaaaaaggtggaacatcatggtcaaccgcgtcctgcaccccaccgtatacgaacccgtgatgaatctctctgcccgtgccctggggagaaagtgggccccactccctgccattctcgcttcttttgccgtttccggattgatgcatgaactggttttttactacatcaagcgggaaaaacgcacgtgggaggcatgggagccctcgtgggacgccacgtgtttctttctcatccacggggtgtgtgtggccgtcgaggtcggaatcaagaagagtcttctcatcagagggaaacagtggcaggtgccgaggctgctgtcgtggctgctaacgttggtgtttgtggtctacacagcgatggggttgtttctgcccgcgctagcgcgatgtcgcgtttatgacaaggcaaccacagagtttaccgctttgacccagtttctgaaacatctttacgctcttccgagtcttgttcgttag

SEQ ID NO: 48151 - DNA, 276 bp, Glycine max
  Peptide Sequence Number=SeqID_164929
atggcttccggagcttctggtactcccgcttccgcacattacgatagaaggggagtgaacttatcaaaccgaaggggtgtgtcgcaacgtgcccttttgcgggcgagcgaggcgaggctcacggctgcgctttccaaaggaggaaagatgcgcggagtcgcgaccaacgaaggtattagcacctcttacgtcgacaaaagcggggctcttgctcctacgtaccctccatcaaagaggaaatcagacctacgtagttcttccttatgcgtgaatcaa

SEQ ID NO: 48152 - DNA, 234 bp, Glycine max
  Peptide Sequence Number=SeqID_164930
atgtcgtcatctgcacctttgtcatccagagacggcaagtccaatgacatgcggagataccttatgattatccgcaccttttgtcaactagaggcaagcgagcttgttgacacgcagagactaacatcgtcatctgcaccttttcggagatgtcagcatctttcggccgagattgcgaaaaagtctcgtttgctttccgtcagactcaagggtccggtagcatgcagtgactaa

SEQ ID NO: 48153 - DNA, 1545 bp, Glycine max
  Peptide Sequence Number=SeqID_164931
atggctgtgcttcaatctttcgtttcggtccacccagattctcacttccccatacagaacctcccctacggagtgttcaagccccaatccgcttctcctcctcgtcccggcgtcgccatcggagacttcgtcctcgacctctccgaaatctcttccgctggtctcttcgacggccctctcctcaaaaactccgattgcttcctccagcctaatctaaataagtttgtatcactgggaaggccagcttggaaggaagctcgtgccactcttcaaaagcttttatcagcaactgagccaaccttgagggacaacgtggttttgaggcagaaatcactactgcctgtgagtactgtggagttgcttctccctgttgttgttggggactataccgatttctttacgtctctgcatcacactaaaaattgtgggctcatttttcgtgggccacagactcctgttctagataattggtatcgcctgcctgttgcctaccatggacgagcatcttctgttgttatttccggaacagatattgttcggccaagaggtcaagctcatccaattggcagctctactccctactttggcccttcattaaagctagactttgagttggaaatggctactattgttggacctggaaatgaattgggaaaacctgttgatattaacaatgctgaagatcacatctttggacttgttgtaatgaacgattggagtgctcgagatattcaggcatgggaatatattcctcttggtccttttcttggcaagagttttggaacaacaatatcaccttggattgtgaccttggaagcattagaaccttttgcttgcgaagccccaaaacaggatcctcctccacttccatacttgactgaaaaagtatccagaatctatgatatttccctagaggctcacataaaacctgcggggcatgaagattcaggtgtggtgtcacggactaatctaaagcacttatattggacattgacccaacaacttgctcaccatacaatcaacggttgcaaccttaggccaggcgatctcctcggaactgggacagttagtggtcctgagccggagtcccgggcatgcttgctagaattaacgtggaatggacaaaacgcggtaccagtgaatgggttaaataagaaatttcttgaagatggagatgaagttatcttaactggatattgcaagccgttggaacatgatccagaattagcttgtcagcttttgatccaggagaagctatcaaaggctttgaaagctctgagaggtggtgctcttaattggtggctaacatggaaatggcattacccaaatgcagcatggtggatctttgtgaaggtgctggtcaaaagattccaaccagagcatgattttgatcaactagtttgggtctggaaagaggaacaagaactatgggaaccaagatgcagtaatgaagatatggaggtggaaaacaagaagaagcatcatgggagagacgaagcaaacctttgtaaaccagaaccagaaacaaaattagagatcaactag

SEQ ID NO: 48154 - DNA, 276 bp, Glycine max
  Peptide Sequence Number=SeqID_164932
atgaagatgaaaataacaacttctcatgagaaaatgactacaaaaccgttacaaaagagcaaaagtgaaggtaaacccatgaaatccgttaccttgaagcctgtgctgcgaaactcgctttctaagggacatgctagaacaatttgtgttctaccagaagaaccttcttccggaaactttccggaagaacaaattgttgttcttccgaaagaaggttcttccagaaagttttcagaagaaggttcttccggtagaacaatttgttcttccggatga

SEQ ID NO: 48155 - DNA, 883 bp, Glycine max
  Peptide Sequence Number=SeqID_164933
atgtcgacggacctgcaattgaagtcgagttgtagcggatgcggatcaacgacggatctctacggaagcaattgcaagcacatgactctgtgcttgagctgcggcaaaaccatggcggagaaacgcgccaaatgcttcgattgtggggccaccctcactcgcctcattcgagaatataatgttcgtgcaagttctaccaatgataagaattacttcattggaaggttcataaacggtttgcctgatttttcgaagaagaaaagtgctgagaacaagtggtctctgcagaaggatggactgcacggacgccaaattactgatactctgcgggtattgaaatctatccttgtgttattattgttgctttgtcgttatagcttccaagcgtggtatttagttagaaggagtgctttaaagcactgtatttctcaaaagaaatgctctctgaaaaattggaaacttgtaatacttaagtattactttatgcttaggaatacaacgacatatcatgtcacggagaagtacaagaacaagccttggctcttggaggacgaaacgggtcagtcccagttccagggtcatctagaaggttcccaatcggctacatattacctgctaatgaaggaaaggaaggagtttgttgccattcctgctggttcttggtacaactttaacaaggtagctcaatataagcaattgacattggaggaagcagaagagaagatgaagaatagaaagaaaactgcagatggatatcaaagatggatgatgaaagcagcaaataatggcccagctgcatttggtgaacatgggaaatttgatgacaaggaaagcaacacaggtggagtgagaatccgtaaaaaaactggtgaggatgatgaag

SEQ ID NO: 48156 - DNA, 297 bp, Glycine max
  Peptide Sequence Number=SeqID_164934
atgcaattggtagtgtgggcaaaaattttagggtatcaagagctctacactgccttcaagaattatgactctgttttagatataaaaaaggtggactgtggtgggttaaaaaatgcatcagagttctcaaccatatcagaagataaattggaagattttgataattttcagcggcaacagctgcaacaggttagtacaattacagagacactgaggctctgtttcatggcaaaaaaatgccttagcaaacagggcacctgtttgtgtttgtcccaggaggggttggggccattttga

SEQ ID NO: 48157 - DNA, 780 bp, Glycine max
  Peptide Sequence Number=SeqID_164935
gatgaggaagaagaggatgaagataatgaagaggggggaggtctgagtaaatctgggaaagaactgaagaagctgcttggaaaagctagtggtctgaatgaatctgatgcagaggatgacgatgatgatgacgatgatatgaaaaagttaaacatagctttagtgcaagcagcaatcccttttgtggtggaggatgatgttggtgttcctcctgccattgctacgaagcaaaaggatgctcttaaggaagaacccgttgacaacagcccttcaaagccaacagcaacaggacctgctcgtggaacaccttcttcaaagtcttcaaaggggaagagaaaattaaatgaagaagcaaagccatctaatactgcacctccaaagaaggtgaaggtagaaaatgaaccaaaagtgtccaccaaagatggaaatgggtctgcatctaaaaatagtgcacctccaaaaggtacacctccattgtcatcaaaggccgggtcttccacaaccacttctggacctgtgagtgaggaagaaattagggctgttttaaggcagaagactccggtgaccactcaggatcttgtagctaaatttaaggcaagactaagatgttcagagcttgtaaaagcccaacatggcttgctactttgctcaaaagcaaaacgaataggtagctgcattaaatgggaggataagcaagcatttgctgagatccttaagagaatctctaagatacagaagactacaagtggagccagttatgttatcctgagagataagtga

SEQ ID NO: 48158 - DNA, 177 bp, Glycine max
  Peptide Sequence Number=SeqID_164936
atggcagcaagagggaagagacgcgcggaggaagaaggaaaagaagaaaagcaagaaggcggaaaggtggggactgtgttggatacttggccatttgagtaccatggataccaacaagttttgatggtgagtgatggaagcttgcttgagaagtttctatggaggttgaatctttga

SEQ ID NO: 48159 - DNA, 432 bp, Glycine max
  Peptide Sequence Number=SeqID_164937
atggcaggaattctaggaaacatgcaaaatctttatgagactgtgaagaaggcacaaatggttgtccaagttgaagcagtgcgggtgcagaaagaactcgcagcagcagagtttgatggttattgtgagggtgagttagtaaaggtaacgctgtcggggaaccagcaacctgtaagaacggaaattactgaggcagctatggaattgggacctgaattcgaaattccgttttcgaactcgcaactcttccctcacaccgatgatcctctacttcaagaaacactgtctgagctcgcggagtgtcgatcaggtgcgggcatagggggacacgcagaacgacacctgttagtcaggggagcagccattgttgcctattacgcaatagaggtgctcgtcggcgcggagggtctaggtcatgccttgcgccgttga

SEQ ID NO: 48160 - DNA, 705 bp, Glycine max
  Peptide Sequence Number=SeqID_164938
atgaccaagaacatcatgacacttgggattcataatttggcctgtttgttcaatactgggcatgccctaggtaacacatatttaaggttttttgggctcagcagcggatttggaataagattaggtgtttcacttctgttgggtgcaaaagcaaggatttccctaatagatagactgagagatacgactgttggaggtggtggcaatgtcaattgtaggggtgggggtgccaacggcagcaactgcagaggtgatggtgctgatggtagaggtgtctatggtggtggtggtggaggcaatagtggcactgtcttcaacacaagcagccacaacagcagaacaatcaacaaaggcagtagaactgcagcgcgaagcgatatgcctactccagccaccactttctgcgattttggtcgtgaagctgcaacactaacccttcaagaagcgacagggtgccgcgacatgatgctccaatgcaatagcatcgctattgcactgcaaaacggggacacacacctaattgctgaaagaaccttgcaaaaaacacttgagtgtggcactggtccaggggaattacataaagctatggcaagtgtcacagactcgcagcgtgctcctgggcgtggaggaggtggcggcgctcgccaggatatcgcagccccacaagtgtggagagcagcatgcgctacggttttcgacttctag

SEQ ID NO: 48161 - DNA, 720 bp, Glycine max
  Peptide Sequence Number=SeqID_164939
atgaagttcaaagtcctcttcactgaatcagtccatgccaggaagacggcatcgatatgcgggttctttagacatgtagaaagagagccacaagcctcggaaaaagctgttttacatgcagatcggaagcgggaagttgggagatctgtgctagatggagggagttggggcccggctggggcggtcctcgacccgtggaagaagaaatggatccacgtgtccccctcttctgcttcctctaattccaacgccaataaccacgcttccaatgcctctcatcttctcctctacaagtggacccctctcacccaaagccagaacaccaccaacaacgccaacgctaacggtaatgccaaggacgcgccgccggagccacccgcggaaccgcctcgaagaaaattcaaatatgttccggttgctctactagaggagcaaaaaaatgaggctgcagaaaatgagggtactgagaaggttgacgaggaatctaaaccaattgatgttgattcaggtgcagcagaggcaactcgcaagaatgagactttggatgaaaaacctgacataaatgatgtcccaatggaagaaagtcagtctcagtacaaaaatcaggtggtgcgccaagatctgaatgaaagcaccttggatttaagtttgggcttgacatcacatgatgatgaacatgattctgattcaaaaactaatcaaacgagagatggccagtaa

SEQ ID NO: 48162 - DNA, 198 bp, Glycine max
  Peptide Sequence Number=SeqID_164940
atggagaagaggaacaatggtttggtgcatgagttgttagctagtgtatatcaccttacgagactagagtatggtatagatcaacccgaaaagataaggatcctttggagagttgatgctcaaggggttcataatacaatcaaagatggtgcctcctcaacgtggaaaagaggaggaagacatgaatatattggttag

SEQ ID NO: 48163 - DNA, 321 bp, Glycine max
  Peptide Sequence Number=SeqID_164941
atgtcttcagccatttacgctttcaacgacgataatgtcttcatctcaaagactgcaatgtcttttttccttataagtaaaaaggggcaactttcataccctaattttgtccggggactatcatttgccaacatttttttcttgctagccaaattgagctgcttgatactagttgtcgcgcaatccgtaaggtttttcgacgtttcggaaggaaatgtgcaaaatacccaaaaggagggcaaaatggtcacttttggggcattttcagcccctgggcccactaggaagcttagggttgaagtaaccagctcgcttgggtga

SEQ ID NO: 48164 - DNA, 1101 bp, Glycine max
  Peptide Sequence Number=SeqID_164942
gcactaggaagaaggaagttttttgatttcatgatggatgcgttgtgtgacatgaggcgaaacgccattgatggtgatttgttcatgttgtctgttgttgttgatagttttgtcagggccggtcatgtgtctagagcaattcaggtgtttgggaacttggatgatctcggggtgaggcgtgacaccgaggctttgaatgtgcttttattgtgtctgtgccggcggtctcatgttggtgctgcgaattctgttttgaattcgatgaagggaaaggtggattttgatgttggtacttacaatgctgttgctggggggtggtctaggtttggtagagtgagtgaggttgagagggttatgagggagatggaggctgatgggcttcgtcctgattgcaggacgtttggattccttattgagggtttgggaagggaaggtaggatggatgaagctgttgagattttatgtggtatgaaggagatgaattgtcagccggatactgagacttataatgcagtgattttcaattttgtgtctgttggggattttgaggagtgtatcaagtattataataggatgctgagtgataattgtgaacctaatcttgatacttatgctagaatgattaacaggtttctcagagcgcggaaagtggctgatgcacttctgatgtttgatgagatgttgaggcgaggagttgtgccttctactgggaccataacgacttttatcaagcgtttgtgtagctatggtccaccgtatgcagctttgatgatatacaagaaggcaagaaaattggggtgtgtgatatcgatggaagcttataagatactgcttatgcggctttctatggttggaaaatgtggaacgttgttgagtatctgggaggagatgcaagaatgtgggtatagttcggacttggaagtttatgagtgcatcattagtggtctttgcaatgtaggacaactggaaaatgctgttcttgttatggaggaggctttgcgcaaggggttctgcccaagcaggctactggtctttgagcctgcttggatgcttattttgaagctgatcccaagtgcatcaatctttccaactttatgcgag

SEQ ID NO: 48165 - DNA, 219 bp, Glycine max
  Peptide Sequence Number=SeqID_164943
atgactgagagcatatttctctatcgaatccttgagcaagcaacagtggctcatggtggccaccaagggttgtgggtggtggaggaggagtttctaaggttgtttgggcagagttttgagagagagagagagatgtcgattaacgagctcatctcgctaagtgggaatccacttttagcgctaagcgtgactttttgcattgagcgtaattcctcttag

SEQ ID NO: 48166 - DNA, 132 bp, Glycine max
  Peptide Sequence Number=SeqID_164944
gtgaaagcggggaaacacgtgcttcaagcgaaggccgatgccgcgcctagtagaagattcaaagagaccagggtaagcgggggcatggtcacgtctttacttcataatgtcgttctgctcccaaaggcctag

SEQ ID NO: 48167 - DNA, 156 bp, Glycine max
  Peptide Sequence Number=SeqID_164945
atgaaggggtctcaagaaacccaaaaacatgtactcagaatagaataccacatatttggagtcgagtttctaaggggggttttgagccaacaacgaaggcttcaaagggtgcttttggagtgttgtttggaatcagcatcgaggaaaggtttgtaa

SEQ ID NO: 48168 - DNA, 537 bp, Glycine max
  Peptide Sequence Number=SeqID_164946
atggagtcaaacaacatgccagacttgaatggtgtcgctaagaagactaaaggtcgacaaaagatcgaaatgaagaagatgagaaacgagagtaaccttcgggtgacattctcgaagcgtcgcactggggttttcaagaaagctagtgagcttgcaaccctctgtggcgtggatgtcgctgtgattatgttctcacccggtaatcgagtattttcgtttggcagtcccggtgttgattatgttgtccagcgctataagacacagggcccacctcccctccttacattggacctcaacgaggtgcactccactgtggacgaagttgagctccacacacacctccactgcttgtccaaccaaattgctattgagaagaagcgcacaaaggatttaaatcatttagtgaaggctgcagaggatcagttctggtgggctaggcctattgaaagcatgaccgattcccaacttgacaagtataagaagatgttagaggagtttaagagacaactcaaagaaaaacgtggaaacctcaactga

SEQ ID NO: 48169 - DNA, 637 bp, Glycine max
  Peptide Sequence Number=SeqID_164947
atggcacgttctccagacaagataaagagcatcgatggctcaaaagaaactcttaaattcagtgtgaggatcaatgatctatggtttattggcacgcctaacaaatctgagcaagctggaatggtgtttgtggactccgatggtgatgagatccacgctgtttgtaaacaagaccaattgaaggttactgttgtgagggagtgtgttctaggggacatcccttttagaaaatacagatttgttggatttgcagatgttgtggttggccagtttgaacatggactattggttgatgttattggtcttgtggaggaggttgtctttcggcaagtttcaggaaaaggtagaagggtagttttcaaattaaaggacttgagccagcaattgctatcttgcactttgcgggatgattattgcttgcagtttgtgaagttcttagatgattatgaaggtgatggtgcaattacagttctattaagccattgtaggatcaaggaagcgcagggatcttatcttgcatcgatcaacaattccttcaaggcttcaaagttaattattaaccagcccgtgatggagattcaagaattcaatgaacaatattttttgcttgcagagttgggcattgaggcccggtcag

SEQ ID NO: 48170 - DNA, 806 bp, Glycine max
  Peptide Sequence Number=SeqID_164948
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatctgatgcacctgataccggagtcaaacgtcggttgaagacttgggaagaaatcagaactccatcaatgatatccgagtaccatcatagaaagcaaaaaattgatcagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48171 - DNA, 225 bp, Glycine max
  Peptide Sequence Number=SeqID_164949
atggaacattgtaatcgtcccaacaatcagaggactactgctacggggtttgctggtggtaagggtagaaaacccactactttctcaacccagatcatttgtttcaagtgtgacaaaaggggcatattcaaagatattgaacagaatggtggaggtctaaatgaccaaattggacgtctaaaggccaagagaagagtctttactcttaacggtgtcgaggcttaa

SEQ ID NO: 48172 - DNA, 537 bp, Glycine max
  Peptide Sequence Number=SeqID_164950
atggcggcgacgatattcaccgcgtactggatcaacagatcctggttcttcaccaaccagttgccggcaccgttgatgccgtctactacattcaaatctttcattcgtgtcgtcctaactcagtccctaacgggagaaactcgcaaaaatacactggcctcggcagccagtcggaaaccaccgcctaaggcacgccgcagcacattcgccagatcgcccggcgacaggatgaaagcgccagcacggtgttggcgctggtcagtttcgcgccaaacaggccagcgactcgctgaaaaccctgcatctggcgttaaccggcggaacgctggcggtctcctggctgctgctgccgaccgccttcaccatgcactacgcccatcaattttatcgccagggtgcgcagcaggagcctttgccgctgctgtttcccggcaatctcaccgagccgacctatctggacttcgcctacttctctttcaccatcgcggtcgcgtcgcaaaccgccgacgtggcggtcggcgccgcggaggtgcgtaa

SEQ ID NO: 48173 - DNA, 474 bp, Glycine max
  Peptide Sequence Number=SeqID_164951
atgcagccgaacagaaaagattggagcaccaggctggatgatgctgtttgggcgcataggactacctacaaagcacccataggaatgtatccttatcgggttgtctttggcaaggcatgtcatcttcctgtagagatagaacacagagcctactgggttgtaaagacctgcaacttctctattgatcaggctagagaggaaaggaagttgcaactaagtgagctagatgagatccgtttagaagcctatgagaattccaaattctacaaggagaagaccaagaagttccatgatagtttgatcgctaagaaggacttcgtggttgcgacagaaattgagatcaaaagtgaatccacaaataagagcttcaaggtcaatggacaccggctgaaatcattcctcacaaatctttccttgatggatgtagtggtggaggagacctccttacttcaccctacttctcttccgccatga

SEQ ID NO: 48174 - DNA, 264 bp, Glycine max
  Peptide Sequence Number=SeqID_164952
atggagaacaacgatggtttgtggaggctaatggtggctgtggatgatggagaaagtgcttgggacattagaaatggctttggaagaaagaaaggagaagaaatggcgtttttcctaagctacacgaaagcaaaggctgaaatgctctcgggaacggaagcttcgagcacactccagacatcttctcaaagatcccaacggtcagattgtggacaaatgtcttgtgaagatgaagaccgcatttcgagaagatccaacggttaa

SEQ ID NO: 48175 - DNA, 503 bp, Glycine max
  Peptide Sequence Number=SeqID_164953
atgggctcagaaatctaccctgtggttcatgagaaccccagggccttctttagcaactctagcccaatcctcttggagtcttctatccaatacccttgggggcctcacctcaaatatgctactgaggggcaagcatttggtggcatacccccgccaaacactttggatggccctcagtatcacccacaacccttgcattttgcggtgggaagagtccttcctgccatggtggaaaaggaaaaattcaatcatatagaagaaaggttgagggccattgaagaaggcgaaaattatgtctttgctgacatggcaaagttgtgcctagtgcccgacgtggtcattcctctgaagttcaaggtgtcagatttcgataagtacaaagggactgcttgtcccaagaatcacctcaagatgtactgcaggaaaatgggggcatacacaaaagatgaaaaattattgatgaatttcttccaagaaagtcttattggggcaaccatcacctg

SEQ ID NO: 48176 - DNA, 853 bp, Glycine max
  Peptide Sequence Number=SeqID_164954
aggactacacatcctcgccttcagagggctacacgccctcgcctttagaggaccacacgtcctaaccttcagagggctacgcgccctcacctttagaggagtacacgtcgtcgccctcagagggctgcacgccatcgccttcagcagactgcatgtcctccccttcagaggactacacgtcttcgccatcagagggctacacatcgtcaccatcagagggctacacgcccttacctttagaggactacacgtcctcgccttcagaggactacacgtcctccccttcagaggactacacgtccttgccatcggagggctacacgtcctcaccttcagagagctacacgccctcgccttcagaggtctgcacgccctcgcctttagaggactacacatccttgccttcagaggactacacgtccttgcctttagagggctacacgccctcgccttcagaggactacacgtcctctccttcagagggctacacgccctcaccttcagaggactacacgtcctcgccttcagagggctgcacgccctcaccttcagagggctacacgccctcgcctttagaggactacacgtcctcgccttcagaggattacacgtcctccccttcagaggactacatgtcctcagctttagtggactacacggccacacgccctcgccttcagtggacctggagaagtccagcagggtcttagggtttctagctctgattacgggcctctgtcagttcaacggagtgcctgtcgcccccaataaggtcatcaagccccctactaaccaagctttcatcaagaagtactgcgcccccaggcaggcacagggcgagacaccacagtag

SEQ ID NO: 48177 - DNA, 333 bp, Glycine max
  Peptide Sequence Number=SeqID_164955
atgtggaccaccacggcaaatttaagagaatacgcagtgccaagaaggctgaacccttatctcttcactcctccccctatttatagcaaaataggggaggagcttgccacccagctcgcccaggtgagcttagcttgccccggcgagcaaggttgcttcctccagaagcaacagccttttggaggaagaatctggaaggcccaagttacgaatcttcatggattatgtatctactcttttttagctttcgaagaagttacgaaaactcacggattgcggaaaacgcctcctttcgatttccgtcacattacggaattttcacggatcgcgtaa

SEQ ID NO: 48178 - DNA, 189 bp, Glycine max
  Peptide Sequence Number=SeqID_164956
atggaagaaacaatgagtttgacagtgataagtcgtgctttggaggaagagacaaatgtcaaaatatacatattgggagccaccatcattggcccaaaattcacgtggaattacaaatggaggctacggtggttgggtggctacgtagccacattttcaggggtcacctcatatatctctggccttcag

SEQ ID NO: 48179 - DNA, 141 bp, Glycine max
  Peptide Sequence Number=SeqID_164957
atgaagaaaggaaagtcggctcaagcactttatgtgcaaaaatcattggatatttatttgttctataagtggtatcaaactaaaccacatccccaaacacgaaagtcaatgaaaacagagcaagttgaaaaaccccaataa

SEQ ID NO: 48180 - DNA, 250 bp, Glycine max
  Peptide Sequence Number=SeqID_164958
tcctacagggtgcccgttccccctggcaaggtcacgtcatcatgacatagggatcgcgcctgcaagacacccagtggacccgaagaagtccaacaagttctacggagtgcctgtcacctccagcaagggcatcaggccccctactaatcgagctttcatcaagaagtactgcgtccccaggcaggcgcagggagaaacaccacagcagcctggggatggccggcagcgggcaacagacgcaccgccataa

SEQ ID NO: 48181 - DNA, 426 bp, Glycine max
  Peptide Sequence Number=SeqID_164959
atgaattgcgtttttgttcatgtgtcctccaccttcgagtttggagctatgcgaattgattgcttagggcaattctccattctcaccatttttcggagccccatgaattgggttttcgttcaggtgtcccccaccttgaaatttggagccatgcgtatggattgcttagggcaattccccattcacaccatttttcggagccccataaattgcgttttcattcatgtgccctccaccttcgagtttggagctatgcgtagggattgcttagggcaattctccattctcaccctttttcagagccctaaaaattgcgttttcgttcgtgtgccccccaccttcgagtttggagctatgcatagagattgcttagtgcaattctccattctcacccttatgaagcttatcgataccggcgacctctag

SEQ ID NO: 48182 - DNA, 246 bp, Glycine max
  Peptide Sequence Number=SeqID_164960
atgaatgctgtgaagggtgagaatgtcaatccttaccctcggaagaaaaagagtgggagaaagcaaaaaaagaaaagaaggaaaattcccaaatcaaagagtgggagaaagcaaaaaaagaaaagaaggaaaattcccaaatcaaagagtgggagaaagaaaaggaaggaaagaaaattcccgatcaaggatcgaaggaaaacagaggaaatgtgcagaaaggtcgttggaccagacgatatctga

SEQ ID NO: 48183 - DNA, 567 bp, Glycine max
  Peptide Sequence Number=SeqID_164961
atgggtgacactatgaagcgggtgccatttgaaaaacctccttttagtctcagcaagatcaagaaggccattccaccacactgttctccgttcattttcatgtctcattacattgccacaagttacttccacaacattcctcaccctctctctttcttgtcattgccaatctactgggctgtccaaggattcaccctagctggtgtttggatgcaggagtacttaacttgcagtaatgctatggacttttccatcttgtcatggcaaaagggcttgcttgggtggtgtgtgtttatggagttccactgcttgcattgccacactacgattcctctgagtgggactggttgcagaggagctttagcaacagtggatagggactatggaatcctgaataaggctacaaaggcaatcaagcccatcttgggagagtattatcagtttgatgagaccccatttctcaaggcaatgtggagaaaggcaagagaatgtatttatgtggagccagatactgagaacaaaggtgtattttggtataacgatcgaaaagttgtacgtgaattgtga

SEQ ID NO: 48184 - DNA, 255 bp, Glycine max
  Peptide Sequence Number=SeqID_164962
atgttgaatccaactcagtttcaggccaaagaagagaagattaaagcagctaatgactcgcttagcgaagtgtatccgcttaacgagatgcatccgcttagcgagacatcctgcccgcttagcggatgggaaaacctagaagaggagaagtcaaagatctgtgcgctcaaccagcctgcccagcgaggatgttgtttcttcttgcgcttagcgcgtccactcttgctaagcgaaaattcactaactctcgcttag

SEQ ID NO: 48185 - DNA, 303 bp, Glycine max
  Peptide Sequence Number=SeqID_164963
atggttactggacttcaaaaaatagatggtcactgggccttgggcacgagtgagaacaagtgggatttgccaaacaacgtgtcaaaatataccccgtgggtcccacctcaattggacggaaggcgcactagtgccactgctaatcgctcgcttttaaataccgcctctctgcgttcccctaatctttgcccccctctctctcaccctcctcttcacacattttctgtgcgctctaacaaacattctcgttcacactttcagtgtcaaactgaagcacacgactgcttagaagttagaatttga

SEQ ID NO: 48186 - DNA, 288 bp, Glycine max
  Peptide Sequence Number=SeqID_164964
atgggtgtcaagtacctcaaaatgatcaagcaaaggttgcatgccatcaaacaatggtccccagacgaaattagggcaatcaatttgtggggctccagacctgatggtggaggatgcacgaacaacgctaggcaatcaattcgtggggctcccggactcgatggtggaggatgcatgaatggcaatcaattcatggggctccgaataagatttgatggtggaggatgcacgaacagcgctaggcaatcaattcgtggggctccgaactcgatggtggaggatgcatga

SEQ ID NO: 48187 - DNA, 552 bp, Glycine max
  Peptide Sequence Number=SeqID_164965
atggctgagccaataaaggagctagatattctgttgagtcagatagctgctggcttgcctttggatatcatgccaggacccagtgaccctgctaatttctcactaccacagcaggtaaataggctactttcaatattactgcctttgatgctcaatctattataccttgaacatgatccccacactgcttccagatttcttgggacatcgggtcaaaatgtagatgatcttgagaagtattcagaggcaaaagataaacttgaattcatggaaaggacattaagatggaggcatttggcacccactgctcctaatactcttggatgctatccttatactgataaggatcctttcttcattgagagctgtcctcatgtttactttgttggaaatcaagataaatttgaaactcgtgtcataaagggatcagaagggcagttggtgagactcatatgtgttcctaaattcagtgaaactggagttgctgttatgctaaatctgagggaccttgattgtcatgctctcagttttggaacgcaattcagctcataa

SEQ ID NO: 48188 - DNA, 156 bp, Glycine max
  Peptide Sequence Number=SeqID_164966
atgagaagtgcaagtaactcagggagtgcaggaagcaattgccttcaaattgatgccttctgcatgagaagcaagtctgagaatgctttggacaaagcacaagtgaaactctcactagcaaatattatcataccaagttggcaaattggcatatga

SEQ ID NO: 48189 - DNA, 411 bp, Glycine max
  Peptide Sequence Number=SeqID_164967
atggacactacaattgttattgctactgctgctgaagctaataaggttcaacatgtcaccaagaaatcttctgatgagcttctgaggaagttcgccgaagcgggttccgacgaggccgccggggaaaacaaacggaggaagaagaagaagagggaaagtgaattgtgtgagtgtgacagcccctcttccaatggtggcgccgccatggtggaaaggaggtcccttctgctgccgaaagtgacgcggaggtcggtgttgctccggcagctgagggtgagggatgttagaaacaagtcatcactctttggaaccattcataagacatggcgtagaaccgtggaaggtgcctccagagttttcttggaaaaacattatcatcgccataagcgtttgatcaatgatattgtttag

SEQ ID NO: 48190 - DNA, 692 bp, Glycine max
  Peptide Sequence Number=SeqID_164968
aatggcaaaagcaagagaggtatgggagaggttcatacatcatgaaagagaaactcaaggcaatgaagaatagcttgaagaattggaatagacttcgggaatatacacaagaatgctcggaagagtttgggcgacatgctttgtttagggagtcacttctcaagcaacaatctagatccaaacggcttcaagaagggaggccatgtcttgatggggtgatgtttgagaggataactcatgaagataatactatgttgattggcaaatttggggagatggaaattcaagaagcaatttgggagtgtggaagtgcaaagagtctgggacccaatggctacaattttagattcattaaaaagttttgggagactattaagggagatgtgtttaacttcctcaatgactttcatgattctgcaaattttgtgagaggagcaaatgcttcattcacctctcttattcgaaagaatgatgacccacaaggatccaatgaagtggttgatgaagctagaaggaataagaaaaggtgcatgatcttcaaagtggactttgagaaagcatatgctttgtttcaacaaagtggtggtggccaagagtgtattgaggaggaaggagacatgggagccaataataacaaaattcaagaagaaacttgcaacgtggaggcacaagcacctaaccattgccggtag

SEQ ID NO: 48191 - DNA, 198 bp, Glycine max
  Peptide Sequence Number=SeqID_164969
atgggagaagaagaggtgcttgaatccgaatccaatgtaaccaacggcaacgtccaaattcaacttctgcttctctcttctcttaggtcacccgatggttccccgacgacaacactctccgcctcttctcttcattcaattctcattatccactaccgggaaccggaagcgacgcccccgttgctgcttacttcataa

SEQ ID NO: 48192 - DNA, 690 bp, Glycine max
  Peptide Sequence Number=SeqID_164970
atgaggcgcgcataccctaacgctctcaaggcggagttctaccgcgccaccaagaacttgaccagggggaggacgaccattcgtgccattgtcaatctctgcgctctccagtccatctcagcacgcgacatcttgctaagcccggatgcggcggcttccgagccgctgttggatctttggtttagctatgcaacgttaaagctacctgttgggaggcatgcggagcggctcgagcgatgtgccaaatgcttttcagatgttctaaaagcatccgagaaagaccactatgtaccgcagatgaaagttgtacttagacgcttcaggctcaataggcagttgctaagagagatgcacctagacgtgtacgaggagtacaaatcgagatatgaagagcaagggccgtacagtcagagagttcacttgaacagggcaatggaccttgcgctacagatggctgaaggagatgcagagaagatgggatccatcagcagacttcagcatgctgctaagcaaatagcccaacgatgcaacgtatccttggaagcgggattctcagtactgcttggagcacgaaatgtgctgaaggcgttaagtgagaaccgcttgcgaaagaaaccctctggaagccgcgaccttatggatttgactagcactcgccgcgctgtcaagacatctcgatcctttgcatag

SEQ ID NO: 48193 - DNA, 147 bp, Glycine max
  Peptide Sequence Number=SeqID_164971
atgagtggtgatatcatagcgacgaagcaagtcattacaacagtggagcccattacaaacttgtcatgcattaactcatcgtccttaaaggatctttgttcgcagccggcaagtgcaccggatcgcacaagtagtgtaaaacggtaa

SEQ ID NO: 48194 - DNA, 857 bp, Glycine max
  Peptide Sequence Number=SeqID_164972
cgatcaatgcttttctcgcctttcatgactacaaggaaagcccggttgtcgctatcctagccgatctatatgacaccttcgaccgaagatgtgaaaagagcagtacaaggattgttttctgtactccggccctctacgtatggttggcttcgcaccttttccgccaagaggtgatacatgcttgcccactagaaagccaccgttcatgcacagagaaaagagaggcaagatttccaaatgttcccttgataggtacaaggggttgcatcagttacaatcccgttcttgccataagacagcttggctaccctatgagaggggcaccactaaaggaagaagagctcgcacctattattgcacgaggcagtaacaatgggcccatcggcggctaccataggtggttgaaagcccacatgcaaggtttggattggctcccgagtttgagaacctctaaagtggtggaagttgaagcaccggaggaagacgaagaggtgcaggcccttagggcagaactcgagaaagcccaaacagtcaaagaaaggttcaaatcagcagctcttaagatccgaaaggagaatgccgaactgagagacgtaaatatagctaacaccaaggccttggaacaagagaccaaaagggctcgaaagggaccaatcacgagtagacagtttgatcttgaaggatgggttaaaggtttgcctaaggtccaagagaagcttgtctcaatgtttatgcgagacaaagaccaacatgttagccatcatcagcaagtaccaagaagaattaaatctagccacggcccacgagcacaaagtggcggacgagtatgcccgagtgtacgcggaaaaggaggctag

SEQ ID NO: 48195 - DNA, 201 bp, Glycine max
  Peptide Sequence Number=SeqID_164973
atgcacgaaacacaatgtggaccactacgggtacatagaatgaatcgaaaagcttggttcgagcaaaataggggaggtggttgccgcccagctcgcccaggcgagccaggttgcttcctccagaagcaacaaccttctggaggaatatttctggagggcccaagtgggcctgggtgctatttgcacccccatttttactaa

SEQ ID NO: 48196 - DNA, 462 bp, Glycine max
  Peptide Sequence Number=SeqID_164974
atgtttgcaggagaacattatgatttgtggaaaatagtgaaaaatggaagcaatccagctcctttacctgacaacccaacagcgatgcagataagattccacattgatgaagtggttgaagagggtagagcacttgtcatcatacaaacagcactccatgataatgttttcatcaagattgtgagtcttgaaactacaaaagaggcttgggacaaactcaatgagaagttccaaggtagtgaaagaactaggaggataagagaatctgagatcaagtacgacgaaggaagggggttttctccgcttcttcacattcctcttttgctttcttttcgcgattctgaaatggagcctgtttcagctttaaccaagtacaagctcgtgttcttgggtgaccaatccgtgggcaatgtatggatatttggtgagaagagggacatgcatagttcgggtaatgtatga

SEQ ID NO: 48197 - DNA, 520 bp, Glycine max
  Peptide Sequence Number=SeqID_164975
atcgttggaggatatgatttgtgaccttggacaagagtcttttcagcaagcacatgcccctatgtatgatacattgcaaagtcattcaaagaagcctttgtatccggggtgtaagaattccttgacgctgttgtcagcggtgttaagtctggttagtgtgaaggttagatatgggtggagtgacaaaagctttagttcactgcttcaagtagtgtacgatatgtttctagaggaaaacacattgcctaagagttactatcaggcgaagaagatattgtgttcaatgggtgtgggggtatcacggtacatagtcaaggatgatgatgagtgtagtagtgatgaaaactcaaagaagggccccctagcgaaggtgttgtggtatctttcaattgttccaaggtttaagcgtctttttgctaatggaaacgatgctaaagacatcttacatggcatgcaaatgagagcaactgcgatggaatggtccgtcatccggatgattgctcctagtggaaaaggatag

SEQ ID NO: 48198 - DNA, 276 bp, Glycine max
  Peptide Sequence Number=SeqID_164976
atgcttcattccatgctccagagcttacacggggggcagtccattatcatgcagagccttcagggtttgggcttgccatccatcatgagcatggctgagtttgatgcacaggagcctaagccagaggagccagtagcagcagcagatggtaaggatgagctcacccctcctaagcccttttattttgaggcagtacccatacctgatgattccatgccatctgcaccagcatctgagctagagcagcctatctctcaggattcaccagctgctcag

SEQ ID NO: 48199 - DNA, 288 bp, Glycine max
  Peptide Sequence Number=SeqID_164977
atgggaggtactggagctgtggaagaagaaggagctactatctctggtggtgttgaagtagtggggacctttgatctcttacccctggccttgcttggccctctaaatttaatggcagggctcaagttctccagggatctagaatctgattggactcctctggccttgcatagagttgtgatcaaggtagggaatcctagtctggatgtatcatgctgcgcagtaagagagatctggtgggagatgaggtaccccacattcatatctatcttcataatgatgccataa

SEQ ID NO: 48200 - DNA, 227 bp, Glycine max
  Peptide Sequence Number=SeqID_164978
atgttggatcaaaggattccaaggagaccttacctatcgtggaatcacctaggactaagctgaaggctagttacacttttccatcggggactagatgtcctctagtgttggagactagtgtagaagaggcgacatcatctattacgaagcttagggctttagagtcaaaggaagaggaggacatcgagaggacttctcatgacaatcttccaagaagttcagtctag

SEQ ID NO: 48201 - DNA, 213 bp, Glycine max
  Peptide Sequence Number=SeqID_164979
atggagtggtatctacagcactttgttcgccagcaggcggccaaccatcgggggcaggtgcagtttagggctgaggtcgcatggcccggagattggcccgaggcccagacagaggaggcacctgcaggagctcccgacgatgcaaaggaggcccgcatggatgaggagatgatagacttgctcggcttcttgggaggaagcggagccacgtga

SEQ ID NO: 48202 - DNA, 117 bp, Glycine max
  Peptide Sequence Number=SeqID_164980
atgctggactggggtgaagaagggcaccggacagaggctgaaatcgctgccctcaggtcggcgtttacacaagaagttgctgtttggcatagacttgaacatcctaatgtcactaag

SEQ ID NO: 48203 - DNA, 366 bp, Glycine max
  Peptide Sequence Number=SeqID_164981
atgaacgcaggcggcattgatgctcaacgcattacgtccatgctggcacagttacgtgcagcagcacaaaagcctgaagggcttggcagcagcgctatcgctaatccggtacaaaaaaccaatgcggcgagcccgaccagccaggtcagctttagtgatgctctcaaggcatcgctggaccaagtcaataatatgcagctgcaatcagaaaagctggggcaggactttgccatgggcaatgataatgtcagcctgtctgatgtgatgatttcaggccaaaaagccaatattgctttccaggcaaccgtccaggtccgtaacaaactggtcaccgcctatcaggacatgatgaacatgcaggtataa

SEQ ID NO: 48204 - DNA, 132 bp, Glycine max
  Peptide Sequence Number=SeqID_164982
atggctaactggctacgactgccctgcatggttttaagcgcttgcgcctcacttggcagtatgcgcacactaaaacggccattcaccatggcaatattgactttgacatcgccgagccgcggcaagtgcaag

SEQ ID NO: 48205 - DNA, 135 bp, Glycine max
  Peptide Sequence Number=SeqID_164983
atggaggttcagatggctgctgatgctgccttacttacgtcaaatgatgagtctaacgggtcacccaatatgttcgggcaactaggacaaaagctgatgctggtcgcaggcattgcggcggttgtcgccgtgatg

SEQ ID NO: 48206 - DNA, 273 bp, Glycine max
  Peptide Sequence Number=SeqID_164984
atgaggcggatgaagacaggcggcaatatgcagcgcgataaggcttatacacaatctgcggtggcactggcctatgaagcaggagatcttgccccacgtgtggtggccaaagggaatggtttgctggctgagcgtattattgcgctagcaaaagaacatgaggtagaactggatgcacatattccaccacagctatatcaggccattgccgagatattggcttggctgtatcaactggagcagggagagttgagggaaccgcctgcggtataa

SEQ ID NO: 48207 - DNA, 384 bp, Glycine max
  Peptide Sequence Number=SeqID_164985
atgtctgccagtgatcatgctattctacgtgatagagtgcatcaacccaccaagatgagcttattggagttatcatcacaagacgctgtgttggcacaaaataagttgctttctaagaaacttgagatcttaatagaaacaattgaacaaatgcaagaagttagttacatgggaaatcaacaaaggcaaggatacaaccaaggaggattctcaagtttccagcaaggtccttacaatcaacaaggacaatggagatcacaccctggtaatcaattcaataaggaccagggtggaccttccaataggccacctcaacaagggcctaatatcttccagaggggactaccaaactggaggaaaacctggctcaattcatgcaagtga

SEQ ID NO: 48208 - DNA, 392 bp, Glycine max
  Peptide Sequence Number=SeqID_164986
ggaatatgaatgcacaattaaggggacaaatgcttacccaggattgtttggactgggcacagttagtagtcaaggtggctaaggtcgagcagttcatgaatgagaaagatgagaagaagtcatacaggggagaagaggatcttgatgacaatttgactactgatcatatggcgactaagttggacaaagggaaactttactcttgcctggccttgcaacctttcaaagggaagggggctaaaggaaaagagtcatacttgtttgctatctccaaggctgaacaagtctttgattatttggtcaaggacctacagatttggctactgacaagcaaaggtgtaatgttgaggggcaacatcactagcaatagaggcccaagtttgacctgggag

SEQ ID NO: 48209 - DNA, 243 bp, Glycine max
  Peptide Sequence Number=SeqID_164987
atgggagctgaatggagatggaagaaatatgattggagacgccacttcaaggagaagagaagtcaagaagaagctcaccaccatgggcgagctgatccagctcaaattttactgcttcagttaaaaatcatatctcattctaaatttgttataatgataatcccaacggcgttacagccatggctaggagactcaaagaagattgggccaaagatgcaggagaaggcccttgggttttcatga

SEQ ID NO: 48210 - DNA, 108 bp, Glycine max
  Peptide Sequence Number=SeqID_164988
atgggtgataaaatgcaagatggtgtttgccttctcaaactctccaccatgggtcctgagattatggatcatgcagttctattgcatcgtaaggccaaacattcttaa

SEQ ID NO: 48211 - DNA, 723 bp, Glycine max
  Peptide Sequence Number=SeqID_164989
atggcacgtgttgctgataaaataaaattgatagatggatcaagggaagctcttaagctttctgtaaggatcactgatctttggttcattgggattcccgaaaagactgaacaagccgaaatggtggttattgattctgatgaagacgaaatccatgttgtttgcaagcaggatcagctgaagtctcgcaaggctgatttgaaagaaaatttgacttatgtgatgcataattttaaagttatcaagaaagatgggaaattcagagtttgtgatcatgaatataaattatgttttactggagttactgttgttaggcaatgtgatatggaacagttaccttttaggaaattcagatttgttgctttttccagtgtcattgttggtcattttaaaattggactcttggttgatgttattggcgtggttgatgaagtggtattccgatatgtgtcatccaaaaatacgagggttgaatttaaaggatttgaggtgctatcttgtacactctgggaaaattactgcttacagtttttgtcttatttgaatgatattgaagatgaaaggccaatcattattctcttgactcatgctaggattaaggaagcacagagatcatatctggcatcggtcagtaattctttcaaggcgtctaaactcatgatcaatgacctcgtgctggaaattcaagaatttagagagagtcttttagatttagggatcgag

SEQ ID NO: 48212 - DNA, 460 bp, Glycine max
  Peptide Sequence Number=SeqID_164990
gatcccaccccgaaagatggtgaactatgcctgagcggggcgaagccagaggaaactctggtggaggcccgcagcgatactgacgtgcaaatcgttcgtctgacttgggtaggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtggtagtagcaaatattcaaatgagaactttgaaggccgaagaggggaaaaggttccatgtgaacggcacttgcacatgg

SEQ ID NO: 48213 - DNA, 294 bp, Glycine max
  Peptide Sequence Number=SeqID_164991
atgatcattcaatgttttgatcaagaatgcgaaaatacccaaaggggatggcaaaagggtcattttaaggcttttttgaaccttggctctcccaggctagcctctggctcgcctgggccaccaaataactttatggtgaagctgagagatgggtaccaaggtccagcattgagagaaatcagagaggataagaagaagaaagaagagaaaaatgaggtcaaggcgctaccgaattgcgaccataatcgacttcttcctcgttcttcgtttgttcttcgtttgtcatccggttag

SEQ ID NO: 48214 - DNA, 1850 bp, Glycine max
  Peptide Sequence Number=SeqID_164992
acaaagaagacgcgattgataacaagaagggtctgatacacactctctctccgtcgaaatggccgcttcttcttcctcttccgacgagccttctcgctctgtctttcctcggcgtcgacgtcggcaccggcagcgctcgtgcaggtctatttgacgaggaaggaaagcttcttggttcatctagcagcccaatacagatatggaaagatggtgcctgtgttgagcaatcctctacagatatatggcttgcagtttgtgcagctgtaaaagcagcttgttctaaagctaaagttgcatcaacagaagtaaagggtatgggatttgcagctacttgttctcttgttgcagtggattctgacagctcacctgtttcggtttcttggagtggtgattcaagaagaaatgtgattgtctggatggatcatagagctatagaacaagctgaaaggataaattcgtctaaatcacctatattggagtactgtggtgcagctgtttcacctgaaatggagccaccaaagcttctatgggtcaaagaaaatttgcaagaatcttggtcaatggttttcaggtggatggacttgagcgattggttgtcatacagggcaaccggtgatgatactcgtagtctatgcaccacagtttgtaaatggacatatctgggtcatgcacacatgcagcatgtcaatgataaagagtctcgagacctggaagcttgtggatgggatgatgatttttgggaggaaattggattgggtgatcttattgaaggacatcatgctaagatagcttatgattattcatctatatttgtgccattcattgctggttctgtcttcccactgcttaacttgatagtgaatcataataacaggacgaagtgttgctttccctggccatcctttgggttctggtcttactcctactgcagcaaaggcaagaacttttgcattattttgaagtttgaactggtgctttctgaggaactgggtctggtaccaggaattcctgttgggacatcattaattgatgctcatgctggtggtgtgggggtaattgaaagtgtgccacaatcagaagctgcagatcatgacaaggaagcaatttgcaaccgtatggtgttagtttgtggaacttctacatgccatatggctgtatcgcggagcaaattgttcattcctggggtttggggtccattttggtcagcaatggtaccagaatattggctaacagaaggtggacagagtgctactggtgcattattggatcatataattgaagaccatgctgcttctgcatgccttgcaaatcaagctgcttcccaaaagatttcattgtttgagcttctgaacaagatgttggaaacaatgatggttgagctgaacctatcctttattgcagccttgactaaagatgtacatgttcttcctgacttccatgggaataggtctcccattgcagatccaaaagcaaaaggagtcatctatggtttgacacttgacacaagtgacaaacagttggctcttctttacctggcaactgtgcagggcattgcatatggcacacgtcacattgtagagcattgcaatgctcatggtcacaaagtaaggatctgccgaaaggaaagtgaacctgtgctcttgggtgctgctattctgggtgccgttgctacaaggaaatatcatagccttagcgaggccatgaaagccctgaatgcagctggccaggtcattcatccatccaaggatccaaaggtaaaaaaataccatgatgccaaatacaagatcttccgtggcctttatgaacagcagctctcgtaccgttccgccatggcccaagccttgtcatag

SEQ ID NO: 48215 - DNA, 3509 bp, Glycine max
  Peptide Sequence Number=SeqID_164993
atggatagtccaattcgatcgccggccaccggttcgggttccggttccggtgaagataaccggcgtgttaagttcttgtgcagctttctggggagcataatgcctcgcccccaagatgggaagctgcgttatgtaggcggcgagacacgaattgtgagtgttcacagggatattagctatgaagagttgatggggaagatgagagagctgtatgatggggctgctgtgttgaagtaccagcagcctgatgaggatcttgatgctctagtctctgttgtcaatgatgatgatgtggttaacatgatggaggagtatgataagttggggtcaggggatggattcactaggctcaggatttttctgttttcgcaatccgagcaggatggttcctcgcatttcattgatggggatgattctgagaggaggtatgttgatgcattgaatagtttaaacgatggttctgactttaggaggttgcaacaaggggagtttcctatgatgagtcctgttgaggatattcatgtggttgctgatcagttctatagtccaatcagtgtggaaagtgggattcatagtcagagaagtggggacctatctatgtcgccgtataatatgcatcatctcacggtccagcacccgaaatctatgggccagaggtataatgaaatggatgctccttggaatcctgcctattactcccctaggcaccatggtctccatgaatttccatcctctccttctggtacaaggtaccgagtgccatttcccgagttaccagataagtgcattgatagagtgtcggaagagtatgtgcgacatcacgtaaatcatcatcctgtgtatgacaatcaactgcaatattctgaaaatgttatgtgggtgccgactggagcagcacatggcgaaaagtcggcttttccaggcaatattcttcatagtcctcatgttgttgatgggaacagtatatgtgagcagtgtcgcatgggttttcatagaggtcaaccacatatggagcattctaatataagtaatggacttccacaagctgctaatccatgtgcagaatgccccccaccaaatagggatactttcacagtgaatgctgatgcaaagttacatccggcaatctatcccaatgaacctaataatgatcataggtctgtttataatgatactcagaatcacgagagaggatggggcttgcagcatccaactgctcgggttgaggaatcaagagtacatgtctctggatctggaagaatgtttgatgttcctgttgcaaatttctctcttgggcatggtagtgtgactgatgggcataacttgtcttccaattatgttcaccagcaggctggacctgaattggggcccgaactgttccctgaccaaaccgtgacttctataccacctatccaaattcctccactggaagagtgcaatgtgcagtatggaaattcaccttctccttatggattagattgtaattacgctgtgccccgtggtcatccacctggtttctggagaaacactccagttcctgttcatattggaccatcttatgaggctgctacttcacctcagccgctgaatagtatgatgaatgtgggattaatcaggggagagggcagtacaggatttttcattggaccagatagtcaaaatcattgggttgattcctcacagaaattaacaggacatgatggtacagccatcccagaatatccatatgcacatgctctgaatccagtgccccttggtcaagaaaatcaacacccagatattgtagataccattcatcccccacaggacatgaatgctggtacctgcttggaacccttgcagctgccaaaatcatcttttaatatggttcaaaatcaacaggttttaagagatgatactcatttgactgaagcaaagagttttgaatctaatagtttgcttggtgaaggaatagtgataaaaattgaggacaatgttgaaaaccctggcgcacagactatatcttcttcagagcaaaataaaattgctgagcatgcatgtgaagctgctgcctctgttgagtctaataatttaaagtcaaaacctgaagcagactgcgtgcatgttgagaaactggctgataaggacccttctgttccagaagattctaaacatttagttgatcaattcagcttcttgcctgagttgattgcttctgtaaaaaaggctgcattagaagatgccgaggaattgaaagctgcagctgatgagcctgccaattctcagaatcacaattcagataccaaagatgaaacaacaaatgaagtagaaccaacgaatgctcatggtgatttagaattggactctgaaaatgaccatgtagatactaataaaattgagtctacaagggctgaggaagaagcatttgctaatggattgcagactattaacaatgatgatttggaggagatccgtgagcttggttctggaacctatggagctgtttatcatgggaaatggaaaggttctgacgttgccattaagagaataaaagccagttgttttgctggaaggccatctgaaagagcaagattgggatgtgttggtttatgggatagccctgttaagagatgtgttggtttatgggatagccctgttaagagatgtgttatcacagatttctggaaggaggcgttgatgttgagttcattgcatcatccaaatgttgtctccttttatggcattgttcgtgatggccccgatggttctttagcaacagtcacagagttcatgattaatggatctttgaaacagttcttgcataagaaagatagaacaatagatcgtcgtaagaggctcattatagccatggatgctgcatttgggatggagtatttgcatggaaaaaacattgttcattttgatttgaaatgtgagaatctattggtcaatatgagagatcctcaacggcctatctgcaagattggtgatttgggtttatcaaaggttaaacagcacactctagtgtctggtggagtacgggggactttgccatggatggctcctgagctacttagtgggaaaagcaatatggtgtcagagaagattgatgtctactcattcggtatagtcatgtgggaattactcacagggaatgaaccctatgctgatatgcattgtgcttcaataataggaggaattgtcaacaactctttacgtcctcaaattccaacatggtgtgatcctgagtggaaatctctaatggaaagttgttgggcttctgatccagtagaaaggccatcattttcagaaatttccaagaagctgaggattacttgcactatagcatggattctctcccagaagcagcttggtgttctgaagaaagctacatatatcactctggtgatgacaactatagctgtggctttaccatcacaaatgaaccgtgccttctggagagatgtgtacataaaatcaaccaacgacatgcctcctgtgctttcacatgggaaggataatgatgaatt

SEQ ID NO: 48216 - DNA, 2001 bp, Glycine max
  Peptide Sequence Number=SeqID_164994
gaaggagttgggccccctccggagctgctctgcaagacgctgtacgcgtgggaggaggccgtgtcgccgcacttggcagcggagagggagggtttggtcgtgaaggactcggcggtgctggaaactcttggtgagtgtctcgaagacgtggcggaatgcggggccggtaaggagagatcggaggttctgtgtgtggtggagactgctggtggagttgccagtccaggaccttctggctcgcttcaatgtgacttgtataggccattccgtattcctgccgttcttgttggggatgggaggctaggaggcatttctggaacaatatcagcttatgagagcttgaagctgcgaggttatgatgttgtcgctgttgtttttgaggatcacggtcttctaaatgagggtccactgatgtcttatatgcgaaacaaggtccctgttctagtgctaccacctattccaaaagatccattgaatgacctaatggaatgggatatcatctggtggcctttcactcaacacaaacttgttcctgacggtggggtcactgtaattgattcacgctgtggtgagaacttttctatcttcaaggttcagaagacagaagtcatagcaccacaatttgatgcatgtgctagctggtggactcaaggacccgatgctataatgcagactgaacttgctagggagatgggatatgctgctgcaagatttgggcatgtaatgttccctgagaatgttcatgagccagccttgaattgtgctgagcttttgcttcaaggtgtgggtaaaggctgggcttctcggacatatttttcggacaatggatctacagcaattgaaattgctctcaagatggcgtttcgtaaattttctgttgatcatggacttattgtgcattgtcatgaggataccacaaatgaaagatccactgagcttatggtccttgcacttcagagatcttaccatggtgacacattgggtgctatggaagcacaggcaccgtcttcttatacaggcttcttgcagcaaccatggtacactgggagaggtctttttctggatcctccttctgtctttatgcacaacagtacatggaatgtttccatacctgaagggtatcatttggaaagtctgaaagggaaaagtatcacctttgcctcacctgatgaaatatttcacaagggcagagataagtctgagcttgctacagtttattcatcttacatatcaaaagtattatctggatttagaggaggttcttcgccatgcgaaggtatgggggagggatgttgtacgcagccttacccttgcatatgcaaagaggctgtttccagatttgaacccatgaccaacaagtcaccaaggcacaactttaccgctgcaccagggctcgccctcatcccacatggctctctggatattctaattaacttattttcaccttttctggacattgatcatctcatttggggcctgagctgttatgtagttatccaaggtgctggtggaatgcatatggttgatccactttttcagcgtgtgcttgttaatgagtgtcggagtagaaaaattccagtaatctttgatgaggtttttactggcttttggcgtttgggagtagagactgcagtggagctaatccattgtgtaccagatatagcttgctttgggaagctgttgactggcggaattataccattggctgtcaccttggcaacaaatgctgtttttgattcatttattggagactcaaagggaagtgaagagagaagaggccatgttgtcagttgtgagagcattggagtctttgtgcattgggaggtgcagacccccttgaagtactacaagttaggcactctcaaagcccttttgcatggacattcttactctgcacatgctatgggctgcgctgctgctgttaaatcaatccaatggtttaaagatccttgttccaaccctaacataacttctgaaggaagattacttagggaggtatga

SEQ ID NO: 48217 - DNA, 1770 bp, Glycine max
  Peptide Sequence Number=SeqID_164995
atggggaaaaggagcctggagggtggagaagatgatcagcccgaacgaaagaggcctgctcttgccagtaatactgatgaacaggtcagtgaagaagtggagcgtgctttggcaaagttaggtcctgcaagacttagtggaaggtctcctcctaaaatgattgaaggccctgatggtagaagcttacagctgaaatttaggtcccggctgtctcttcccctattcacaggaggaaaagtggaaggcgagcagggggctccaatacatgttgttctgatggatgtcaatagtggaagcgttgtaacatctggacctgaatcctgtgttaaacttgatgttgttgtccttgaaggcgattttaacaatgaagatgatgaagattggactcaggaggattttgaaagccatgtggtaaaagaacgtgaaggaaagagacctttgttaactggggacctgcaagtgacactcaaggaaggagttgggacattaggggaactgacgtttacagataattccagctggataaggagtcggaaattcaggcttggcttgaaggttgcatcaggtttttgcgagtccttacgcattcgtgaagctaagacagtggctttcacagttaaagatcatagaggagaactatataagaagcattatccaccagcattgactgatgaagtgtggagattggagaagataggcaaggatgggtcattccataagaagctgaataatgcaggaatagtcacagttgaagaatttcttcggcttgtggttaaagatcaacaaaaattgcggaatatccttgggagtggtatgtcaaacaagatgtgggaggctcttttagaccatgcaaaaacatgtgttctaagtgggaagctctatgtttattatccagaagatgcaagaaatgttggcattatttttaacaacatctatgagctgcgtggccttatatcaggagaccaattctattctgctgattctctcactgatagccagaaggtttatgtagattcattggtgaagaaagcatatgaaaattgggatcaggttgtggattatgatggcaaatcactcgtgaatgctaaaattgcttctgaaaatgaacttcgggtggagtcaattgattatggtagtggtttagatcatcaactgcaactgccggcacttcccgtgtctgttccttctgagcagcaaatcaattcagggatgcctgttggagcgttgtgctacattgctgattgcaactcccggactcagttcgatagctcattatatgtgtctaatgaccaattaattagcaatgctcaccaaacccaaagcactagtaatgatcgtggcccaattgggttagctcttggtcctcctcaatcatcgacatcagggttccatgctggtagctcttctattcagccatctactataaatccttttgatgattggtcacacaacagggacaagggggctgatgaattcttttcggaagaagaaatccgcttcagaagtcatgagatgctagagaatgaagatatgcagcagttgcttcgcctcttcagcatgggaggtaatggctccatgagtgctgaggatggctattcattcccatcattcatgccatctcccagtataccaaactatgatgaggatcgctctcgcccaggcagagctgttgtgggatggctgaagatcaaggcagcaatgaggtggggcttctttatcaggaagatagcagctgagaggcgggctcagatagaggagttagatgaatag

SEQ ID NO: 48218 - DNA, 552 bp, Glycine max
  Peptide Sequence Number=SeqID_164996
atggtcgtgccaagatactcaacaacggcgatcttcttactctttcccttgacaaagcctccggatcagggtttcagtccaagaacgagtatctctttggcaagattgatatgcaactcaagcttgtacccggaaattctgcaggcactgtcactgcctattagcttctcagtggatgggaccccaataagagaattcaagaacatggaatcgaaaagagtttcattcccaaaggagcagccaatgaggatatactcaagcctatggaatgctgatgactgggcaacaagaggtggcattgtgaagactgattggagccaagctccattcacagcatcatataggaacttcaatgccaatgcctgtgtccattctggagcatcatcttgcacttccaactctgcctcctccaatgcctggttcaaccaacagttggattcaacaagccaagacagactgagttgggtgcagaagaattacatgatttacaattactgcactgacaccaatagatttccacaaggccttcccccagagtgccaagcatcatga

SEQ ID NO: 48219 - DNA, 432 bp, Glycine max
  Peptide Sequence Number=SeqID_164997
atggttaggtaccttagtctctttttctggggtaggaacttgtcataccctaatttcgcccaggaactatcctttgttgatcttttgatccttgttagtcgacttacggtgttaaacgtcagttacagtgcgaaacagatgatcattcaatgttttgatcaagaatgcgaaaatacccaaaggggatggcaaaagggtcattttaaggcttttttgaaccttggctctcccaggctagcctctggctcgcctgggccaccaaataactttatggtgaagctgagagatgggtaccaaggtccagcattgagagaaatcagagaggataagaagaagaaagaagagaaaaatgaggtcaaggcgctaccgaattgcgaccataatcgacttcttcctcgttcttcgtttgttcttcgtttgtcatccggttag

SEQ ID NO: 48220 - DNA, 291 bp, Glycine max
  Peptide Sequence Number=SeqID_164998
atggagagtaaggaaccaatggttctattccatctgcaagaaggtgagattgcgttgagaaaatggatgatggatagagttacactaggtataatgggtgaagagcttgaggatcaatgtatattgtattcgtatatggcgatcactcccaactgtcatccatgtaattgtataagaccattaagacctaggaggcttggtggcaaaggttgggccctactacgtgataagtgtgctagttatgcgctcaggatctcaaaagtgttgcttgcctggaaaaaccacatgtag

SEQ ID NO: 48221 - DNA, 309 bp, Glycine max
  Peptide Sequence Number=SeqID_164999
atgaggtgtacccatgggccaaaaatctaccctaaggctcatgagaaccctagggccttctcttgcattctaggtccaatctacttggagtcttctatccaatgcccttgggggataggattgcatcacatcaggagtagttggctgtcaagtttccaacaaagggggtttagcctcccattgtcatggaggctttacaattacaagaggggaatatttagtaaaggggacaaagataagaaagagaatggagggaaggaatggttctcaatgcttgcttttccttcttctagcattttccttctataa

SEQ ID NO: 48222 - DNA, 171 bp, Glycine max
  Peptide Sequence Number=SeqID_165000
atggagagagaaaaaggaatcacacgaagacagtacatatggaggcttcaatgtcttctccgtctctctgacgtttgggaactctatcggagcagttggaggaaaaactggaggaatctcagggaaccactagagatgccgctatcgctgtcggaagacacggatccttag

SEQ ID NO: 48223 - DNA, 273 bp, Glycine max
  Peptide Sequence Number=SeqID_165001
atggatagcgacagctgctcccttgactggtgggtgcaattctatgtgtccccctacgctcacatccaatcgatgctcaacgaacttagacgatgtttcttgaagaagaggatcatcggcgtgagggaagagtcgcgagctcgagaacaggaatttcaggaactttcaggtggaagagaggagaaggacaaggtgctgtatatgcaagttgaatggtggaccatgaagctcaaatggaccgaagtatttgaattactcgtttggcctccataa

SEQ ID NO: 48224 - DNA, 504 bp, Glycine max
  Peptide Sequence Number=SeqID_165002
atgtttttggtgaaagaaaaatggaaaaagatgagggagactgtcttctccagcctctctgtccttcttctatctgtttttcacgtagtagaatggttagctagactgtggttgtggtggtctcctttggttttccgccaactcggtgttttaaaggctcttggacttctcagcacagaaaggctcgctgagcgagatgcaagaagagacaacgacctcgctaggcgggctggctgcgcgctgagcgcgcagatatatgatttatcctcttctagggtttcccatctgtcaagcgagctggatgcctcgctaagcggatggggctcacttacctattctacctcgctaagcgagttccaaggttcagaagtagagagaattgagagaagagggaaagaagaagaagaagaaagaagaggaaatgaagttgaggcgctatcgaatcgcgactgtgatcgtcccaacgtcgtttcttgttcggtattcttcgcaccagtcagttag

SEQ ID NO: 48225 - DNA, 189 bp, Glycine max
  Peptide Sequence Number=SeqID_165003
atggctagcagtcattccagagctcagaacaaggccaagttctcaaagaggaagcaagaagagtgctctcagagcgctcttaacatgcaccacgaccagcaacaaacatggaccaaatggaagaagaagtggaagatgaagctcagcaagagcctgcagaccaatggagtccttttgagtctctcatga

SEQ ID NO: 48226 - DNA, 231 bp, Glycine max
  Peptide Sequence Number=SeqID_165004
atgacatcaaggctgaagagcttgaacaaagcaaagaaatctctacgacaacgcttaaagaatttcctagagaatggagaacttagaaaaatctctcattggataacattattggagaaatttcaaagggttgaatcaggaaacattgatgaagccttgtgtgatgaacattggttgatggtaatgcatgaagagctaaatcagttaagagaaatgaagtgtgggacttag

SEQ ID NO: 48227 - DNA, 555 bp, Glycine max
  Peptide Sequence Number=SeqID_165005
atggctgaaaggggcttctgggaactcccgcagaagaagagtggaaggttcttccgtggattcctgcggaaaaagcttctgcaggatattccgcgtgatccaacggaagaaggctacattttgttgtcgcggaagaacctgcggaaacttcttccgcagggtatattttcttctcgcagaagatcatgcggaagtttttccgcggatcatgagctggtagaggtagaagcattagtgaggatgcgcatgaggctgatgttactcggcgtcgcaggcttactgcctcagcacgcacgtaggcaacgggttcgtctgcgtgaggacgtcactgagagacatgaggatgtgcctcagttgcatgaggatgttcctcatgtgtttgatgccaccccagagatgacaggtgtcgccgatgctgttcagacagaaggagtggctactgatgggagcttggggtcacctgctgcagatgagggattccccgatggaccacgcgacccatcgattttgaccgattttgctgagcatgtcgaacacagcatctggagtagacaa

SEQ ID NO: 48228 - DNA, 507 bp, Glycine max
  Peptide Sequence Number=SeqID_165006
caccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgg

SEQ ID NO: 48229 - DNA, 135 bp, Glycine max
  Peptide Sequence Number=SeqID_165007
atggtggtggcttccaaggctcatggtttcccggcaccattgtcagccacgtcgattccgacagattcatggttccagtaccataccgtcgttgaagatgcaagcaccaaggctacatcaaagagaatgggatga

SEQ ID NO: 48230 - DNA, 479 bp, Glycine max
  Peptide Sequence Number=SeqID_165008
ctgaaatcattggatttacctcttatcaaccagcctacctcaacttaaagaccaaaggaaagaaccttttgaatggtgccaacttgcctcagcttctgctgagtttatatgcattgggagcaaggaggattggtgtgacaacattacctccaataggctacctgcctggagccatcactctctttggagctcataccaacgaatgtgtgacaagtttaaacagtgatgcaattaacttcaatgaaaagatcaacaccacatctcagaacttgaaaaatatgcttccaggcctcaatttggttgtctttgatatctaccaacccctctatgacttggtcaccaagccttctgaaaatggattttttgaagcaaggaaggcttgttgtggaactgggttgatagagacattgtgcaataagaagtccataggaacatgtgatcatacttaccttaaaatcgtaatagtaaaatatggataa

SEQ ID NO: 48231 - DNA, 273 bp, Glycine max
  Peptide Sequence Number=SeqID_165009
atgaagaacatggaacatagaagaagaaaggaagaagaagcaccaatgaaggaagaagtgactcgtatacggacgagtcacttttttttttatagagaaaagttgctgggtgtcccagtaaaaatgttagatgcccaaaataaccgcctttggtttaggtgtgagagtatttctaagagccaaattgaagtaaacggaaatgagtttttcggaaaaacaacttaccccaagaatgatgaagaagatgaggttcaagcagaagatattggttga

SEQ ID NO: 48232 - DNA, 483 bp, Glycine max
  Peptide Sequence Number=SeqID_165010
atgataagattgtttgaggacaaggtgaagagggatgcggctgagactactactactaaggttgttgctgatgcggaaaatgtcaatgttggtggattagttacatcgaaaaatgttttggttaagaaggttaatgatgaagctcgccgatcgaagcgccctcaccatgacattggtgaaaaagatctcattagtttggatgaatctcaagaacatcctggttcggctaggtctggtcaccattctcctatggatgcagacgttgaggaaaattgggatgttcaaaatttagggaatgccctaaatcaagctaagtcattttcaacatgcaatgaaacaaagagagggttttacctaccgactttgataagaatcttgaaaaaaagactctacatgtctttcatgatcaagcatttgtcaagatttgcttcaatgcctcggtttgtgagcatgaaacttaggaacttcccgcttagacactaa

SEQ ID NO: 48233 - DNA, 258 bp, Glycine max
  Peptide Sequence Number=SeqID_165011
atgggtgagatctcgtactccgataagtactacgacgatacttatgaatatcgacacgtggttctgcctcctgaagttgccaaactgcttcctaagaatcgacttctctccgaaaatgagtgtcgagcaattggggttcaacagagccgtggttgggttcattatgcaattcatcgacctgagccacaaataatgcttttcaggaggcctttgaattgtcaggagcagcagcaggaaaaccaggcccaaattatttga

SEQ ID NO: 48234 - DNA, 2874 bp, Glycine max
  Peptide Sequence Number=SeqID_165012
atgtctcctcgcggtggctccaagcagcaaccagattcacgccgtcaagcgccaccgtccgcggcggcggcggtgccttctcctcccggaagaggacgcggccgtggacgcggagaatcctccgttcccgcgccttctctggtgaatgcaccatctgctcctcctccggcttccaccatcggcgttccgtccggcgccgcgccttttcgtgctgcgttgccacctccggcggtggaatctctcacttccgcggtcgaaaagcaacttacaatgcaaccttcggcgccgtcgtcgtcgaaggcggtgaggttcaaggaacggccagggttcggtcttgctggggagaaaatcaaagttcgagcgaatcattttcaagtccaagtcgccgaacaagatctatttcattatgacgtctctatcaatcctgagattacttcgaagaaggtttctagagatgttatgactttgcttgtgcaagcgcatcgtgaaaagattctcggaaatcgcataccagcctacgatgggggaaagagtcttttcaccgctggatccttgcccttcgaatctaaggattttgtgatcgtgctaaaagacgacgatgaaccaggctcgtcgtcttcttcctctcctactaggaaaaaacgtgaacgcgagtatagagtcaccatcaggcttgcttccagaactgacattcaccacctcagtcagtttctcaggcgccgtcagttggattgtccttatgagactatccaggctcttgatgttgttctgcgtgctacaccgtctgaaaggttcgttgttgtgggaagatcgttcttctcaccttctttggggaaacctggatcgcttggtagcggaacggagtactggaggggctattaccagagccttcgcccaactcagatgggcctgtctcttaacattagttggttttacttctcttattatgtgtcggcgagggctttttatgagcctattcctgtgattgatttcattgaaagtcattttagggccaatccttccaggcctttgcctgatcaggatcgaatcaagcttaagagagtactgagaggagtgaaggtagaagtgactcatggaaagaatcttagacgttacaagatcactggagtcacaaaagaacaactcagaaagttaatgtttactcttgatgacaatagaacaaaaagctcagttgttcaatattttcatgagaaatacaatattgtgttgaagcatacgcttcttcctgctcttcaagctggtagtgacattaaaccaatttttctgcctatggagctttgtcaaattgtggctggacaaagatatacaaagagattgaatgaggagcaagtaactaatcttttaagggcatcttgtcagcgtcctcgtgatagagaaaactctatcagacaggtggtgaggcaaagtaatttcagcacagacaaatttgtgagtcactttggaattcaagtgagggaggatccagcattgcttgatgctcgagttcttcctgcaccaatgctaaaatatcatgacacaggtagagaatcaagtgttgaacccaaaatgggccaatggaatatgattgataagaaaatgtttaatgctggtgttgtggaacattggacttgcctcaacttttctggaaaaataaacagagagtttccaagtgcattttgtcataagttggccagaatgtgtagtaacaagggcatgcgttttaattcaaagcctttactgcccataacatctgctcaaagtagtcaaatagagagtgctcttgtaaatttgcataagcagtctattacaagactagcaaaccaaggaagactccaattgttgatcataattttgccagatttcgaggggtcctatgaaaaaataaagcgtatttgtgaaactgagctaggaatagtgtctcagtgttgtcagccgaggcatgtttgccagatgaagccacaatatcttgaaaatgtggccctcaagataaatgtgaaggttggtggcagtaacacagtattgaatgatgcaattgctagaataattcctcgtgtgtctgacagacctacattaatcttgggtgcggatgtaacacatccacagccaggggaagattctagtccttctattgctgcagtagttgcatctatggattggccttatgtaacaaggtacagaggagttgtttctgctcagactcaccgtgaagaaatcatccaagatctttataatacatgtgaagatcctgtgaaggggaaggtgcattcgggaattatcagggagttacttcgcgctttccgtttgtctactaatcagaagccagagaggattatattctacagggatggagtaagtgagggccaattcagccaggttttgctgtacgagatggatgcaatacggcgggcttgtgcttcactacaagaaggctatttaccccgtgttacttttgtggtggtccaaaaacgacaccacacaaggttatttcctgtagatcatggaagtcatgatcagacaaataaaagtggaaatataatgccagggactgtcgtagacacacacatatgccaccctcgggagtttgatttttacctcaacagtcatgctggaatgcaaggaactagtcgaccaacacattatcatgtgctgttcgatgaaaacaacttcactgctgacgggtatgcaaggtgtactcgatcagtctcaatagttccacctgtgtattatgcacatttggctgccttcagggctcgctgttacattgaagttgcaacatcagattctggttctgcaagtggaggccgggctgctaactgtgaggttagattgccttcggttaaggaaaatgtgaaagatgtgatgtttttctgttaa

SEQ ID NO: 48235 - DNA, 216 bp, Glycine max
  Peptide Sequence Number=SeqID_165013
atgtacagagaaaaggtacgaggcttccctattgaaagttggaatggtgtaggaatacagaacacatggcttgatggcacaatggagaggaagtggagaatcacgtctgcattctgcagcgccgcttacgcagcacgaatgactgatcgcatagttggtcattcagtgtttttcacgcgcctttcttggaatttggatgttactcgcgcgctgtga

SEQ ID NO: 48236 - DNA, 711 bp, Glycine max
  Peptide Sequence Number=SeqID_165014
atggaatggatggagtgttttcaatatttgcaatgtacttgggtgcctgctcctggaaaggtgccttgtgtaaggccacattacaatttaaatctgcagagcatctctgttaatggccaaattgtgccaattgcccctgcagtttttgctacatcaaacaacagaggtaccattgttgattctggaacaactttggcataccttgcagaagaggcttacaatccctttgtcaatgcgattacagctcttgttccacaatctgtacgcagtgttctttccagaggaaatcagtgttacttaataaccacctccagcaatgttgacatttttccacaagtaagtctgaacttcgctggtggtgcatctctggttttaagaccacaggattaccttatgcagcagaattatattggcgagggatcagtgtggtgtattggctttcagagaattccggggcaaagtataactattctaggagacctcgtattaaaagacaaaatttttgtctacgatcttgctggtcaacgcattggatgggctaactatgattgttcattgccggttaatgtatctgcatcagctggtaggggcagaagtgagtttgtggacgcgggagagctaagtggcagctcttctttacgtgctgggcttcacatgttgataaatacactgttccttgctctcttcatgcacataactttaattttgtag

SEQ ID NO: 48237 - DNA, 426 bp, Glycine max
  Peptide Sequence Number=SeqID_165015
atgacgttgctacttagcaacattccatctagtgaccataatgccgatctcctcctgcagaagtatcagttgggatcgcgcccacaaggcacccagtggactcggaggagtccaacagggccctggggtttccaactctggttacgggcctctgtcagtcctaagtgcccgtccccccagcaaggtcatgccatcgtgacatacgtaaggatcatgcccgcaagaaacccagtggacccggagaagtccaatagtgtcatggggtttccagctctgattatgggcctttgtcagttttacagagtgcctgttgcccccaacaaggtcatcaggccccctattaaccgggctttcatcaagaagtattgcacctccaggcaggcaagacaccacaacagcctagggatggccgacaacgggcaatag

SEQ ID NO: 48238 - DNA, 339 bp, Glycine max
  Peptide Sequence Number=SeqID_165016
atgtccctccccacactagaaacccaatgcgcaaaggaaggagggggaaggtggtggcgcagcgtgaggagggtgcaggagttggcgcagtggaggatgagatcacttccgccacgggaggatgaaggaggtggcaccatgtggaggacaaggtcactgccatcgtgggtgaaggagaagccatcacgacgcgagtatgcttgtgaggaaggatacaatatgggaggtgcaagcctcaaatgtcattcatatcatataaggcctacttcttgcatgtgggcctcctatgcctttgagttaacgtttttgctccagttggattcgtttaaaaaacattag

SEQ ID NO: 48239 - DNA, 438 bp, Glycine max
  Peptide Sequence Number=SeqID_165017
gttatcactggcatcgcacttcctgttggatccgacaaactttattctggcagcactgatgggacagttaggatatgggactgccatactggtcaatgtgctaaagtcatcaatcttggtgctgaggttacctctttgatcagtgaggggtcatggatttttgttggtctgcaaaatgctgtcaaggcttggaatatccagaccatgtcagagtttactcttgatggacccaaaggccgagtccgtgccatgactgttggcaacaatacactctttgctggtgcagaggatggtgtcatttttgcttggagaggaagctctaaagccgattctccttttgaactggttgcgtcactcactggccacactaaagcagtggtttgtctggcggttggatgcaagatgctgtactccgggtccatggaccaaagcataaag

SEQ ID NO: 48240 - DNA, 615 bp, Glycine max
  Peptide Sequence Number=SeqID_165018
atgaagaagtccgagctctaaaattagagctagggaaggcgagactcgccaaggagaagttcaagtcagctgctacacacatccggaaggagtgcaccgggttacaagaggaaaacgcggccactgcaaaagcccttgaacaagaaaccaaaagggcccgcaaggaggaatatggccgagagaaattccgaggagcattgtggggtagcaacaatgagctcaagctccgaagagaggagagagatcggtcacgggtgcatggcatgatcttaaaagaagagttagttgcttgtgcgaggtccaaaaggagtttggctcaacacttggaagccacggagcaaagcatgctagctatcatagggcaatacaaggaaaaattgaaccagtccatggcccatgaacaaaagctagtggaggattttgcacaagtgtatgccaaaaaagaagcaagagggagggtgattgatgcgttgcatcaagaagcgactatgtggatggataggtttgccttgaccttgaatggaagtcaagacctcctgcgtctgttagccaaagcaaaagccatggctgaagtgtgtactgcccccgaggagattcatgggataatcgattact

SEQ ID NO: 48241 - DNA, 1265 bp, Glycine max
  Peptide Sequence Number=SeqID_165019
ccaatcagcgcgccgatcaccgccagcaccagcgtcggcaccagtccgccgggacggccgggaaacaccctccgcttcagccagccggcagccaggccaataataatccagatgataagggtcatgcttctcctcccgtcagcgctgtttccagtatagaggaaagcgaacggcttacggctgcgccgcgatctccagtttatgcagcgcggcgtggcagcgcgccagccgctcctgcagaatctccacctcgcgcatcagctgctgctgcacgctcagcgtttcagcttgcgccaggtgctgttcgcgctgctgcagcatggccagcaatcgcgtttcgtagccgcggtactcatcacgcttcggctgcagcggatcgcgacgcggccgttcacgcaccacgcgcagttgctggctactgcactcgcgctgcagcgcggcaatctggtccagcaccttctgcgccagccactggcggcgcgacgcatcactgtcggacgccgcgagctgcgccgcattgtgctgcagctcttgcagatagtcagccagtcgcgtgcctttgcagcgaaacagctgcgcgtcaaagcgcggctgacggcagctaccgtccggctgctgcgcaatctgctggcgcagcgtgtcaatcattgcgtgcagacgctgttgggcgggcagttgaggcatcacttcgattccgcatctggcatgcagcgcattttactgttaagccttggctggctggcgattgtgctgggcacgctgggcattgtattacctttactaccgaccacgccattcgtgttgctggccgcctggtgttttgcccgctcgtcgccgcgctttcatcactggctgctgtggcgctcgccgtttggccgctatctgcgtcactggcagcagcatcgcgccatgccgcccggtgccaaaggccgggccatgttgctgattgtcatcacctttgcggtttcaatctggctggtgaagctgctgtggctgcgcatcctgctcggtgtgatgctggcgctattgttgctcatgctgtggcgcatcccggttgtagcagaaagtgcgaacccgcacgaaccgtagcatcagggttgcatttagccggctgtttgcttagatttgggcatcttcgtgcgtggcttccctttgagaaacgacttcgcttaacccggtttccgggtattggcgctgtgggagctgcgcgttttagatatttttccaggcgtaacctttatgaccgcaactgcgcagcagcttga

SEQ ID NO: 48242 - DNA, 267 bp, Glycine max
  Peptide Sequence Number=SeqID_165020
atgggccattttgcctttctgcgaagcctgtatccggaagacccttcttccggaaaaattccggaagacgtcactacggaaaactcccggaagaaccttcttctggaagaagtaggtggacttccggagactctggaatacgttccagaaggatgtgttccggaattttttcggaagaagggtcttccggaagaccaccttctttcggaagaaggtagatgtttagagaagatgaacagtagaaagttattcccagaagaactttaa

SEQ ID NO: 48243 - DNA, 1549 bp, Glycine max
  Peptide Sequence Number=SeqID_165021
atggaagaatgtactaatgcagactgcagtgacgtgatttgggtgatcattgttgtccaggatactgaagatcatattgcatggcttcttcagcacgggtggcatgaaaaagctttggctgtggttgaatctggccagggacggagtgaactacttgatgaggtgggatctaggtaccttgatcatttgattgtggaaagaaaatacagggaagcagcatctttgtgtcccaagttgcttcgaggatcagcttcagcatgggagagatgggttttccactttgcacatcttcgtcagctccctgttttagttccttacatgcctacagaaaaccccagactacgtgatactgcttacgaggttgctcttgttgcattggctacaaatccttcttttcataaggatctcttgtccactgtaaaatcctggccatctgtaatttattctgctttacctgtaatttcagccattgaacctcagctaaatacttcatccatgactgattcacttaaggaggcattagcagagttgtatgtaatcgatgggcaatttgagaaagccttcttgttgtatgctgatcttttgaagccagaagtatttgattttattgataaacataacctacacgatgctattcgtggaaaggttgtccaactaatgaggctagattgcaagcgcgctgttcctttgttaatccagaatagggacttaataagtccacctgaagttgtgaatcaacttctaaatgcagatgataagagtgattgtagatattttttacatttatatctccactcattatttgaagtaaatcctcatgctgggaaagacttccatgatatgcaggtagaactctatgcggactatgatccaaagatgctgctaccttttctccgtagcagtcaacactacacccttgagaaggcttacgaaatttgcattaaaagagacctattgagggagcaagtcttcatcctaggaaggatgggaaactcgaaacaagccctagctgttattataaacaaattgggggatatagaggaggccgtagagtttgtcaccatgcagcatgatgatgaactttgggaagaattaatcaagcaatgccttcacaaacctgaaatgcacacagttggaaatcttgatcccctttacattgtaaataaggttcctaatgggttggaaatccctcggctccgggatcggctggttaagattatcaccgactacaggactgaaacatcgctcagacatggatgcaatgatatcattaagtattacaaagaggcaaggcatgggatttctttaggtaatgaagatgagccgcgggttaaaatgagtgatactcgtgcttctcagaatgtatcggtcattgttttcttttgctgtcatggttatcacacaacttgtctcatggattcgtcttacactagtagtaaccagaaagaggtccaagccacgtccctagaggcggaaacgtatgatggttacaatggttatgaggaagatgctagtgaggatgatgaagaagccaagtctggtggtcctc

SEQ ID NO: 48244 - DNA, 2112 bp, Glycine max
  Peptide Sequence Number=SeqID_165022
atggttcacaaatttatcggctgcatcacttcatggttacttcgggataagattcataaccattttcatgctcatatgcatgcgaagaatttggttgattctctcactgccattggtgatcctattactattaaagaacataactatgcgtcttttctctcatacatcaataattgttctgaatctccaaccattgatgaaattcaaactgttcttggtcatgaagcttgtattgataaatttaggaaaaaggttgtagtctctgttaatgttgcttcaacttctactgtaagctctacttctagctcaactgcacctcaagctaattttgtgcaacaaacaataatcagcaacaatctgttggtcagaataacttctaaactaatcaaaatcagtatcaaaattttaatggtggccgtggcagtcgtgctggccatggcagttgtgggggtcgctttgttggtcgaggaggccgtggacgtagcaatattcagagctacatctgccaaaaatttgatcatgatgctgcgaactgttggtacaagccatcatctccctttggtgtttcataatccaatgtgcatgccacagccacatcctcctgctgcttttggtgcacccccacaatttacatcaccctacattttttctccaccaatgatgactagttcatcagcttttggtgtttcccctgagattatgctgacacctatgactcagcaaatgcaaccttctacacaatttgtgcagcaatctacgcagcagcctcttcaaaccttttggggcaattcttcccaagcctcaatgcctcagcaaatgtcatcctctaatcctatgcagcagcaaatgcaacctatcaatcctatatcctctcataatccacaagccatgactattggttccactgcagctcaatccagtaattggtatcctgattcaggagcttcacatcatgtgacctccaatgttgaaaatatccagcaatgtgctccctttgaaggtcctgaccaagtcatcataggcaatggtcaagttctatctcccagtccatcaattgaacatcctgttcagtctctttctccatctccacagcctttacctcaaaatgtccatcccatgcagaccaagtccaacgatactacatggttggctgctatgcaaactgagtatgatgccttgattaaaaacaatacatggagccttgatagtaatcctattggttgcaagtgggtgtttcggaaacattctcaccagttatcaagcctatcactgaaacttcttcttactcttgctgtcactaataactggccaatacagcagttggatgtgaacaatgccttccttaatggcatcttagaggaagaggtctacatgcaacagcctcccggatttgttacctcaaacaaatcactggtctgcaagcttcacaaggcaatttatggtcttaaacaagctcctagagcttggtttgataggttaaaggaacaacttcttaagtttgactttaagtccagcaagctcaataatgttctctctctcaaagatctggggtgtttggactattttcttggtattgaggtcaaagctcaaactgatgggtctctcattctcacccaaggaaaatataatagagatcttttggcaaaagttaatatgtctgaagccaaacctatctcttcacctatggttactggctgcaagctaaccaaagcatctgatcctaatgatagaagatcaacatcaggtgcttgtgttttctttggaccaaatctgatctcttggtggtctaagaagcaatcggtggtggctcgttctagtactgaagcagaatatagaaatcttgccttggtgactgctgaagtgtcctggcttcaatctctcctttctgaacttgcagtcaagcacactatgcctgttattcacagtgataacatgagcactgcttctcttgcttgtaatcctgttcttcatgctaggactaaacacgtggaacttgttctttgtcggggaaaaaatgctcagcaagctgctgcaagtgaaccaagctcacagtctgtgattcctcaacttcggctaagaattacccaccatgagcttgcgggggagtattag

SEQ ID NO: 48245 - DNA, 114 bp, Glycine max
  Peptide Sequence Number=SeqID_165023
atgggcctcagatcattattgatcaaaggtgacgagcttggatactttccagcaagcttgatggctaggatggaaaattggctgcagaggatccaagtgcaaccacactcttaa

SEQ ID NO: 48246 - DNA, 708 bp, Glycine max
  Peptide Sequence Number=SeqID_165024
agaggactgcatgtcctcaccttcagagggctacacgccctcgccatcagaggactgcgtgtcctcaccttcagagggttacacgccctcgccatcagaggactgcatgtcctcacctttgtagggctacacgcccttacctttagaggactacacgtcctcgccaacagagggctgcacgccctcaccttgagaggactacacgtcctcgccaacgtagggctacacgccctcacctttagaggactacacgtcctcgccttgagaggactccatgtcctcaccatcagagggctgcacgccctcacctccagaggactacacgtcctcaccttgagaggactacatgtcctcaccatcagagggctgcacgccatcacctccagaggactacacgtcctcgccttgagagggctactcgccctcgccttggggctacacgccctcacctttagaggaccacacgtcctcaccttcagagggctacacgctctcgccatcagaggactgcatgtcctcaccttcagagggttacacgccctcgccatcagaggactgcatgtcctcaccttcgtagggctacacgccctcacctttagaggactacacgtcctcgccaacagagtgttgcacgcccttcaccttgagaggactacacgttctcgccaacgtagggctacacgctcctcaccttttataggactacac

SEQ ID NO: 48247 - DNA, 3478 bp, Glycine max
  Peptide Sequence Number=SeqID_165025
tgccgccgctcgatctcggggtcttaagtttgcgatgcagccaaatttgtttccctttggaagcgtgctggggaatcctttcattttcaatggcgacggcgatttgagcgagggaggaggagggatcgagagctctagggttttcttcttgctcccgttcttcttgctctcccagggcggagcaatggatttgtccaaggtcggcgaaaaaatcttgagctccgttaggtccgccagatctctcggattgctccctcccgtttctgatcgccccgagataactccgtacgattggattgttgaaatgtattgtgtgtttgttgttaagttaggaagaagcagtaactgtgctgcttttaatgcgtttgatgcgagttttgggtttgatgatgtatgtaccgttgctatgcgcctgccacctcgttgcgatttagttgctatccttgacattgcgggtgatgcggtcgcaattgtggtcatggtgagtgaaaaaacccttgactttgcagttgcaattgcggttgctgacatttttttacaaccatggggactactgaataatttgttcaatttagtagctataggagatataaggttgatccaatggttggggaagggtgaagggagaagggaggggggagaggttgcagctcgagctgctgctgcagctgctgtagctcgtgctcttgcagggttacctcctcatcagagatacagtctttcttcaagttcagaagaactaagttcaatatatggaagcatacctcaaggccaagtagtggaggagctggaggatgaattctatgaagaggactttgatccaattaggcatgttttagagcacgttccagttgaagaaaatgagctgacatattttgaaaaacagccagctgcaggaactgcttatttaagcaatggttgcaaaccattaaatgagctcatgttggcgagccctggtgcagcggtaaagttgtgccttggtgacttgttggtcatgggttcgaatccggaaacagcctctttgcatatgcaaggcgaagagcctctgggcaatggggctgcccttagattggcacaactggatagagtagctgagcgtttatctcgccatgttatggagcatcatgaagtaatggtagctgatacttacttttgcccagtgaaggggatgaatttggtcagagaattggaaaaagacttaagaattgcaaatgtcatctgtatgaatggaagaagacacttgacatcatctatgaatgaggtttcaagggatctgattgtgaattcttattctaaaaagaaacaagctcttctggacatgcttccaaccttgactgaacttcgacgtgctttggacatgcaatcaacacttgaatcccttgtagaagaagggaattactggaaggcatttcaagtcctatctgagtatttgcaactcttggatagtttgtcagagctttcagcaatacaagaaatgagtcgtggtgtggaggtttggctgggaagaactttacagaagctggatgctcttttattgggagtatgccaagaattcaaggaagatggctatataacagtaattgatgcatatgcattaataggggatactgccggtcttgctgaaaagatacagagtttcttcatgcaagaagttatatcagaaacacactctgtattaaaggctattgtgcatgagtggggacaaccctcactctatgagctagcttttggaattgagttaggtccaaatcattcaaagatgtgtattgagaaaaattcaagttccacatcaactagagatagtgtcaagatagagtatacaagtgagggtcaaccctcaccctatgagctagcttttggggttgagttaggtccaaaccaacattctaagactcaacaagactcagcagcacaaacttcaaataagtgcaatgaagaaatttcttgtagtccaggtgagcctcaggaagttgattcagatgtaagagcctgcaacaattctatgtccagttccggagatgtaatacatggctcatcttctagggaggaatctgcaacagtgagctcactgactgaaactagtggttcaccatatagtgattctcatgatacaattaaggaggctggaaaggaggacagtgcaacatcaagcattgagtccccttggtaccatcttcgcaaagaagctacaacatttgtttcacagacccttcaaagaggacgcaggaatctgtggcatctcactgcaagtcgtgtgtcagtattgctttcttctgctacagcctatactgctagcattcatcaattcttgaaaaattatgaagatctcagcatctttattttgactggggaagccttttgtggaattgaagcagttgaatttaggcagaagttaaagtcatataatgttgatcgtgatttcttatgtagttcttttgagtctggtacgtgcaaaatgcaatgtcatttctatcctcctatgtctgcacggtgtctccaagatgatgatggtgctctaaaaatggttttggagaaagagacttggctaaaattacctccagatacagtacaaatgatcagttttgcaggtcttattggtgatggagcaccgttgatttctttatccagtggtaaatcaactaatgtcagtgcagtccattccactaaatcggtcaatgtggttcacactggtgcaaggaagaatgggttttctcactggattaaaagtggaaaccctttccagcaaaaattaccaacctccaatgaaggtcgtggttactcacaacctaatggatcagtttgtggtgaatttgacggaagttcaaccaataattttcatgatgataaaacacccagaaagaatgatttcaatcaaatgaatggtgccaattctgtttcagaagatgaaaatgaggatcttcttgctgactttattgatgaagacagtcaactaccaagtcgaagttctcaaccccatcattcaagaactctctcttcacatggaaatgacgaagagaatacaactcaaactggatcttctctttgtcttttaaagtctatggataaatatgcaaggcttatgcagaaattggaagtggtaaatgttgagttcttcaaggtatgggacttgtgtctcacattggaaggatgggattttaggtgggtttacaatgtcttagctctccaactacatgttcactcaggactagtcttaggagttaggactactgcacagccagtccatgtgggtgctggggcaccggatgagcatggtgggatgttaggatccaattgcaaggaatgggacttgagtttcaaattggaagtatgggaatctagtgtgggatttgaggaaagatgtgtggctgttgacactatatctcttgttgctcgaatactgaatagatctaaagctcatctccaatcaatgctcttgcaaagtaattcaactatactcgaggatttctatgttcatctg

SEQ ID NO: 48248 - DNA, 390 bp, Glycine max
  Peptide Sequence Number=SeqID_165026
acagccagaaagcatgttgatacggacaaccactcgggtatctccgcccgtcagcgtgactcaaaagtcagtatgacagatcgtgtgagcgcggaagatgacatagcaaaaaagaatgtttatacggataaccactcgggtatttccgcccgtcagcgtgactcaaaagtcagtatgacagatcttgtgagcgcggaagatgacatagcaaaaaagaatgtttatacggataagcagtcgggtatttccgcccgtcagcgtgactcaaaagtcagtatgacagatcttgtgagcgcggaagattatacagaaaaaaagaatgtttatacggataaccactcgggtatttccgcccgtcagcgtgactcaaaagtcagtatgacagatctt

SEQ ID NO: 48249 - DNA, 495 bp, Glycine max
  Peptide Sequence Number=SeqID_165027
atggggcatcatctagatctacgacttgtccggaatcaatggcttttgatagatcccaaagtagattttctgatgtcagaggctaatgaagataaaacatttggagacttcagagagatgggacataggctagctaaggaagttattgcttttcttaaaagcaaaatggacaaagcatcaagatatgggagtctgggagatattaggctaagttttgttggacattctattggtaatctcattataagaacagcgatagcagatagcataatggagccatttctatgtcacctatatacatatgtttcagtatctggtccacacttagggtatctttatagttcaaactcgttgtttaattctggattgtggtttctgaagaagctaaaaggcacacagtgcattcatcaactcactttcacagatgatccagatttccaaaatacatttctctataaactgtgtaaggtagggattgtgtcctacaatggttga

SEQ ID NO: 48250 - DNA, 171 bp, Glycine max
  Peptide Sequence Number=SeqID_165028
atgacaaaagtgaataggtgtcacaaacataatatcgacaaacaagtaaaagaaagtcaggttccttctagcccacaaagaataaaggaagaaaatgatgccgcaattggtgtatggatgattctcaggaaagaaccttatatgaagaagcaaggtggaaaagtgccataa

SEQ ID NO: 48251 - DNA, 1656 bp, Glycine max
  Peptide Sequence Number=SeqID_165029
atggatcatcagggtcgtcttcttgtttttattttgctctcgttcttattaagaggcgagtcatggggttggttttcatcatctaaggagactccctctagtgacaagactcataccaccaatgaaggcaattttagaggttcaagtgctgagttctctattgaatccttcaatgaccataagggagtgaagttaatagaaaatgctaagaagaaaatgattagctcaaactcgtgttggcaaaatgcttatcaacatctttttgctggatgttctgaaatcttggctgttgatgagaagaggtctagattggcttggcaccttagtgattgctttcagagggattctggcaggacacatgcattcaaatatgaaacagagagacttgtgactgaattaaaaagttcggcccagtatgttgaggacaagttagatagcattgaagagaaatcagaacatctattacaaggctcaagacaaattcatgattctcttgattcaattggtagccacacaaaacaagtagctcaaactgctaaaaatttggaaggtcacattgattctgtattaacgcattcgaagagtgtttacgagcaaactacaaaaattgcactatcacaaacacagttaaaagaagggcaagagaatatgaagagaaacttggaggatggggtagggatgctcaaagactcttacaattatttgggtagagaaattgaaaagttaagaaatgaagccattgagattgagaatgaggtaattaaagttggagatgctatgtcatcaaaaatggacaacctgcaaagcaaagctgaagatattgggaatatggctgaaatttccttagataagcaacaaattcttttagacgggcaatccgcagcacttgagggcctaaactcattgactgagtctcaagctaaagcactagaagagagcaggaagaccctacaatattttgctgaatatgggcatagacaacatgaagagcttcttcagcgtcagcaacagattcaaggatttcatgatcgtttaatggaaaactcaaaggaaatactgtcttctcaggaatcttttgaatcaaagcaggcttccatgtttgttgttttagacaggatttttgctttgcaaaataccttgttacttgaatctagaatgatcaaagctttcttcgtttattccgtattaatctttgtcatcttcatgttgaccagtacaaagcaaacatacaatatcagaccattcctatatattgagctttgtgctactctctttgtggaagtactcattatccgtttaaccggtgataacattgagcaccaaacctggataataaacatggcccgattatttttcctggtagcagctttagtgcaacttctacatgcaattttcacatacaagaactatgagaccttgaaccatcaaatgctgctaactctaataaacaaggttaacagcatgcaaaaagaaaaggagttgtcatgggacttgtatactgattatgaggattggtctgaatggatagatgccgatttacctgatgatgtgaattgccttgatgatcctgactatatacttccacaagaagttgcagagaattcaatcacagttacaaaaaattataatctacgcaaccgcaatctttttcattga

SEQ ID NO: 48252 - DNA, 437 bp, Glycine max
  Peptide Sequence Number=SeqID_165030
ccaacccgcgagtcttctcttgcaattactgcaagcgcaagtttttcagctcgcaggctcttggcggccaccaaaatgcgcacaagagagaaagaacaatagcgaagagagctatgcgaatggggatattctctgagaggtccttaggaataaaggcacactcttcactgcaccacggcttttcgccaacaatgaggcctcctgagatgaaaagcagtgcaagatttgagcaaggatatgttggtcttccaatattcttggaggaggatgaggcagaactcttgtggcaaggtagctaccatcaggttccctctgagggaggccatactcatcagaatttcacactcagtggaagttcaaatttgagttttgttggttcgagtcttccaccagttgacttagagaactcaacacctgagttgacattgaaactttga

SEQ ID NO: 48253 - DNA, 198 bp, Glycine max
  Peptide Sequence Number=SeqID_165031
atggatgatggaagccaaagtttcttttatcaacctcatcttttacatggagccgagcctaacgacacaggtttgaggaaagataatgctaaaaacatgggtgatgatgacattgatatgcaaccgcaatccaacaatcccgacttttctagttatttcatgactgatgaggttttttcaagagcacaaattttttga

SEQ ID NO: 48254 - DNA, 1218 bp, Glycine max
  Peptide Sequence Number=SeqID_165032
atgcccttggaagggattttcattgaacctacttcaacttctacacctgatctttcccttcacataagtccaccaagcacttccttttcctcttcttcgatttgcaacaacaacaacacatctggtggtggtggtggcatcaattatgaggcacgcaattcaacaagcacaaatttcccttcacaagctcacattgagctttctttgggaaggaatttcagtgttggaggaggaagaggaggaggagttcctgaagaaccactaccacaccacaacaacaacatcaacaataacccttattatcaaacccaacaggctcatttccatcatcttcaacaccattctaatgcttcaagagcaacaacaacgacaagcactactacaagttcctccaatcacatgagtcacataaattatggggtttctttgcttgatgtgtcatcagaaggattgaggccaatcaaggggattccggtgtatcacaaccgttcattccctttcttgccctcggaacattcaagagacaacaaggatcatcatgccaaaatgtgtttatatcatcacatgccaacatatccctctttgtcctcttcttgttcccctctgtgttcttcttcgtcttcttcttcttctccagctgcaccctacttcgccgctgctgccgcggcgtatagggctgccacggccacaaggtttaatggaatttccggggaggctttcaaatctcatcatccattgcaccaccatcactcatcatcaccacactatggggttggacttggaccctctcatgagacctctgcagggttgatgagatcaaggtttttgccaaagttgccagcaaagaggagcatgagagcaccgagaatgcggtggacaagcacactccacgctcgatttgtccatgctgtggagcttcttggtggccatgaaagagctacaccaaagtcagttcttgagctcatggatgtgaaggatctcacattagctcatgtcaaaagccatttgcagatgtatcgaactgttaagaccactgacaagcctgctgcttcttcaggcctttcagatggatcaggagaagatgacatgtctccaatgggaagcagtggtggaatgcgtcaattttcagaccaaagaagcctttctgatcgaccactgcaacaagatatggactactcttcaggcaacaacactctatggagtaactcttcaaggtaa

SEQ ID NO: 48255 - DNA, 729 bp, Glycine max
  Peptide Sequence Number=SeqID_165033
atgattcaaaatgtggctctaccactagctcacagagaggatcataatatcgtttggtgcccttctgtctctggtacattatccttcaaattgacctatgattttatgcgtcctagacagtcaccagtagtctggagcaagcttttatggcaccccgcaatacccccatccagatcattccttttttggagattccttcatgataaagtacctacggatgataaattaaagaagacaggtagttatttcttgggctctatgttgttggtcatgcaagcaaagctcttgtcattaagggggttcattggtaccctcctattgtgggggtggaccaaatgcaatattgatggtgttgcgacgggtggaggggtgacaacaactttttgtgcggagcttcaggcaactatggaggcaatcagaattgctaagaaacgaggttgggaccacttatggctggaatgtgattcaactttggtggttcgggcttgtacatctcaagacttggatacctggtggcataaatctcaatggtttaactgttgcttagctactcattccatgtcctttaatatatctcatgtttttcgtgaagggaaccaatgtgctgacaggcttgcaaactttggtgttacatctcatggttcaacatggtgcgatactattccagattttgttagagagctctttagtagggatatatcgaggtcaccaaattttagatttggttga

SEQ ID NO: 48256 - DNA, 252 bp, Glycine max
  Peptide Sequence Number=SeqID_165034
atgaagcacttcactgacaccctcatcagtgccaacatagttactccacttaactttgtttcacctccgccattatctacacttcttccatctaccccaaagaccaccttcaagaaactctctcctgtagaaatggcagcacgccgagagaaggggttgtgctacaattgtgatatcgaattcctgcagcccgggggatccactagttctagagcggccgccaccgcggtggagctccaattcgccctatag

SEQ ID NO: 48257 - DNA, 607 bp, Glycine max
  Peptide Sequence Number=SeqID_165035
ctgtccctcctgttcagctactgacggggtggtgcgttaacgggcaaaagcaccgccgggacatcagcgctggcaagtgtagcggtcccgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatatcacaattgtagcacaaccccttctctcggcgtgctgccatttctacaggagagagtttcttgaaggtggtctttgggccggagttttcgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 48258 - DNA, 717 bp, Glycine max
  Peptide Sequence Number=SeqID_165036
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatgtagcaaagtctcttcgtcctatccttggaaaagaaaagtctggaaattgacccttcccaacccagaactggaagttgggaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48259 - DNA, 204 bp, Glycine max
  Peptide Sequence Number=SeqID_165037
atggcttacttgtctgtgacgtgggctaacagcggaggtgcaatggaggcacgacagtcgcggaggcacagcgggttcccttatcaagttgcaaaggggagtgacacaaggctagagttggaggcattttatttggggataatttttaatttcgacaaatttgattccttcagtaaaatccatcaaaaatccatacttttctga

SEQ ID NO: 48260 - DNA, 396 bp, Glycine max
  Peptide Sequence Number=SeqID_165038
atggcgatcactcctgactatcatccatatgattataccagacgttacatctgccatactcgagtccacgtagtgccaatagatagactagatgtagtgcccattattgtagaccagacattgacctattatatcccattcggattcacctttcacatagaggtttggtattatgaagattctcgcttgtatttcagactggaagagccacactatgatttggaattcttgttgactccaatagagtatgatgagcaggacaatgtttgtggatacaacatggagctagtgcacccaggtggaggttatagaggactgaggagacaattaagacatgtcgttcgaggagatcaaggagtgccaaatacttctgaggcaattggagcatacgcctga

SEQ ID NO: 48261 - DNA, 624 bp, Glycine max
  Peptide Sequence Number=SeqID_165039
atggagggcggcataggtcacatactaaacatcactcccaaagaagcgaaaatgatagaaggcctcaagagggaaagaaggattcatgagaatcctccagtagaatattggaatgatcttaagagtgtccttaggaaggggcacattcccatctactatgaaagggggcttatagacaagctccaaaggcttagacaagggagtatgagtgttaaagaatatagacaacaaatggaactactttttttaagagctggacttagggaggaggaaagaacaagcatagctaggttccttagtgggcttaatatggaagtgaaggacaaggttgaactccatccatatagggacctagacgagctagtccaactttgtataagagtggatcaacaacttaaaagaaagtcttctttaaaatcttatggctttcactgttatccaaggaaggaccaagcccaaggaattttggaggttgcaccttcaaaacccaaggaagataagggtaagaccatagagaaatccacccctaagactagttcccaagcaaggattagcaacattaatagtgtgtttggatggagcaatttagcaggagaattcattttttcaagaaatttaaaatga

SEQ ID NO: 48262 - DNA, 323 bp, Glycine max
  Peptide Sequence Number=SeqID_165040
ggatcatccccttcaacaaacatattgcggcagtagggactaccagcaacaatatgttatcaaagagaaaaactctagatgagggttcactgttatcaagcaagtcggagacccaacatgaccacagattcacctccactccttatgttcccatggacccgggccctagctcacccaggccagcatttggctcgcttgggccaccaaataacttcaaggctaagggactagctcgcctgggtgagctcactgcttcagggttaagtttcggctcgcctgggcgagctgcaactgccccaagctggctttttgcctataaatag

SEQ ID NO: 48263 - DNA, 183 bp, Glycine max
  Peptide Sequence Number=SeqID_165041
atggctcgctcgctaaacgcatcttattccctggctaagcgcgagacatcaccgctaagcccatttcgatgcgatctaaattgggatgaactcgctaagcatgcctaccgcgctaagcgaggtcatcttttggagaagaacattagtctccctgatgagttgcctatggctaagcggggctga

SEQ ID NO: 48264 - DNA, 342 bp, Glycine max
  Peptide Sequence Number=SeqID_165042
atggggccaataaaacttttctttgattcaatgtttagatcaggaatgcaaaagttaccaaaaggagggggcaaaaagttcttttcattgagtttcctggaccctagctcccccagtctagcctctggctcgcctaggcgagccaattgcttcatggctaagtctcagcttgcctgggtgagctgcagggggttgagtaaagggttacaaggttcagcattgaaggatattaagagaattgagagagtagaagaacaaagaagagaaaatgaagccgaggcgctactgaatcacgccgtgatcgaaccctacattgttccttgttcagtgttcttcgtgtag

SEQ ID NO: 48265 - DNA, 219 bp, Glycine max
  Peptide Sequence Number=SeqID_165043
atgcgcgctcagtttggcaaaccctttctccatcctccttcgaaagctttagttcctcattgtccttcgaaagcttttcccccacgcacactcagtttggcaaaccctttctccatcctccttcgaaagcttcagttcatcattgtccttcaaagttgtgaccctcgaaatcaccctttctgtgtcactgaagctttggctgggtcgtctttcacttga

SEQ ID NO: 48266 - DNA, 114 bp, Glycine max
  Peptide Sequence Number=SeqID_165044
atgggcttcttagttgatggatcagcaagagtaaaggcacaacctcaagatgactctaaggctacattggctccaaaggtttctattgttggagctcctgttgatcagaaatag

SEQ ID NO: 48267 - DNA, 150 bp, Glycine max
  Peptide Sequence Number=SeqID_165045
atggagaattggcgaacagcgctacgcaataacttcgcggggctccagactcgatgtggagaatggagaattggcgaacagcgctacgcaagaacttcgcggggctccagactcgaaggtggaggacacatgaacagcgctaggcaataa

SEQ ID NO: 48268 - DNA, 876 bp, Glycine max
  Peptide Sequence Number=SeqID_165046
atggcgccaccacggctcgattacagaatggtttacattttcgtgatgcagcagagaatgggagattgtcatgagctgggcatggaagatctcacgctccttgaggaagaaatggacaaggccgccaaggttgttcatgagcgtaagatggaagctctcatttatagcttgcactttttttccttgaattcttcaaaacatgatgcatggcttaaaatgatacttgatgatgatggtattgctgctccaggggaaattcttaggccatatgacatctatatcaataaacaatcaccgattgatacacgtactccaaaaataggaccagcaaatttgcccgatagtgcatatcggtccaatgcacaatcattcaatgataatggaggagaagtagttgatagggtggttctatgctctgataaggataataacatgtgtatcaaatttctaattcgtcacactcgtatgcctgaggttaaagcatctttctcattatggtttgacaactggcaactaatgttctttggagttttctataagatatggaaccatgagaaggctatactgcttaacagttttgataatcatgattttcccgacgaaggaattcctaagctctgccttgtaaatgagcttgatgatagcttgcttcttgatgcttcatctgatggaaacattcagatttggaaggactatactctgaagggtaaacaaaaacttgtcactgcattttctttaattcatggtcataaacctggcatgaggagtctgaatgcagttgttgattggcaacaacaatgtggctatctggtatgtggttgttctttgattatttttgggaatgtgggatatctccctctacccccaatgtcctaa

SEQ ID NO: 48269 - DNA, 210 bp, Glycine max
  Peptide Sequence Number=SeqID_165047
atgactgaagacatttttgtctttgaaatgtatgcggattaccgtatagggtgtctccgcatgctacctgacttctcacaggttggggtagcaaaactgtcaaatgagactttttcgcagtctcagtcggaagacgctgacatctctgggaaaggcacagatgatgacgttagtcactgcatgttatcgggctttgagtcttacacatag

SEQ ID NO: 48270 - DNA, 522 bp, Glycine max
  Peptide Sequence Number=SeqID_165048
atgatggtaacaagatggagaacaaatactgatgaacttcaaaagcaaattcgaactctagaaaatgataaggaaagtcttatgaaggacataaacaaattgaatgaacaactcagaaagatggaagaaaagatgcatggagtacaggatctaaatcaaattgttgaggatcataataacactctccaaacccaattcaatgaagcacatagtaatcttgatcaactctcagagaaagtcgaaaatgattcatcaagccaggctgaattaaaaagcaaatctgaaggacaagttcctttaaatgaggacaatatgttgttgaatgatattaagtctgaaaaggagcttacaaatggtttggtagaagatgatgcaaaagataaggagcttaagattgctggtactgttgaagacgatgtaacatcagacaacaagctagaggccactggctcaccatttgctaatgaacctaatgtcacccgttcattggaaaatgatgctaagtcagtagataaaacctaa

SEQ ID NO: 48271 - DNA, 645 bp, Glycine max
  Peptide Sequence Number=SeqID_165049
atggagaaggttacagatgcggatgctccagttcctatacccactgatgagtgttccttagtggggcaggcatttcacaccttccttgctaggccaacacatctggtcaagtctttatcacagcaggcagttgtgtctccggcaaaaccacctcaaaagcccgatctggaggtcgatgatccgcattatctgatgacattgaccatcccagagcttttcttgagaccttatcaggttacatgcgatgccatcgtgttcggggtctttaattcagatttcccgctctacataaagcacgaagacctcttcgaaatcgcacacggtggtcaatgtctcagcatatcaatgttacagttgtggattctcggacactggcaggtggtggtcattgtgcccaaggaacacctagttgtctggttttgttcattgcataacaggccagccaattaccttaaagggataattaacagtgctttaaaaggtcttgatgatgctccacagcctaaatcaaaggctcctgcttggtggattgtcgtcaagtattttaacgatcctagaccattggagccagagagattaaaggcgttgcagatgcagtgggcacagtattatctccgagttagagatcaaacacctaggatttag

SEQ ID NO: 48272 - DNA, 171 bp, Glycine max
  Peptide Sequence Number=SeqID_165050
atgaggaaaatgcaaggatcatgcatgagtgcagttaagaaggtgatatggacctttcgacttcctatgacaaaagacgagaccaacatacaacacgtgcatgacgacatgatgcagacgcgcaaaagcacaacacgaggatgtacacagtatggcaatatccgaaaataa

SEQ ID NO: 48273 - DNA, 138 bp, Glycine max
  Peptide Sequence Number=SeqID_165051
atgcccgggagaattggacaaattgaactaaaggaccgatgggacatctccgaagatgaggaagaggagcgtagaagaccagggatatcgattactggtcgtaaggggtgggatatctggttcagcagcagatcctaa

SEQ ID NO: 48274 - DNA, 333 bp, Glycine max
  Peptide Sequence Number=SeqID_165052
atgactaacgcaaactatccgcaagaatcattgcattcagtctcaaacgggaatctaaggatgtgtgtagttgtgatgctagtaaaaattgagggcaaactagtgatcagtgttgtgaaaaatccaacagcaagaatcgaacatgaagctagtacgtccaaaattggtgaagatcaattgttttattttcagcaaaggggaatagactatgaaaaagcaatgggtgctatgatctctagattttgttgtgatgtctttaatgagcttccttatgaatttggttctgaggtgaaccaactcatgagcttgaagcttgagggatcagtaggttaa

SEQ ID NO: 48275 - DNA, 531 bp, Glycine max
  Peptide Sequence Number=SeqID_165053
atgagcgtccacgtggctcagttgattactgacgccatctatttgtttgcaggtatgccacccactaggcaccctctagacccggataagtctaatagggccctggggtttccagcattgatcacgggcctctgccagtcattcggggttcccgtcacccctagtaaggtgatccaactgatgatcacccgggccttcattgagaagtattgcacgcctaggcaggtgcagggtgatgcacctctggccgcagacgcaccaccaccacctcatcaggccgatcccgctaggtcactaggcatggagcgttatctacaacacttggttcgccagcaggcggccaaccaccgggggcagggtttcgctccttttgcgtgccctattccagagcagtttagggctgaggtcgcatggcccaaggcccaggtaggggaggcgcctgcaggatctcctggcgatgcagaggaggcccgtatggatgaggagatgacggacttgctcggtttcttgggaggaagcagagccacgtga

SEQ ID NO: 48276 - DNA, 246 bp, Glycine max
  Peptide Sequence Number=SeqID_165054
atggggcttcgaataagatttgatggtggaggttgcacgaagagtgctatgcagtcaattcgtggcgctcctgactcaaaggtggaggatgcaatcaattcatggggctccgaactcaatgctggaggaagcatgaacgacaatcaactcaaggggctccgaaaaagatttgatggtggaggatgcacgaacagtgctatgctatcaattcgtggggcttcggactcaacggtggaggatgcatga

SEQ ID NO: 48277 - DNA, 531 bp, Glycine max
  Peptide Sequence Number=SeqID_165055
atgaaggaggctctgagcaaggccttggtccctttctacccaatggctgcacgcctctgccgggacgacgacaggctcatggagatatactgtgatgctcaaggcatgctcttcgttgaggctaagaccactgccgccatcgaggacttcggcgacttctctcccaccctggagctccggcagctcatcccctccgtggattattttactcgcacacgctttttcccatcttttactttattttattcctcagttgacttgccacatagacatatgactagcagtggaaattggattttaatagtagggacttatttgcataacagatattatgacaaaggtgatgacaaaaatctcaaaggtcaatcaaagaatgagttcaagatattcaagatagaatcaagaacacttcaagattcaagaggaaagttgatttcaagaatcaagattcaagagatcaagatttcaagaatcaagattcaagagatcaagattcaagactcaagattcaagaatcaagagaaggcttaa

SEQ ID NO: 48278 - DNA, 174 bp, Glycine max
  Peptide Sequence Number=SeqID_165056
atgaaaactgcttatgagcaaggaaggcttgtgctacttcaaaacttggatccatctttatcttcatccgaggtacagaatgctagaaatgagacaatgaaagctatgagtgaggcaagatgcaacccttttaaagagttttccgatcttaggacaagaatagaaaccatatga

SEQ ID NO: 48279 - DNA, 623 bp, Glycine max
  Peptide Sequence Number=SeqID_165057
atgagggtagcaccagcgtgggcttgccaacctctaacgcaagaagccacagcattctccccatttgctcgcgctctcactcgtattacatctctctcttctatgccaacacagcgtcactcttcaaaccctaccccaaccctcttctccgctatgaaacttgactatgcaagacctcctctctcaatcataatttgcttttatttcacctttgaactaactaatatacttcttgttcaagggagttgtccaagaagatttatccgacgaggatttcgacatgagacctcttatcctatccctaatcctaatgattttcccggagctaagaccttgctgcaaacattccttgacggccaggaacgggatttaactgcctttgtagacttgattttagcacaaaccactgtagcctttattgttaagattgaggatgatgacgatgaaggactcttcgctcttgttactgctcttaatttatatagatacaagactgtcgcaacgtgcccttcgcgggcgagcaagggcgaggctctcgggtgcgctttccaaaggaggaaagatgcgcggagtcgccaccaacgtttatttgtgggaaacgtcggaaaaaccgaaggaaaccg

SEQ ID NO: 48280 - DNA, 360 bp, Glycine max
  Peptide Sequence Number=SeqID_165058
atgtggtgggcatgggttatgttggcggttaatagatgggagattccagagaagtaccttatggaatatgttatttcaagtgatttgcaagacagaacaccattgggaatagtccaagttttgacacctagcaatcaagctaacactccccagttctttgagccattgaaatttgataccatgaacaaagatgctatcatcagatcagatgatgctgaatttggagaagcagatcaagatgagcaaaaatatgtagatccattggataaatttctccctcccccatcaaaagctaaatgctctgaggagttacaagatgtaggatgtttccaattgttagctttctatttgatggtttag

SEQ ID NO: 48281 - DNA, 609 bp, Glycine max
  Peptide Sequence Number=SeqID_165059
atgggttctacctggtgtctcaactcccagatgaaaaaactgatgcttcattgtagttatcagaaagcccaagctggagcagatgttgtcagtcctagtgatatgatggatggtcgggtaggagcactgcgtgcagctttggatgttgaaggctttcagcatgtttctataatgtcctatacaacaatttttacattattgattgttggtttgctcattaatctggcatggctgaacaaaagttatcagatgaacccagctaactacaaagaggctctgactgagatgcgggaggacgaatttgaaggagttgacattctcttgattcctgttcaaggtctccatgtcccaacaccctcctcaggtcaaaagatgcatttgcagctatttcacacttccctcgtgctaaaatcaatattgaatatacccagatatgactttccagttagacgtcacaaccaatgcatgtacactactcataaacaacatcaaggaataagctggtaccatgaagctgatatgaggacaggacaggaagagcaacttattggcaacttacaagccttcaagcattttggcctggcctacaggctagtagctggactttga

SEQ ID NO: 48282 - DNA, 669 bp, Glycine max
  Peptide Sequence Number=SeqID_165060
atgaacatttcaaggccatactctgccatgctcgttcaagtaagccaacctcatcatatcttcgatccaccatgctcttcatctgtgtcctggggaaacaagttctccggaagagcaacaacctgcaaaacaaatcacctcacagattcatacatcgtcaattttggaatgggcttttctctaccaaaaatcctgaaaacatttgacttaaaggaatcaatggcactggacgccgagccgagcctacttgagcgcgttgtggactcggttgacgaatgcagcgtgaggcgagccctcctctctagcgtaaatctccttcaactgcttcattgccttggtgtggttctggcggcggagtgtggtgagtgcgcgctcacattcgagcttgattatgaagtaatcgaaaccctcagattggagtgtggccaattcgatcttcctagggttgtcaatggaaacattgcacgtggtgtaggcgtccggcgaggtggcaacaccgttggcggtggtggccgcgagggattgtttcgaaaggtggtgagaaataaaagaagaagaatcgtcatcgttggagcggcggcagccaaggacggcgtggagatcatcacagaagtgggtgatgctggtggccaaggcaagagaaagcgcaagaggctgaatgggctttag

SEQ ID NO: 48283 - DNA, 408 bp, Glycine max
  Peptide Sequence Number=SeqID_165061
atgcccaaacctaatgctgcaacaatcacaccaccaacagttgtgacagctatatcagctctgttactgttcgaagccttggcctggcaagcatccaataaggatttctcagtaaaccaccaggctaagtggattcatggacttgcaataacaacttgtatgaataagaatgtctttgtttccattgctgttgttgacatgtatgcaaaatgtggagccatgaaaactgccagaaagcttttcaacatgatgcaagagcaacatgctataacatggaatgcaatgctagacagatatggaacacatgatctaggaaaagaagctctggatcacttcaatgagaagcagaaggaagctgtcaatccaaaagaatttatgcttttcttgggactcttggagatgagataa

SEQ ID NO: 48284 - DNA, 1113 bp, Glycine max
  Peptide Sequence Number=SeqID_165062
atggcacatgagaagaagtctgaaacaaagtggaaaaagtctatgacaaagaactcctacctggtaaaacatagagctatgttcaaattgtctggttcaagaatatcaagttctatttcagctgagttgggtaacttcacttctcttcaaacacttgatttgtcttcaaattctctttctggcttcatcccttcagaactgggtcagcttcaaaatctaagaatattgcaactatactcaaatgatctctctgggaacattccttcaaagataggtgacttgaggaagttgcaagttcttagaataggagacaacatgctgacaggtgaaattccacctagtgttgccaatatgagtgaattgaaagtgttggctctaggctactaccacttaaatggaagcataccctttggaattggtaaattgaagcatctaatatctcttgatgtacaaatgaacaacattaatggccacatacctgaagagattgaaggctatgaagagctccaaaactttgcaacatcaaacaacatgcttgacggagacttaccttcctctatgggatctcttaaatctttgaaaattctggatttggccaataacagtttatctggatcaatccctacagctttaagtagcattccaagtaacttctgccttagaggttcaaagcgtcaacaacttttcttggctagaaacatgctctttggcaagtttcccttagagctactcaacttctcctcaatccaacaactggacttttctgatagcagctttgaaggaaaacttccttctatcttggacaaactgcagaacctcacagatcttgtgctcaacaacaacagctttgttggacaaccacgtaacattggaattgcgaggctcacgggtgcgtcttccaaaggaggaaaatgcgcggagtcgccaccaacgtttacttgtggaaaacgtcggaaaaaccgaaggaaaccggtcatgaagaatattccagattcgggagttgtatttacgtttgaggaaggtattagcacctctcacgtcgacaaaagcggagctcttgctcctacgtaccctccatcgaagaggaaatcagacctatgtagttctttctaa

SEQ ID NO: 48285 - DNA, 188 bp, Glycine max
  Peptide Sequence Number=SeqID_165063
cgttttctggaaaatgtgatgaactcgctaagcaagcatgttgcgctaagcgagttcatcaatactcattgtgtataaaggcattctcggaagaactcgctaagcgcacccaccatgctaagcgagttcatcctgtgaggatgaacactcatccccttactggactacctgtggctaagcgcggctga

SEQ ID NO: 48286 - DNA, 407 bp, Glycine max
  Peptide Sequence Number=SeqID_165064
gaagccttcttaacaacaaagagaagaacaagatgaaagattggaaaaatacaagtggtgaggatttctccttcacctctaggatctcacaatcactcacaaactcatttcaagctctcaaatcggctcctgcttcaagccctgcgcgcctttctcgcttagcggatgaactgaagcagagtgttgcacttagtagatgctcgctaagccagcagattggcttagcgagaagtggacactggcaaatggtcgtcattttgcctaaggaaaaccttgttgtctggttttgttccttgcataacaggccagacaactaccttaaaggaataattaatagtgctttgaaaggacttgatgatactccacaacctaaatccaaggctggtgctaggtggattgttgttaag

SEQ ID NO: 48287 - DNA, 474 bp, Glycine max
  Peptide Sequence Number=SeqID_165065
atgacccaagagctggtagcccgcggagacaccttacggttatccgcacctcgtcattcagtcaccccaagtgtgattgacgagcagaggccaatatggtcatctgcgccctttccggagatgtcagcattttccgatggagacttttcaagtctcacaaattatccagaactacgtagaggcggcgggcccgatgacaagcagagaccaagtttggtcattctgcacccttgtatcatccagaggcgcgcgggcccgatgatacgcggagataccttacgattatccgcacccttttgtcatccagaggcggcgggcccgatgacaagcagagaccaagtttggtcattctgcacccttgtatcatccagaggcggcgggcccgatgatacgcggaaatacccgagtggttatccgtataaacattcttttgctatctgtaagaaagaacgcttgatagcatgcagaggctga

SEQ ID NO: 48288 - DNA, 132 bp, Glycine max
  Peptide Sequence Number=SeqID_165066
atgtgtgttcctagaaatgggaggtggaacttcaataacaagaaaattgtcaagccaactaaaatagaaagatgggttgcggttaactactctgcacgctgtcataatgagagaacgatagatgctatttaa

SEQ ID NO: 48289 - DNA, 1299 bp, Glycine max
  Peptide Sequence Number=SeqID_165067
atggttcatgagctacctttcagtattatcgaggatgaagtatggatgtgggcattccaatatgcaaattctgaatttaaaaaaatcagtcaaaaaatagtgagaagtgattgtttagcattacatgaagcagagaagaaacaattgaagaccttgctgaaaactattagcaatattagcttaacaactgatatgtggaaatctagtcatcaagttgttgagtacatggttattacagatggcctcgataagattaaggatgtcattcagaatgttcgtgaaagtgtgaagtatattaaccataatgattcaagactaaaggcattttgtgatgttgctgaacaaaaacatctgaaagaaagaaagctcatcattgattgtcccactaggtggaattccgcatttcaaatgttgtcaacaacattgaagttcaaaactgcattttcaacctatagtgaaagagatccacactatacttatgcacctttacatgaggattgggaaaaagtgcaaaaggtttgtacacttttagaagtttttaatgtagctacacatgtaatctcaggcaatgagtatcctattgctaatttatgtcttgcagaagtttggagggttaagcaagtaatagacaatgcattagaggatacaacttttttcatgagagaaatggcaggttcaatgagggtaaagtttgacaaatattggggagaatgtaatatgttgatgtccattgcaagtgttttggatcctaggtgcaagttccatgttgttaacatatgttttccattgatatacaagtctaaagaaattgcaatggagaatatagagaaggtacgaaactcacttcaacaattatatgatgagcatgtgactttgagtatcaatgaatcatccttaaatgaaatgaatgatattggcataaattcttcaactacctctgcatctaaatcttctattgtcattggatttgatcaaataatgaacattgtgcgtgcaaatgaagccacccctccagtgaactcagaattagaggattatcttaaggagaatgtttatattcctgaaactagtaactcttattttagtgtgttagagtggtggaggaacaatagcctaaaatacaaggttttatcaaagatggcgggtgacatactagctattccaatatcaacagtagtttcagagtctacatttagtgctaagggtagggtaattgatgagtattgttctaaactaaatgaagaatctattgaagcgctcatttgcagggggattgacttcgccataattataatttga

SEQ ID NO: 48290 - DNA, 303 bp, Glycine max
  Peptide Sequence Number=SeqID_165068
atgacgttgcaattgacgaatttttcggcagatccatcttctcctcacttgaattttcagagctctgcctggcaccacaattctcgacgaccggcatggaggtccgatgagatcaatggtgaaggggaggaattcgacaagatcgagatcatgaaacaaaagtgtggcaccagaaattgttttccgaaatggaagattcgttggagtgaggctcgtggtcccttgttggagtttggtggcagtgtcttcgaacttcttcgagttcgacgtgtacaacacatctacctgctcctagttctctga

SEQ ID NO: 48291 - DNA, 165 bp, Glycine max
  Peptide Sequence Number=SeqID_165069
atggtgggggtcaaatgccagaaccctctgaagaggaatttgaagctgcacagagaaaggtggaaagcggaagtaccggttactgtcaatggtgaaatagccgcaactttcctgaaagttttagggattatatgttatcttccatcaattttctctgatccttga

SEQ ID NO: 48292 - DNA, 336 bp, Glycine max
  Peptide Sequence Number=SeqID_165070
atgaggaacatgatttctaccttctttggagttactaatcagattgaaagaggaagatacctagggctaccatctatcattggtagaagcaagaaagcagtctttggttacctaaagggtaaaatttggagtagaatcaatcactcggcaagaaaacattattccaaagctagtaaggaagttcttgttaaatcatgtgctcaggaaatccattcgtattgcatgagcgtatatcttttgccaacatctttggaggatgaaatgcaaaaaatgatgaatagtttctattggcgttctaaacatggttcttcaagaggaatcaactggttgaattag

SEQ ID NO: 48293 - DNA, 165 bp, Glycine max
  Peptide Sequence Number=SeqID_165071
atggactttcttgtagtccatgcgaaatatgatgcaaattccagaggcgagccagaaattgcgtacatgctcactgccaaaaaacacatgccaagagttctccagattggtttgacaatactccgcgagattgaagacgatggtgaggtggtagacagttccatg

SEQ ID NO: 48294 - DNA, 516 bp, Glycine max
  Peptide Sequence Number=SeqID_165072
atggcgagaaagaaggttgactttacatacataagcaatccgaggaagaggaaggctgcattgaagaaaaggaaaaatggtttgctgaaaaagattgatgaaatcacaaccctttgtggcattcaggcatgcgctataatttatactccagacgaacctgagcctgaggtttggccatccaaccaaggagtggaaagtgtgattttcaactttaggggagtttctgaatcggcacgaaacaaaagaatgttttgtcaagagtcacttttaatgaaaaacataaccttagcacaagggcagctcaagaaacttagggatgaaaacagaaagaaggagataggccttttcttgtgtcaatactttgctggtggtaacaaccttggcaagtgcaacattattgatctgaatgatatcacgttcttggctgataaaaaattggaggagattacaaagaaaattgaaatgctccttgtccaagaggtgacaccagctactgaaaatgaggataaaccgtga

SEQ ID NO: 48295 - DNA, 516 bp, Glycine max
  Peptide Sequence Number=SeqID_165073
atgattatgaggagccaagacatttgtagtagtcaagatgaggctactacttcaccttcctctagtgaaagtgaagaagcaaaaggggaagaatatagtgaagaaatctacccccaagaagaaggacaacctttaatgtttaaggaggagtgtaaggaggtaagtgtctcctccaagagcttagctaagaaggaaaggcattttgaaataaagacaaatattaaagaaatttcccctcttagacaacctccacattttctcctttgtaaaaagacacttgttagcattgccacacctcttgggcttgagtttattcctcaagtaaaggagttgttggatgagggtttgcttcccaagagcttaaatccttgtgctttgttggtgcctgtcgcaacctacccatcggcgggagggcgacacggggctcgtgggtgcgtgttccaagacaggaatatgcgtagagttgccaccaacgtttatttcaggaaaacgtcggaaaaaccggaaaagacgtga

SEQ ID NO: 48296 - DNA, 420 bp, Glycine max
  Peptide Sequence Number=SeqID_165074
atgaaggccaacatggaggccatgaaagaccaaatggccgccttgatggaggccatgttgagcatgaagaagataatggaggtcaatgcggctgcagttgccgctaccagtgccaccactatggtgaatccaactcacccgtctggcataaaccaaataagtcgtccagtccccgacgtggtaggtcaaggaggagaagcattgggaagtacaggcggtccccatgtggtgcaaagcaagaactctttcccaccatatagtttgcctcccaactatgcaccacccaatgttgcacacgctcccgataagaatgtcaataactccactcccatactcattgagagccaacaaccccaatctcaacccatgggggagaaacatgaagcaccccaccataatctggccgactttgagccttaa

SEQ ID NO: 48297 - DNA, 222 bp, Glycine max
  Peptide Sequence Number=SeqID_165075
atgaagaacttggagatggggggcgggctaagggctaggcgacggggaccagggtggagagcagtttcgggagggtgtcatgacggtggactcttccatgccattcccaacagtgagagagtcgagcatgcttggtccgaatccatttggcctgtcgggctatatggattgggtaaaaaaggctcgtttctatttgggctgcattttattagcttagcctga

SEQ ID NO: 48298 - DNA, 243 bp, Glycine max
  Peptide Sequence Number=SeqID_165076
atgacatattacaaaagtacaaaaaatggcagaggaaaacgcatcacaagtagtggcagtgcatgcagtcttccaaatcaagccgtggtagcagaagaaaatgagtgtcgtcccatggttagcctctgcaactgcaacacatgggtccaaatcgtcggggaaggactcttcgaagatgtggctaggggagcatgggagctgaaagcgataacagcaaagggttgggaaagtgataaggactaa

SEQ ID NO: 48299 - DNA, 177 bp, Glycine max
  Peptide Sequence Number=SeqID_165077
atggatacctcggagccctacactagggcaatgagaggcaccgtgcatgagcctcaagcgaatctagggacagatcaggagttcttacccggagtagagtccaacccaaaaggtacaagcaacgctcttgaggttcttactcaatataaccctcaaacactctttgagcctctctaa

SEQ ID NO: 48300 - DNA, 288 bp, Glycine max
  Peptide Sequence Number=SeqID_165078
atgaagactttgggaggagtggatgacatctactatgccgccctcatcaacaaagatgacattctgcaaaagaggcagaagaaactggccaaggctattgctaataaagacaaggctttggaaacttttggccttgctatgaaggttaaaaggatccttagggagcagaagggaaaggtccaaaccaaaaagcctgcccatcaacaaaaggaggaggaaaaaattgttatagaggagcaacggatgaagaagaaacatgaagtgcccagaccctctcttccagtgtag

SEQ ID NO: 48301 - DNA, 360 bp, Glycine max
  Peptide Sequence Number=SeqID_165079
atggctgctagtgaccatgcaatcttgcatgatagatcacacatcccaacgaaaagaagcctgctggagctttcatcacaggatgctttgttggcacataacaagttgttatccaagcaacttgaagctttaactaaaacattaactaagttgccaactcaattgcatgctggacaacctttaccctcttttgttttgcgggttgcaggttgtgttatatgtggtggagcacatgattctggctgctgcattcccacaaaagatatagcacatgaagtgaactatatggggaatcagccaagaccaaactttaatgcaggtggatattctggatttcaacatggccagcaatataattag

SEQ ID NO: 48302 - DNA, 663 bp, Glycine max
  Peptide Sequence Number=SeqID_165080
atggaatcaagcaatgtgaagaacaagtcaagtggaaaaagaaagatgtctagtgaggacacaagaagttacttcgcatggaacttggaaatggagcgtgtgctagctgatgtgcttagagatcaaagaaatttgggcaataaaggtggtggaaattggaaagcagtagcatatagtactgcagctcaaattttgtccaagcgttttggagttcacctcatggcagataatgttaagaatcgttttaagctttggagaacatggtatggaattgtgagtgtcattcttagtcaaagtggatttgactgggatagcataaagtacatgattaccgttgaaaatgaaattgcatggagtgaatatgttaagtcacatgaagaggccaaacaatttcgattcaaagtcattcctaattgggatgatattgttgacctatgtgcaaaggatagagctattggactcggagcagaaaatgcattagatgcagatgatatcatgagcaaagaaacaaatgaagaggaagcaattcatagtgtgagttttgacttagagggatcaagttctgccacgagaaaaaacattcgtccaagtaagagtggagagaaagaagggatgattttctcaatgaaagaagtagccgagtcattgaaagaatttgttgaa

SEQ ID NO: 48303 - DNA, 324 bp, Glycine max
  Peptide Sequence Number=SeqID_165081
atgatgatttcagactctgtgaagagattcaataaatttctgagaaacaaagaaaatcaaaggagattaaacttcaatccaaagaacaaaggagaagattcctccttagttcctaaatgctatgaatgcgatcaacctgagcacttgagatttgattgtcctgtctttaaaagaagaatgaaaaaatccgacaagaaaagtttcaaagataagaaagataagaaaacatacatcacttgggaagataattacatggattcattaagtgattcagaaaatgaaatcataaatctaggcctcatggccaaggactatgaaacatag

SEQ ID NO: 48304 - DNA, 243 bp, Glycine max
  Peptide Sequence Number=SeqID_165082
atggccactattcagcacctggtgatggaaaacaagaagataaggcctatcatatgcaaaaccaagccaaacctcaacaaaattttcaaggaagataccaatgctatagagcttctcactaagccaatctgtcggcttagcgagccatccactgagaacaccactcttgtggctgagcgcgaggaagaatctggaagaaggatgagatggacacacgcgctaagcaagcactcatccttctaa

SEQ ID NO: 48305 - DNA, 264 bp, Glycine max
  Peptide Sequence Number=SeqID_165083
atggtagcctggcccaggacccaaccttctcttcataaggaagacgaaggtcccacaacccagcgatcccttgaggctacttcagagccttctgcaccagtggtaactctaccctcacgtcagcctgcagcagactcctccactcctcttctacagatgccagaggacccaactacaccagtcctagctgtggacacttctcctcccactactctagtgcttcagctgacagatgaggaggatggtcagacacaggacacatag

SEQ ID NO: 48306 - DNA, 3060 bp, Glycine max
  Peptide Sequence Number=SeqID_165084
atggtgctgttaagatgtttctcagtgacacttttgcagtggtgtttcttggcttgcttactttgcttgtcactagggcttaataataataataatcaagccctatcttgtgaccctcatgatttatcagctctgaaggagtttgctggcaaccttacaagtggctctatcatcacagcatggtccaatgacactgtctgctgcaattggcttggagttgtttgtgctaatgtgactggtgctgctggtggaacagtggctagtagagtgaccaagttgatccttcccgaaatgggtctcaatggtacaatttcaccctctttggcacagctagatcagctcaatttgctgaatctttcattcaatcatcttaagggtgttttgcctgtggagttctccaaattgaagctgttgaagtatcttgatgtgagccataacatgctgtctggacctgctgctggagctctttctggtttgcaatccattgaagtgttgaatatttctagcaatttacttactggagctctcttcccttttggggaattccctcatctccttgctctcaatgtgagtaacaattcattcactggcagattcagttcacaaatttgcagggcccccaaggatcttcacacccttgatttgtctgtaaatcattttgatggtggtcttgaaggcttggacaactgcgccacttctctccaaaggctgcatttggattccaatgcatttgctggctctcttccagattccttgtattcaatgtcagccttggaggaactcacagtctgtgccaacaatttatctggccagttaaccaagcatctaagtaagctctctaacctaaaaactttggtggtttctgggaacaggttttctggggaattcccaaatgtgtttgggaaccttttgcagctagaagaattacaagcacatgccaattcattttctggacccttgccttccaccttggctttatgctctaagcttagggtgcttgatcttagaaataattccttgtcagggccaattggtcttaatttcactggcttgtctaatcttcaaacacttgaccttgctactaatcatttcattggaccccttccaacttccctcattgagaacttatctggggcagtgtctgttctgcagcagtgcaaaaatctcaccacccttatcctctctaagaatttccatggtgaggaaatttcagaaagtgtgaccgtaggatttgagagtcttatgattttagcacttgggaattgtggtcttaaaggccatattccttcttggttattcaattgcaggaagttggcagttcttgatttgtcttggaaccatttgaatggtagtgttccttcttggattggtcagatggacagcttgttctatttggatttctcaaataattctctcacaggagaaataccaataggtctgacagagttgaagggcctcatgtgtgcaaactgtaatagagaaaatcttgctgcttttgcattcattcctctctttgttaagagaaacacaagtgtaagtggactgcaatataaccaggcctcaagtttccctccttcaattctcttgagcaataacatattgagtggaaatatatggcctgaaattggtcaattgaaagcactgcatgccttggatttaagcaggaacaacatcactggtaccattcctagcacaatttcagagatggagaacttggaatcattagatttgtcttataatgatctttctggagaaattcctccatcatttaacaacctcacattcttgtcaaagttcagtgtggcacataatcacttagatggaccaattccaactggagggcagtttttaagcttccctagttcaagtttcgagggcaaccaggggctttgtagggaaattgattctccttgcaaaattgtcaacaatacaagtcccaacaattcttctggttcttccaaaaaacgtggtagaagcaatgtccttggcattacaatcagtatagggattgggcttgcactgcttcttgcaattattctgctaaggttgtcaaagaggaatgatgataagtctatggataactttgatgaggaactcaatagcaggccacacaggtcatccgaagcacttgtttcctcaaagttggtgctttttcagaattcagattgcaaggatcttacagttgcagatttgttaaaatccacaaacaatttcaaccaggcaaatattattggttgtggtgggtttggtcttgtctacaaggcatatcttccaaatggcacaaaagcagcaatcaagagactttcaggggactgtggccagatggaacgtgaattccaagctgaagtagaagccctctcaagagctcaacacaagaaccttgtttctctgaaaggttattgtcggcatggcaatgaaagattgctaatatactcatacttggagaatggaagcttggattattggctacatgagtgtgtcgatgaaagttcagctctcaaatgggattctagactcaagattgcacaaggcgctgctcgtggattagcttacttgcataaggggtgtgaaccattcatagtgcatcgagatgttaaatctagcaacatacttttggatgacaagtttgaagctcatttggctgattttggtctctcgaggctacttcaaccatatgacactcatgtcacaacagacttggtaggaactttaggatacattcctccagaatatagtcagacactgacagcaacctttaggggtgatgtttatagttttggcgttgttcttcttgagcttcttactggtagaaggcctgtggaagtcatcaaggggaaaaactgcaggaatctgatgtcttgggtgtatcagatgaaatccgagaataaggagcaggaaatttttgatccagcaatttggcataaggatcatgagaaacagctattggaggtgcttgccattgcttgtaaatgcctaaaccaagatcctaggcagagaccttctattgaagtagttgtttcatggcttgatagtgtaagatttgctggttctcaacagtga

SEQ ID NO: 48307 - DNA, 228 bp, Glycine max
  Peptide Sequence Number=SeqID_165085
atggattctcattcatgtaattgcaagagtaggccgaatttgtctaaagtcgtggattcccagatccgttcattagtaggacaagcaaatgggcacctccaagccactgtggagagaaaaagaaagacatcggatgtcatttttttcatcaatattctaagaaattgtggacggaaagacatggtcggtcattatgaaacaaaggagaaggattatgaacttgtataa

SEQ ID NO: 48308 - DNA, 441 bp, Glycine max
  Peptide Sequence Number=SeqID_165086
atgccttcttcatctttaagggtgatgagcctcctaagtctcaccataaatcttttgcttccttcagaggaaggaaattcttcaacccctgtaaaggttccaaaagttatttctgattttggaagattaacatttggaagttcaagccaaacatctttggaagcatattttgaaagccaaaagccaacatttttcatttttcttgttgaggctgggcatgagaaagctaaagttgaacgtgagaagtttaatgttgggcatgagagtgttgacgtggcattagtgaagctaaaacaaagggataaaaagccaaatgaaggggatttcgttagttttggtttagagagctatctagggcattgtgaggggctaggaagctctcacttgttttctatggctttcctaccaactctcatcattttgtgcatcattttctcttaa

SEQ ID NO: 48309 - DNA, 210 bp, Glycine max
  Peptide Sequence Number=SeqID_165087
atgaatggctcttctttcttgggagatcccattgttccttctttcgagggcaaggatggaaattctcatcctaggtcaagattaaaaacagcttgtaacctgggcacagctgatgcccgagatcacatctttttgaatggctccgcctcctccaaggaagtgcggaaattcatcatccctcagttgcgtctgtctctgtctgaggaatga

SEQ ID NO: 48310 - DNA, 387 bp, Glycine max
  Peptide Sequence Number=SeqID_165088
atggcatatagaaaaatatccagaagcttctgcctctttctctcgagtccctctcttcttctcttcttctctaagttcttccctgaactcgcgttctccttctctgcgagttcctcaagctttctcaaggtctcgcatatcgcggaggattctgaagcagtgatgcaaagagcaataaatggccacaggttatttttcctatcttggtttactacaatgctttctaaactttctagaattgttatggctaaagcaaagaaagcaaacgcatcatcagtgctttcacaggctatgaaaaagggaaaagagctaggttttgatattgtattatgtgatacatctagcgtttacatactatacttgtttttgtatccaccaccagtttaa

SEQ ID NO: 48311 - DNA, 240 bp, Glycine max
  Peptide Sequence Number=SeqID_165089
atgaagaggaggtttggttcaggtaggttactgaatggactctaccgactgaaaggaactattgcacaacattcacaacacccaccaaagactatcgatcatgttggtgatcttgtgatatacctatatgatgggttgtctaagaatctggtgagggtttgcaagaagttgaaagggatggaaataaaaggtgctaaatttggagaggttcaagaggtagtcattattgcaaggctgtag

SEQ ID NO: 48312 - DNA, 933 bp, Glycine max
  Peptide Sequence Number=SeqID_165090
atgacgagttctcgagagcgtttggtgaaggcggtgaagcagttcgtggaggttcggtacaaggttttcagcaaccgttatggccaaaacatcatcgacatcctcgacttcccgattaaggttgtcttgtctcctttcactctcgccttcgacattgccggctctgctcctcgcggcttcggcgtccccgaactcatctccaagctctccgctacctccgtcttcgaaatggagattaaaggtcacttccttgatgctgcgtcgtttgcttatttggattctgagaatgtttttgtttttgttataaaaatgtcattttttttcttcactataccgccctcaattgcagtgaagttgttcatgcttagtgctctcgaattcgagtattgggctatagctgctctgggaacttatgacattgcatttgagctggggaggaaggtgatatgtcaaaggaattgtaactcatgtaatggatggcgggccttacgctgtacaatgtgtcgaggaagcgggagggtgcattatcaagttaagaattgcaacttgaagagtggagaaaaagcgactgctgaatctgtagcagatgccattgccaacaaccgggctgagttggtgcatataccatcgtccttggattttcagaaaccattaccttcaaaagagtgtccaacttgtgatggaacgggtgtaatgagttgtcctgaatgcaaacacagattgctacatgttaggatctcagcagatgatattatggagcccccatggcaagcttataatgtcttgaaaaagattgattatccatatgagcacatattgcacagcatgaaagatcccagtattgctgcattttggctgattacatttcctcagattatgggtggatttacctatgacgatgatgtgaagcagaaaatatggtggcagtacaag

SEQ ID NO: 48313 - DNA, 204 bp, Glycine max
  Peptide Sequence Number=SeqID_165091
atgatgcgactgcctcgcccggtgcctacattgtctgtcaaagtgggaggcggcaacacgggggaggacgaggggaatggtggcaataacaatgagagggaattgattgttttgattaaatgggaaaagattgtgaaattttcattcactgcaaaaataattcttaaggtgcttaacgaagaagatgagatggggacattttag

SEQ ID NO: 48314 - DNA, 1692 bp, Glycine max
  Peptide Sequence Number=SeqID_165092
atggcagccattggtctgaacggcgtaaaggtggggacgacgtcgtctcaggcgtaccttgaaggcaaggcagtgaaggagacgagggctttgatggctgaactgtgtcgccatttctacacccttggatgggtgacagggacaggtggcagcatctccatgaaggtccacgatgactcaattcccaagcctcagcagctcatactcatggccccttctggtgttcagaaagaaagaatggagccagaggacatgtatgtattatcacacagtgggtctgtcttgtctgctccatctcctaaaccttggccgcacaagcctcctaagtgtagtgattgtgatccacttttcaagaaggcatatgaaatgcgcgatgctgcagctgttttccacagtcatggaatagagtcttgtctcgtaacaatgatcaatcctttatcaaaggagtttcgaatcactcacatggaaatgataaaaggaatcaaggggcatggctattatgatgaacttgttgtccccataattgagaacacggcctacgagtatcagctcacagaatcttttgctaaagctattgaagactacccaaaagcaacagcagtgcttgttcgcaaccatggggtatttgtctggggagactcatggatcagtgctaaaactcagtctgagtgttaccattacctctttgatgctgctctcaaacttcatcaaatgggattggactggtcaactccgaatcatggtccaatacaaagtgcaagaaggggtctaagtattgctggggagtcaaatgtgtcagttaaagcaaggaaatctaatggtgacagtgatccattcccacgttgcgttgttcttgacattgaaggaactactactcccatatcatttgtttctgaggttctcttcccatatgcccgtgataacgttgggaggcatttatctctaacatatgatacccccgagactaaagctgatatcaagttgctttgttcccaagttcagagtgaccttgaacaagggattgcaggtgctgtgcctatccctcctgatgatgctgggaaagaggaagtcgttgctgcactcgttgccaatgtgaatgctatgattaaagctgatagaaagatcactgccttaaaagagttgcagggtcacatatggagaactggttatgagaataatgaattggagggaatagtttttgatgatgtaccagaagctctagaaaagtggcacaccttgggtataaagagttaccaaggaataggcacagagaattggcctaaagaattggcatcacagttgtctcctccgaggcaccacctatccaaagaaagtctacttgactgcattgcacaaatctttctgctcagggtatacatatattctagtggtagcagattggctcaaaggctaatatttggaaaaaccaaccatggggacctaagaaaatatttatctgggttttttgacaccacagtggggaacaaaagagaaacacgcagttatgttgaaatttctgagtcacttggtgttgataaaccatcagatattttatttgtcactgatgtatatcaagaagccacagctgcaaaggcagcaggtttggaggtgataatttctattcgacctggaaatggacccctccctgacaatcatggcttcaagacaatcaaatccttctcggagatctaa

SEQ ID NO: 48315 - DNA, 315 bp, Glycine max
  Peptide Sequence Number=SeqID_165093
atgactgagacaagtatgcaagcgaggaatgtcgatgtgtatggattcctcgagccacaatccatacaaaaatctgggcaatcacaatttgaatcagaagattatattaagaaatggatgcagaattcacaaagagatgtgtacctaggagcctacttgaatggtgcacattggcaaatgatcgttattttgcctaaggacaatgttctcagctggttttgttccttgcacaatagtcccaacaactacccgttgtatttttgctttgaagggactcaacgacagacaagtaaatccaaggctgctgctagatga

SEQ ID NO: 48316 - DNA, 1133 bp, Glycine max
  Peptide Sequence Number=SeqID_165094
gagcatacaggtggaagggaaatacttcgtctagctccaacccattttccactaagttcattgctttgcaaagcatcttggctcaaaaagatgcattgaaagccatggtaacttctaaagattggacaagctcggcttatgccaaagaagccaaggcaaaaagatttatggaacaagttttagactctaggttttggaaagcatgtgctgagattgtgaaacttactaaacctcttatgcgtgtgttacgtattgttgataatgaagataaactagtgatgagatttctttaccaagctatgtataaggctagggaggagatgttgagaaggtttcaaagaaataagaagaaagtgaagccttacttggaaatcttagatcattgttgggattcacagcttcgtggagattttcatgctatcgtttattggttaaatctgggttgttgctttaatgatcaagaatttgaaaagcatatgaacacaacaagtgcattttatgaggtccttgagaagtattctcatggaaatcttgagttgaattgtcatttgacaaagcaatacccaaaggagtattaccctaacgaccaaaccctcaccagaagagtctcctcatcctcgtcctcttccacgacgagcgtccacgtgacagccctagacggcctggtgaacgtgaactccctcttcacgatcgccgtcttcgtgggtctctccctcaccaccccgggccagcgcagcctcgagaaccgctcctcctgcgacgccgacgttgacgtagccaagaagctcctcgtcttcgaagtggtgtcgtttagcttcttcctcttctcgtcgctggtagcgcaggggctgaagctggcgctgaatctgctcaacagcaaggacgccgacgaggccttccgggcccacatcaacctcagggccctaaggcttggcatgctgggctccgccattggctccgtcatgggctgcctcttcctcgttctctccatggtcaacgtcatcgagatccgattgggaatgctgtcgtgcgggagcaaggccgccgcgcacgctgtggccgcgatggtcgtgttggtctcctccgctctcgtgctttatatttccactgctatctatgcttttactcactga

SEQ ID NO: 48317 - DNA, 627 bp, Glycine max
  Peptide Sequence Number=SeqID_165095
atggttggtaacaaggttgggcatgttggctcttctactcacaatgtggagagtaaggatgaggtacaacgtgaacatgacatccacatcggggaatggaaacaaccctcgacaatggagcatatgatggcagagatggtaaaaataaagagagaaagtgtagatgcaaggatggaaactacggagattaagaggatggctgatgaagccttccaggctcaagaggtgctacaacaacaaaacgaggagatgcatcaaagggctgatgaagctcaggcaaatgttcaaacccaggtgactaatcttagacatttggagggtgtggccaccatagagcaaccgagggacttccaacctttcacaacgtctatcatgaatacaaagatttcgatactgatcagtggtgtgactgaccagattaagtgcaaattgttcattgggacgcttactggaattgatctcgattggtttagtgaattgccaaatgactcggtcgaacacattgatgatttcacacacttgtttttgtggactgaccgagtattagaccatgacgaaaggatgactatggtaaccttttgcaaagggttgagagcggggtcgtttggtgaatcatcaagctattag

SEQ ID NO: 48318 - DNA, 280 bp, Glycine max
  Peptide Sequence Number=SeqID_165096
atggcatccaggaagagaaagaacactgcttctaaaccttcagctcagtatgataccaggcgattccaatctttggaagcttggaatagatacacggacaacattcttggccggagggacacagctagcagaccctcctacaccagtgcatgagatgccaacagacccttcgactccattactggagattccagaggaccctgccacaccagtcctgggactgactaccactcctccagccactcttgtgctacattttacagatgaggaaggcacttag

SEQ ID NO: 48319 - DNA, 177 bp, Glycine max
  Peptide Sequence Number=SeqID_165097
atggatgttgtgggcaagatatacctaaactcatctaaaagacatagtttcattctagtaattactaactatttcatgaaatgggttgaggctgggccatggttcaacatcaagttaatacattcaacaccgtgttgcaacctactcttcgatgggagggcaacgcgagactcgtgg

SEQ ID NO: 48320 - DNA, 195 bp, Glycine max
  Peptide Sequence Number=SeqID_165098
atggacaagtttaagaggagcttcactcttcctgcaagagtggcctcatcatcttcatccacttcaatggatcaacaccaccaccaccaccaccaccaccaccaaggtgtggagtataggaattcagaaggagtattacaagataaccccagtaagctcagctcatatgatttggatggtgttatggaagaatga

SEQ ID NO: 48321 - DNA, 174 bp, Glycine max
  Peptide Sequence Number=SeqID_165099
atggtgatgattgacaaaggtagtaacggtggtagtagcagtgatattggtggtggcgatgacaatggtagtaacattggttgttgtggtggtgatagtaatatcggtgacagtgacagtaaagttagtagtgacaatgacaaaagtgatattgatggtggtggtcgtttttag

SEQ ID NO: 48322 - DNA, 585 bp, Glycine max
  Peptide Sequence Number=SeqID_165100
agacaaggctctaaccgttttcttgctccagcactttcttctacttcttcatcatcattgtcaccaccactcacaatggagatcaagagtagagagaggatacaagtgtcaattgaaaaggtgaggagagacagcacagttgaagttgaagatgaagaagaggaggatgaaagtgtggttggtggtgagggtggtcttgcagaagatgagaagaagaaaggtggtggagggagtgggagaagagggtcaagtggagtttctccaccttcttgtcaggcagagatgtgtggtgctgatttgactgttgcaaagaggtaccatcgccgccataaggtgtgtgagcttcattccaaggctccttctgtgatggttgcaggactgaggcagaggttttgccagcaatgtagcagctggcagagtttgatgaagctaaaagaagctgccggagacgcttggccagacataacgagcggcgccggaaaagcaatgctgaaacttgcaatgaaggatgcagtggaagcaaagggcagcaccctacagaaagccactgcagaaatgctgatgtctggggaagaattcagatga

SEQ ID NO: 48323 - DNA, 243 bp, Glycine max
  Peptide Sequence Number=SeqID_165101
atggtcgatcgactaggccaaaggtgtaagactttgaacgagtcacataagaatgagagggatctagaggctgtacaggctaaaggcccaagtggagaaggacgaaggcccaagctaaaggcccaagtggagaaggacgaaggcctaagtggagaaggacaaagcccccgagtggagaaggatgaaggccaagaggcagagacactaccaagactactaattgttgctgaaggcccaaactaa

SEQ ID NO: 48324 - DNA, 309 bp, Glycine max
  Peptide Sequence Number=SeqID_165102
atggagatgggaactcatgagggagaaaggaagctcgtatactatgacacttcacgcggtgacacttcacttaacttctcgttggtcagaatcctccaccgatcaaaagccttcgtaggtagccctttccaagacttcaaaaatcagcttttcctgctttcaggatcaatgattgtccccataaaccaacacgagacttttcagcgtggcttgtcttcactcacacgctttctgggaaactttccagaatgtcacccatcccataattactccaagttaagcacacttaactatggagttcttatgtga

SEQ ID NO: 48325 - DNA, 840 bp, Glycine max
  Peptide Sequence Number=SeqID_165103
atgaatgcttacaaacactaccatgagactgaaatggaaaaaattcggcaatgctacgcagagaagttccctgacattgccaaagagagatttgtggacatgataaactacctgttgaaatcgatcattttcaagcacgagcgaggtgtgaaccaaaccgaatcctttcgagagaggaacagcgaagatatgatcttgatacatccatggctcagcagaagcatcaccaaggacttgatccttctagaggatcaaatacccttctttgtgcttgagaaactctacgatgatgttgtccctgattacatgaagatggaaaaacaaactgcagggtttgttgatcttgccatcaagtactttgcattctataatacccagatgttttattctattaaatacaagaagcaatttttctctggttcacaccgcagttcttccaagtcaacaaaacacttcactgatttgataaggttcgattaccttcccgttggtattgcggtcaagagtggttatgctcgtcatgttctgagaaccgccacaaagttgcgggactcaggggtgagctttgagaaaggtgatggttgggttggaaccgagttaaggcgacttgacccaacccgcgattacgtaacagggttggaaaatcctagttgccatgcagaaaacggcgcgcccaatgcgaaaaccaccatggaaggtggcgtgctacccctggcaccattggtgcaaggtctagcgacacaagaccgccatgggactggcggtgacatgacagcgacagtggcaacactaaggaagcacgatgatgcaaacaaaacaagaaagaaggaaaaaagatga

SEQ ID NO: 48326 - DNA, 234 bp, Glycine max
  Peptide Sequence Number=SeqID_165104
atggctgaggtgaggaagaagaagaacaaaacactccttttcactacaagtgctgggtgcaccagcaaaaatggaaacgacaacaacaaatggtggcaagctcctcaacgaagaagaagaagaacatcttcctgcaacctcctcttaacggcaacaacaaatggaaacgctggtgatgtgagcaacaacaatacgaaaatggctgaggtgaggaagaagaacaaaacgctatga

SEQ ID NO: 48327 - DNA, 501 bp, Glycine max
  Peptide Sequence Number=SeqID_165105
atgtctaccgaacacgcaatcagaggacttagtcctgtcctagcaactagtccctcaatggcagggacaagcctgcctaaactatggaccttcctcccgtgcatttataatactggatgtattagaggtatgcaccatattcaccaagcagaatatatgtcattcctcgtacaattggtagtggctcagttcctagggtttcctttgataggaatagttcttggaggatcaccagctataaatggagggttttatagtagagcaaatcaacaatctaccctatccgatcatcctaactccggcaacaatggtggaaacgacatggttagggagcttacctcgacggtggacggtgaggaagctccctcaatggtggacggcggcattgctcttcgcggaagcctcctcaatgcaccacgacaacctcctattcacgacaacaatggtggcaagctcctcaacgaagaagaagaagaacctcttcccgcaacctccacttaa

SEQ ID NO: 48328 - DNA, 348 bp, Glycine max
  Peptide Sequence Number=SeqID_165106
atggagcacttagagtgcaataatcgggtgttgaagactcatggagatggatcatctagacctaagaagggaaaccatcagaagaagccatacaatagaccacaacaacatcatggaggtccaattgtgtctcgtacagggaacaagggtgtcagcaatgccttcaaaggttattttgatgatgccaaagaatcaagagttaagcaaagtttcaagcaaagattcaagaatcaagtttcaagtttcaagattcaagattcaagaatcaagtttcaggaatcaagaataatcaaaatcaagattcaagactcaagattcaagaatcacgaaaagactaaatcaagataa

SEQ ID NO: 48329 - DNA, 540 bp, Glycine max
  Peptide Sequence Number=SeqID_165107
atggcttgtcctgaggacaagaaagtgtcttatgtggtgttcatgttagctactaaagcagagttttggtggcatggaacccaatcaatgatagaagctcatggggaagccttcaaggaacgatttttgggcaagtactttctagagagaaacctatttgtgcatgaggatgcaactaagtttgagtgcttggctcattattactctcaagttactactaaggcttggagatgtaagaagtttgcagagggtttaaggtttaaggtgcagaggacaatttttctgatggctatcatagagtttcttgccatggttgagaagatgaagattgtcgatgtaacaccccaatcgaatcacaccagaatgagagggatccagaggttgtacaatccatcacttaagaacttcatagttaagtatgcttggcttggagtagttgtgggatgggtgaccatctgggaagtttcccaaaaagcatggctacctatggagtgttctaaccaatggagggttctaagttctaaccaacaaggatgttga

SEQ ID NO: 48330 - DNA, 219 bp, Glycine max
  Peptide Sequence Number=SeqID_165108
atggtagatgaaatgattgactacaagtgggatcaaatagctggtcgtgtcgtttgggaacaaacctatggggagattgtgaaacttcctaggactcttcttacacctcaacctccatttaacagtgctcagattgctcgtgcttttgagataatggcaactacactgcataagaaaagtaccaccatagctccacaacatcaggcagctttggcttag

SEQ ID NO: 48331 - DNA, 375 bp, Glycine max
  Peptide Sequence Number=SeqID_165109
atgggggagaggtggaaacaatttaaatctgatttgacgtcgaaatgggcacttgcagccggcaagaatagtgtcgatgacactgtatgcgaaaagtacgacattagcaaggagaagtgggcccaattttgtcagagctgcaaagatccttcttgggaggatgtgcgaaagaaagcacagaccatccagaaaaaaaatagtgcccttcacgtgttgtctcgtgggggttatgaatgtgaatacttgtttcaagattcactaaagatcaagccttgcctcagaacaaagggtttcaaagtcatgcaaggctctggtaatcgattaccaggaagtgtaatcgattaccagaagggaagaatgaaaaagagctgttga

SEQ ID NO: 48332 - DNA, 213 bp, Glycine max
  Peptide Sequence Number=SeqID_165110
atgaccgtcattttgcctaaggaaaatgttgttatctggttttgtttattgcataattggctagacaactacctcaagggaattattaacagtgctttgaaaggacttgacaatactccacaaagtaaatccaaggctgctactaaatggattgttgttaaatgtaatggacaaaaaggaagcactgaatgtgggtattacgtcatgcactag

SEQ ID NO: 48333 - DNA, 534 bp, Glycine max
  Peptide Sequence Number=SeqID_165111
atgtaccatccagataaggcgaatgttgtagtggatgctcttagtagaaagacgattcaggtgtcagctttgatgatcaaggagttagagttggtggagaaatttagggatttgaacttatgtgttgatttatggaaaatgatagagatgttgggtacaaaaaaggttgtgaatttcaacatgggtgatgattgcatcttgagattcaaaagcagagtttgtataccgcaagctcctgagttgaaggggcttatcttagatgaaggtcacaagagaaaacttagtttgcttcaaggcacgacgaagatgtatcaagatttgaagaagatgttttggtggtttggcatgaagaaagatgttacagactatatggcggcttgcttggcttgtcaaaaagctaaggtagagaatcatagtcctggtggtttgttgcaaaccatagagatccctgagtggaagtgggaaactatcattatggactttgtcacacacacttgccaagatctactagaggttgtgatgctatatggctga

SEQ ID NO: 48334 - DNA, 333 bp, Glycine max
  Peptide Sequence Number=SeqID_165112
atggagatgagggggaagaagagtacaattctaatgctagtgagagtgatggatttcaagaacataatgacttggatcttgaagaggatgaagattctgattagtaatttaggtgataaagataagaaaattgtagaacttactatggagttagagcgccaagatcaattgtgtgctgcatatcgagaaaaactgctcagcttcataagcaatgttgaggaagaaacagaggaactgtccacaaaaattcaactcattattgaaaatgtaaggagagctgagtcagacatgaaaaaatgttcacagaacagaaagccttggtgcttaacctga

SEQ ID NO: 48335 - DNA, 537 bp, Glycine max
  Peptide Sequence Number=SeqID_165113
atgggtgatcatgtgttcttggaggttacacctacaacgggtgtaggaagggtgatcaagtctaagaagcttaccctaagttccttggacctcattagattctcaggcgtgctagcctctggctcacctgagccctcaaaagacttcagcctgaaggaaccagctcgcctgggcgagccaattacttcaggtgtaagtcttggctcgcctgggcgagctgccatggtcccaagtgcccattttcccataaatatgcgtgcttgggaggctgaggagaggttccaaggttcagaagtgaagaggattgagagaagagagaaagaagaggaaacaaggccgaggcgctaccaaatcgcgaccgcaatcattccttacttagtttcttgttttgtgttcttcatgcgaccgataaaaaagcttagaggcaagaccatcaatttggtcaatgtggtgtggagagacactatgggaagtacgatgtgggagcttaaggataagatgtgtgagcaatatccaaatctattccctgttaagtga

SEQ ID NO: 48336 - DNA, 213 bp, Glycine max
  Peptide Sequence Number=SeqID_165114
atggagcagagcagcaacgacaacactaggaacgtacggtggccggaacgcagagcagcaacggcgccggaacggacggtggccggaacgcagcaacggcgccggaacggacggtggacggaacgcagagcagcaacggcagtgctagggttttcgcaatgttttccagcgcaacaatggagccccgataaatcgagaaacaacaggttttag

SEQ ID NO: 48337 - DNA, 663 bp, Glycine max
  Peptide Sequence Number=SeqID_165115
cctctgaggaggacttgattttgatgtgggctttccttaccggtcgtcagatcgactgggctcacttggttcggtaccgaatgcataaggcattatgggccaatgcacctctcccttaccctcaattggtcactctatttctccgtcattttcaaattccgcttgatgatgaaccatttgttcaagtcaagtgttcctttgctattggtgttggtgtagtgacttcttttggataccgtaaggatcggaatggtcaatggctgaagaaagatgcacttcctcctcaagttgagcgtactccttctcctcctcctcagcgagatgattcaaccctcatgactgaagttctttccgagttacggggtcttcgtacttatgttggcgaccgttttgattctctggataatcgctttgccggcatggatatccgtctcacacagcttgaagaagatgtgggaggaactcgagagataccactagatgaggagttgactgaatttggtgacggcaacattgatgttgccaatgtgaaggaattctatgccaacctctatggccctgaggataaatcacctaagcaggtgagggtaagaggtcatttgattaagtttgatgaagacatgcttaacatatttttgaagacccctgttgttgtggaagagg

SEQ ID NO: 48338 - DNA, 351 bp, Glycine max
  Peptide Sequence Number=SeqID_165116
atggcaaatagaatttccctagttatgtcacacaaaaatttggtcaaacacctccactcaactagtactaaaaatgcaaatgctcatgtgcatactcaaggtggtgattcaattgtaggagcagcagcacaaggggcagtgaaggcaacagaggttttggagaatgtgggagaaagggctaaggagacagtgggcacagctttggatgcagcaaagaagactacaaagttggtgacagagacaacaacaaccatggttgaggctgataccaatgttgtggacacagttgagtacagatgtactgaagatttggggggccagcttggagatggccatgatagttataattga

SEQ ID NO: 48339 - DNA, 312 bp, Glycine max
  Peptide Sequence Number=SeqID_165117
atggttcatgattctcatgtggtggttgagaacaggatcatgttgaatacatttaaactaagttatattagtggattccagaattctttcatacataataagctgttactttctggaaggccatatctccagatgttaatgcagcacattacaatcgttcagaatatgccactattgcagatactcagggttacaaggattaaggatcagcatctgcccttcttaacagatgctaaacttagctacaaagcaagccaaccctctacacaatatggacaagctgagcatagcaaaattacaagggcatgctaa

SEQ ID NO: 48340 - DNA, 309 bp, Glycine max
  Peptide Sequence Number=SeqID_165118
atgtatctttctccagatctcttacttccggctctgactccatatcatccaagtctatcactagaggtgccaccttacgagcatccgctcacgtcaaacaacaaggtgctaatggtggtacgcaagactcaggcaacattgatcgagaaggcaccaaagaagtggacggtagagaagagtccaacaatgagagttccattaaagaaacaagctccacatgacgatggtaagatggtgttggctaagtccaccatgcatagaagtccaaggtatgagagcactttctgtatgtccacccatactaagtga

SEQ ID NO: 48341 - DNA, 441 bp, Glycine max
  Peptide Sequence Number=SeqID_165119
atgtgggagaagttgagaggtaaaaggctaatgtttgttggagattcactaaatagagggcaatggatatctatggtatgtttgttacaatcagtaattcctgctgataagagatcaatgtcaccaaatgcccatctcaccattttcagagcagaggagtacaatgcgactgtggaatttctctgggctcctcttcttgctgaatctaattctgatgatccagtaaatcacagactagatgaacggataattcgtcctgatacggttcttagacatgcatcactatggactcatgaagaaaatggagcttgtgaagaattggatgggcatggagccatggagttagccatgggagcctgggcagattgggtatcttctaaagtcgatccccttaagaagcgtgtcttttttgtgaccatgtcacctactcatctctggtga

SEQ ID NO: 48342 - DNA, 339 bp, Glycine max
  Peptide Sequence Number=SeqID_165120
atgttaggtgttgggtgccaaggatatctggtttttgaggaatcagtgcctccagagaattgcataatcttgctagggaatattacaaataacaaatttagttatgcttgccccctagcagccgacaagatcactcaacaacattccttctgccagctcagcatatccacagcctcaaatgtaatcacacagtcccaaactgtggaacaaaagagtatctcgaaccaacacggaggtattgacaatgattctcaaatatcgcaaaacagaatgagatacgatgagatagaatgcaatagaagcaaagacaaggaaaatcgagttatctactcttcttaa

SEQ ID NO: 48343 - DNA, 1063 bp, Glycine max
  Peptide Sequence Number=SeqID_165121
aggactacacgacctcaccatcagagggttacacactctcgcctttagagagttgcacgctgtcgccttcataaggctacacgccctttccttcagaggactacatgtcctcgccttcagaggactacacgtcctcggcttcagaggactacacgtccttgccttcagaggactacccgacctcaccttcagaggactaaacgacttcgccttcagagggcttcacgtcctctccttcagaggactacacgtccctgcctttagagggctacaagccctcgcctttagaggactacatgtcctcactttcagaggactacacgccctcaccttgagtgggctaaagaccctcaccttcagaggactacacgtcctcgtcttcagaggggctacatgccctcgccttcagaggactgcacaccctcgccttcagagggctacatgtcctcaccttcagatggctacatgtcctcgccttcagaggactgcatgtcctcaccttcagaggactacatgtcctcaccttaagagggctacacgtgctcgccttcaaaggactgcacgtcctcgccttctgagggggatatacgtcctcgccttcagagggctacacgtcctcatcttcagaggaagtctgcacgccctagccttcggagggatacacaccctcgcactcaaaggactgcacgtcctcgccttcatagggcttcacgtcctcgccttcagaggactacacgtccttacctttagaggactacatgtcctcatcttcataggactacacgtcctcaccttaagagggctacacgccctcgccttcaaagggttgcacgccctcgcctgcatagggctacacaccctcaccttcagaggactacacgtcctcgccttcagagggctacacgccctcaccttcagaggactacacgttctcaactttagaggactacacgttctcaccttcagaggactacatgtcctcacctttagaggactacatgtcctcaccttgagaggactacacgccctcaccttaagaggactacacgtcctcgccttctga

SEQ ID NO: 48344 - DNA, 372 bp, Glycine max
  Peptide Sequence Number=SeqID_165122
atggattttcaaacacatgagagaaaaaagaagattagaaaatttaaggaatcggcatggaaatgtgtttattttctatctgcagaaatttttgctttggcagcaacatatgatgagccttggtttactgatacaaggtacttttgggtggggccagggaatcagatatggccagatcaaaagattaaagaggagaggatattggaagccattgaagtatcaatagaggtttgctcccaaggttgtaggtggcgcgaatataatcccaatcctcccaagaagtatcctctggggctaggcctgcccactggaccaaaactttttgcgctggtggatcctggctatgatcccatttccaatctaaaagggtaa

SEQ ID NO: 48345 - DNA, 747 bp, Glycine max
  Peptide Sequence Number=SeqID_165123
atgactcaggctccggtgttggcctcgtcggatttctcattgccttttgtcctcaaaacatatgcctttgctattgccatgggtgccattcttcaacagagatcacatccaatcgccttttatagtaagatgttctgcccacgccttcaacatgcatctacttacattcacgagcttcatgccattacctcggcagttcgaaaatggcgccattacctcctcgggtaccccttcattatcatcacggaccacaagagcctaaaagacctcatgtctcaggttctacaaacgccggaacaacaacattacctatccaagcttctcggttttgactattcaattcaatatcggcccggttcgaggaatgtgcccgtagatgccctgtctcggctcccagtaacggacatcactcacttctccctatcagtggtgaattttgaaatccttgagcaattgcgtacttccctccaagacaaccacgactttcaggagttgtcgagtcgtattacagctgatcctgtcgaccaccctgattttgctacccgtcgcggcttaattttccacaaacgaaaaatttggcttccgccggtccatcccttcattcccctgttattggatgagttccactctacccttgtggggggtcatttgggctttgccaagactttacgccgcctccaagataacttcaccaggcccgccatgcacagtgatgtccgtcacttcgtctccacctgcctcacttga

SEQ ID NO: 48346 - DNA, 2133 bp, Glycine max
  Peptide Sequence Number=SeqID_165124
atgaccaatgacagagagcttttcaaagatttaaagccaaccaacatcaccaaagtcagaataggtaatggtgattatatttcagttaaaggaaaggggactattgcaatatcaagcggctcaagtacaaagtttattcctgatgtcctttttgtacccgaaattcaacaaaatctgttgagtgttggccaactgattgaaagaggcttcaaagttgcttttgaagacaatttttgcctgattagagatgcagctaatcaggatatatttaaaatcaaaatgaaaggaaaaagttttgctctaaatccgttggaggaagagcaagttgcttttccaatcaaagaaaatatcacagaagtttggcacaaaaggctcgggcattatcaccaccaagggctactgcaaatgaagtccaagaaaatggcagctgattttccagaactttataatcacgtaccaacatgcaaggcgtgtctatttggaaagcaaaaaaggaagccacaaactggaagcattgttgttagcagagatgtccacttcgtagaagatgaagagtggaattgggatgaggtaaagaagaaggatcaaactgtggcagacctacagcttaactctcttgcttcaagaaccgaagaagaagaggattggcagagtgaattggtagacgatgcccctgcaagaggaactagatcactctctgatatttatgagaggtgcaatattgccgtttatgaacctgtagattttggagcagcaaagaaagatcaaaattggatggctgcaatgaaggaggaattgtctatgattgagaaaaatagaacatgggaattggttgatcgaccccaagataggaaggtgattggagtcaaatgggtatacaaaaccaagctaaatgctgatggttctatcaacaaacacaaggcaagacttgttgtgaaaggctatgctcaaatctttggcgtggattactcagacaccttcgcaccagttgctcgtttggacaccataaggattttgcttgttgtagctgctcaaatgaattggaaagtgtatcaacttgatgtaaaatcagcatttttaaatggtgttttacatgaagaaatttacgttgaacagcctgaaggttttgtgaaaaatgaagaaaaggacaaggtgtatcttctcaaaaaggctctttatgggctgaagcaagctccacaagcttggtacaacaagatagatgaccatttgctgagcatcagttttaaaaaaagcttgtctgaagccactctttatgttaaacatcagagcaatgaagttccgatgatttcactttatgtcgatgatcttttggtgacaggaaataatccagggatgattcaggaattcaaacaagaaatgatgaaggtttttgagatgacagatctcgggttaatgaccttctttcttggattggaaattaagcaggctgagtatgaagtcttcatctgccagaagaagtatgtcaaggaaattttgaagaagtttaagtttcaggaatgcaagaaagtaagcactcctatgaatcaaaaggaaaagctgtgtaaggaagatggagctgataaagctgatgagggatatttcagaagtttgattggttgcttgatgtatcttactgcaacatgtcctgatattttaaatgatgtaagcattttgtccaggtttatgcacaatgcaagcgaattacatctcagagctgctaagagaataattcgatatgtcaaaggcacaagtgattttggtgttaagttcacatggagcaaagaatttaagctggtgggtttctctgacagtgactggggaggttccattgatgatatgagaagtacatcaggctactattttactcttggatctagtgttttctcatggagctcgaagaagcaagagaccgtggctcaatccactgttgaagcagaatttattgctgcaacagctgctgtcaatcaagctttgtggctgaggaagattttaatggatctaaatctggagcagaaagaaagcaccaagatttttattgataatcaagctgcgatttctatctcccatattcctgtgtttcatggaaaaaccaagcatttcaacataaagttgtttttcttaagagaagtgtag

SEQ ID NO: 48347 - DNA, 306 bp, Glycine max
  Peptide Sequence Number=SeqID_165125
atgtattacaacgggaagtggaacataccacgtcaaggtgagtttttgggttactcctttactgaaactaatccaataagatttgacattcattcgggatgtgacatggagaaactcaaggatttaatcaaacgattgttctttcgacaaccaggtcattctaagtattccgaaaatttgattgaatatgacataacagaattgaaaaatgatgaagacgtgctaaaggtgttagcacaattcaactattggaaacgattatgcacaacagaaattttggctatttttagcaaatcagtaatctaa

SEQ ID NO: 48348 - DNA, 300 bp, Glycine max
  Peptide Sequence Number=SeqID_165126
atgccggccagggcgttgagaatcaactggggtgtgtcaggcaagggggtagaagcgatgaccaacaactcatttgtcatcgcactgataatagaggccacaatctctgcgaggacgagaaacgggtggtgcgacggcgatcatggagcttatcctcctgaagcccgaaatgaaatagctcaaaaggaggggatgcgcgagcctgatggtacggttggccaagcgctcaaagtcagagaggtaatcattgacggaacctctctgctggagcttgaacaaggcgccatgtggatcatcgta

SEQ ID NO: 48349 - DNA, 201 bp, Glycine max
  Peptide Sequence Number=SeqID_165127
atggcggcactctcgtatgctagaaggtttgccctaacactcccttcaagatccaaggaattagggcccatcgttactgattacacctcccggacgatgtccttcacattgttgggttcaccagtccaactcacgacagatgtttccctctttcctgcatcggcctccattcaccaagttcaccggctggtccacacatag

SEQ ID NO: 48350 - DNA, 654 bp, Glycine max
  Peptide Sequence Number=SeqID_165128
atgcaatggtactcgaagaactgggtgattttgaaaatccaccccagtgggtcttggccgtcaaatctgggaatgtctagcttcatgtgtggtcggggtaaaggggatgaaggtggcgaagatttaggtgaagtgggagggggcgtgattttgggaaagggattgctggctttgagtgagacggagcacggcctcctcgagtctcttgacggtggcctgcctggtgttatgttcaggcattctaggagagacagggcaggtcggaccaaagatgatagggaaaaggaactacactacaaggctacactaaagtttgttcgtgttggatctgtagttttagctcttcatgatgctagtgatgtgtttatcgagacagggaaaatgtccaaatacagtggtgctgaaacaacagctagcattgcatttattctttttgttttgtgttttaccgtgacgcggatcatttactacccattctggattcttaggagtacgagctatgaagttgttcacgccttgaaaatggacctggtggatggatgcttgttaaacaaatccaagaaaaaggaaaagttagtgaagatatacgatctgattcagaagatgaacatgaacataaacatgaagaatgaacagaaaaacgtacaagactga

SEQ ID NO: 48351 - DNA, 177 bp, Glycine max
  Peptide Sequence Number=SeqID_165129
atggaggtgggggttcaaagagagatatcgagggagttaggagatggaaggggggtggtggagttgggggattggcaagggaatgaatggggatgggatttaagttggagaaggaggtttcaatgggaaaatattaatatgaagtgttttactgtcaaaaaacacatggagtggtag

SEQ ID NO: 48352 - DNA, 618 bp, Glycine max
  Peptide Sequence Number=SeqID_165130
atggatccttcctttccttcaaaatcctttctgcatgttgttcttatcttttgctttcttggtgccaccagattgtatgcgaatgacccttatctaacactggattactatgcatcaacttgccccgctgtgtttgacattgttaggaaggaaatggaatgtgcagtgctttctgatccccgcaatgcagccatgataattcggctacacttccatgattgctttgttcagggatgcgacggatcaattttgcttgatgatacaatcacacttaaaggtgagaaaaacgcagctaccaacatccactctttaaaaggcttgggaattgttgataaaatcaagaacatagttgaatcagagtgccctggaattgtttcttgcgctgatattctcactattgcagccagagatgctgtgattctggtgggtggaccttactgggatgttcctgtgggaaggaaggattctgtcactgcaaattttgatcttgccaacaccaatcttcccactcctgatgagagccttctctctatcattgccaagtttctttaccaaggactatctgtcacagatatggtagcccttgtaggtgtgttagtgttcctaataatgcaataa

SEQ ID NO: 48353 - DNA, 276 bp, Glycine max
  Peptide Sequence Number=SeqID_165131
atgaccctgatacaagcccttgatgaaccatcgattatctacgtcgggagccatcataaaagagaggaggttgtagtagaagatgaagctccatgtgttgaggctgagcctcatgaccatgtgcttgatgtagactatctcgatggtgatggtgatgaggatattggtgttggtgaagatagtgaggtagaagacgagtgtgatggtgaagaagttttggcggtggggaggatgaaggagtcgtggtggagaaaccctaatttttccagcctttag

SEQ ID NO: 48354 - DNA, 480 bp, Glycine max
  Peptide Sequence Number=SeqID_165132
atgatcgacaacattacttccaccactaaaaagcttattgggatatatgaagataatgacaatgtaaggcaggacgagattgttgcactcagaggccaaattgccactgaaattaaagtgtttagcgccttttatgataaactcaaagagggaacttttgggattgtgctatggcgtgtaattttggttgttgtcaagacacttggggaggaattgttcactgatgataataaaaagtgggttcacaaggtacaagtggaagtgcataattgtcagataggacttgatttattatttaaacaaccatctcaatctgatgtagctccatgtggagcttgtaggacttggatcttcttcactgtggaagcaatgacttccaagattattttgatgatgccaaagaatcaagagttaagcaagtttcaaagaattaggcttcaagaatcaagtctcaaagaatcaagattcaagaacaattaa

SEQ ID NO: 48355 - DNA, 273 bp, Glycine max
  Peptide Sequence Number=SeqID_165133
atggtgaagaaaccgaatggcaagcggaggatatgcacaagctacattaacctaaaccaagcatgccctaaagacgcttatccatttagaaacatcaaccgattggttgatggagcatccaaacacaaactattaagtttcctcgatgcatattcggggggtaagggattgtctgagcttgacatgtcctggagaattgcatttataattactacctttttgacttctctcattctagaatatagcatgggataccatgatgatattctttaa

SEQ ID NO: 48356 - DNA, 300 bp, Glycine max
  Peptide Sequence Number=SeqID_165134
atgataaatgatggaacatacaaatttggggatcccacggtcatgtggctctgcatgccaccagacccttgggtcatgcatttcgtttctaaacgaccatttagaggaaacactgggtccaacaaagataggagaaaatcactcaaagtgtatcaatctcacacagtgcgtggcgagaaagtcactagcactctggattttgtcggcaatcaaagggagaggaccactttaggtcgtggtttcctttttcttgtttacttggtgacaattctgtactgttcagatattgtctggccatag

SEQ ID NO: 48357 - DNA, 416 bp, Glycine max
  Peptide Sequence Number=SeqID_165135
tcggagatacccaagtggttatccgtacaaacgattcctgttaatcctgacctgagaagtcaggtggcagtcggggaggcaagcgagcccgttgacacgcagagactaacatcatcttttgcaccttttgtcatccagagacggcgagtccgatgtcatgcggagatacccaagcggttatccgtacaaacgatttttgttaatcctgacccgggaagtcaggttatccgcaccttttgtcaaccagaggcaagcgagcccattgacgcgcagagactaacgtcgtcttctgcaccttttctcaaccagaggcaagcgagcccagacagcaagtccgatgacatgctgggaataccttatggttatccgcacctttcgtcaaccaagacgaatgaggtcgatggtatcgggataat

SEQ ID NO: 48358 - DNA, 739 bp, Glycine max
  Peptide Sequence Number=SeqID_165136
gctgcacgtcctcgcctttagaggactacacgtgctcgacttcagagggctacatgttctcgcctttagagggctacacgccctcaccttcaagggactgcatgtcctcgcctttaaagggcttcacgtccacgccttcagagggcttcacgtcctcgccttcagagggctacgcatcctcggctttggaggacttcacatcctcgcattcagagggctacacgtcctcgcctttagagggctacacgtcctcgacttcataggactaggcgtcctcaactttagagggctacacatcctcgccttaagagggttgcacgtcctcaccttcagagggctacatgcccttgccttcagaggaccgcatgtcctcatcttcagaggactacacgccctcaccttcagaggactgcacatcctcgccttcagagggcttcacgtccttgcctttagagggctgcactccctcgccttcagagggcttcacatccttgcctttggagggctacacgtcctcgacttcagaggactgcacgtcttcgccttcataaggctccaggtaagtatcctcgcctcatctcccccctgccgaagtgtcagcagggattgtgcccacaagacacttagtggacccagagaagtccaaaagggccctggggtttctagctctgattacgggcctctgccagttctatggagtgcccatcacccccaacaaggtcatcaggccccctactaa

SEQ ID NO: 48359 - DNA, 234 bp, Glycine max
  Peptide Sequence Number=SeqID_165137
atgtatcttgatgagaatttgcatttaattggcttaggcatggaccaagttgcaaaagcttgtaaagtgaggaaagagacattgaagaaggtatacagagatcttcattcccttgctttggttcagattccaagctggtatgccaatgctgaggacataaagcgactctgcattgttgaagctcatcttccgatcgagtcatcgtcgttacaacttccacggtgggatgcatga

SEQ ID NO: 48360 - DNA, 234 bp, Glycine max
  Peptide Sequence Number=SeqID_165138
atggtgcttggggatacaatctgctccaaatgtggcttggttctcgagtcccgttccatagaagaagaagcaccaaaacggagactctataatgatgacgatgacgacgatgatgatgaaaatatagggatttttgtatggacttcttacccttgcatatgcaaagaggctatttccggattcgaactcatgaccaacaagtcaccaaggcacaactttaccgctgcaccataa

SEQ ID NO: 48361 - DNA, 117 bp, Glycine max
  Peptide Sequence Number=SeqID_165139
atggaggaagggacaacaatggcagagggtgtggttcgtcaaagggaaggtcctattttcttggtctttgggtctctctccattggcctcatcctcgtactaaatgcattggtttag

SEQ ID NO: 48362 - DNA, 373 bp, Glycine max
  Peptide Sequence Number=SeqID_165140
ctcgatctctcctccaacaacctctcaggcgctcccccccgtcgtgttcaacacttgcacttctcttcagtccttcgacatctccagcaacctttttgtcgatgtgttgcctatggacattctcacgcaaatgaaaagcctcaatgagctcgcgatggcacttaattggcaccctcttgttcccaagtttcctaccccacgtgttgaggaggaggagttggagttgggatcgagcacggcgaggcgctcacagaggcatgaagggcataagccggtgaagttctcctgcggctacggcggtggctgcaacatggtgggggttggagaagctgcggcggcgacagaaacggcagtcccagagaaagtgaagtga

SEQ ID NO: 48363 - DNA, 246 bp, Glycine max
  Peptide Sequence Number=SeqID_165141
atgaggaaaggtggttcagcgggtggtgtgggttgcggtagtcgaagctgcatcccttatatagaggcactagctaaggttgctgctacgaaaacaaaaggtgctagaatgccaaaagaaaataacagaaaagtggaaaatggcaacaatgcagtgttgcacgatgggaagcaacatgccaacaacatattccctatgaaccagtatcctcctgacagttcaacaccttctaacaaattctgttaa

SEQ ID NO: 48364 - DNA, 333 bp, Glycine max
  Peptide Sequence Number=SeqID_165142
atgtatgctaagacaagctacttgactagacaagagttgattgtggatatttgcctggccactagagtccacagtggaggactgattgacgtgcaggaactctgtcatctcctttgtcagagacgaaaaagtgatcgtgaagttgtttctgagattgattgcctgcgtgctattaagaagctgaaggtgttaacattctttgcaggagttctactagagaaacagatagttgttgtctgttctaatttgatgtgcattgaaagtatacttgggggatctcatgttgaggacgtcctcgcaacctatatgtcacgttgtagtcctaatcgctaa

SEQ ID NO: 48365 - DNA, 306 bp, Glycine max
  Peptide Sequence Number=SeqID_165143
atgacgaacgaagaacaccaaacgaagaacgatgtagaagtcgattacggtcgcaattcagtagcaccttggcctcgttttctcttctttcttcttctcctatctaatttctccattgagggggtttgggactttggcagctcgcccaggcgagctggttacttcacccctaagctatttgggggcctaggcgagccagggtgtagaaaaaaagctaaaaaggatccttttgccctcccctttgggtattttttgcattcttcaccaaaatgtcgaatgatctttctcatcttacgcggtaattga

SEQ ID NO: 48366 - DNA, 714 bp, Glycine max
  Peptide Sequence Number=SeqID_165144
ggtcttgtcacgacagaaaggagcaatctagatccagctgcagttacatttgccaaaaatccaagagatcttgaaaggctttcaaagggtgctagtataattgaagtagttaagaaggttaagccacatgtgctccttggattgtcaggagttggtggtgttttcaacgcagaggtcttcatgctatctacttcaaatgtggttgctatggtcacaaaagagccaatgtgtgttcagaataccaaggaagtagaaaatgttgtgcccaatggtgtcaatgaagaatctatcgcaccagagaatgaaaagatgggagaccagtcagggtcacgatgttttgcgagaatgctccaaccatatgcgatcagcataggcataaaggagcactcaaacccggtgacccccaaggcctacactccgaagagtccgtcagggcctctcccccctgattcagcgattcctttttctctctacatgactattatctcgcaaatcacaacggtgaagaccgttctgggtttctacgtgaaagaaaaaggctacgatgcgaaaggtatttctctcagctcaaacatgatatcaaaattaccaacggaagaagtggttcctcatcaattggtaccaaaagagaatgaggttagtactgatatggatatggagatagaaaatgatgatgtttatcatgaaatgcaacctgttttaggtggagtttag

SEQ ID NO: 48367 - DNA, 267 bp, Glycine max
  Peptide Sequence Number=SeqID_165145
atgctgcaaatgcatataaacaaactgaatcaccaaggtgtgcatatatcaagcattggacgcagtcagcgtcagatcatgcatcaattggacaatctcaataatcttctcagggggagcttgggggagaagtctcacccaacaagaaccaacagcaggaaaagcattgacatgtcatcggattccgtgggagctcgtgttatggtggtggcggcagttggttgtttggggatcttcttgatgaaggttttgttgaacaaaaagtga

SEQ ID NO: 48368 - DNA, 516 bp, Glycine max
  Peptide Sequence Number=SeqID_165146
atgacagatattgagatttcattggagaatttctctctaataccttctgtaaaggaggttgactctcaaattaaggaaaaaaataagggacatgacgagataaggagagaaagggataatgttaaaagccctaatgtgaatagtgagacaaaggaaggaaagaaggagtcagtgcagaggctagagatagaggatgcatccaccactaatcccccaaagcacaaacaagatcgacggggattgaggcccaaccagtctcgctggcacaatgagggccctaagttggaattgtcgtggggttggttacccacaaatagttggagctatttgaaagcttattacccaccaaattcccaatttggtgtttctcatggagacaaagaagaaagtggggacaatggaaaggctagggcagtcaaacatgtgtacaaatctcaaggtgcccaggcggttctaacatgtttctacatgttccctaaacaagccaaaaagcccttatcctgggatatgctttag

SEQ ID NO: 48369 - DNA, 321 bp, Glycine max
  Peptide Sequence Number=SeqID_165147
atgaacggatggtttgataggagattgaagtggaaaattggggaaggtgatcaagctatattttggcttgataattgggtgggggaggaaagtttagcgtctaagatccctaggttatatagtttgtctaaacaacaaaatgagtgtacaaaaaacatgggacattggagggaaggaggttgggtgtggaagtttgaatggacgatggaaatgtttgagtgggaaaaaaggagtggtggaagtatggaaagcttgctattggtggttgggtataaaatcggtcttaccaaattcactggaagcacatataagccaacatga

SEQ ID NO: 48370 - DNA, 258 bp, Glycine max
  Peptide Sequence Number=SeqID_165148
atgaaggttcaatccagaaatcaagtggatagggaaagaggcactcacaagtctataggccttagacaaagaaaaacagcaacaccagagaacaagctcaagaggttgctcaagaagttggcattaacagatccacttaaactgttacaagaatacaataagggattagacgaaacatacctacgtgaggtggcgaaggagaagaagcatagacttgtgacgatgctcgagtacgacgaacatgatgctcgaccttag

SEQ ID NO: 48371 - DNA, 210 bp, Glycine max
  Peptide Sequence Number=SeqID_165149
atgactgcttatgctggtttctttgaattaggctctcccaagaaaggagagaatgtttttgtttcagctgcctctggtgcagttggtcaacttgttggtcaatttgctaaattggctggttgttatgtggttggaagtgctggaagcaaagagaagtccaaagcttgcccctctgcttttacccccataataaacttgagcctttattaa

SEQ ID NO: 48372 - DNA, 303 bp, Glycine max
  Peptide Sequence Number=SeqID_165150
atggagatggaagcaatggagataggcaaacacaagatgtaccagttcttaaggattgttcgattttcattccttgcagttttattttgtattcaaattgcatcactagaagaagataagaatgcttttggaatgacacactcaaaagagctggcaacattgcttaaagcagagaagatttcatgtgtggagataagcaaacacaggatgtaccggttcttaaggattgttcgatttgcattccttgcaggtagttttggacgcttatcgaagccaatgggtatggaaaatctaccatcttga

SEQ ID NO: 48373 - DNA, 1011 bp, Glycine max
  Peptide Sequence Number=SeqID_165151
atgggggcggatctgaccacccgtttgcaccaatcgccgagcggcccgcagatcgtcgccgggctggaggccaccggctcgggcatcagccggttaaacggcgtggcgccgcgctacccgatcttcaactgggacgatctgccggtgaaagaggggctgcacaatcggcatatggttgggctgaccgcctggcacaccttcttccagaccacccatttgacgctgcacgaaaagcgcgtgctggtgatcggctacggcctggtcgggcaggggacagcggcggcggccagggcttacggcggccaggtgatggtggcggaaatcgatccggcgcgcgcgctgcaggcgcgttatgacggctggcaggtggtggatctggcgagcgccgtcgcgcaggcggacgtgatcgctaccgcaaccggcgcgaaaaacgtgctctcggcgcagcttttgcaacaggcgcaagacggcgtgtttatcctcaacgtcggccacgtggcagaagagatcgacgtcggcttcctgcaaggcctgccgcaccacgagccgatgccttatgtgaacgcttaccaacttaatgagaagacggtgtatttgctggccaacggctcgatgtttaacctgaccgccggctatggcgacagccttaacgccttcgatgtgacgctggcggtgatggcggccggcatcggccatatcgtcggcgccgtcggcctggcagccggcgctgtaactttttccacgcgggcgttcatcccagagcgcccgcgggctgcgtcgtttttcagcggacagaatttgtcacaaatccgccatacaatcccagcgggcgcaggctttgcgccgcgcgcgttggccagcgacaacgccgccgccctgcacgccacccaaccggagctggcctccggcagcgcgatggtcgtcgatatgcaaacccataaggtgatgtatgcgcgcaacccggatgaagtggtgtcgatcgcctcgatcaccaagctgatgaccgccatg

SEQ ID NO: 48374 - DNA, 282 bp, Glycine max
  Peptide Sequence Number=SeqID_165152
atgggctcgaaatctaccctaaggctcatgagaaccctagggccatcccttggatctctagccaatctacttggtgtcttctacccaatgcccttgcgggctaggattgcatcaaatgtacccttcagcgggagagcgaggcgagatagaaatgtgcttcttccaaaaaggagaatgcccgggagtcaccaccaacgtttattcgagaaaaacgttagaaaaaccaaaaagagggttgacaaggctgttgtccttgctcctatgtatcctcaggtgcgatga

SEQ ID NO: 48375 - DNA, 192 bp, Glycine max
  Peptide Sequence Number=SeqID_165153
atggagaagagcaaagttgatacattgatagcaatttctccaaacacatggcatgcatcaaagcttattcatatttctccccaagatagtgaatatgtgatctatggagacaacaagcaaaggccacttgatcaacatgcccaacaagtgatatcaaatgataccaacagattgtccttgatgattgattga

SEQ ID NO: 48376 - DNA, 324 bp, Glycine max
  Peptide Sequence Number=SeqID_165154
atgtgcttcgatttacttagaatccaatccttcacgttagtttcaaaagataaagaaaaagttcttaagccattcgtgacttctgtacaacatttcattagccaaattgatagatctggtgcagtggttgtttggacgagcacatctgaagaagtggaggttggtggtggcctatattggtggttttgggagcagatttgggggaggggaggctggtggtggtttgggcaattggatctagtgaaagggaggccactggtgtgcggtggtgtggtttgggtgaggggatctaatgaaagggagattggtggcaaacagatctag

SEQ ID NO: 48377 - DNA, 495 bp, Glycine max
  Peptide Sequence Number=SeqID_165155
atggtcactagagcaaagaatgggatagatcaaccaagaattcatcctactttgcttcttgctcgtgctgaacctaaatatgtcaaacaagcactgcagggtcctaaatgggttactaccatgaccgatgaattcaatgctcttcaaataagttatacttgtactctagttcccttacctcagaatagaattgcaattaggtacaagtcattcgtatgcaagttaaataaggctatctatggtctaaaacaagctcctagagcttggtttgaatggctgaaaacaactctgttacagcttggcttttctgacagcaagtgcaacccttccttgttcacatacaaaactaaaactgccacagtttatatcctgctgtatgctgattttatcatcatcgctggatgcttccttctacagtccattgttggtgccttacaatatgttacttaccctgagcagctgatgctctcctttaataaacatggaagtaattga

SEQ ID NO: 48378 - DNA, 363 bp, Glycine max
  Peptide Sequence Number=SeqID_165156
atgtggttcgatttacttagaatccaatccttcacgttagtttcaaaaaataaagaaaaagttcttaagccattcgtgacttctgtacaacatttcattagccaaattgatagaaacggagcttcaaaatccttttccagcaatgatcaaatagatctggtgcagtggttgtttgggcgagcacatctgaagaagtggaggttggtggtggcctattggtggttttgggagcagatttgggggaggggaggctggtggtggtttgggcaattggatctagtgaaagggaggccactggtgtgcggtggtgtggtttgggtgaggggatctaatgaaagggagattggtggcaaacagatctag

SEQ ID NO: 48379 - DNA, 360 bp, Glycine max
  Peptide Sequence Number=SeqID_165157
atggcggaaccatcgaagaagcgaaagggcacttcgagtcacagtcaacggcattccgggtcacaggaaatgccaattccttcctccattccctctggatcattgttttcattagaggaacaaagtatacagtgcttggcacccatcattaggcaatttgtgaaattccgtgacgtgccggaaatcaaaaggaaacatcgttgcacaatagtgaggttccgtaacattccgggtgcaaatagcaaccaggcccacttgggccctccagaagattcctccagaaggctgttgcttctggaggaagcaaccttgctcgcctgggcgagctgggtggcaagcttgtcccccaattttctataa

SEQ ID NO: 48380 - DNA, 294 bp, Glycine max
  Peptide Sequence Number=SeqID_165158
atgaggagaagaaacgagttttggatccaagggaggagctttcctccactccaagagcaagcccattaccacaacatcaccaaaatcccaaaaacgatcacaaacaaaatcaaaaacccaaaaataaatgttttttatgagcttccatggatgctctatgagaaaacaaaaatggaatccaaagaaggaaaaagtggtgcttaccactctatggctcaaccaaacaacatcaaagggagaggaaaaagtccccctttgatcaccaacaccaaatctcaagcttttagaatttag

SEQ ID NO: 48381 - DNA, 392 bp, Glycine max
  Peptide Sequence Number=SeqID_165159
catctagctctagtttaagtaaacctgctagcaatgtggatttcgaaaaggctgttgagaattttaagaggttggcttttgaaggaagctttgaatttgctttatctaaagctgattataaagctgaatcaagaaagcactatctccatgtttgtctgaaaattgtgctgtcaaccccccgtcaagtgcttgcctgcatctccgtcacaccaccgtgtcctccgttgaaggaagagttgtcgcaccctacaactgctcttcaaggtaagcttgtggatgtttttattttcagagtttgtgtcaacatcctcccatggcaagaacctgctcgtctaggggtatgcaccatagaattggctgttgagagttctgaaccctccaccgatgactag

SEQ ID NO: 48382 - DNA, 438 bp, Glycine max
  Peptide Sequence Number=SeqID_165160
atggcacgaatagtacttttgcatgctttggtgctctttttattcacatttacatcagccatagctgaagcggtaactttgaatgttgtcaattttggggccaaaccagatggtgaaactgactccacaaatgcattcgtgagtgcatggggtagagcatgcagctcaacagcaccaactaccatttatgtgccactaggaaggttcttagttggtaaagtagtgtttaaggggaggtgcaataataagggcatcacaatacgtattgatggtgcaatgcttgcaccttccaactatgatgttattggaaatggtggaaactggttgttttttgatgatgttgatggagtttcaatcattggtggtgttcttgatggacaaggcacaggcttgtgggcatgtaagagatctggcaagacttgtccaactggtgctacg

SEQ ID NO: 48383 - DNA, 300 bp, Glycine max
  Peptide Sequence Number=SeqID_165161
atgtcgctgattgtgcaggacttgccaacgacaacgatgaggatgattactccaactcatgttcatcatcgacattggcaccctcctccatgtttgatttgccacattccaagactcactggccacgtcgggtgcaccgtcgcgtgcggagaggtaggacttctaccacagtgcaacaaaactccgatcttaatttgcagaacttcaataggggtgcagcggaactcaaatcttgaacgttgccgtggtgaccacgaccatgaatgtgtcgacgccgaacaacaaagtggtggaacttga

SEQ ID NO: 48384 - DNA, 276 bp, Glycine max
  Peptide Sequence Number=SeqID_165162
atggataagatcatcgttggagaagtgttggccagtgaccggtctgggcgagtaacggtggagaaggtggcattcgatggagggaggaggagtagtttgcttgagattgtggaggtttttggaagtgacaaaaaagagaaatccaccattgtcgtagttcctaacaccactattgtgatcactacaaccaacatgttgtcaccaccaccaaaacctccaccaatgccacatcaccacaaccaacttcatgaaaactatgacagagtttttgtgtaa

SEQ ID NO: 48385 - DNA, 1813 bp, Glycine max
  Peptide Sequence Number=SeqID_165163
tcacctgccattagctaataaaccagctttacaggttacttcaagctctgtgagactggtcagctccaaccctagagagcttcggaatgaatggcatgcaccatcaggctattcagtaaatgtagctacggcaaacgctacccaggttttgttggccacaggaggagggcatttggtttaccttgaaattggagatggcatattacaggaagtaaagcatgcccagctagagtatgagatttcatgcctggacataaatcccattggtgaaaaccccaatcacagtaatctagcagcagttggaatgtggacagacataagtgttagaattttttctcttcctgatctgagtctcatcacaaaggaacaattaggaggggagatcatacctcgttctgttcttctttgtgcctttgaagggacatcgtacttgctatgtgccctcggtgatggccatctcttaaactttatgttgaatattagtaccggtgaattaacagataggaaaaaggtatctctagggacacaacctataacactgcggactttctcctccaaaaatactactcatgtatttgctgcatctgatcggccaactgtaatttatagtagtaacaaaaaattactttatagtaatgtgaatctgaaggaagtgagtcacatgtgtcctttcaattctgctgcttttccagacagtttggcaattgcaaaagaaggtgagcttactattggcactattgatgatatacaaaaacttcatattcgctctattccgctgggggagcacgcacgacgtatctgccaccaggagcaatctaggacttttgctatttgtagtctgaaatacaacccagctagtggtgaagactcagaaatgcactttgtccgcttgctggatgaccagacttttgactgctccttctcagatgacaataatgtgtattactgtgttggaactgcatatgtactgccagaggaaaatgaaccaaccaaaggaagaattcttgtttttgctgttgaagatggaaaactacaactaattgccgagaaagagacaaaaggagctgtttattgcttgatggcatttaatggtaaattgcttgctgctattaatcaaaaaattcatctgtataagtgggtgctatgggatgatggtactcatgaattgcagtctgaatgtggacatcatggacacatcctagcactttatgtgcaaactagaggagattttattgtagttggtgatcggatgaagtcaatttccttgttaatctacaagcatgaagaaggtgctattgaggaaagagctcgtgactacaatgcaaattggatgtcagccgttgaaatcgttgatgatgacatatacctaggtgctactgatgaagagcgaggtcgtcttgaagtggttggtgagtatcacctaggagaatttgtcaatcggttccggcatggctcccttgttatgcgcttgccagattctgatgtgggccagattccaactgttatctatggcaccattaatggtgttattggggtaattgcgtctcttccacatgagcaatatgttttcttggagaaacttcagtcaaatttgaggaaggtaattaaaggcgttggagggctcagccatgagcaatggagatcatttaacaatgagaagaaaactgttgaagccagaaactttttagatggagatttgatcgaatcatttctcgatcttaaccgcagtaagatggatgaaatttccaaggcagtggacgtttcagtagaggagttatgcaagagagtagaagagttgacaaggttgcactga

SEQ ID NO: 48386 - DNA, 249 bp, Glycine max
  Peptide Sequence Number=SeqID_165164
atggcttctaagacccctatccctcttaaagccatcaacacaaagctaccatctttgaaagcaaagaaggatcgccacactaagggtgaaccctccattatcgccgccaccagcaccgggtatcaccttcttgcttcttccatggttgtatctgcatcaacaccaacaccatcattgtctgaggaccaaaacattgttgatatgcatgcaaattcaatggttgcacctacaaacattgagattgagtaa

SEQ ID NO: 48387 - DNA, 1491 bp, Glycine max
  Peptide Sequence Number=SeqID_165165
atgactatatggaactacgtcgtcacagctcacaaacccaccaacgtcacccactcctgcgtcggcaatttcaccagtcctcgagacctctatctcatcatcgcgtatctactcattctctttccttttcctagggttcctttcttctctttcattttcgtctccacttatttaccctttcacttcgtttttcttccaggaaatgcacgcgcatctagattcacctgctttctccccaaggcttgcagtatgtttcattggctttttggtattgcaagaaattttggttttgttcgtggttatcaacaaggatacatttaccagcagaagtttagtcttgtgaacataaagttgaaatgggtgaaagataggacattggatgctgttgttactggtcagagggatcttaaggcagttgggattcttgtctccatcatttattcttcttctgaatgctgccttccaatttatcatctttctcgccaccgtggacaacttggtcttcccagtgacctcaaactttccacctttataagaagatatcccaacatatttaatgagtcctcttttcttgatagtggaggctctcctgttccgtgtttcagtttgagtcctgaagccttggagctccatcatgaggaagtcaacatccttcagcaaaatcagttggaactcagggataggctgtgcaaactgcttatgctcacaagtgataggatccttccactacaaaccattgaccagttaaaatgggacttgggtttaccatacgattaccagcattcttttgttccaaatcatcctgaaagtttcttatatgttcgccttcctgatgatcgtattggcctgaaattgttattttgggatgacaagcttgccatccctgagttacagaagaatacttctctacaacaaaaggcagaagacataaaaaatggatccttagaatttccaattagtttcaccaggggttttggtttgaaaagaaaatgcatggagtggttgaaagagtggcagaaactcccttatacttcaccttacatcaatgcctctcatttggatccccgtactgatgtatctgagaaaaggatagttggagtcttccatgagctccttcatctcacactccataagcaaaccgagcgcaagaacgttagcaacttgcgtagacccttggccttacctcagaagtttactaaagtatttgagcgtcatcctggtattttttatatttccaagaggagtgatacccaaacagttgttcttagggaggcctataatggtcaggaacctgtgcagaatcatgcccttgtacaaattagagaggaatttgcaagcctgttgaagaaagggctattggataggagtaagggtgtatacaaaaaaagcagacacactaatttggtggagggtttgagaaaggaggtttgcattgctaaaaaaactaaccagcttagttctgaggatgaatcagattccatgtttttctga

SEQ ID NO: 48388 - DNA, 571 bp, Glycine max
  Peptide Sequence Number=SeqID_165166
atgaatcttcctaaccaaacaaggaaggttccttttgttatagttgttgtattaataaacttcattgtgggacccaggctaattttttgtcagaagagtagtggtggtggtggcggccttgagataatcgctcaagaagtataccgtagcatgtccaattatacatctgtgttcaagagtgcaataaaaaaagaattgggttattgcatagttgatgtggatgctgattggaatggagcattcaatttcaccaaagatcttacctttttgaccatttgtgcccaacaattgaaaggagatattacacaacgcatgtgcacagaagcagaaatacaagcttatggccaaagttttgctagtgggaagtcaggaaccagatccagcttcttgaaacccaacataaattgtaatttgagctcatgggttaatggttgtgaacccggatggggttgcaaagctaataaaaaagtagacattggtagtaacaaaaaggacatacctattagatcccttgattgtcaaccttgttgtgaaggcttcttttgccctcatggtctcacttgcatgatac

SEQ ID NO: 48389 - DNA, 205 bp, Glycine max
  Peptide Sequence Number=SeqID_165167
tttgataaccttgcatgcgacatggagaacgcactaaagagtgtagcctacaatccacaacctgagaggcatgttgggattcttgttgcggctgagaaccaagatagtggcggtgatggcgatgaaggcgaagttctagagaatgtccaagatgacgacgggcttggaataggcttaattgctctgcctctctttgagttgccat

SEQ ID NO: 48390 - DNA, 1411 bp, Glycine max
  Peptide Sequence Number=SeqID_165168
atatcgttatcagcttcctcctggaaagcctaaccatacttgtggtggggcagatatttgggcagatattcagagtagcggtgaggtgttctgttcagcagggtcattttgtccctctacaattgtaaaaaatccttgcaataaagggtattattgtagaacaggttctactactcaggaacgttgtttcaagttggcatcttgtgagcctaagtcatcaaatcaaaatattactgcatatggtgtcttggtttttgctggcttgtgttttttgcttattatcatatacaattgttctgaccaagttcttgcaactcgagaaaaaagacaagcaaaatcaagagaaagggctgcacaaagtgtgcgagaatcacaagcacgtgaaaaatggaaatctgcaaaagacgtggctaaaaaacatgcagtaggactacagtcacaattgtcacgtacattttctcgcaaaacttcaaagaagccagatttgaaaggtgctgctttaccacctgttggtacatcaaaaggaaagaaaaaggacaaaaataatctctcaaaaataataaatgacattgaggaaaatcctgatagttcagaagggtttaatgttcagataggagataaaaatgtcaagaaacaagcaccaaggggtaagcaattacacactcaaagtcaaattttcaagtatgcatatggtcagattgaaaaagagaaggctttagcagaacaaaacaaaaacttaaccttttctggagtaatttcaatggctaatgacattgagataaggaagagacctaccattgaggttgctttcaaagacttaaccctcactttgaaagggaaaaacaaacatttattgagatgtgtgactggtaaattacatcctggtagagtttcagcagtcatggggccatctggggctggcaagacaacatttctttcagctttaactggaaaagcaactgggtgccacacaactgggcaagttcttgtaaatggtaaagaatcttctatcaggtcatacaagaaaatcattgggtttgtgccacaagatgatattgtgcatggcaatttgacagtggaggaaaatctatggtttagtgctagatgcagactctctgctgatctaccaaaagaagagaaggtgttagtggttgaaagagtcattgagtcattaggtctacaagcaataagagattctttagttgggacagtggagaaacgaggaatctcgggaggtcaaaggaaaagagtaaatgttggattggaaatggttatggaaccttcccttttaattttggacgaacccacttctggattggatagttcatcttctcaattactacttagagcacttagacgtgaagctcttgagggagtaaacatatgtatggtccttcaccaaccaaggtga

SEQ ID NO: 48391 - DNA, 396 bp, Glycine max
  Peptide Sequence Number=SeqID_165169
atggatattgtcaaaattaatgtgataagcgttagtgaaaatgccacgggttttagagtagttggacaacaagcgctaatggacgcgtccaaactgcaacacccaaaatcaaaggtttttatgcagctactaagacacaagtggcacttggtggtgggtgcaatttatgcggttgcacaatgtgttgaaactaccacagagactgattgtttgaaatgcatgcaagtcggatacaacaacttacacacttgtcctccgaacaccgagggtagagcatatgatgctggctattttatgagatactccaccacaccctactttgctgattatcagaccattgatattgcaccctatttcaaacaaggtacaatcacaataattcctccctttcgttaa

SEQ ID NO: 48392 - DNA, 846 bp, Glycine max
  Peptide Sequence Number=SeqID_165170
atgactccagagcttgggcaagaagactccaataccggcacgacattcatggtggtggatgtcgtggagttgtcgaaggaacaattggggtcgtacatgatcctttcaacaatgtcgagggacgaaattatgttttatttgagattgagagtatgttacatgcgcttggcttcgcggcctcaaaggattacacgacccaaggagttgcggtcctataatctgcttggtccttctgtccttgctgccaatggcctggataatggtagtttagtgcagtgtcgattctcttctaggactaaatatggtgctttgcattccttgtatgaattagtccttccttctacttctgactggattttgaaccgacaccacactaatataaagatcgttaagtttgatattagaacaggccaaaggaaaaatatattggtggaagaaaacaacagttggatcaatatacatgactgtttcacacctcttgataaaggagttaccaaattttcaggtggatttagctgggctaacagagagagagagacacacagagagagggagagagagagagagagaaagaggtacaaacaaggctacaagaacaaagactgtagtagtggcagtgcctcagttgttgagcttgtggtggcacttttttgttcattcagccaactaatctgttttgagccaactaatgtcctccaaggacagccagttcagattttgtttttcacacttcaaaatcaaaatggagctcctgggaaaggcatatttgttggtgactgtgttcattgtgaggtggaggatttgtctaacaccatttgggctggttctattgccatggaagagtaa

SEQ ID NO: 48393 - DNA, 330 bp, Glycine max
  Peptide Sequence Number=SeqID_165171
acaggagattcaactatggtcaagataagtgagaaaaataataatgttgatgctggcgactgcatgattcttgatgaccatgaaggacaagagcattgttgtggcaaaggaacaaatgcgaggagtgtttcttttttgccaagaagccaagagaagataggagattcggctaaagttgtgataaaacaagacatgaagggaggagagcataaatatgggtttaactacaataaacgtgacaagccagagaaggtaagggtggtggatgctgaaactggtgacaaacatgagttgtatgaagtcctaaggatgccatctagatgtgtatga

SEQ ID NO: 48394 - DNA, 467 bp, Glycine max
  Peptide Sequence Number=SeqID_165172
cacagaagcataaaccaaagagggtggagagtgtcaatgctgatgcagaaacctttggtgatcactgggaaacttcagattgctctatgtattctgaagctgaagcattagaacatatgaagaaaagagatagaggccatcaaagtgtgtcattggagaataagacagaagattcaactatggtcaagataagtgagaaaaataataatgttgatgccggcgactgcatgattcttgatgaccatgaaggacaagagcattgttgtggcaaaggaacaaatgcgaggagtggaggagagcataaatatgggtttaacaataataaacgtgagaatccagagaaggtaagggtggtggatgatgaaactagcgacaaacatgagctgtatgaagtcctaaggatgacatctagatctgtgaaaaccgatgcctcaagttttttactgagggcaggaggggtattataa

SEQ ID NO: 48395 - DNA, 828 bp, Glycine max
  Peptide Sequence Number=SeqID_165173
atggctcctagttctgctcacaacaatgggttctatgtgcttatgctagttgggatagtggttagcactatggttgctacctgtgctgctagcttctaccaagactttgatctaacatggggtggtgaccgtgctaagatattaaatggtggccatcttctatcactttccctagccaaagtctctgcctctggcttcaaatcaaagaaagaatacctatttgggaggattgatatgcagctgaagctcattgctggcaactctgatggcatagtcactacttactacggtaagggaaacttcactaaggagaagaagcacagagttgtcatgatgctcgagttaaatatgagataccctagccatgtttacttcactaagtgtgcgatacatgaatgtggtgaaggagaagaagcacagagttgtcacgatgctcaagtgagacgaacacgatgcacgagcttagacaaaacgattcttagatggagaacagatagcttcaaggtaaatggacaacaaagagagcaagaaagcttagatggagaagaagacagcgagaaggagaagacaacgcgaaggagacgaaacatacctaggtatggtagcgaaggagaagaagcacagagttgtcacgatgctcgagtgcgacgaaaacgatgctcgagcttagacaaaacgattctcagatggagaacagacagcttcaaggagaagaagcagagacttgtgacaatgctcgagtgcgacgaacacgatgctcagatgcagaatagagaccttcaaggtagacggagattagaaaaagaagaagagagcgcgaaagcttag

SEQ ID NO: 48396 - DNA, 393 bp, Glycine max
  Peptide Sequence Number=SeqID_165174
atgccaatttgtatgaattcctcaagccacaatctatccagagatctggccaatcacaatttgaatcagaaagttacattaagaactggatgcaaagttcaacgagatgtgtacctaggagcttacatgaatgggccagacaactacctcaaaggcataattaacagtgctttgaaaagacttgatgatactcaacaaagtaaatccaagcttactgttaggtggattgttgttaaatgtaatagacaaaaaggaagcactgagtgtgagtattacgtcatgcacgggatgtcaactataatcttaggaaatttcaagaataattgggaaatgtatttcactgatgctagaccattggaaccagagagattgaaggcgcttcacatccagtgg

SEQ ID NO: 48397 - DNA, 390 bp, Glycine max
  Peptide Sequence Number=SeqID_165175
atgtttagcaaggcatggaatacagtgcaaaggaacaataaagagcttaggggaagcagtaatggggtcatcggcagctatcataagtggctgagagtccagacacaagggttggattggctcccaaaggtaaaggctgcaagaaaggaagaggctgaagctcctgaagaaagtgaggaggtacaagccctaaaggcggagcttgaaagaccccgagcagtcaaagagaagttcaagtcaatgaccatcaaagtccgaaaagagtatgatgaactaagagacgtcggccaccaccaaagtcttggaatgagaaaccaagaggacccgaaaggaagaacacggtcggaacaagttccaaggagctttatggggcagcaacaacaagcttaa

SEQ ID NO: 48398 - DNA, 294 bp, Glycine max
  Peptide Sequence Number=SeqID_165176
atgaagccacaccatgaagagacggaaatcataaacttgggtgttggcgaggaaaagaaaaaggtaaaggtcgatatgcccggtttgaaccccgacattgtgcaacatcggttacctctaaatcccaagtgttcctcggtcaagcaaaagctgcggaggatgaagcccgagatgttcttaaaaatcaaagaagaagtgaaaaagaagttcgacgctggcttcctagcagtggctcgatatcttgaatgggtggcgaacatcgtgccagtccctaaaaagaatgggaaggtatga

SEQ ID NO: 48399 - DNA, 285 bp, Glycine max
  Peptide Sequence Number=SeqID_165177
atggtagagagagaaagttgtagggaagaagaagaagaagaagaagaaggcttgtttggttggggaggtgaagatggaagtgagactgagatcgtgttggtggtgtttaacgttcaggaccttgatgagaaaataaatggagtgagaaggaagaaaagggacggattttggggaaatatttacagtgggagccactcacacagaaaagggttcgtcggattgtggaacagagaaggctctcgtttgaacagtgctgctgctgcctatggacaaattattgtttga

SEQ ID NO: 48400 - DNA, 169 bp, Glycine max
  Peptide Sequence Number=SeqID_165178
atggactgccagtgccggaatctgacggtggtgaacttggatccggagagaaagcgaagtggagggttgaggactaaacaggcggggagaggatcgtgccgtggactctgtgctcaaggaatcgctggtcttatgccattttttggaagatcggttgcaataattccaa

SEQ ID NO: 48401 - DNA, 254 bp, Glycine max
  Peptide Sequence Number=SeqID_165179
atggcggaagcatcaaagaagcacaaaggttcttcgagtagaagccaacaacattctgaggctcaggatactccaattccttcttccatttcctcatcctcattgttctcattagaagaacaacatatacggtacacaaacctcttctcctctcattctatcatagaccctaagtttatagatatggatttcttttctgatgagagtttcgaatgcattcaagcatttcaaaaatcaaatctcattccctttat

SEQ ID NO: 48402 - DNA, 930 bp, Glycine max
  Peptide Sequence Number=SeqID_165180
atgcctgatagtgcgctttcgttgagtgatagagtgggaagtagtagtaggcagaaagtgaaggtgcttagcgttcttgataccttgcctcctattgcggaaactatgagttctgttatgatggagaggcacggggttaggcctgagcatggtagtgtggaacatggaggagggttgtctcatgggaaattcggagctaaggggaatgggagagttattgggcctgagcaagcggtgaaattgttgcagaaggtggtggcacatattttgatgggtgttgggtttgaaggtgccatggaaggttctgttgaggacttctccgaagtattgagcggacaaatatgcacagagatgcaagttgttaacaaaagtgagagagcaatctcacttgaggcaaatggtcaggttgttctaactcccgatcagggacaagaagcctcttcagagatattgcctatcaattttgatggactggctaagaacatagctacattggttgggtcattgttcactttgcatgcctctcagattcatattgatttgcctactctcactgagaaagaccaggaggttataagctcctggggtgttaaaaacaaaattgattttctgtcattgtcatatactcgacacgctgaagatgttcaccatgctcgtgaatttctttcaaagttaggtgatctcagccaaactcaaatttttgcaaagattgaaaatgttgaggctgagaaagttttcaatcaagacctatattttaaaaggacagtcaagtatgttggagaacccatgactcacttggaatctattgcatcctccacggtacgagctgcaattaaggtgaaagcatctattataatttgttttacttcatctggaagggctgcaagattgattgcaaagtataggccaacaatgaactatctgttgtga

SEQ ID NO: 48403 - DNA, 306 bp, Glycine max
  Peptide Sequence Number=SeqID_165181
atgttggccatgctccttctgatatctttatcagaggtggcaaccagcgatttgaaggagggtgaggttgtcaaagtaactaatgaacagggtgatgccaaatttgttggtggtggtggtgaccttgatgattttatggtcatttgttttcctcctccccctccttatggccggggtgtttactacaaatacgttgataatatttctcaaaagaagcaagcagataaatgctattgtggttgttgttggatgataaagtcgggagattacagacaatgctgccaagaatactattggtcgccttga

SEQ ID NO: 48404 - DNA, 513 bp, Glycine max
  Peptide Sequence Number=SeqID_165182
atgcccagagttggagaagtcataagacaagaagaaacactacaagacccaataaaaaaatgtcttatgagcacctgggaagatttggatgacacctcgtctgacgaaggtgaagaagaagccaatctatgttcaatggtagacacaacttctaaagaatatgaatcaaatcaagaggataaggagttggaaaaaaaactgaaaggtctacaaaaggatctgaaggagctaaatgaacttcacaatcatcaaagtcaagaaagatatgatctatggacagaatatgcacaagcacacaaatattatgagaaccttaaaataatagaaagcaaacgcctatcatggtacctggacaatggctgctcacaacaaatgacaagagaaaggtgtatcttccaatgcttgactcctaatcatggtggaattgtcactttcgaagggaatcaagaaataagaataacaagagtgggacttgttaaccttttaaatacattaggatttatgtcgacctag

SEQ ID NO: 48405 - DNA, 396 bp, Glycine max
  Peptide Sequence Number=SeqID_165183
atggatctttcgcttccgctgaagaagaaaaaccctagcctttctctttatttgttcaacatcaatggcttccttgtgctgggattattccaaggcccaaatgtgcttcttcaagattctccacataatttcatccaccccaccctccaaacaataacaacaacaacaagaacaaccaaaggcattgccattgatttgaatctcatgaccgaagaatttaaatcttctagtagcgagaatgacaactactctaccactactcaaaccaacaacaacgaagggtttctagagaagagcgttgaagttttagagaaaatcgacaacagcaacaacattaatgaagttaacaatcacgtggaaacgacatcatttccatgtgaatccgtggtgctgtga

SEQ ID NO: 48406 - DNA, 441 bp, Glycine max
  Peptide Sequence Number=SeqID_165184
atggggtctgatgcctcaatcttctctgaaagtggtcataagatacacgatttattggagaagagggaaaccaaaaaggatgttggatatgtacattatccttctagcatatggactaaacaagcatgggatggaatcagcaatgaggggtttaatggctttcagcaccagtgtggaagctcttatacagaaagagctataggaaaatcactccatttttcattccctaatccatcatcagtatgtgctccgtgttacaggctatgcagtggactaagtaccaattattccttttcttctgcttatgcaattgcaaagtactgctctcatactgctactaatcacattagaagaggggacaagatattatgctgggtagtgaagcagcaattgtgcttagtggtgttggaagcttcaattgcctgcaggactttgtcttag

SEQ ID NO: 48407 - DNA, 297 bp, Glycine max
  Peptide Sequence Number=SeqID_165185
atgatgatttcgatgttgaaaccagtttccgttctgcctttggtgggaatagattcttctattggtccttcatcaatgaggaaaatcctcagtggaggagtttctgatagattagccctcggattgagtgtttctggtccactgaaacttgaagatgtaaaaaatgcgtaccggccctgtgctctaaaatggcatccagatcgtcatcaaggctcttccaaggctgtagcagaagagaagttcgagctttgcagtgcggcttatcaatctttatgtgatagcctggccctggattaa

SEQ ID NO: 48408 - DNA, 200 bp, Glycine max
  Peptide Sequence Number=SeqID_165186
atggttgatgcatttgatgcttctatacatgaagaaaaagatgtcatattcattttcatagtggccttagctggaaatggtggtcaaaccataggaactgtaacaaatactgcaccatggattgtaacaatagcagctattgtggcattgaaagggcttttaagagcactttacagttgggaaatggcaagaatgttact

SEQ ID NO: 48409 - DNA, 1713 bp, Glycine max
  Peptide Sequence Number=SeqID_165187
atggagaagatggagcatttcagccacatccaccctctactgttaaagcaggaacatagcaataatttcaacaaccaagtcctttgttcaggttgtgaagaactaatctcatcaggtcctgtcttctgttgtgtccaatgcaactatgtccttcacaaaaaatgcgcacaaattgcacgccatgtgaaacacccatttcaccctcaacacccccttgttctcctttccaccaccccttatgaaggaccatacgtatgtgattcctgtagaggcctcttcagtaacttcgtttaccattgttatcagtgcaactacgaccttgatgtctcatgtgcttctcagtttaaccctgatgatggccacaagcatgagtttttgtcactgacaaatccacaatcttttgtttgttatgcttgtggcatgtatgcaaacgagggtcttgcttgcttatgcaccgtttgtcagatttgggttcattctggttgtgctgaattacctcttgctattagaataaaaggccatgaccaccctttgaagctcacttatacccttcatcatttttatggtttctggggcaagttaacttgtggtttttgtaatgaagcgatgaatccagcttttgcgggttacttttgctcaacatgcaaatttgccgtgcattgtccgcaacaacatttaggagagtatgaagataaggaatcattttcaggctatgaaactgaggaggaatctctagatattgatttcacttttaatttctttggtcatgaacatttgttgaagttcacggaggaattagagagtaatgatgatgatgtgcaatgttttgataaactctgtgatgcgtgcgtccaacccatcatgccacctttcttttcctgtgaagaagaaaattgtggcttctttttgcaccaaagttgtgccgaattaccaagaacgaagcaacacccgtttcacaagcaccctctgactcttcaatccaaggctccttatgatggaatttacaagtgcgacggatgcagaagattgggcaatggttttgtttaccgttgtgacgtgtgtcaattcgaccttgacgtttgttgtgcttcccttgaagagagaattgaacatgaaagtcacaagcatcccttgttcctcaagaagacaagtgttgcgaggcaatgcaaaggttgtcatctatggtcgaagcttgtgtttgtgtgtgatgtttgtgaggattttgctattgattgtggatgtgctactctactgagtaaagcgtggcacgtgtatgacaagcatcctctaagtctaaactattgtattgaaggggatttgagggaacatgaatgtggcatttgcaatgagaaaatgtctaagaagcaatggttttattgctgtgatgattgtgactctggtgctcacccttattgtgttgctggcaagtttaggcggatgaagtttggaggaagtttccaatatgatgttcactcacaccctcttgctctggttgaagaaactgagcagaagaatgaatgtggagcctgtggtgaacactgcaatggatggacacttgaatgtggccaatgcaaacgctactttcacagggaaggacagtgtttttggaaggaatttaaaaagagtgctaagtatttggagttatcaggaatgatgagacacaggtatgcagcaaacgtgttggcctccacgccaaatgcaaccacaaagtga

SEQ ID NO: 48410 - DNA, 111 bp, Glycine max
  Peptide Sequence Number=SeqID_165188
atggctgcgaagggaatgaaggaggttttatacttatcactcaaattgaaacttcctcttgttcaaggagctgctgcgattgaagtcaaagttgtcaaggtgcataggtag

SEQ ID NO: 48411 - DNA, 1314 bp, Glycine max
  Peptide Sequence Number=SeqID_165189
atgggatcagcacacaaggacccgaatgtcttccactttagccatccacatcctttggaatgtaccaccccaccctccaccggaaacaacgtaattatctgctttggatgcaagctaaaagttaagcatggtgaggactattacgagtgcaaaacatgtgccttttctcttcacaatgtgtgctacaagatgcccttgatcacaaaccacccttcacatgcaagccacaacctagtcctccttgctataccttccaccaaagccaccctcaactgcgtggcatgtgggaaccatgtcacgggcttctgctaccactgtgccgaatgcagcatattctttcattctttgtgtcttgcacttcctgtttccctcgctatcacttatcatccccacaaaatcaagcttgagttttcagcaccatatcatttcttctgtgacttgtgcaacaaacccagttacaataataacgggtggctatataggtgcaacatgtgtgaattcgatacacatatagcttgtgcagttgaaaacttagagccccattcgttcaaaaacgaatctttccatcaatcaagccccttgttaaggcaactcacgagtgatcaccgagtggaacacaaaagggttagtgcaagtgtaggtgatagttgcaaagggtatgatgagtatgagatcatgcgtttggtggcacaacaaataattggtgggggaatcagagaaaattctgatagtgcagttgctggatgggacaagagattatatagtattccatggaaaaagcttaacaaaactgggagtgggaagatgaagattattagtgaacttgaattacaagaaaaagaactaagtcctgctcaacttctattaaagttagaagaaagaacaccacttagggataaatccacaccattttctgatcatttgggcacaccgtatagtaaccaatatagtgactcatatttttcaatagatttggcaaagtcatattcaaaccaacatggacatagaagtcaggtaccaagagaaggtggtagtgaccagataactcgagatgttactatgccagagagagttggtgtggggcaacagaataaggtgaacaacgcaacgttttacatcaaagaaggacgaactagttattttgggaaatcaagccagagagtcgtgaagaaaaatcctaacgaaagcattgccaaatcgtctgttcaagatcaaacaattgctaaatcagattcacctccacaccctgcatatataacaagcttcttggtagatctagctagaatcgcttcattcgattttatttctttttag

SEQ ID NO: 48412 - DNA, 1119 bp, Glycine max
  Peptide Sequence Number=SeqID_165190
atgaggatccggaaaaggccggcgcttttcccttcttcgctctcgccgctgcgtctctcagatccccacctgatcaaccggtcaccggtggtggtgcaactaagcgacgctacttccaccgcaccgaaactctctttttcttcttctgcacaccatgctgctttcgcgcatccttcgaccttggatcgtttccagccgtctgatcagcctctccctttgatcgggaaacaaagcaacggctcggatgatccctccggcatcggtgaaagtggggcacacagacagcacaacaagcaagaccctttggacgaggttgttagaagagaagagagtggagaagactcgggagagaagggtaaccatatcaggaaaggacgcacctttgattcggaaaaaacacaagctgagttgttgccaccgttaagctcatcttctactcaagatgggagatggtacgagggagagaaagcgattccgctgaagaaaaggagagggaacttcgaggagaataataataataataatgctgctgctcatagcaagaagatgatgaaggcgaagatgaagacgaagatgaacaagaagtgttcaacgccgcgcaacaacgaggatagcacgggagaggaagaagtgaagaagaaggtagaagaaacaataaaagtggaagtgaatgttgtgagtaaaaagagagcaaggggtagtgcactcatggaaggttctaggtgcagtcgtgtgaatgggagaggatggaggtgctgccagcaaacgctggttggttactcgctgtgtgagcatcacttggggaagggaagactcagaagcatgacaagtgttagaagccgttccattattgcatcaactgcaccaaaggaggtgcacgtgcaccacgtgcctcacccttcttcttcttccccttctttttgttctctcgagaagcaaattgagtgtgttgatgatgctgagccctttggggagaaggaggagaagaagccagggataataatgacgtcgacgaagaagaggatgaagcttggcatggtgaaagcgcgttccataagcagtttgctggggcaaacaagcaaccacattgctgctgtagctcatgagaatagcaagtaa

SEQ ID NO: 48413 - DNA, 219 bp, Glycine max
  Peptide Sequence Number=SeqID_165191
atggtgatgtttgatggcgatttgggtcgcgggtggttggtgacgatggttatacagttgcaaggttggcagtgccgatcaggtggcgtgctagatgttggtggtggtgctggtgtttgggttgggatgacatcgttttgcgaaagaaaagagaaaaaaagtgggcgtcgaagggagtatactactcgtacgaaccttactcatatatcgtgtctctaa

SEQ ID NO: 48414 - DNA, 99 bp, Glycine max
  Peptide Sequence Number=SeqID_165192
atggatatctgtctctgtgtgattggttatcccatgaatggagttcaacggagttggtctgtttctcattcctatgatgaggtgtactataaattgtag

SEQ ID NO: 48415 - DNA, 993 bp, Glycine max
  Peptide Sequence Number=SeqID_165193
atgttttcttttaattacctattcaccaccattttcttagtgctaacattctttctttatccatcaaatgctcaactgagttcaaccttctactccagcacatgccccaacgtgtcttccattgtgcgcagtgttgttcagcaggctctgcaatctgatcctcgaattgctgcgagcctaactcgtcttcattttcatgattgctttgttaatggatgtgatggatccattttgttagacgtaggtggcaacataacactgagcgagaaaactgcaggtcccaacaataattcggctcgtggctttgatgtggtcgacaacataaagacatctattgaaaattcatgccccggtgttgtatcttgtgctgatattcttgcccttgctgctgaagtttcggtgtctttgggaggaggtccttcatggaacgtactactaggaagaagggacggtttgattgcaaaccaatctggtgcgaacacatccattcccaatccaacagaaagcctggccaatgtcactgccaaatttgctgccgttggcctaaacataactgatctcgttgcattatctggtgcacatagttttggtcgtgcgcagtgtagatttttcaaccagagactgttcaacttcagcggcacaggtagccctgatcccacgctgaatacaacctatttagcgacacttcagcaaaactgtccacaaaacggaagcggcaacactctgaacaacctcgacccttcgtctccggacaccttcgacaacaactacttccaaaaccttctcagcaatcagggccttctccaaacagaccaagagctcttttccaccaacggcgccgccacagtttccgtcgtcaacaacttcgccgccaaccaaaccgcgttcttccaagcctttgctcagtccatgattaacatgggtaatattagcccgttgactggaagccagggtgaaatcagatcagattgtaaaagggtcaatggaagttaa

SEQ ID NO: 48416 - DNA, 867 bp, Glycine max
  Peptide Sequence Number=SeqID_165194
atggagctagctttgagcttaggcgacacacccaaaaccgtctctttggccacaaaaaatgattcagtgagtttgtgcatagcactggctgatgacaaaaggggttcttcatatccacccgttcagctcgaccttcttccttcaacaccagttcttcctttttcacactcacaccttcgaattccatggctctccgatgcactgggtatggaacgtgtgacatcagagattccggtgagggtggtggatgacaccgacgatggtgctgcactttcatctcccaacagtgcagtgtcatcttttcagatggattattgtgtcaggaacaatagaaagtctagtgaaggtgccagcgatgacgacgaaaatggctcatcaaggaagaaactaagactctccaaacaacaatcagctttcctcgaagacagcttcaaagaacacaccactctcaatcccaagcaaaaacttgcacttgcaaaacagttaaatctccgtccccgtcaggtggaagtttggtttcagaacagaagggcaaggacaaagttgaagcagacagaagtggattgtgagtacttaaagagatgctgcgagagtctgacagaagagaataggagattgcagaaggaactgcaagaactgagggctttgaaaacatgtcaaccgtttttcatgcagcttccagctaccaccctcaccatgtgtcccgcttgtgaacgcgtcgccaccaacaccgccaccggagccgccgccgccgccgcttccaccaccaccaccaataataataatgcctctgcccccaccaacaataatagtgtttctcaaatctctgctgcgatgtctgttgacaagcccagaatattgccctga

SEQ ID NO: 48417 - DNA, 234 bp, Glycine max
  Peptide Sequence Number=SeqID_165195
atggaaaaatgtggtacgatgcccaagttgcggcagcacgaaacctgggtcatagtggtgcaaggtagaagaggaggagctagcacacaagagctgcgatcgatatggattgaaatctggtgcggacgagtagatttgtatcttcaaataagccatgccgatgagtggctctttggctattggggaagtgcggaaatcgaagaagtagaattaccatacttggaccttgaatga

SEQ ID NO: 48418 - DNA, 1869 bp, Glycine max
  Peptide Sequence Number=SeqID_165196
atggctgatgccaccaagtatgttcccatcgctggtaccaacgtctcttccattctcaaaaccagaaaaacggtggctgctgcatactctttcatactcgccttcgtcgctttcactgttttcttagccttttccccttcttcaaacgcttcttcaccttggttcaccaacatattctctcccacatccaccaccgacggctcctacaagcctcaaattcctaacattttctctctccttttcccaaacactacttcaccctccaattcttctgatcccctgcataacaacactcactcttttagatctaccaatgccacttctttatctccttatccaaaaacagccttagaatctcaaacactcaaacaaacctctttagaaaacagaacccagacaaccttggtgaattcaacccaacatgcagttcctgttccaaccacaaaccagaccacggattctcacgcgccaagtttggaggtgaagtcaccaccattccttgcaagtaaggaaccgccaggtgctgtaaaaaatcagacttttaactctgatgaagctaaatctgcgagcacaaatcaaactacaaatgctactgcaactgcaactgcaaccaatgtttcagtgagtttccctgttcagaatgttccaaatctgaacacgagttctaattcttcggtgaaggtggatttggtgaagggtactgttgtgtctaatgataattacaccgcttctctggcgaggaaacagaacaatgggaaggatcacgctaaggggaacgatgaatcgatggagtctctgatgaagtgtgatttttttgatggagagtgggttaaggatgatgcatatcctctctataagccagattcttgctctttgattgatgaacagttcaattgtattaggaatggaaggcctgataaggattatcagaaatataagtggaagccaaagggttgcacccttccaaggttggatgcgcatcgaatgctgcaattgttgagagggaaacgactggtttttgttggcgattcgctcaataggaacatgtgggagtctttgatttgcatattgagaaatgctgtgaaaaataaacacaatgtttatgaagtaaatggaagagttaatttcagaggcgaagccgcttattcatttgttttcgaagattatcacttctccgtggagctttttgtgtctccattcttggttcaagaaggggaaatgactgataagaatgggacaaagaaggaaacacttcgtctcgatttggttggtaaatcttcatctcaatataaagatgcagatattctcgtcttcaacactggccactggtggactcatgataaaacttctaaagggcaggactattatcaagaaggtaaccatgtgtattccgaattaaacgttcttgaggcattccgaagagctttaacaacttggagcaggtgggttgatgccaacataaatccatccaagaccacggtcttcttcagaggctattctgcatcccacttcagtggtggacaatggaattcaggtggtcaatgtgatagtgaaactgatccaattgacaacgagaagtacctaaccgagtatccagataagatgaaggttttggagaaggtgctaaagaatatgaaaacccgtgtgacttaccaaaacatcactagaatgacggatttccggaaggatggtcacccctccatatacaggaagcaaaatctatcacctgaggaactaaaatcacctttgagattccaagactgcagccactggtgccttccgggtgttcctgatttatggaatgaaattctctacgctgaacttctgttgagagagtatcggaatcagcatgagcagaagaaagcatag

SEQ ID NO: 48419 - DNA, 496 bp, Glycine max
  Peptide Sequence Number=SeqID_165197
atgactaccctgactcagacatggatgacgttgctgcttagcaacatcctacccagcgatcataattctgacctccctctaccgaagtgtatggcgcctaccaggcaccctctggacccggataagtccaacagggccctgggatttccagctttgatcacagggctctgccagtcgtttggagtccccgtcgcacctagtaaggtgattcgcccacccatcacccgggcttttattgagaagtattgcacacagagacaggcccagggtgatgcaccacaggccgcaggtgcgccaccaccacctcatcaggctgacccagctgggtcatttgacacagagcggtatttgtggcactcgatgcgccagcacgcggccaaccacaggggactggggcaggtccatgagtgtctctaccatctaagcctcaacatgcagagccaaggcttcgctccttttccgtgccctactccagaccagttcagggagaggagat

SEQ ID NO: 48420 - DNA, 985 bp, Glycine max
  Peptide Sequence Number=SeqID_165198
cgccagcatggtgccacggcacggcggggtgccgcagaggcacttgtagccttccttcagggccttggtgatgcggccgtccaggaccaggccgtagtcgtaggagagttcggtgccgcgcgggatgtcctgcagcgcgacgatgtagacgcgcttgccgtgcttgccttcctgggcctcgcagttgggctcacaggagtggttgatccagcgggcgtcgttgccctggtcgccgccgtcgatgacgcggccggagctgagggcgaagaagaaggtgtggaagggatcgtcggggttggtggggtggcgacggtcggcttccttggcgctgatgcgggcgccgccgtactcgatgatgcgggtgcccgcggggatcttgcgggcggcgaagacgccgttgccgtgcagcttggagcggcgcacgacgtaccagggcttgatgggggtgtcttcggagtgggcgccgcctcgtttcttgcgtacctgcaccatgattgtccgtccgcgtccttccgcgctgggtttgttctttgttttgcgcggttcgatcattccccgcatcttcagccgcatcctggtcattacgctgctgtcgtgcgtggtggtgtggatgtaccaccgccaatggttctcgcccacgcacctgtcggcggtgccgttctcgctgttcgggctggcgctgtcggtgttcatggggtttcgcaacaacgtctgctacgaccgctggtgggaagcgcgcaagcaatggggcgacctgatcgtgcaggcccgcagcctggcgcgcgagagcgcggtgctgctggcggccagtaccgccaatccggtgcaggaaaggctggtgcggcgttgcatcggcttcggttacgcgctggcggcgcggctgcgcgaccaggatgtgctggcggccgtgcggccctgggtgcagccggaggaactggatacgctggcgggcaatcgcaacgtgccggatgcgctgctgctggcg

SEQ ID NO: 48421 - DNA, 293 bp, Glycine max
  Peptide Sequence Number=SeqID_165199
ccgacttcgagccttgcctcggatatgccactgaagggcaagcagttggtgatatacccctgcaaaacactttggagggccctcagtatcacccacaaccacaccccttgcattccacaccgggtaaaaaccctcatgctatggctgaaatgggagagttggatcatcgaaaggaaaggcttagggccattgaaggaggtgaagattatgcctttgctaacctagaagagttgttcctagtacccaatatcatcacccctccgaagttcaaggtgccggactactttccctaa

SEQ ID NO: 48422 - DNA, 156 bp, Glycine max
  Peptide Sequence Number=SeqID_165200
atggaggatagggtcacgaccgaccgatcttcatcccttcccggcgctggtcaagcagagaacgtcgctgcaaggcagcccaaatttgtgaagcaattcacatgtgaattcatgcttgattattgtgaattgacgggttgtaagggatgggcctag

SEQ ID NO: 48423 - DNA, 684 bp, Glycine max
  Peptide Sequence Number=SeqID_165201
atggatcaagaaaaggttcaagcagtcctgaattggccatatcctataaatctgaagcaattgagaggcttcctccgtctgactggatactacaacaaacttatcaaaggttatgcgtcaatcgcaactcctttatccaattcgttgaagaaggaaaacgttcattggaatgaccacgcttccaaggcttttgacaatttgaaagccgcaattaccaaggcaccagtactggcattgcctgatttttccaaagcctttacattggaaactgatgcctctggtattggcattagggctgtattgagtcaggaacaacacccaatagcttttttcacaaagaagttcacacctaggatgcaaagacagtcagcttatattagggagtcctatgccatcacagaagcagttgcaaaattcagacattatttacatgggcatcgatttgtgatcaaaactgaccaaagaagcctcaagtcactcactgagcaagcaatccaaacaccagaacaacagaaatggctacacaaattgctaggatatgacttctctattgaaaacaaactggacaatgagaatttagttgcagattccttgtctagatcatttttcatggcatggtctgaaccaaaacttaagttaattcagttgttgaaagaggcaatacaagctgactctcagttgtag

SEQ ID NO: 48424 - DNA, 373 bp, Glycine max
  Peptide Sequence Number=SeqID_165202
atgaattcctcctccatttatattcttgtctttgtccagctttggttgttgagcttaccatgcagagagagtgtgtgcatcccaagtgagcgtgagacacttttgaagtttaagaataatctcatagatccttccaataggctttggtcttggaatcataataataccaactgttgccactggtatggagtcctctgccacaaccttacttcccatcttcttcagcttcacctcaactcttcagattctattttcaatgatgattgggaagcttataggagatggagctttggtggagagataagtccttgtttggctgatttaaagcatttgaattacttggacttgagcgccaatgaataccttggagaag

SEQ ID NO: 48425 - DNA, 533 bp, Glycine max
  Peptide Sequence Number=SeqID_165203
aaccgctaaaagggaggaagttgaggcaccggaggaagacgaagaggtacaggcccttaggatagaactcgaggcttgtcgggaagaacacggccggaacaagttccgaggggctctgtggggcaacaacagcgagcttaagctccggagagaggaaagggaccaatcacgagtagacagtttgatcttgaaagatgagttgaaggtttgctcaaggtccaaaagaaacttgtctcagcggttatgcgaaacagagaccaacatgttagctatcatcaccaagtaccaagaagaactaaatctagccccagcccatgagcatagagtggcggacgagtacgcccaagtgtacgcggaaaaggaggctagaggaagggtgatcgactcgttacatcaagaggcaacgatatggatggaccgatttgctcttaccttgaacgggagtcaagaacttccccgattgctagccaaggccaaagcaatggcggacacctactccgcccccgaggagatccatggacttctcggctatt

SEQ ID NO: 48426 - DNA, 1362 bp, Glycine max
  Peptide Sequence Number=SeqID_165204
atgggccggcgcgcttggccagatcccgcccggcgcggagccggacgcggccggcagccgcccttgtcagaacggcgagtcgggccggaagttcggcgcccgccgatcgcgcaacgactgcacgccttcgcgcacgtccgggccgccgaaccccatgaattccagcgccagcgacgtatcgaaggtcgggccggccatgcgcagccagttgttcagcgaatacttggtccagcggatcgcggtctgcgagccggccgccaggcggttggcgacctcgaaggcgcggccgatcaactcggcctcgtccacgcacagcgacaccaggccgatacgctcggcctcttcgccgctcacggtttcgcacagcatcaggtagtacttggcgcgcgccatgccgcacagcagcggccagacgatggcggcatggtcgccggcggtgacgcccaggcgggtgtggccgtcgatgatgcgggcatcgcgcgcggcgatcgagatgtcggccagcaagccggccaccagccccgcacccacggcggcgccgtgcatcgccgacacgatcggcttgctgcaattgatgatgttgtagaccagatcgcgcgcctcgcgccagacgcgggtgcgcacgtcgaagtcctcggccatctgctgcaccaggtccaggtcgccaccgcccgagaagcccttgccctctccgcggatcaccaccacccgggtgtccgggtcggtatcgatatcgcgccagatgtcggccagctcgcggtgcatgcggtcgtcggcggtggacagcttgcccggcttgccgtccttggagcccatgatcagctccagcacgccgttgggatggcggcgcagcttgagggactcgtaggcggaatagtgttccagcgtgatatcggccgcgcgttttggggcactatagtggatagcccctgccccgacgatcccggagcctcagcccatgaacacccccgactcctcctttgccggcgagatccgccgcgacgatctgcccgccctgttcgccgcgcgcggcccggacacccacaaaggcagtttcggcaccgtcggcgtggtaggaggcgggcgcggcatggaaggcgcggcgctgctggccgcgcgcgccgcgctcaagaccggcgcgggcaaggtgctggtgggcttcgcccaggacgccgcgccgctgccctgcgatccgctgcaacccgaactgatgctgcgcgacgcccgctcgctgctggacacggactggggcgtgaccgcctgggtcgccgggtgcggcatcggcaccggcgcgacggccgccaacgccctgtcggaactgttcgtgctgcgccacggcgcgccgctggtgggatcctctag

SEQ ID NO: 48427 - DNA, 576 bp, Glycine max
  misc_feature (83)..(83): n is a, c, g, or t
  Peptide Sequence Number=SeqID_165205
atgctacaggcgcgctatccgcaggcgcgactggcgaaaggcaaaacgctggaggaagacgatcgcgtcattaccagcggtgnctgtttttcgtggatatcgctggccctgtatatcattgaaaaaagcgccggcaaggcggtggcggatctcacccgggagatgtcgctggccgataaccctgtgctgcacacccaccttcccggctcgccgggaatggggaaaagcagcacgccgtttctggtgcgggcgcaggagatcatccgcctggaaaatcctgccatcaatgccgcgcaactggcagccgcactgaacgttaccgggcgtaccctgcagcgcagaatgaaagccctgtcgcaggagacgccaaaagagtttattacccgcatccgcattgaactggcctgtaccattctggccagcaccgacgtcagcgtgcgtcagaccgccatgcagtgcggctacagcgaagataccgcctttcgtaaagccttccatcaggtgatggcgatgacgccggcccagtatcgtgagtggatagcacaccgtaaggcgcaggtaattagcgccaaataa

SEQ ID NO: 48428 - DNA, 378 bp, Glycine max
  Peptide Sequence Number=SeqID_165206
atggcaagacacaaggcacaagggggaggaggggcttggtcgtccgtccgcccgggcacacacctagttagcaccaggcaggcaaaacgagagagagccgacgaacggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 48429 - DNA, 162 bp, Glycine max
  Peptide Sequence Number=SeqID_165207
atggggatgaaagtcgttactgagacaacggatcgacaaaagaaagaccgctcatttttcaacactccaggaaagttaaaaacaggctctactcctgagaagcaaatgcatcttctcaactggaagacagtggaagaaagtaggcttgtgaaccagagatag

SEQ ID NO: 48430 - DNA, 621 bp, Glycine max
  Peptide Sequence Number=SeqID_165208
atggaagaacaattgaagaagcaaaagggttctttgagtagaagccaacggagctttgggtctcaggatactccaattccaccatccatttcgtcctccacgctattctcatctgaagagcaacgtatccgtgttggtgtaccgtttgaaggtacacttgatgatgattggaagttcgatttttctgtttctgatgcctgtcggttggtttacacaaacaaagcggatatgaccggaaggcttcttgccggttcattggcatttgattgctgcatcctccactatcttattgttcgcattttgcttccgagatcttcaaaccttgcacaggtacctcttgattctgaaccttctgttcaaatcaagaagtccttttccattggggctgcagttgtcgcctccttcggttaccacaaagagtgtgatggctcttgggtaaagaaggatgctcagcaacatgatgttgagggttgctcgcccgctcgagaggattcttctcttttgcagagtgtcatggatagatttgacagtcttcaggcctatgttggagagagatttgactctttcgagagtcaagtagacattcgattcgtaccctctcctgatatccaatcttcttaa

SEQ ID NO: 48431 - DNA, 507 bp, Glycine max
  Peptide Sequence Number=SeqID_165209
atgacattgaccatcccagagcttttcttgaggccttaccaggttacatgggatgccaccgtgttcggggtctttaatccagacttcccgctctacataaagcacgaagacttctccgaaatcacacacggtggtctatgtctcagcatatcagtgttacagttgtggattctgcatctgactgaaacaagtatgcgagcggggaattttgatatctatggattcctcgagccacagtccattcagaggccagacaattaccttaaggggataattaacagtgctttaaaaggtcttgatgatgctcctcaatctaaatcaaaggctccagctaggtggattgttgtcaagtgtaatagacaaaaaggaagtactgagtgtgactattatgtcatgcattggatgtccaccatcattttaggaagtttcaggaataactgggaagcgtattttaacgatcctagaccattggagccagagagattaaaggcacagcggatccaatag

SEQ ID NO: 48432 - DNA, 119 bp, Glycine max
  Peptide Sequence Number=SeqID_165210
atggcaataatggaagctacagggctccaaatgagggtggagatgattggaaggaaagaatcactctttccagcgagggcaacacacaaaggttgtgaaagtcctttgatacagccagg

SEQ ID NO: 48433 - DNA, 444 bp, Glycine max
  Peptide Sequence Number=SeqID_165211
atgcaaaggagatctgttgcaggtgatttaattcccatagatttggagattaacgctacttgcaggagacaaaatgcagagagaattagaatttttttgcaggacttagaagcagtagcaactccaggagaagaacctcgatcttttgaggcattttctagttttccaactcaagggcaatctcatacaagagttaaaggagacactatcatggctgagcagccaaggagaatgatccttgaagactattcaaatgtaattcgattgagcttgttttcgttctcattgtctggagaagctaagaggtggcttcactcgttcaaaggcgttaagacttgggatgaagtggttgagaaatttctgaagactatttccctgagtctaagactgcagaaggaaaaacgaccatctcttcttttcaccaatttcgagatgaatccctga

SEQ ID NO: 48434 - DNA, 373 bp, Glycine max
  Peptide Sequence Number=SeqID_165212
atggatgggattctcatttctagtgtggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactctta

SEQ ID NO: 48435 - DNA, 528 bp, Glycine max
  Peptide Sequence Number=SeqID_165213
atgactacatttgggtatcacttatcttgtagtatagtgcgtcttctagtatcagctcttattggagtatatatgatacgtgggctccggggggcggagattgagttttacgggcccactgggccagaagcttctcaagctcaagcatttacttttctagttagagaccaacgtcttggggctaatgtaggatctgctcaaggacctacaggtttaggtaaatatctaatgcgttccccgacaggagaagttatttttgggggagaaactatgcgtttttgggatttgcgtgctccttggttagaacctctaaggggtccgaatggtttagacttgagtagactgaaaaaagatatacagccttggcaagaacgccgttctgcggaatatatgactcatgctcctttaggttccttaaattccgtgggtggcgtagctacagagattaatgcagtcaattatgtttctcctagaagttggccatttatggcacgcgggaagagctcgcgcagctgccgcaggatttga

SEQ ID NO: 48436 - DNA, 228 bp, Glycine max
  Peptide Sequence Number=SeqID_165214
atggaacaatcaagtaagggaaaaggaatagctgttgagccagaaagttcaccaccaatttttgttcccatgccatcattgtcacagtcttctgattacgatcctgaaaactccacctgtttaactccaaccaaaaggattagttgtcaacaaaccagttctgatttcgattctgatgagcatacacagtatcagttatcaaataacaaacatatcaaagctgagtaa

SEQ ID NO: 48437 - DNA, 114 bp, Glycine max
  Peptide Sequence Number=SeqID_165215
atgtctccaccatcaagaccgtatataatgaatgacaaagatatcggtgcgaacaaaagggtccaagaatggagaagagttgacactcaagatgttgccaaagatataatgtga

SEQ ID NO: 48438 - DNA, 192 bp, Glycine max
  Peptide Sequence Number=SeqID_165216
gaaacaactgaatcgactcaacgagcatttaaaagtgtagtaattcaggttggtaagctggcagaagaagtgactaaagttatggctaggagagaagaaaactttgtagtggttgaagctcaagaggaaagccctgtagaagagcatgattcaagagaaaaagatgaagaggaaatggaagaggaagcatga

SEQ ID NO: 48439 - DNA, 203 bp, Glycine max
  Peptide Sequence Number=SeqID_165217
caaacagaccaatggcttacacccacattccggtgaaagttgaaaatcctgacctcgcaccctacacttcagagccctacaatgctcaatggaacgccccggggcttctccgtgacaagcacacgttgcgttcgagtcgtattctcggagaaatggaggtggtcttcgtcattggaagtgcggtagacaggctttgtggttga

SEQ ID NO: 48440 - DNA, 282 bp, Glycine max
  Peptide Sequence Number=SeqID_165218
atgaagaacgatgaagaacggtggaaagccttcgcgaaatcgcccacggaaacgtctcagaagcgttacggaagcgcctcagcttggattttcttcacgaaaacaatttttctcactaattttaagggaaaagagggaggtggatgccgcccagctcacccaggcgagctgggttgcttccaccagaaggcaccgccttctgttggaacatcctacaaggcccaagtgggcctgattgctatttgcacacccttgtttactaaatacaccccctccccttag

SEQ ID NO: 48441 - DNA, 414 bp, Glycine max
  Peptide Sequence Number=SeqID_165219
atgacagatcttgtgagcgcggaagatgacgtaaatctccgcgtgtcaacgggcttgtcggccgcgattgacgaagggcgcaggagacgacatagcaaaaaggtttatacggataaccactcgggtatctccgcccgtcagcgtgactcaaaagtcagtatgacagatcttgtgagcgcggaagatgacgtaaatctccgcgtggcaacgggcttgtcggccgcgattgacgaagggcgcaggagacgacatagcaaaaaggtttatacggataaccactcgggtatctcctcccgtcagcgtgactcaaaagtcagtatgacagatcttgtaagcgcggaagatgacgtaaatctccgcgtgtcaacgggcttgtcggtcgcgattgacgaagggcgcaggagacgacgttag

SEQ ID NO: 48442 - DNA, 105 bp, Glycine max
  Peptide Sequence Number=SeqID_165220
atgcggggttcatccatcccaccgggggatcctgcaggctcctcccctgcctgggcatcgggccagtctctcggccatgcgaccttagccgcaaactactctggg

SEQ ID NO: 48443 - DNA, 156 bp, Glycine max
  Peptide Sequence Number=SeqID_165221
atgccctccagatccgatgatgagtccctcgaaggtactaatacctgggacccgaccatcgatttcaagcaagaagcgggtcagatggagagtgaagaggacgaggatgtgggacttcccccggagttggagaagatagtcactcagaaggactga

SEQ ID NO: 48444 - DNA, 207 bp, Glycine max
  Peptide Sequence Number=SeqID_165222
atgtcaggatttacacgtgattctcctcaaatttcagccagcccgcatcaattagaccttgcaccttacgcttcaggcccctacaatgctcaatggaatgccccggggattctccatgacaagcacacgttgcgttcgagtcgtattctcggagaaatagaggtggtgtttgtcattggaagtgcggtaggtaggctttgtggttga

SEQ ID NO: 48445 - DNA, 453 bp, Glycine max
  Peptide Sequence Number=SeqID_165223
atgggtgaagtagaagaggtacaagagcggatgaaggccgacatggaggccatgaaagagcaaatggacacaatgatggaggccatgatgagcatgaagaagataatggaagtctatgcggctgtagtttccgctaccagcaccgttgctgtggtggaccggaatcccctatctggcctcaaccaaataaatcctctagccttggatatgatagctcaaggaggcaaagagttaggaagtacgggtggcccccattttgtgccaattcagaacaagcatgtcttcccgccatatggcttgcctcccaactatacaccacccaatgtggcgcacactcccgatgagaatgtcaataactccacccctatactcattgagagccaacaacctcaatctgatcatgccatgtctctcaacatgcgggaggcacatgaaataccccacacaatctag

SEQ ID NO: 48446 - DNA, 649 bp, Glycine max
  Peptide Sequence Number=SeqID_165224
ggtgtggtgaaagggttttgccttgcaaaccttcccggtgatgcttttagtctatgggggaacttctttgagcaaagaacaatgatggctgatgccaagtttgcgggctgcttggttagccattgcttaagtttttccatgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggtggatcatcatgcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagg

SEQ ID NO: 48447 - DNA, 619 bp, Glycine max
  Peptide Sequence Number=SeqID_165225
atgttgccagtggtggagcccatggagacatgacccctgctgaagccagaaatttaattgagaagatggcttcaaactcccaacaatttagtgccagaagtgatgctattatcattagaggagtgcacgaagtagccacgaattcatcaggtgagactaagaagcttgaaggtaaactagatgccttggttaacctggtaacccaactggccatgaatcaaaaatctgcacctgtcgccagactctgtggtttatgctcctctgccgaccactacacagacctttgcccttctgaagcaattgaacagcctgaagcttatgctgcaaacatctacaatagacctcctcaacctcagcagcaaaatcagccacaacagaataactatgacctctccagcaataggtacaatctcggatggaggaatcatcccaaccttagatggtcgaatccttcacaacagcagcaacaacaacaaccttattttcaaaatgctactggcccaagtagaccatatgttcctccaccaatccagcaacaacaacaactacagcccagaaacagcaaacatccgcaaccttcccttgaagaacttgtgaggcaaatgactatgccaaacat

SEQ ID NO: 48448 - DNA, 676 bp, Glycine max
  Peptide Sequence Number=SeqID_165226
atggctggctggatttgtgtttctgggccatcagggctgcgctatgccagccggtcggtcgatggaggtctgccaagcctcggccaggtccgccagcaggcggtcggcgatatcgagttgctcggtatccgctttcagatttgccgtcagcaaggtgcggacgatgtaatcgtagagccgggcgaggttggcggcgatgtcgccgccggcctccatgttcaacccggtcttcaagccttcatcgacgatcttgatcgctttcgagatagccgcgccgcgctcggcgacccgaccttcctgcaggtggatgcgcgcctgcccgatcgctgcccgggcacccaggtacagcagggtgatcagccgctcggggctcgcgcccagcacctgggtttccaggccgatatcggcgtaggagcggacggattgggaccctgtggggcggcgggcggcgtagttggcggtggtctgcatctgcatgtagaacttgtccagcgccacgaaacgcgtgcgcatctggtcgatttccgcgtcgctggcggccttggcgcgcttttgctgggcgtccaggtcgctcatcgtcttggccaggccgtcggtgcgcgtcttcagcgaaccggtgctgcccagcacgtccttgaaggcggcttcgaagttcttggccaggccgtgttcgccg

SEQ ID NO: 48449 - DNA, 513 bp, Glycine max
  Peptide Sequence Number=SeqID_165227
atggcaaggaaagaggccgcggcagccaacgggtttgctcaacagctttaccttgagcaccacagttggctatgccattggctgagacagaaggtcgggtgcgcgcatcacgccgaagacctggcgcaggatacgttcatcagtattttactgagtccgcagttgcttgccattcggcaaccacgccccttcctggcgaccgtggcgcgccggctggtggcgaattattaccgacgtaaaacaatcgaagagagctatctgcaggccttgagcgagctgccggcgatcgaggcgccctcgccggaggtccgtcaacaaaccctcgaaatgctcgaacagttggatcaggcgttggacggattgccggcgcacgttcgcgaggctttcctgttggcgcacctgcagggcatgcgttattgcgacatcgctgaacgtttgcgggtgtcgaccagttcggtaaaacaatatctgcagcgcgccaatttgcactgtttctttgcattggcggcgtaa

SEQ ID NO: 48450 - DNA, 229 bp, Glycine max
  Peptide Sequence Number=SeqID_165228
gatcgtcaccggccgacagcgatccgatggcgttgtctgggcgctgccgaaaacgtcgggttatgcattgcacggcctgttcgcctcgtggcagccagcggtttgcagggcttcgaaagctcgcgtcgcggtggacaacctgttcaaccgcgattattacccttacctgggcgaatcggtgtccggcgtagggcgcaacatcaagtttagcgttagccaacgtttctga

SEQ ID NO: 48451 - DNA, 249 bp, Glycine max
  Peptide Sequence Number=SeqID_165229
atgttgaagaacggtcgagaatcttcgcgtaattactcacggaaacgttacggaagcgcctcggcttggattttcttcacggaaataattttcctcagcaatatcgagagaataagaagtgccaagaaggggaggagcttgccacccagctcgcccaggcgaactcagctcgcccaggcgagtcaggttgcttcctccagaagcaacagccttctggaggaagaatctggaaggccaaagtgggcctga

SEQ ID NO: 48452 - DNA, 213 bp, Glycine max
  Peptide Sequence Number=SeqID_165230
atgaatctggggatcccacggtcatgtggctccgcatgccaccagactcttgggtcacgcatttcgtttctaaacgaccatataaaggaaatactgggtccaacaaagataggagaaaatcactcaaagtgtatcaatctcacacagcgcgtggcgagaaagtcgctagcgcacaggattttgtcggcaatcaaagggagaggaccactttag

SEQ ID NO: 48453 - DNA, 114 bp, Glycine max
  Peptide Sequence Number=SeqID_165231
atggccctatacccgggttcgtgggaacataaggagtggagtatgttcttcgaaggggatgatacctctagaaaccatcaagagagatatgactaccttgggggttatcactaa

SEQ ID NO: 48454 - DNA, 226 bp, Glycine max
  Peptide Sequence Number=SeqID_165232
aatgaccaaacttggtctcttcttgtcatcgggcccgccgcctctggatgacaaaagggtgcggataaccgtaagaatgaccaaacttggtctctgcttgtcatcgggcccgccgcctctggatgacaaaaaggtgcggataaccgtaaggtatctccgcgtatcatgggtgcagaatgaccaaacttggtctctgcttgtcatcgggcccgccgcctttggatga

SEQ ID NO: 48455 - DNA, 252 bp, Glycine max
  Peptide Sequence Number=SeqID_165233
atgggtgcgaataaccataaggtatctccgcgtatcatgggtatctccgcgtatcatgggtgcagaatgaccaaacttggtctctgcgtgccatcggacacgactgtgtctgaatggcaaaggggtgcggataaccgtaaggtatctccgcgtatctccgcgtatcatgggtgcagaatgaccaaacttggtctctgcgtgccatcggacacgactgtgtctgaatggcaaaggggtgcagataaccataag

SEQ ID NO: 48456 - DNA, 630 bp, Glycine max
  Peptide Sequence Number=SeqID_165234
atggcattcttgggagagacaagaagtcagacagttgtgaactccacattaggtaatcaatttcggtttcaatgtatgcaactgaaagatgatgctgatgttaacacaatgttaatgtgtaatcatgaattttcgtttgttggtccgattgagttattatgtagcattgctagaaacccagatgatattttaaacttacttgaagctactatgacccctacttatgatgccctgctatattataatgggaggtggaacatgtcacgccaaaatgagtttgttggttactcattcacaggaaaaaatcccaaaaactttgacattcccatcggatgtaccatggatgaactgaatgatttgatcaagcaagttgcgcctcatgggattcccccttatggtattgatgaaacacaaatgataaggcgattgttttttcggaaaccaagtcaccatgagtattcagaaaaagttataaaatttgaaataattgaactcaaaaccaacgaggacgtgatgaaggtgctcattgagtctaactactggaaaaagattgggccaatagaaattttagctgttttcagtaaacctataccgcaaatggaagacgagttgtccttgtcgcaaaattag

SEQ ID NO: 48457 - DNA, 584 bp, Glycine max
  Peptide Sequence Number=SeqID_165235
aattatcatttagctctacatttctccagcaattatgtggatctggggtgctagctgatggtcgactagctgatctgattcgaagagttgctacttttggcatggtgttaatgaagcttgacttgcgtcaggaatcaagcagacatgctgaaaccattgatgcaattacaaggtatttggatatgggtacgtacagtgaatgggatgaagaaaagaaactggacttcttaactagagagttgaaagggaagagaccactggttcctcccagtatagagagcttccaaggagtggttgattttcttgctcaagagttgttcaaccagaatgcatctatcatactacacacctacacgatcactttacaaaaaaagatgagagagaaagagagagagagagggagagagacagagagagggcgcgagagaaggagagtgacagacagagacagaagaaatgagagatggagcgaaacagacacggcgaggacgagtgtgaagcagtatcgaaacacggcgaggactagcacaaacagaagaactccaaacggttccccttcaaggagatggaggagtatggattga

SEQ ID NO: 48458 - DNA, 309 bp, Glycine max
  Peptide Sequence Number=SeqID_165236
atgtcaaatgaagaattgaagttgcaggatccacgatgtcggatacaatgtcctgacatcctgcccgaaaatactggagttgctgcacaatgcataagtcaagataaaatgtcaaatgaagcattgaagctgcaggatccacgatgtcggatacgatattttcaggaaaatgatagatctcatccagcacaagcagttgcagcccagaaacgcacattgctatataatcatggaggctgcacgagttctgtaccaagtccgggattgaagagttattttgtgagtttttgggacttgagtgttttgtga

SEQ ID NO: 48459 - DNA, 378 bp, Glycine max
  Peptide Sequence Number=SeqID_165237
atgggtgatcaagaggagacacaggaacagatgaaagccgacatgtcagctttgaaagaacaaatggcttccatgatggaggtcatgttaggaatgagacaactcatggagaaaaacgtggccaccgctgtcgctgttagttcggctgccgaagcaaacccaactctcctagctaccgtgcaccatcctccctctatttttgttgaacccagtgtttcctctaaatggagcaagagcctcgcttttgtccgccgccccacaatctctgccatactgaccctggggtcatgtgacatgcggaaattcccaagtggttatccgtataaactttcttttgctatctctaagactcaaagcatgatagcatgcagcgactaa

SEQ ID NO: 48460 - DNA, 809 bp, Glycine max
  Peptide Sequence Number=SeqID_165238
gaaggacgccgcggctgaagggaccagtgctgctcccgagtttgacagccatcatttcaggagcgctgagcaccagcaacatttcgaggccatcaaaggatgcttgccggcgttggacgttgctggtcacgcccacggaggagggcgtgcgggacatgcggtcatggagaaggaaccaggtgatggatttgacgaggaggccattgcccagctattatgcataccgggtcaggattttgcccggaccgttgtcgggagacaggtgtggatcatgcgcaccagcatgaccaccttgactcagatgtggatgacgttgctgctcagcaatgtcctgcccagcgatcataatttcgacctccctctgccgaagtgtcagctggtgtatgccatcctgacacggatgagcgtccatgtggctcagttgatcgctgacgccatttatttatttgttggtatgccacctaccaggcaccctctagacccagataagtctaacagggccctggggtttccagcattgatcacgggtctctgccagtcatttggggttcccgtcgcacctagtaaggtgattcgaccaccgatcacccgggccttcattgagaagtattgcacgcctagacaggcgcagggtgatgcaccacaggccgtagacgcgccgccaccacctcatcaggctgacccagctgggtcatttgacacagagcggtatttacgacactcggttcgccagcaggcagccaaccacaggaagcaggtgcaggtccatgagtgtctctaccagctcagcctcagtctgcagagccagg

SEQ ID NO: 48461 - DNA, 165 bp, Glycine max
  Peptide Sequence Number=SeqID_165239
atgcagttatccgcccgctcgatgagtgatgaacgcgcagggacagattctgtgccctttatcattcaggagcagcgagtcgagtggaacaacaagttgggtggtaaacgcgcagagatagattctgcgccctttatcattcaggagcagcgagtcaagtggtaa

SEQ ID NO: 48462 - DNA, 363 bp, Glycine max
  Peptide Sequence Number=SeqID_165240
atgtggtataatgaaagaatatcaaaagataaaacttgtgcaactccaagtcaacattctggaattcagcccgacattgtttcaagattaagtcacatgctggatgaacacaatgcccatgctaaaagctttagaatggccagggatagattgacagatggtcaagtcaacaatatcaaattgaaattgatagctgatcgtgaaaaagatggttgtgtatacaatatcccaaatgttcctgaagttgttgcacttattgttggtgattttgacccaagctcaaaaagagatattattgttgaaactcaaaatggacaactacaaagaatccatgaattacactctagctatctggctctatag

SEQ ID NO: 48463 - DNA, 579 bp, Glycine max
  Peptide Sequence Number=SeqID_165241
atgatcgaccctctcgatgagtcgatctcttgctttctcataaggaggactacatgtcctcgtcttcagaggactacacgtctctcgtccgtcaaagggtcatgtaccttcacctttgtagggctacacgccctcacctttagagggccgcacgccctcgccttcagaggactacacgtcctcaccttcagaggactacacgtcctcaccttcagaggactacacgtcctcacctttagaggactacacgtcctcaccttcagagggccgcacgccctcgccttcagaggactacacgtcctcaccttcagaggactacacgtcctcaccttcagaggactaacgtcctcgcctttagaggactacacgtcctcgccatcagaggactacatgtcccccattttcaaagggggacatgccctcacctttagaggattgcacatcctcgccatcataggactacactccctcgccttcaaaaggcgacacgtcctgaacttcaaagggctgcacgccctcaccattagagggctacgcgttctcactctgagtgggccccatatccacaccttaagataa

SEQ ID NO: 48464 - DNA, 144 bp, Glycine max
  Peptide Sequence Number=SeqID_165242
atgtctgaagtggttagaatgcttgaaggagatggtcttgcagagaaatgggaggcctcacagagtgctgaatccacaagaaatggaggcgaagatttttgtgggaaatgtccttctggctccttcaacatgtttgaagaataa

SEQ ID NO: 48465 - DNA, 618 bp, Glycine max
  Peptide Sequence Number=SeqID_165243
atgttgtcatctaataatgctttattatcagctctcctttctaaaattgcggctttaagatcattctcattggataagttgcactactggcgagaaagttcttcaggcatgagtagtttggcttactttctatcaaaggataccgtcgaccattttagcacaattatcaagccactagtttacctttcaatgttttatttcttcaacaatccaagatcttcagtcacagataactacatggttctgttgtgtttagtctattgtgtcactggcatagcttatgtgttagcaatctttcttcaaccaggtccagcccaattgtggtcagtgttacttccagtagttttgactttggtagcaacctatagcagtgaaaaagatagcaaatatataaaatttctatctgacttgtgctacaccaagtgggctcttgaagcatttgtaatatcaaatgctaaaagatacactggagtttggttattaagtcgatgtggtgcactctatactaatggctatgatcttaaacattggtaccaatgtttaggccttcttatcgtaacgggaatcattagtcgcatgcttgcatttttctgtatgataaccttccagaagaaatag

SEQ ID NO: 48466 - DNA, 276 bp, Glycine max
  Peptide Sequence Number=SeqID_165244
atggagagaaatccaacatgcaaaggaagaaggaggaaggtggtggtgtggcatcatgaggagggtgtaggggttgcacggtggaggacgaggttgctatcgtcgtgggagggtgaaggaggtggcgtgatgtggaatacaaggtcgcatgtgaaggaggagctgttgcgacgcgagtatacttatgaggtaagtgttgtggcagaattcaaatgcctattaatggctgtgaggaaggcccactgtttcattcgggttggggctattaatgcatag

SEQ ID NO: 48467 - DNA, 312 bp, Glycine max
  Peptide Sequence Number=SeqID_165245
atgattctcaaggaagtattcaacctggaggtatccatccggctaccccatacaaaacctctcaggctagggtcagaagcaacaaaatactacagatatcaccacgaccagacaatcaccaagcaggagcaagacctgcaggacacccagaggagcaaaataggaaccaggaagcatacagaagaagagcaaaagactaaggtagacaaagacaccaacaacagcgacataaacacaacctccattagaataggaactcgtccagcacatcagaggtgtaatcaacaccattgctggcgacatttcctatag

SEQ ID NO: 48468 - DNA, 684 bp, Glycine max
  Peptide Sequence Number=SeqID_165246
atgaaattccctacactaacatcggagattgtaaccgtcaaggttgaccaaaagcaagtgcgacagtgctatgtagtgagcttgaaggtagcaccatatccttccatccgggagcttgtcatgcttgacagtagacgaagcatgggaagagaatttgacatagattcgcgagacgacacatctgacagaggcttgaaaccaattgaagagcttgtccaattgcaactcggacctaaatcggggaaatgcacgcggctcaattgggacctcaccaatcatgagcatcggtgcatccctgacgtgctacacagaaacgcggatttatttacctggtcgctatctgacatgtcggggatccatcccgacataatctaccacaaattggctatctgccccaggccaaacctatatcatagaagaaaaggcaaaccggagaggagtggtgtaaagtcgtcaaagaagaagtcgaaaagctcctccatgcaaacttcatcagagagggcatgccccaaagatgcataccctctccacaacaccgacaggttggtcgatggagcatccagatacaaccatatcagaatgcatcctccagacgaggagaaaatgaaattcatcactgaaaatgccaacttttgctacagggtcataccattcaacctaaaaaacgtaggcgtcacatattag

SEQ ID NO: 48469 - DNA, 1215 bp, Glycine max
  Peptide Sequence Number=SeqID_165247
atggatcaagaggtcatctcgataagcggttcctcgtcaaaggatacttgtcgaggacttcgcactgaattggtaggggtacttctcgccctcacggaaggacatgactttctgctgatgccagggagtcagtcctggtactatgatgcttttaggggtgcaaggagagctagcggtgagaaagatgtgaggatgtctccacgcgtacgacctagcatgtgtggtgggtcgtcttcatcaccctcgggtgttgctgactatgagtgggtgaaggatgatgggttgaagtataagtcctgtttgaccacaacagcgagtgtcgctgcgcttcaacaccaggtgaagctggtgaaccctgagggctcttgtcctatggatcatttttcccttgaccaccttttagtatgctccgttggagcacttgaatgtggtccattcctagctccacccaaacagttggacaatgggatggcgagccctacttctcgttctactagtaatctgatcccaccagccatcttgtctcttcctttggtgagcaatcctctcgctgccttggatggtattatgggtgactttgcttggaggccattcgtgaagcaggttggacctgtaggtgagaccgtaccatcatttgctgctactccatttgctagagaagggggatggatgatgtttttggactggaagaagtcgaaggcccctatgagtgtccgtgccttgaggcaagctgcagggctagggcccactgcgggttaccttacgactacgcaagatgtacctccggctccaccggtcgtcaaggctcctcctactgctgctgctactcttactacttttgctccttcacctcctctcgtggctatggttcaggaggtttctcccactattgttgaagctattgtgctagctgctcaggctgagtctgttgtggtgtcgtcatctactgtggcggctcctttactaagtgccggtgtagcgaccactagtgctcccacggtgctgcttctgtcttcgttggcttcagtggtcatgcctattgttgtttttgaggatatggcgtcaccttcttcgtccttgcgccctcgcatctccctcgatcatttatacacctctagtgatgctgactcaatgtggggcacgcttagcacgtctaaggcgctcaacgcaaagcataggctcaatgggaacaacacgcttagtggcaggaagtag

SEQ ID NO: 48470 - DNA, 264 bp, Glycine max
  Peptide Sequence Number=SeqID_165248
atgtacatcaagtatggcccaaaatacatcatgaagcatagccaacaaaacaagcttgtagtgagcttcaaaacaaggaaagggaaacaaggctcaaaagggctatcaaaggaattaattcaaggtaagtccatttggctagaagcttataagaacaaaattgcctcaatcatttccaaatatgcatgtgaattaggaagcatcaacaagaatcaagccaaggctattgtgcaagcaatcaatggggcaaaacacaccaaatga

SEQ ID NO: 48471 - DNA, 210 bp, Glycine max
  Peptide Sequence Number=SeqID_165249
gagtacgtgagctcagttgaaggtgggcaactggggatggtgggtttcatgtgtgatttgtggatgtggagagtcgacttgcaccatcgcccgatcgccacctatggtacttggagatatgtcgcagggggtcaggagaccttggggacgtcaggtggggtgctattggccaaaaccaagcttgaccaatcccgacccaacccgggcata

SEQ ID NO: 48472 - DNA, 558 bp, Glycine max
  Peptide Sequence Number=SeqID_165250
atgggagctcgatcgattccaaatcaaaggagaattttgtgcatgaacaagattgatctagtagagaaaaagaaagacttattgaaggttgccgaagaattcaaagatcttcctggatatgaaaggtatttcatgatatcaggactgaaggggtctggagtaaaagatctgactcagtacttgatggagcaggcatgcatctttctacttctactgtctactagatttcaacgaccctgggaagaagatccatttaccatgagtgaggaagttatgaagatgatagcattagaagttgtgcgtgaaaggttattggaccatgtacatcaggaaattccgtatgatgttgaacatcgattgattgactggaaagagttacgagatggttctcttagaattgagcaacacttcatcactaacaaattaagccaatgcaagattcttgtggggaagaatggctcaaaaattgggagaataggaattgaagccaatgaagagctaaggtccattttcaaaaagcaagtgcatctaattctccgagttaggcataaaaagtga

SEQ ID NO: 48473 - DNA, 201 bp, Glycine max
  Peptide Sequence Number=SeqID_165251
atggaggtaccttccataatatatacagtttctcaggatgatgaagcagaggaaactcgtgaaattgaacctcaacaagaaaattctgcatccgaacttgcgaaggttttccttgcttctgataaagcaaaccccgctcaatccaggaatgttatccatgtctcaccattcaaattcagtttccttcacaagcatgtatga

SEQ ID NO: 48474 - DNA, 1845 bp, Glycine max
  Peptide Sequence Number=SeqID_165252
atgcagtgttcaaaactaatgaagggaacatacatttctcttctcaaaagctgcaaatccatgtcccaattgaagcaaattcaggcccacatattctgtgttggccttcaacaagacagagacaccctcaacaagctcatggccttttctatggactcatcactaggggattttaactatgcaaacagaatcttcaactacattcatgacccctctttgtttatctacaacctcatgatcaaggcctttgtgaaaagcggtagttttaggagtgccatttctctttttcagcagctgagggaacatggtgtgtggcctgataactacacctacccttatgttttgaagggtattggttgcattggggaggttagggaaggggaaaaggttcatgcttttgtggttaaaactggccttgagtttgacccttatgtgtgtaactccttcatggatatgtatgctgagttgggcctggttgaggggttcacccaggtgtttgaggaaatgcctgacagggatgcagtttcttggaacatcatgatttctggttatgtcagatgcaagaggtttgaggaggctgttgatgtttaccggcgaatgtggacggagagcaatgaaaagcccaatgaagccacggttgtgagcactctgtcggcttgtgcagtgttgagaaatttggagcttggcaaggaaattcatgattacattgcaagtgaactggaccttactactataatggggaatgctttgttggacatgtattgtaagtgtgggcatgtgagcgtggccagggagatttttgatgcaatgaccgtgaagaatgtgaattgttggaccagtatggtaactgggtatgtgatctgtggtcagttggatcaagctagaaatttgtttgagaggagtccaagtagggatattgttctttggacagctatgattaatgggtatgtgcaatttaatcgttttgaagagacaattgcattatttggggagatgcagatcagaggtgtgaaaccagataagttcattgtggttactctccttacaggttgtgctcaatcgggagctctggagcagggcaagtggattcataattacatagatgaaaacagaatcaaggtggatgctgtggttggtactgcccttattgaaatgtatgctaaatgtggttgcatagagaaatctttcgaaatttttaatggattgaaggaaaaggatactacctcatggacttcaattatttgtgggctggccatgaatggtaaaccaagtgaagcacttgaattgtttaaagcaatgcaaacatgtgggttaaaacctgatgatattacttttgttgctgttttaagtgcttgtagtcatgcaggattggttgaagaaggccgcaagttatttcattccatgtcaagtatgtatcacattgagccaaatttagagcactatgggtgtttcattgaccttcttggtcgagccggacttttacaagaggcagaggagttggtgaagaagttaccagctcaaaacaatgaaataatagttccactctatggagctttgctgagtgcctgcagaacttatggcaacattgatatgggtgaaaggcttgctacagcactggcaaaagttaaatccagtgattcaagtcttcatacacttcttgctagcatttatgcttctgctgacagatgggaagatgtgagaaaggtgagaaataaaatgaaagatctgggaatcaaaaaggtgccaggatatagtgccattgaggtggatggcaagtggcaacagaggttaagtgagggccctttcccatttccggacaaaaattggtcttcctgcaggggatag

SEQ ID NO: 48475 - DNA, 186 bp, Glycine max
  Peptide Sequence Number=SeqID_165253
atggtgcacggttcaccgaagcttccagtgacaaaccaatcagcaccgagtgcaccacaatccccacgaatgatgcggtatgagttgaaagagggtggaaagtgtggtttgaatgatgcggtgaaggtgccaacttatagggtggcgggatgtgtgggggaagtgtttgttgggccgtccgactag

SEQ ID NO: 48476 - DNA, 384 bp, Glycine max
  Peptide Sequence Number=SeqID_165254
atggaatgtgtgaaatttatgaagaacactaatgcattgcaagaagagttaattctaaatggtataagagaaccagcatccaatgtgggacttggtgatggttttaatggtgaagatcagtttggcttttatgatgttaaggagaacatgggtattgatgatggtatcaacgatgttgttgaaactgaaaatgatgtaagtgaagatgatgcaaatgagggtagtgatgtaagcaaagatgttgcagctcctaaagcgcataagaagttgagtgctacagatattctagaaattgatacatttagaaaagttggtataaggccttctcaaatgatgggtgatggaagcttgcttgtgggacttctatggaggttggatctttga

SEQ ID NO: 48477 - DNA, 195 bp, Glycine max
  Peptide Sequence Number=SeqID_165255
atggcgccaaatttgatcgaggccgtacccgaatcaaataaacatgaaaatgcaggagaactgccaggaaaccacattacaagcgaaacctcaaagagagttgggcttcgtcctcaaaaggaaacaacaccagaaaatctagccttccatggattcaaacagaaaatgcaattgaaacatgaagcagaaacgtaa

SEQ ID NO: 48478 - DNA, 780 bp, Glycine max
  Peptide Sequence Number=SeqID_165256
atggatgcgttccgcaccccgccggccgatgcggcgatcgctccactctccggcggtgagaagcgacgagtcgctctggcaaagatgctgctccagaagccggatctcttgcttctggacgagcccaccaaccacctcgacgccgagagcgtgctctggctcgagcagcacctgcaggcgtacaagggtacggtcatcgcgatcacccacgaccggtacttcctcgaccacgtcgccgagtggatcgccgaggtcgaccgcggtcgcctgatcgggtacgagggcaactactcgacgtacctggagaagaagggcgagcgtctcgagatccagggcaagaaggacgccaagctcgccaagcgcctcaaggaggagctcgagtgggtccgatccagcgcgaagggccgacagaccaagtcgaaggcccgtctggcacggtacgaggagatggcttccgaggcggagcgcaccaggaagctggacttcgaggagatccagatccccgcgggtccgcgtctgggcaatgtcgtgatcgaggcgaagaatctgcagaagggcttcgacgggcgctccctcatcgacggcctgagcttcagccttccgccgaacggcatcgtcggcgtgatcgggccgaacggcgtcggaaagacgacgctgttcaagacgatcgtcggactcgagccgctcgatggtggcacgctcaagatcggcgagacggtgaagatcagctacgtcgaccaatcgcgtgcgaacatcgatccgaacaagaccctctgggag

SEQ ID NO: 48479 - DNA, 5175 bp, Glycine max
  Peptide Sequence Number=SeqID_165257
ctaataggagtttctgtggctggtcttgaacctgaatttcaaccggttgtaaattacttgctgcctaatattttatctcacaaacaggatcctcatgatattcatctccagttgttgcaagacatgacaagtcggttgcttgtatttcttccacaactagagacagacctttccagctttcccgacagtcctgaatctaaccttcgatttcttgccatgcttgctggtcctctttatcctattcttcatgtggtgaatgaaaggacaacttcaaaacctccaggcaatatcactgaccttgatgtctccaaaagtagtcaactgtcaccaaccctaactgtttcctctaactttgaggcatctagaattatgcagaagctaataaatccagatactgagcaagatgtatcaaaacctcaagatgaagtaacatctcctttggaagataaatcaaattcggaactgtctagttctttcactttagttgattattcaaacctgttgggtgaggagttccagatgccatatgagcagtgcgattgcagctatcttaatatattagatattggggctgtggaagaaggaaccttacatgttctttattcttgtgcatcacagcctgttctttgcagcaagttggcagagagatcttcagatttttgggctgcactgccacttgtacaagctctgctgccagccctacgcccatgggtgagcaattcttttgatgttgttgacgacactttctctcagtggaagcaacctattgtacaacaggctttatctcagattgttgctacagcaacatcagccgcatatcgttcgcttgttcatgcttgtgctggttatctgtcttcatactcaccatctcatgctagggctgcatgtgtactgattgatctgtgttctggtgtgctggcaccgtgcatgactcaagtgattgcgaaggtcgatcttgctctggagcttttggaggatcttttgggcataatccatgatgctcacaattcacttgttcgtgctcgtgctgccttgaaatatattgtgctagctttatctgggcatatggatgacatacttggaaaatataaggaagtcaaacacaaaatcctctttcttgtggagatgctggaaccttttcttgatcctgccattgctgtatcaaaaagcaaaattgcttttggagatttagcttctttgtttccagaaaagcaggaacataattgcacaattgctctaaatatcatccatactgctgtacgaaagccagctgtgctgccttgtttggaatcagaatggaggcatggatctgtggctcctagcgtgcttctctcaatattggaaccacacatgttattgccacctgatgttgacctctgcaagtcagttttaagaccaaccgatcatgaaactgcatctatttcacctctttcctctggcattagtggtggaggtgatttttccaagtcaaatggtcaagatgagtctattggaaaaacagatgtttcagaaacagcaggaaaatctgattttgttgaagatcgtaatctactttttgccccaccagaactgcagagtatgacattgacagatttctctaatattcctaatcaaaatagctctgtttctaacattggggatatgagcttggaacccaaacatgtggctgagaaacatgccagccatcattttcctactagtatcttggatgctggccttggttttgaatacttcaacctgcaggcagattattttcaactattaaactacaatgattgtgaacttcgtgcttctgagtttagacgcctggctttagatttgcattctcataatgatgtctctgttgaaagccatgatgctgcaattgatgctctgctgttagcagcagaatgttatgtaaatccttattttatgttgtctattggagcctcttcaaaactgacggacctcttgaatgttaatgaatttaaagcggtgcagtctcatgataaagttaaggctgcagaattggacaggaaatatcatttacaagtatctaatggggaagatgaggcttattctgctgaaggttttgatgaacagggagaccaaatctcaatgcatgaaattctcctacagagtcttgtgtacattttacacacaggcaccaagttatattgtcctccagaacatgtgattgatatcattttaaaatatgctgaagacttgaacaagttgctggcatcttttcatcaccagctgaaggaaggtgaagaacaaacttttggaactaatgtccaaaataattacctctgtggaaatttaattccttcttcagcatggatgcagagaatttctcatttttctggttcttcataccctttggttcgatttcttggttggatggcaatatctcataatgcaaaacagtatatgaaggaccgcattttccttgcatctgatctgtctcatctgacatatttactttctatttttgctgatgacctagctgttgttgatggtgttgtcgataaaaagtatgaagaggtaaaaattgaagattcacggcttgaacacagttcttctgctaagagggaatttgagcgaggtaatcaatgtgatgaggaacgatctttttgtgcaatatatcctgaactctggaagttctttcctaatatgaaaaggcaattcaaatcttttggagaagccattttagaggctgttggtttgcagctgagatctgtttcttcgattctggtgcctgatgttttgtgctggttttctgagttgtgtttgtggccattttcttttgcatcttcaattggaagtgataatttaaaaggctataatgcaaagaatgccagagcaataatcctttacatacttgaagctattatagttgaacacatggaagctatggttcctgagactcctaaactagtgcaagtgcttgtgtcactctcaagttctacatactgtgatgtgtcatttcttgactcagttttgcgtttgttgaagcctatcatttcttattctttgtctaagatctctcatgatgaaaagctattggatggtgattcttgtcttaactttgaggagttgtgctttaacattcttttcatgaaactgaaacaaaagagtgagtttgaacatagttctgaagataaagaatacaatacagcgctgcctatttttattttggcttcaatttttcctgatttatccatccgatataggagggagtttttgcagtctttattgaaaccggcaaactttgctgcttttgccccaacaacttctttctttgattatctcagtgcatttcaatgtgttatggataattgcaaattactattagtgaatgcattaacagaatttggtgtgattcctcttcggctgcctccttatcctcatgcaaatggtgctggactttctgatgataacttgaaaccaaatccatggtttcttagtgatgtctgttgcacttcatgtgagaatgatgttcataatgtagaaagtaacaactctgatgttggtcattgtcatttaccttctgatgatttagaaggcttttgtaaggacatagagggtctcattttagaacttaatccagctattgagcgctgttggaatcttcatcatcagataagtagaaaactaacgatagcatttgccgaatgttttgttttttcaaaatgtttgacatcagtttctcaaaaatttcataaagctgaagatgacgatcaaaattcttcaccaactaaatcatctgacatattcacacttcattggagatttggtcttcaaggcctttgtgaattgatcgttatgcttcaagaaagcagttgctgggaagtttcttgcttgatgcttgattgtttacttggagtacccgatagtttttgcctggatggtgtggtaggcataatatgttccacaataaagaatgtttcttgcagtgcaccaagaatatcttggcgtttgcagattgataagtggttatcttctttaatctctagaggcatctataacagtcaagaaagtgaggtttctctgatagatctattttgtactctgctagcccatgctgaaccggagcaacgtattgtagcagttaagcatttgggaatacttcttggtcaatgtacaaatggagaaagagctgagatgaattctaaaatttgcactgacttcattcgaaataagttagttttatccattcctaattatgttctttctcgtctggtttctagtacttgggatgaagttgttgtgctggcatcatctgatttgtcattacaaataaggattcatgcaatggcacttctgtcaaattacattccgtttgctgagcaccatcacttgcaatcttttcttgtggcagctgatagcatttgttgtttgtgtaatgcacaaccatcacaagagggtcctatcctgcaactttcattagcacttattgcttatgcttgcttgtactcaccagctgaagatatttctttgattcctcaaaaagtatgggaaaatgttgaaactttagggtcaacaaaacatgatggcaagcttggagacctcgcaaagaagacttgtcaagtcctgtgtagattgagggatgaaggagatgaggccaaagaggccctgaaagaagtactttctcagaattcttcaaagcagtatgacccggacttttctaatactcgtcaatctgttgtccaggtccttggcaacttaactgcagttcactcatactttgatttattctcaaggaaaattgaccaagatgatatggagcttgaggaggctgagttggagctagacataattcagaaggaacatgcattacaaggacgaatggaggattccaaagattggaatcagattccaggtcttccttcctacaaaaaggatgtctcaaggcttcagcaaatcagagagtgcattcgttccttagaaaagtccaaacttaaagaagatatcatagcccgtaggcaaaagaaactactcatgagacatgcccgtcaaaaacatttggaagaagcatctttacgggaggcagatcttctgcaagaacttgatagggagagaacagctgaaatggaaaaagagctggaaagacaaagattgctagaaatagagcgtgctaaaacaaaggaactgcgtcacaatcttgatatggagaaggagaggcaaacacag

SEQ ID NO: 48480 - DNA, 249 bp, Glycine max
  Peptide Sequence Number=SeqID_165258
atggggtttggagggaagatgtgtgatgttgggattttggatggagaagggatttgtgaggaggttctgggtgctttttcggttagagatgattatgtagcgctacatgaagagcgggtaggatcacaccaagtggaggttatgaagcactttggaaactcaagggtccaacataaggcttgctttctaatttggcgcataataggaaaaaaccacaagtacacagttttgacagttatcgttaagtaa

SEQ ID NO: 48481 - DNA, 255 bp, Glycine max
  Peptide Sequence Number=SeqID_165259
atgagctcaaaatataccctaaggttcatgagaatcctatggccttctcctgcatctcaatttggctcaatcttcttagagtcttctatccaatgcccttggggggtaggattgcatcaaattggttcacaaagacaacaaggtggaggacaagagggtggaaaagaacaaattctcatagaaaatggtgggcaaggggaaagtgcctatgggaggggtctcagaggaaagcctggtgaaagagatgaagaatga

SEQ ID NO: 48482 - DNA, 645 bp, Glycine max
  Peptide Sequence Number=SeqID_165260
atggcggaagggttatgtggtatgatgagggaagcagttaagaagaatctctatcaaagcaacaaggtaggggataatgagatgcaagtaaatcttctccaatatgcagatgacaccatttatttaggagaatcgacgttcgataatgtggtggtcattaaaagtatcttaaggtgcttcgaacttatctttggtctaaaagttaatattttcaagagcaactttagggcaattggtgttggggaaaggtggtggaaaggtgtgaattttttcaagggtttgctgtggagtgaagtgtcgaaatcaaaatatggagggtggaaaggtcttttatgtgaggagtgtctttcatcttcatctatgtggtggagggacctaagagaggtgagtggtgcgaaaagtgagtcaagatggtttgagaagtttattgagtggaaggtgggagatggtgaaaagacaaagttttggtttgataattgggttggggatcaaccattgggaatatcttttcctaggttgtttctaaactctaataaaaaaatttatatcgttgcaaacatgggagggtgggaatttgagtggcgtatatgcagttttaaacgtaggggagggagactcatggaagtggttgctggaggatactga

SEQ ID NO: 48483 - DNA, 516 bp, Glycine max
  Peptide Sequence Number=SeqID_165261
atgaatgagctagaaagaaaggtaaatcatggggagcttggtgaggaggaaagaaatagaaagttatcactacaagaggagctttggaagattgtgaggcataatgaatctctagctagacaaaaagttagagcaaggtgggtcgtggaagtggagtatcatgagcatggaatcttgcctaggggaagcaatgcatcatttatttccattattccaaagtttgagtggccaatcaacttgggagattttaggccaatatcattggttggttgcatgtacaagatattggctaaaatactttcaactatgcttaaaaaggtgttgggtggtgtcatggatcaaaggcaaagtgaattttttggaggaagacacttattgcatagggcacttgtggtaaatgaggtgattgaggaagctaaaaagaaaaagaaaaagtgtttggtgttgaaggtggactacgaaaagcgtatgattcgggaaattgggaatttcttctgtacatcttacaaagattag

SEQ ID NO: 48484 - DNA, 207 bp, Glycine max
  Peptide Sequence Number=SeqID_165262
atgatgaggagaaactgtcttgccaagcaagaattgattttcacaaacaagattctgaatttgagagatgatgaattagtgatgctacacggtgttacggaagatcttcatcaaagagagtgtctgactatccagttacatgcttgtagagacaagaattcgtccatgaggaaggaagagttaagcgagttacttaatggctcttga

SEQ ID NO: 48485 - DNA, 444 bp, Glycine max
  Peptide Sequence Number=SeqID_165263
atgtttgggaatatttttagaaaaaaatgtcagttggaagcttgcataaaaggaatccacactaagcttgacaatggctcttcttcctctctcattgctttggagaagcatcttcaagatcagtacaaccaaattcttcaccaagaggagatgttgaagtatcaaaagtctagagagaagtgggttagatttgtggatcatgctatctctactggccatatcaataaaggtttggctgagaccttgattgttcctattcctatggttgataatcccatcaccttcagagattttcgcccgatcaacttatgcaatgttcttcttaaggtggtctctaaggttatagtgaatagagtagggcctttcttggacaatattattgggtcccttcaaagtagttttatcccaggcaggagtacaagtgttagtgctattatagcctag

SEQ ID NO: 48486 - DNA, 588 bp, Glycine max
  Peptide Sequence Number=SeqID_165264
atgggctcctcatattgtcgggaagaagcccttattcgcctcaccaaccaaaatgtgtacttgggtgagtctatgaattatatgactctgaaaattgatgagcttatccagcgccttggccctaccttgtccactctttcacccacttcatcgcctttgcctccgccttcccctggacctgtagttacacacagaatgaagttagaaggacctcggtttgatggcactgagccactcagttggatctttatgatcaatcaattttttgagtaccatggtactccagagcaggacaaactcaccattgcttcgttctacatggagggtcaagccctcacatggttccagtggatgaacaccattggccagttcacctcatggctggtgttcctcaaagctctgtgcacacgctttgctccgtcccaatacgatgaccctaccagagcattttgcaagctaactcaaaaaggcaccgtggcccaatacctttcggagtttgaggacctcgccaatcgcatcattggacttccttccccctttctccttagttgcttcatctccggtctcgcaccggagatacggaggtag

SEQ ID NO: 48487 - DNA, 516 bp, Glycine max
  Peptide Sequence Number=SeqID_165265
atgaagatggtgatggtggtggtgttgaagatgcaaaaggttatgaagatcttggttcaaatgcacaagagaaaacaacaagaaactgatgagattgctcaaaaaatagccaagaaggtttgcatccataattttggaaaggttggtgaatgtaaagctatcacatgtaaagaaaatggagtaatctattatgatgaagatggaagtaaaaggaattgtattccaacctcaatgaaagaaaaaagactagcacttaagacatcaagggtacattttaaagaatttttggagttgcaagatgatcttgatgtttggtacatcttttcaaacaatgtgcatgctatgctaaaggcttatctggtggaggcaacttccaaatttattgttaaagcaacatgtaatatctctaattttcaacttcttggcggctctcacactgacatttcatgtggtgacactttactcaacatccttgttggtcagaatcctccaccagtcagaaccctctataggtag

SEQ ID NO: 48488 - DNA, 261 bp, Glycine max
  Peptide Sequence Number=SeqID_165266
atgtcagacaccgtcacctacactgctcctctgaagcaactcagcctgcccctcactctggccactgtgccaagcttgatgagtgaggcaaaacgtgtggtgaggccgacagagagggaattggcgtcgttgagccagagcaagcaggggacacagccgatgtcgtcattcatgacgaagcggaggaaccaatcgtgcttcaactcctgcaacgtgatagtgcccatgatttccatgtgtgagatcaggattcctctatag

SEQ ID NO: 48489 - DNA, 240 bp, Glycine max
  Peptide Sequence Number=SeqID_165267
atgggttgtagatctggtggaatttgtgtagatttggtaatccttgaacagataaccagttccccatggaacaactttttgttcatgatgtactatggcttggttatagaagactttgagaccaaaatcaaccttctcaagcttgcgcattttgctgttataatttctcgacaatattctgagaaagaagcttctgttggttatcttggacgggttattcggaaacttcaagacatataa

SEQ ID NO: 48490 - DNA, 318 bp, Glycine max
  Peptide Sequence Number=SeqID_165268
atggctttgagtgaaaaggcaatgggtcctggctcaaaattgactagttttgagacaaatgtgtttgctatggaaagcaataccaacactataccttgtgtttgctatggtcttgggacgacaaaagtggattgcactgcccatgcatttctgcttgggatgccttggccatcgtcatgtgctaatgtccatggctatgtagcctccttcaccagtcacatgggacaggtgtctgttcgtcactctcttttgtgcgaggatgttccattctatatacctaaaaatggtcttcaccttgcattggcttccttgtcgtaa

SEQ ID NO: 48491 - DNA, 3132 bp, Glycine max
  Peptide Sequence Number=SeqID_165269
atggctgaccacgcaaccaggaagacgaccaccgatcgccttgaagaggctatcgttcgccttaccaacagccacaccgccatcaacgaccgttataatgacctttccggtaaggtcgacgccatacttgagcaccttcgtttacatgactcagccaaccacaccccttccacaccgacaaatcttcccaagcattcgcgcagcgcagtcaaaatcgatataccaaggttcgatggccgtgatcctttgggatggatcttcaagatcacacaattattccaatatcagaacactccagaagatgagcgcatcacggttgcatcactgtaccttgacggtgccgccctaagctggtatcaatggatgttcaacaatgggttgatcacgtcttggaatgggttcctcgaagcactagagtctcgattcgctccaactttttacgaagacccaaagggagccttattcaagctcactcaacgtggaacagtgaatgagtatcttactgaattcgagcgcttagctaaccgtgtcacaggccttccacccccgttcttactaagttgctttgtctccggattgaatccagaactgaaacgcgaggtaatggctctccaaccgatttctcttttgcaggctacagcgttagccaagttgcaggaggagaaattacgtgatagggccaacctagctccacgtaattttcccccatacaaaacctcctctattcctcctcctagctctgtcggcaagcccaagtcctcgtttgtccagcgcacacctgcagaaatggccttcagaagagagaagggcctttgttataattgtgacgagaagtggggtgcgggtcatcgttgcaagggaaaagtaatgctattcattgctgatgaacagcccactcttcctgattccgagaacctggaggtcgaagatgatcgcgttccagccataactagccatgaagcacttcggggtgatgttgattgctcacacatcagtctccacgctctagccggagttccatcatcggaaaccttccgaatttacggcagcatcaagaacgcaaagctaacgatcctggtggatagtggaagtacccataacttcctccagcctaggatagcacaattccttcatcttccaactgcagctacccacccactccgagtcatggtaggaaatggagaaatgctgacaagtgatcaggtttgtttggagaccccactcgtgctacagggcaatcccttcatcgtttcatttcatcttcttccgataagcggagcggatgccgtgctggatatagacttggctgaggcaattgggcccaatcgtgatatctccttacgtgcagacgtcgcgattgggcctgaacccgcttcagcaacccaattaaaacgtcttattcagacgggctcgacctcagagttctatcagctgcacgtcatttccccaaaccagcccgacccacctgatttcccccaccatattcaatctatagaactcctacttcaacgatacgctcatctctttcaacctccgacgaggcttccccctccacgacaggtggtacaccgcatcaccttgcaaccatccacggccccggtaagtgttagaccttaccgatatccatattttcagaagaatgaaatcgaacagcaggtttccgaccttctctctgccggattgataagaccaagtaccagcccttactcctcaccggtgttactcgtgaagaaaaaggatggtacatggaggctatgtgtcgattaccgtgctctcaactccaatacggtccgcgaccgttttcccattcccacgatagaggagttacttgatgagttggggtgcgcttcctggttctctaagctggatctctggcaaggattccatcaaatcttgatggaggaacatgacgtcgagaaaaccgcgttccgaacgcacaatggtcactttgagtacctggtgatgcctttcggactttgtaacgctccatcaacattccaatcagccatgaatcgactccttcaaccatttctccggcgatttgcaaccgtgttcttcgatgacatactaatatacagtgattcattgtcatcacatatccagcatctcgagacagtctttcgtacccttcagcaaaacgaattcttcctcaaacgatccaagtgtctgttcgcacaagagagcatcgaatacttgggccacattgttttcgggaagggcgtgaagccggaaccatcgaaaattcaggccatggtacgatggccaactccctcgacggctaaggagctacgtgcattcctcggacttacgggattctaccgtaagttcatcaagaactatgctgccatggcgtctcctttgaccaagctcttgtgtacggatgcctttcaatggacacctgagtctcaaattgcctttgataaactcaaaactgccatgaccagcgccccagtactggctttaccaaacttctcggacccattcgtaatcgagaccgacgcgttcggaacaaccattggagctgtgctcatgcaacatggtcaccctttggcgtatttcagtaagaatcttggcccacgtttacttcatgcttccacgtacatacgtgaattacacgccattgtagcagcaattcggagatggcggcaatacctcctcggtcgtcctttcacgatcctaactgatcacaaaagcatacgcgagttaatgactcaagtcattcaaactccggaacaacattattacctttcgaagttactcaggtatgattattccatacaatacaagcctggtgcatctaacgtagtggctgatgcgctttcgagaacgccggccaccgacggggagctactcatcctctccattcctcagcttgacttccttcaagatatcaagcattcattaaccaccaacctggagtttcagacactcgcaaaggcaattcagaatgaccctacatcacattccgactacaccctttgtgatgggctgatcttattcaaggggcgaatctggcttaataacggaaacccttctattcctagcttattacttgaacaccatgcaacccctttgggcggccacttgggtatcacaaagaccatacatcgaatcaccgctagtttcttctag

SEQ ID NO: 48492 - DNA, 2964 bp, Glycine max
  Peptide Sequence Number=SeqID_165270
atgggtcttagtttgaagatgcagagccaccatcctgtggctttgaggttacatgatcaaatggggtctaagagaaagtacacattcattcaggctcatagagcttggcttccaaagtttctgctgctgtggatcctgctaatggctttgatcagttggtgcatctatagcaaaatggatgatgacactaaagtccgaaggaaagaggttttgggtagcctctgtgatcaaagggcaagaatgttgcaagaccagtttagtgttagtgttaaccatgtccatgcccttgccatccttgtttcaaccttccattactacagatacccttctgccattgaccaggaaacctttgctgagtacactgcccggacagcatttgaacggccgttactgagtggtgtggcctatgcgcaaagagttgttaactctgagagggagagatttgagaaagaacatggatgggttataaaaacaatggaaagaaagtcttcactggttagagatgagtatgcaccggtgatattcgcgcaagaaactgtctcatatcttgagtctcttgatatgatgtctggggaggaggaccgagaaaacattttaagggctagagccactgggaaggcggttctgactagtcctttcagtcttttgggttctcaccatctcggtgtggttttaacattccctgtgtacaaatctaagctccctcagaagccaacagtggaagaacgcattgaagcaactgcaggatatgttggaggatcctttgatgttgagtcccttgtaaagaatttacttgggcaacttgatggtaaccaagcaattttggtgaatgtatatgatattacaaactatactaatcccctagtcatgtatgggaacctatatgaagaaggcgatatgtctcttgtgcatgaaagcaagcttgattttggagatccatacaggaaacatcagatgatatgtaggtaccatcagaaggcaccgacaaactggatagctcttaccacggcattcctattctttgtgattctttttttagtgggttacattttatatggtgctggaaaccatattgtcaaagttgaagatgatttccatgcaatggaggaattgaaagtccgagcagaagcagctgatattgccaagtcccagtttctagctacggtctctcatgaaattagaacacccatgaatggtattttaggaatgcttgctctgcttctagatacagaattgagttcaacccaacgagattatgctcagactgctcaagcatgtggaaaggcactcataacattaataaatgaggtgcttgaccgtgctaaaattgaagctggcaagctagagctggaggctgttccatttgatcttcgttccataattgatgatgttctttctcttttttctgagaaatctagacacaaaggtttagagctggctgtgtttgtttctgacaaagttccggatattgtcatgggagatcctgggagattcagacaaataataacaaatcttgttggcaactctgttaaatttactgaacaagggcatatatttgttaaagttcatctagcagacaatcgaaagtccataatgaatggaaaacacgatacttttctaaatggagaatcagatgaagttttccatatatctggtgattatcatttcaaaaccttaagtggatgtgaagctgccgatgaacggaatagttgggataattttaagcatctaatcgctgacgaagaatatggccttgattcttctagagaaacaatggctgcttgtgaatcttctgagcaagtcaccttgagggtgtgcgtggaggacactggaattggaattcctttctcagctcaggatgggatattcatgccatttgtgcaggctgacagctcaacctcacgaaattatgggggtactggtattggcttgagtatcagtaaatgtctggttgagctaatgggtggtcagataaacttcataagtcgaccccaggttgggagcaccttttcttttactgcagtttgtgaagcatttaagaaaagttcagttaccaacaagaagaaaaatttggaagatctgccttcaagttttagagggatgaaagtcattgtggttgatgggaagcctgttagagctgctgtgactagataccatttgaagagactagggatactagttaaagttgcaaataggatcagtaaggctgttgctttatgtggtaagagtggttctttgaaatcgggaatgttccagcctgatattatcatggttgagaaggacacatggataactggagaggatggcattttcaatacatggaaacataatggtcgtacgattaagatgcctaaaatgatccttctggcaaccaatattagtaatgccgaatttgataaagctaagttcacgggtttcactgatactgtgatcatgaagcctctgagagctagtatggtggctgcttgtcttcagcaagttttgggtatggggaagaagaggcagctagggaaagacatgcctaatggttttctacatagccttctctatggaaagaaaattttggtggttgatgacaatggggtaaaccggagggttgcagcaggtgcactaaagaagtttggagctgatgtgaagtgtgctgaaagtggcaaagtcgcccttgaaatgctgcaattgcctcacaattttgatgcttgcttcatggacatccaaatgccagaaatggacggatttgaagcaactagtagaattcggatgatggagagcaaggcaaatgaggagatgaatggcagtgagtggcatgtacctatactggccatgacagctgatgtgatccttgctacgtacgacaagtgcgtgaaatgtggcatggatggatacgtctcaaagccatttgaggaagagaatctgtatcaggaagttgcaaagtttttcaaatccaagaccatctcagactcatga

SEQ ID NO: 48493 - DNA, 213 bp, Glycine max
  Peptide Sequence Number=SeqID_165271
atggcgataggagggaagagcttagagacgaaatgtgaagacattgtggccaaaattgaattggtgatggatgagactgagaaaggggacatgatgaggaagaaagttggtgatgtcagagatatgattagggatgttgtcaaggatgaaaatgggtataaagggtcttctgttaggaccatggatgagttcttatctactgttgagtcctaa

SEQ ID NO: 48494 - DNA, 384 bp, Glycine max
  Peptide Sequence Number=SeqID_165272
atgatgacatcccttcctcaacgacacacccaccgtgatggcacccctccctcctatgatggctcctctttccccgccctccctcctatgatggctcctcccgtgaagcctttccggaaatatattttgtatcttgtagaaaagggtattccagaaagcactattttggcttatggaaggaccattctaaaagcaaaaattataatttggaatagcctttccataattcattttgtatcttctggagaaacaaatccagaactcaaaataggaatgtttttccatggagaagagttgagttggagaagaagagaagaacaagaaaagagagggtctgaacttgcgcttgatacaagaaaaagaagaggaagaggggaaacatag

SEQ ID NO: 48495 - DNA, 417 bp, Glycine max
  Peptide Sequence Number=SeqID_165273
atgttgacatcgttgccgttgggggttaaggtttgggtggtggacaatatcacatgggattcgttgttggatttagggccaaaaagggaaggagggaaggagaactacatggagttcagtgcttctgatgatggtggtggtgatgagcgagaagagagggggccattgttaaagctatatgtttttgagattattctagacaataagggaaatgcaacaggaggaaaatcaattggagacaaagaacctacaaaggcaaggcaaaacctactgacaaagtggctgagaaagagaatgaagttagtgtcgtttgatctcactttgcattcttttgatggtcaagcaatcttaagggacatatttatttggctccccgctcccctttactggtcttatgtgcttcgaatgaaggtctaa

SEQ ID NO: 48496 - DNA, 1392 bp, Glycine max
  Peptide Sequence Number=SeqID_165274
atggggaggtcatgctttcccaaatgcaagcttgccagaataatgggttggatacagatcattctgggagggttggtcatcttggtaagccttttgagtctcactagattctactcagcaggatttttcctccacaatgaagatatatgccaacacttctacaatctgagggatgtttctgatggttttgatgtcaaatcattctctgatagagttggagaagtgatagacatgttggaagctttgcaggccaagcttgagtcaaaagttcaagaaatggagaaaaacaaaggcaccatgttggacaagaagtttctagaggatcaaatagttagccctcttcatagtgctaatgttgctctaaggcagattcgggttcccaaggttgatgaagggacgaactccacagtgaaggaggatcatttgatcaattttttcatcattgaggaaattagaaagtacataaccccaaaggagaatagggttggtaagatcaacctatatggggcagacaaggtttacaacacaataggccatgcttgtgttttgtacaagaaagagttagagaagtacatggactatgacattggctcctattgtgatgatgattggaatttggctcagaagcttatgcttaatgggtgtgatcctttgcctagaagaaggtgtttgacaagggcctcaaaggagtaccaaaagcctcaccccatcaatgagtcactttggagactaccagatggaagaaatgtgaggtgggggaattaccaatgcagaaactttgagtgcttatctagcaagaatccaaagaggggttactcaaaatgcattggatgttttcaaatggaaaaagaaaagttgaaatgggtcactaataataataataactcacttgttgtggactttttgatcagtgatgtattggcaattaagcaaggagaggttaggattggactagactatggcattggcactggcacatttgctgcaagaatgagggagcaaaatgtgacaattgtctcaacagcactcaaccttggtgctcctttcaatgagatgatagcacttaggggtttggttcctttgtatgtcacattgaatcaaaggcttccattctttgataacactatggacttagtgcacaccactggtttcatggatggttggattgatcttttgttgttggattttatattgtatgattgggatagaattctaaggccaggaggtttgttgtggatagataggtttttctgcaatagaaatgatttggatgactatatgtatatgtttcttcaattgaggtacaagaaacacaagtgggttatttctccaaagtcaaaggaagaggtatatctctctgcattgctggaaaaacctcctagagccatatga

SEQ ID NO: 48497 - DNA, 288 bp, Glycine max
  Peptide Sequence Number=SeqID_165275
atggctcatcgttccaaattgaaggtagttaaggttgttccaaattattcttcaaagagtccagcgttggagtccaaaagtccatcaattgtcgaggagtttcgaggtatgggggtgcaaggagaggttacacgagatagtgaaggaagaggttcacaaagcgaaggagaattaggaatggaaatcaatgaggaaaaggctttacaaagaaatttagagtttgaggatgaattggatgagaaatttggtggaggcactcaaaacagagagattgggaatgagatttaa

SEQ ID NO: 48498 - DNA, 627 bp, Glycine max
  Peptide Sequence Number=SeqID_165276
atgataactcttatgggatttatgttcttactagtgtctgcattgcttggttatatatactccccacaattggacacacctcctccaagatgggttcattttgctcatggactacttctgtttttataccagacatttgatgctgttgacgggaagcaagctagacgaacaaattcctcaagcccattgggggagctctttgatcatgggtgtgacgcacttgcttgcacatttgaagcattggcttttgggagcacagccatgtgtggaagaaatactttctggtggtggttaatatctgcaattacattttatggtgcaacctgggagcactatttcaccaatacacttatactgcctgttataaatgggcctacagagggtcttatgataatatacatctgtcactttttcactgctatcgtgggtgctgagtggtgggttcagcaatttgggaagtctttgccatttttaaattggcttccttatcttgcggccaatgtaaaacttgtcgatataccaaacatggatctagtttattgtcttaagaggggatttaaaaaagaatttggtgaaaacaacaaaatcttgttttttccatcttctttacgaactcttagaaactag

SEQ ID NO: 48499 - DNA, 357 bp, Glycine max
  Peptide Sequence Number=SeqID_165277
gctgttgtccttaatttatttgatggtcaacattatctttttgttccatacagtgttagtaatgtttataaggttgtgaaggcaaagaacggaagcatgccacttgcattggcaatgctttacccatttgttgtactcgtgggaggagtgcttgtgtgggattatttgtcgccattagacatcatgggtagatatccacatttagttgtcataggaactggacttactttcggttatcttgtgggaaggatgattttggcacacttatgtgatgaacctaagggtctgaaaactgggatgtgcatgatgcttgatttggctgctgtccctcattataaaactttgaaaacacaatga

SEQ ID NO: 48500 - DNA, 876 bp, Glycine max
  Peptide Sequence Number=SeqID_165278
atggacgtttccgagctcgccaagaagctcggtctctccgattccaaactcctcgtccgaaaagctgccgagctccgtcgcctctgcgatgtccagttcgattcctccgtcattggagtcggtgaggttgcaaaatctctcatatgcttggaaatcgccgccactagactcggcgttctctttgaccgatcttctgctgtgaggctcagcggaatgtccgaaagagcttacatcagatcctacaattctctccacaacggccttggtgtcaagatgaaattagatgtgagggaattggcgattcagttcggctgcgttcgcattatccctttcgttcgtgacggtcttaaattatataaggatcggtttgtttcatcattgccggcttctcgccgtgcaagtgctgatttcactcgtccagtgttcaccgcggttgctttttatttatgtgctaagaaacacaagcttaaagtagataaacttaagttaattgagctctgtggtacatctgagtctgagttttctagtgtaagtgctgtatcagtttctgctactatgaaggatttgtgccatgatgtttttggggttgcgaaggaaaagaaggatcctaaggaagtgcagtcaaatcgagatttgcttgatgttttgccaagtaaaaggaaagctgaggatggtggttattcatcggaggatggtccagagctttcaagctataaaaaagccaagaaaatggaaaaacatgattatgagaaatggaaatcttctgtgctttcatccaataaacaaaataagaaagcgccttgcaagcgaaccagacagactagtctcaactttctcaaggaaccttccgataatcaagagttagaggcaatttga

SEQ ID NO: 48501 - DNA, 420 bp, Glycine max
  Peptide Sequence Number=SeqID_165279
atggcatcacagacgatagaggcaaaaactcggcttcatggatggtggtgtcgttcaccgaaaggaaaaacttcggcattgactggtcgcgaaggttctccggctattgtcgaaatgcaagcacgcgtttcacgtggagtgtgtggactcgtggttggacgtgcattctatgtgtcctctctgctgctattgcatggatccagaggacattttcttggtagaggaagcaaagcctttccaccaaagtcatcaacaacagaacaacgatcagggatgcgtgtgtttgaatctggacctggagaagcaggggatagtaaagtctcgacagaggcatttgttcgtttggggtgggggaaggagaaacaacagaggagtagcaacagagtcggaggtggacgacgtcatttagaaggtcattag

SEQ ID NO: 48502 - DNA, 279 bp, Glycine max
  Peptide Sequence Number=SeqID_165280
atgttgaaattgcttgcagggttcgtgactcttcaagctttgggaaagaaaatatcatgtgatcgtgtgagcgacggtgtaggatattatcgtggtgcactcgcacagggtttgtgtggttgcgtccgcagaggatcggagctgtgggctttatgggatcatcgaaacgacgccgggtttgaccggttaaggtggggaacctgttttgaatgtgtggccgttttagttgacacagagtcagtattagatccagatacagccgcaaaacataacttctag

SEQ ID NO: 48503 - DNA, 648 bp, Glycine max
  Peptide Sequence Number=SeqID_165281
atggaaccaccctcatcagtgcctctagccagtgagagtttttcatacagttggttatcaaattgtaataaatccccccccacttatagttcctatggaggcacctcagaagaagaattcaacttcagtgtgaaaaaaagttgtgaggaatttaacttcaattttgatatttctgtccctcactcacctcttgttcttgttcctgctgatgaaattttctctgatggtcttctaaggcctatgtttgttgacccttccaaagtagagttttgcaacacaccagatcccactcaaaccaagcttagttcttctttttcttctaggactttttctcaaagagctatggaaattcatcatggattgcttacaaagtggagaaagtcaacaaggagaacttttgtggacttctttaggtatgtcaaccaattaaggcagagagtagggaggtcaaggaagagcattagagttgatgatattgataagacagattggcaagttaaatgcttgaccagtccacaaaaaggttcatcaccaaaaccaacaattgcagcaactggtattggtgatttgcatgatcatgagaactcaatttatgaagcagttcttcattgcaagagatcaatagatcaaggttaccctaagcaatga

SEQ ID NO: 48504 - DNA, 2022 bp, Glycine max
  Peptide Sequence Number=SeqID_165282
atggttcttctcaactttggtgagaggctatactcaggactggttgccaccatgactgctcatctaaaagagatagctagatctattgaagccactcaagagggttcctttctggaagaaatgaacagaaaatggaattctcacaataaggaattacaattgattggagacattctgatgtacatggataggacttacgtcccaaaaaacgggaaaatctctgttcacgaacttggccttaaactgtggagagaaaatgttatatgttcaaaccagataaggacccgactgttaaatacacttttggaaatggtgtgcagtgaacgtgcaggtgaagttattaacagaggactgtttagaaatataacaaagatgctaatggatttaggtccttctgttgtttatggggaagaatttgagactcattttcttcaagtttcagctgagttctaccagttagaatcccagaagtttattgagtgttgtgcttgtggggattatctgaagaaagctgagagttgtctgaaagaggaaatggatagagtgagccattacttggatcccagtactgaaaagaagattactgatgtggtggctaaggagatgattgaaaatcacatgcttacattaatacatatggagaattcagggttagtaagcatgctttgtgaggataaatacgaagatttgggtcgaatgtataacttgttctgccgtgttactgatggtctagcaaaaatacttgaagtgatgacttcacacattagagagtcgggtaaaaagcttgtcacggatcctgaaaggttgaaggatcctgttgaatttgtgcagaggctcttagatgagaaacataagtatgacaagattataaattttgcatttaacgacgataagttgttccaaaatgctttcaaatcctcctttgaatacttcattaacttgaatccccgttctccagagttcatttcactctttgtagatgataagcttcggaaaggtctggagggagttagagaggatgatgcggagattgctcttgacaaggcgatgatgctattccggtacttgcgagaaaaagacatgtttgagaagtattacaatctgcatatggcaaagcggcttttgtcgggaaaaacagtttctgatgatgcagaaagaagtctcatagtcaggctcaagaccgaatgcggttatcaattcacctctaaattagagggcatgcttaccgacatgaaaacctctctagaaacaatgcagggcttttatgccagccaccctgagttaagtgacagtcctacacttaccgtgcaggttttgacctcagggttttggcctactcaatctactgttatatgtaatctgccagctgaattatctgcactttgtaagaagtttcggtcctattacctcgacacacatactgacgggagattgtcctggcaaactcatatgggcacagcagacattaaagccacctttggtaaagttcgcaaacatgagttaaatgtctccacttaccaaatgtgtgtcctcatgctgttcaatactgctgatagactaggctacaaggaaattgagcaagcaactgagattccggcttcggatctgaagaggtgtctgcaatcattggctttggttaagggaagaaatgtgcttaggaaggagcccatgagtaaagatgtagatgaggatgatgctttctttgtaaatgacaagttcagtagcaatctatacagggtaaaaataggaactgtagttgcacaaaatgaatcagaacctgagaaactggagactcgtcggcaacaagtggaggaggagggccgaaggtcccagattgaggctgtcatagtgaggataatgaaatcaagaaagaaacttgatcacagcaatctcatggctgaggtcacagagcagttccatgcaaatcccacagaggtaaagaaacggattgagtctcttgttgaccgggattttatggaacgagatgataatgacagacagttatatcgatatcttgcctag

SEQ ID NO: 48505 - DNA, 631 bp, Glycine max
  Peptide Sequence Number=SeqID_165283
atggcggcggttgccggtccggcggcgctgctgatcggctggctgatcaccggtgtcggtatcctctttctgtcgctggcgatgttgctgctgacgcgtctgcgcccggaactggatggcggcatcttcacttacgcgcgcgccggcttcggcgagctgaccggcttctgctcggcctggggttactggctgtgcgcggtgattgccaacgtctcgtatctggtgattgtattttcagcgctgagcttctttaccgatacgccggatcgcatcgtgtttggcgatggcaacacctggcaggcgatgcttggcgcttccgtgctgctgtggctggtgcactggctggtgctgcgcggcgtacagacggcggccagcatcaacctgctggcgacgctgggcaaactggtgccgctgctgctgcgcggtggtggtctccgcccgcgcgcggcacaaaaaagatgtcgggcgtgcgacgctgctggcggtgctggccgcgctgctggtctatctgctggtaacgctgctgtcgcttggcgtggtgccgcgtgcggaactggcgcagatgcgcaatccgtcgatggccggtctgatggaacggctgctgggtcactggggcgatgcggtgattgcg

SEQ ID NO: 48506 - DNA, 467 bp, Glycine max
  Peptide Sequence Number=SeqID_165284
atgtacaccgtgaaatgtgccattattaccggcgcgttctggcgcaaggttcggaatcgtactgaaaacaggaggagtgcgagggtgtctgataaagagctggcttcagccggatacagtgaccgcatctgcttcaactacagtgacttcctttccgcttcctgcaaaaaacgctggagctttgtcgatgccatttacggcgtgatgccaatttttggcatggtgacgcgcaagtccgggcacagtttacaggccagcgacgaccatctgaaagaattagcattacaaatcatttcaacccaggtcagcgacgaaattaacatcgcccgactgatcaccctggccgaacagcagcacatcagccgcttcgatattcagctgccttatccgctgtccgctgagcagcttgacgccatccatctggaataccgcaagccgctcaatctgacacagcagaatgatctgct

SEQ ID NO: 48507 - DNA, 616 bp, Glycine max
  Peptide Sequence Number=SeqID_165285
gttaacagtagggaaacttggtttgtgtgacttagatctggttaatcctactgggattgaacgggttctcaccgagaaagaccttcttgccgattcatattcagacctagaggcttctatccttgatgagaaagaatttctcctgttaaaggatgaagatgaagatgagttagatctgaaggatatatgggagaaagaacagtatcaagaaaagacaacaactcaagtcttgattgccttgtataagcatgaggatcgccatacatatgttgtagccttcagaggaacagaaccctttgaagctgatgcatggtgcaccgatcttgacatatcatggtatggtattcctggcgttggaagaatgcatggtggctttatgaaagccttagggctccagaagaatgttggatggccaaaggaaattgaacggcatagtatgggaggagcacttggaatcctctttgggacgatattgtgtttgcacaatgagacattgttgttggagaggtttgtttattgtaatgaccttgttccgaggttgccctatgatgacaaggaaatgatgttcaagcactttgggacatgtcttttctttaatagacactatgaatttgag

SEQ ID NO: 48508 - DNA, 729 bp, Glycine max
  Peptide Sequence Number=SeqID_165286
atgaaccagcgtttgcacgtccactacagcaacttcccgatggcttgtgcgacggcgaagctacgtggttgtgacagaggactcctagacacgacggtgcttcactcctttgcgagtcagcacatggtgcatcatcttcatggcatttactcctttgctatggttcagatggtgcgcaaccagcagaaccagcttcactccttcgcgagccgccacaagtttctcgaagaccaccttcgaatgcagcacgaagggtgggtctctgatgttcgacgtcacaaggatcaaatttctcagatgaatgggatgttgacgtctgaggagaagaaacgatcgctcgaggcagcaaaggcggattttgcgatgggtttgaagcacacagaggctgctatgttaaaatggattttggggggggggggggaatgtttggttttggttttggttcttggtgttagattcttaaaagtcttacttttctataatgtgagtatcatagctaaatatgatccaaaaagtgatttattggatcacgagttcatgctaaaagggaaatggtttcaacagaaggacatggagaaatcctttcaagaccttttacggaagcaggaaggagatcgatcagtgtgggaatatccatttgtttttgctggtgttaacatcacattcatgcttattcagatgctggatcttgaagcagttaccactgatcattatcttagtgatggctag

SEQ ID NO: 48509 - DNA, 426 bp, Glycine max
  Peptide Sequence Number=SeqID_165287
atggccaaatttggaacgccttcatcagtaggtatgtttgctacagttggggatgcggatggtgtggatgtaggtaccgaggatggtacacgtgcatcaatcgaggaaggggatggtgtggatgtaagcactggggacggaccacttgcatcaatcgaagatggaaatagtctaacttcaatcaaaggtagagatggtgtaggtacaacattcgaaaatctgattagcatagatacaatagatggggatgagatagatgatgatagactatctctaggtggtagtagtctaaatgcatataattttttcttcccacttgtccctttcctattggagtcatgtgacaggggtcaggattatcagggtctacttcttcaacactacctcctaaatcttacaatccaaaaatactttcaacttcaatga

SEQ ID NO: 48510 - DNA, 363 bp, Glycine max
  Peptide Sequence Number=SeqID_165288
atgactcctttagatcttgctgaacttaggactcggtgttgggttgcaattacgagactaaagcgtaagggacacctttacgacactggagatcttgctcatacttataaatgtggatatgatagcttcatgcaacatattgaaggatcttcgagtcatgttcaagatctagctaagattaatcgactaagggaggagcttcgtcaatcaaaggaggagatacatcaacatctgaaccagcagcagcaacaagacaatgaccaactagatgaccagcaacaacaatacaatgaccaactagatgaccaacaacaaaatgatgaccaacaaaggcactctaccaatgaatatttggattactga

SEQ ID NO: 48511 - DNA, 501 bp, Glycine max
  Peptide Sequence Number=SeqID_165289
atgtctcttgccactctctttggaaaacttcaagaacatgaaatggaacttatgagactccatcaacatgaagagaatgataaaaagaggaaagaaataacactcagagccttatcatcttctattcaagaagaaagtgacaaaaaggacttgactgacatagaagaagatgatgatttcagattttttgtgaagagatttaatagatatatgagaaacaaaagaaatcaaaggaaatcaaacatcaatccaaagaagaaaggagaagattcctccttacccccaaaatgctatgaatgtgatcaacctgagcacatgagattcgattatcctgtctttaaaagaagaatggaaaaatctgacaagaggaatttcaaagaaaagaaagcatacatcacttgggaagataatgacacaaattcttcaagtgattcagaaaataaaatcataaatctgggtctcatggtgaaagactatgaaagcggagaagagcaaagttga

SEQ ID NO: 48512 - DNA, 378 bp, Glycine max
  Peptide Sequence Number=SeqID_165290
atgactcttcatctcttatgcacaacattcttgacaggttggatggactccacaccttcgtcggtgaacgctttgactcgttggatagccgtattgaagccatggatgcacgatttgcagggatggacacacatatcaccaaacttgaggaggatgctagctttgttcgattgtcatcatcaaaaagggggagattatggaagcaatgccttccaagattattttgatgatgccaaagaatcaagagtcaaacaagtttcaagattcaagaataatcaagatcaagattcaagtaaagaatcaagactcaagattcaagaatcaagagaagactcaatcaagataagtattaaaagagtttttcgaaacattgaatag

SEQ ID NO: 48513 - DNA, 273 bp, Glycine max
  Peptide Sequence Number=SeqID_165291
atggggcttaaaatgctcaagtttacaacaatgcaacttgttgacgaaaaatatgtcaaagggtcaaccttgatagcacacatcaaaagcactgaaggatacaccaccacgtaccgcaaagcatggttggcaaagcaaaaggccattaaagtgtattggtcatcgtgtcatgagccaatgatctgccctgacccagacaagaaaagaaattctaagggtcgtcctgtcggtgcatcccagaccattcaaagaaaaattactcccactgtgtag

SEQ ID NO: 48514 - DNA, 307 bp, Glycine max
  Peptide Sequence Number=SeqID_165292
gtcgactctagaggatcccacaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 48515 - DNA, 597 bp, Glycine max
  Peptide Sequence Number=SeqID_165293
atgccagaagatattgtttaccaacaccctttgtttggtggcaaaatagctagcacattcccccacagattccaggatgtcagcaatattcgacaagtccctgatcatcaggaggtatttgcggatccgagccacgatgaaagcttgatctttgagcttttagaattcaagcctgatgttgctgataatgggagtgctgcatggtttcttcaagaccttgctactgaacaggatgctgaaggaagtgtggttattgagcagtcaggagttcttgaagcacctggtttgatgtacaagaatatgcctgcagttgtaataactgcagtgggtcaaatggcaatttctaaaggacggcaaggaagggaagcacaaaattttgtgaaagtttatttggcaaatttgcatcttaaaggagttgatactgatgtactagtcactgcatatgagcccattgttataaacccttttagcgaaagtgcagacacagttggtgctggtgtagctgttccagctgctcaagctggatgcatgcccatggaagaggtctttaaacttgctgttacaagcttcagggttcatgactggggtcttttctga

SEQ ID NO: 48516 - DNA, 126 bp, Glycine max
  Peptide Sequence Number=SeqID_165294
atggccgagtggtctaaggcgccagactcaagttctggtcctcgtgagagggcgtttgggctatgttggattgtggcccatttcgaatccattccgttggacccagatggtatctatgagaaataa

SEQ ID NO: 48517 - DNA, 783 bp, Glycine max
  Peptide Sequence Number=SeqID_165295
atggtgatttatcgggaacactttagagaattggatatgagatggaatctcactgatgtattattggaggcaatatctaaccgtcaggtgctttcactttaccagggccttggaacaaagaatcttcaatccttcatttcacaatttgtctacttctacggatacagctattttaaaagactgtatctagaaaaaagtggttataaatccattggaacaaaagcaaacttggttattgctgctgctgctggggcttgcacagccattgcgactcagcctctggatacagcctcttcaaggatgcagacaagtgaatttggaaagtctaaagggctactgaagacccttacagaaggaaactggagtgatgcatttgatggcctcagtatttccttgctgctgacatcaaaccctgcaattcagtatacggtgtttgatcagcttaaacaacgagcactgaagaataaacaagacaatgctgataaaggaacatctccagcgtccctttctgcatttatggcctttcttttaggtgcaatttcaaagagcattgctacctgtctaacatatccagctatcaggaaaagatctctgcttctacctgggtgcttatccttgcacttaaaagtagcagttactggaggaagaagcttcaattccttgcggataacgaatgtggttggagtgccaagtgagcattttaaccgatacatgcatctcttcaaagttgagacgagattgttttggtggcttctcttcggtcctcttcccgtggcttattga

SEQ ID NO: 48518 - DNA, 168 bp, Glycine max
  Peptide Sequence Number=SeqID_165296
atgtctgaggcaaaagtaaagcatgcattggaaaattttaactttagtgctttaagcacacctagaagctatccagaaatacaggcaccagcgttaagtgctggaaatagaggaaaagcactggtcaaagtgctggctaacagagagcatcaattgttcaagtgctaa

SEQ ID NO: 48519 - DNA, 252 bp, Glycine max
  Peptide Sequence Number=SeqID_165297
atgaatgaagaaaatgaaaagggacttggtatgaatgaagtagatgaagagaaacctggtgtgcatcaacatattgattgttctgatgccttcaatacttctcagaaacacagaagaaaacttggaagagaagttaaagatctaaagactatcgctcagcgcatagcattcgctcgatgcacaaaagtcacatgcagaagtcaaacaccacgtgaaggtgtccttagcgcgcaactcgcgctaatcgcgtga

SEQ ID NO: 48520 - DNA, 1344 bp, Glycine max
  Peptide Sequence Number=SeqID_165298
atgacattcttccattgcgagaagtcgacatcggcaaccgtggctgttaaggtagcactttggaaggaggatttagtgaaagatgagatagtggcggcggcaacggtgaaggcgaagttccagagaatgtccaagatgcattcctctcctttccctcatctcctctccctcacccagtattgtttcacccccttcacgttttcgcttcctcttcttgcgtcatcaactcccgtcgttggtgccttcgattgtgttcgccactccctgccattgtcgtcgtcgagagtgccttccttttcttcgttgatgttgcctacaacatctgaatgtaggcaacaagcagctgcacctgttgctgatgatgttgatcatgtagatcatgaagctgacgagttccatgaccaggctcaggaggcagttgccgatgatgtagttgctaatgcccaggaacgtcctgagttgaagttgtcctcccacagaaggaaggtagagaaatttggaatgtctgttccagagattgaaggcatagtggttgtcacaggattaagtcctctaattgcatgctccttggacaatggtgacaagggacttatatatgtttttgctgagaggtgtcataagaaaactagtagtttccatcttctggctcctcatgtagaccaagtcgtggacttgttggttgacttgcttgaagttagttcacaagaaggaagagaaaagacatttcaatgccatgaggcatgttgcacactctttgctaacaagagtgtcacacacatgcatgtggtattcttggatgcatttcatgacctcagccaaactggaagctacgcatggggagctgctgcattggtccatatgtatgagaatttgaatgatgcgtcaaagagaagcgctagacaacttgcaggatatatcacacttttagagtgttggatctacgagcattttcttattgttttttcttctattgttgctaaagattatcgtgagaggaaaccacatgtttgtcgttggaagtctatgaaggcattatcagtgtcagcgcatcataagcagttggatagattgacgtcctatgttgtgagctggattccttatggtgatcacccgtgcattcagagatgtgcattggactacatggagtggttctacttcatatctcaccccttcatgagtccgaaacagcttaaggattctcctagacatccacttgcagtgcacgatgatacatttattgaaccaaatcctcctcagcagccaatggatatgccagaaccacatgcagctgcactggttgatgtagacatgcctcgacatgtactgaggtttgccaaggaatag

SEQ ID NO: 48521 - DNA, 555 bp, Glycine max
  Peptide Sequence Number=SeqID_165299
atgattcccctcaaaactcatcctcattctcccttcatcttctccgtttccaaaaccaacccactttacttctctttgctccccacttctatctctcttctctcactcaaacaacccccaccctctctctcttccaatcttctcagggtttcaaatgttggagtttcagtttgcagaaccgaacaccacgaagaagaggaagacaagggggtttcgttggagcttcacgacttgtccccaaatggggaagtgtatcagaaaacgctgcaattggttgagtgttccatgttcgctgcactcaccggtttggtctatttcttgagcaactcccttgccattgagaattacttcagttgtttcttctcattgccaatagtgatatcctcaatgagatggggtgttgatgcgggcaggaaaactctggtggcaacgactatacttttgcttgtcttgtctggtccagttaaagctctaacttatttgcttaagcatggtatagttggtttcacaatgggtactttgtggcgcataagagtgggcatgactaacaagtaa

SEQ ID NO: 48522 - DNA, 1251 bp, Glycine max
  Peptide Sequence Number=SeqID_165300
atgagggagagaaacaaaggtgtggaagatcaggcttacaccaatgacatggattgctactactactccacctctgaactcccatgtaagaaacacccttcttcttcttctgttggaatatgtgcttactgtctcaaggaccgtttggtcaagcttgtgtgttctgattgtggggagcaaaggctttcttcgtgttcttgctctgatgagatggtctcttcccatcgcaactcatgcactgttgaggtggggggtgttgggagggtctcattcctcattgagaatgagaagaacaatgagagtaccccagtggttcttcagcatttgaatcacaataaggccaataaggaggaggaggaggatgaggttctggggctgaggaggagtagcagcagctgtgttgagatcaagaggcatcatcatggtggtggtggtgggttttggaagattgggaagctttttaggaagaaaaaagagaagggttgtgggagaagtgttgttgggtttgatgagagaaacaatgagatgtggatggtggatcatcaagggggtgtgtctaggtcaaggtcactatgcagcttcaggggtggagggatatttggatctgaggatggtggtgattcagtgttgtcaggtgctagaagctcaatttctgcagctaggagttctggggttaatatgttggaatctgggaggagaagtggatacagtgaagctgagccaagaaggagtggttttgatggagtagagaggagggatttcttgtttgataacaataattatgaaagtggaagtgatctcaagggtggtgtgaaaaagggtggtggactaatggatggtgttggtgatggtggtggattctatggtggggtaaataggcgtgtgttttcactcagagagagtgatttcaaaggcatggatgagtctagcttcattgacttgaagcttgattactcatcagaatcaaagcatgagttttctgctgcaaaaatgagcaacaacatggggggtgataccttctcttctttcagaggtgggaatttcatgccacatgatggcggtggaggttcttatggagggttggtaggagatggagttttaaccaatggagggtcatgtagaatcactgtgaatgacagaggaatcaagaggggaaggaaaagcatgaagggttggaggtggattttcagataccattcaaattggggaagctcaaggaaaagagatgaagactttatgttcaaagcatga

SEQ ID NO: 48523 - DNA, 228 bp, Glycine max
  Peptide Sequence Number=SeqID_165301
atggaggagtttatggcccaggtggcctggccaggagtccagccttctcctttggggggaggtgaggctcctacagcccaggagtcacaaccaaaggttgatccagagccggaggcatcaccagaggtcaaggccactcctaaggagacaccgaaggacactcatgctgccacacccgccgagtacacagattatgttacagatatggcggcggtgcagagcacttag

SEQ ID NO: 48524 - DNA, 379 bp, Glycine max
  Peptide Sequence Number=SeqID_165302
atggcaaacgccgtggatcaagatcagcaatggctgctcaattgcttgtccgccacactcgaccccaaccccgaggttcgctgtttcgcggaagcttccctcgatcaagcctctcgccaaccagtccttcttaagcagtttgttaaaaagcattggcaagagggtgaggactcttttgaacctcctgttgtttctagtaatgaaaaggaaagcatccgcagaatgcttctattggcattggatgaccctcataagaaaatttgcacagctattggtatggctgtggcatccattgcaatgcatgactggccagagttatggccggatttgttaccatttctcctgaatttgattaacaatcaaaccaacatgaatggag

SEQ ID NO: 48525 - DNA, 486 bp, Glycine max
  Peptide Sequence Number=SeqID_165303
atggcaaggctcaaggactcgaaagtcaaagaatctggaacaactccccaagcgatgcataaggaagtgataagcgtcggaaatccaagcctggaagagttggactgggccatctgcgagatttggcctgagatgagagagtccaagttcatatccatcttcataactaatccatataccaacttcgccctatccatattaagattggaccattcagaacaaaattgcaccctggaatacagagcttggaggcaagctcctgaggatctgggtgagtgccgcagaacctggtgtaggtacctctcccctggctccaaaaccatgggggtctccaagaagaatgcttcgggagtgaatgttctagtcatatctttcccaggcgcccttggaaatgaatctggtggtatcataggtctcctagggtctagaggcagtagctttcctcttcctagaggtcatctgcatcaaaagaatcacaggaattga

SEQ ID NO: 48526 - DNA, 609 bp, Glycine max
  Peptide Sequence Number=SeqID_165304
atgagaaaccaccctgcatttcaatttcttctcggtagctcatcgaaaatgcaagcgtttcgacgaagaatctcaacagcgacaatctccacggcgaagcaattcaacgctcttccatccattattgccggtgaatttccggcaacgagacggcggtggtcgagccgcaagtcccggagcggcgaggacgagtggaacgaggcgtgggagacggcgtggcttccggatgacctgacgccgaagacgcaagcgccgtgggagagcgacgtcaacttcccttcctcctcctcctcctcctccgccgccgccgccaatgacggagacggcgacgaggagacgaaggcgttcgtggcggagatgaacgagaattggaacgagcggcggaaaggatcgaaggagaaggagaagaaggaagagaacggcgcgctttacagcgtggagaatatgaagaaggattatcggttgaagaagcagagaatgcacgctggcttgtggatgaaggagattgagaagcttgaggaagcgaaattgggcgattctgatgttgctggtgatgatgacattcagagattgcttgatagttgctccgagtataattctctttcttaa

SEQ ID NO: 48527 - DNA, 1245 bp, Glycine max
  Peptide Sequence Number=SeqID_165305
atatatgatccatacattcaaacgaaggccctttcaataatctattcttgcacttctatgctggggacagtgagtggtgtctataaggctgaaacaagttctctgatagttcctatgcttaaaccatggatggaccaattttcttctattcttcaaattccagttcaatctgaaaatccaaatgattggagtattaaaatggaggttttgaagtgcttgaatcagtttattcagaatttttcaactctatttaaaagtgaatttgaggttatattgggacctttgtggagtacatttgtctcttctttgagtgtttatgagaaagcatctattgaaggaacagaagattcacatgagggaagatatgattctgatggttcagagaaaaaccttgattcatttgttatccagctgtttgaattcatgttgaccattgtgggtagtccaagactgggaaaggtggttgtggctaatatcagagaattggtgtactatactattgcttttcttcaaatgacacaacagcaggttcttacatggtctgtggatgctaaccagttcattgctgatgaagaagatgccacttatagctgccgcttctctggtgtgcttttactggaagaggttgtgaattcttttgatggtgaaggaattttggccataatagatggtgcaaaacaatggttcacggagtctcaaatcagaaaagcagctggtaatgcaagctggtggaggataagagaagctactatttttgccttatcatctctttcagaacaactgtttgagacacaggaaaccggatttgatacaagtagcttgaagcacctggttgagcagattttcactgaagactctctattagatcctcttgaatatccctttttatatgctcgcatctttacttcaattgctaaattctcttctttgataagcaatagtttactagagcagtttctctatttagcaatgaaggcaattacaatggatgtgcccccgcctgtaaaagtaggtgcctgcagagcacttactaacctccttcctgaagcaaaaaaggaaattgtacaatcgcaattgttgggtttattttcatccctcacaaatcttcttaatcatgtactacccgatataaatccttgtcatatatcttctactattgttgcatctaatcgttaccttaatacgatttctaggcatcagatgaaaccttgcacatggtacttgatacattgcttgctgcagtaa

SEQ ID NO: 48528 - DNA, 328 bp, Glycine max
  Peptide Sequence Number=SeqID_165306
ggactggggaagtgaagatggcaatggtaggcgtgagggcaggggattggacaagacagagagagactcgttgagaggcaatatggaggttttgcattcacctcagactttgccaccaatgttgaccgaggagcttgaattagctgtacagccagaagatatactgcagtggaggacttatgttggaggcaatatggaggttttggtgaaatgggctcatttgccatcttgtgataactcttgggagcgagcttccaaggtttttccttcccttgaggacaaggtagttcttttagggggggggggtattgataggattgctagttga

SEQ ID NO: 48529 - DNA, 329 bp, Glycine max
  Peptide Sequence Number=SeqID_165307
gctatcaaaagcattcccggatgtgtacatccattggtttccagaattttgccatctattggaccaattttgaataaaccccaagagcaggctgatggtttggtagctggatcattagatctgaatgcccctgctgatgtagtgaaagcaatatatgatgtctcttttaatgctgttatcaacataatccttcaaagtgatgaccacagtgaaattcagaatgctacagaatgtttatctgcttttatatctgagggaagacaacaaattcttgcatggggatctgattctggatcaactatgagaagcttacttgatattgcttcaag

SEQ ID NO: 48530 - DNA, 639 bp, Glycine max
  Peptide Sequence Number=SeqID_165308
atgggtcgcgttaccattactgcacatgggccaaaaccaagggaagcgagtctattgaggcaaattccatcagctagaaaaaagtctgaagcaaccaatagacatatcaacatcaacataataggccattctaaacaggctatagagaaatcaaatgaacatcctgaatggttacctgatgactggaatatggacttcagaactaaaaaaagtggtgaaaatatgggtcatgggtataaggtgctagacaaagcctctttaagtggtgcatcatgctcatcgcccatcctacaagcatttcccattttgaagaaatcatatggagacagtatgcacaaggttttgcatgttggccctgactcttgttttgtactatctagtttgttagaagaagaggatactgaggtttggggaatacaaccatacgagttagatgatgttggtgcaaagtgtaaaagtcttgtatgcaagggcattgtgcatgtggctgatttaaagttttctctaccccattgtgcaaagtcattttctctggatattttgtcagatgcattggattacttatctccaagatacctaaataaaaccttgccaaagttggtgaaggtacattcccctgtgaagcttcagttctactag

SEQ ID NO: 48531 - DNA, 246 bp, Glycine max
  Peptide Sequence Number=SeqID_165309
atggagtgcctagagggagcttgggagaccctcgaaggcaacatgaggtgccgatttcggggcaccattcgattcacggctacttctttggtgcttccagatgaacctgcacggacgcttcagcgcacggtggagtggacagctccttggattagttttgtatattttgaggccaacactgtggacacctttgctctggatgacactatatattttgtaaaactcccatattttggacagctttaa

SEQ ID NO: 48532 - DNA, 606 bp, Glycine max
  Peptide Sequence Number=SeqID_165310
atggctccgaaaaagctttccgcgaagaggtctaggagagacgccgcagctgaaggaaccagtgccacccccgagtttgatagccaccgttttcagagcaccgagcaccagcagcgcttcgaggccatcaaaggatggtcattccacagagagaggtgcgtccagctcagggaggatgagtacacagattttcaagaggagatagctcgccgacattgggtgtcgctggtgactcccatggctaagtttgaccctgagcccacagaggagggagtgcgagacatgcgttcatggatgaggggtcagtggattccttttgacgcagatgccctcaaccagttcctgggtgacccgctggtgttggaggaaggccaggagtgcgagttcattcagaggaggaacggggccgaagggttcgatcaggaggccattgcccagctgttatgcacatcgaggcaagatttcacccggaccgctgtagggaggcgggtgcggatcatgcgcaccagcatgaccaacttgacccagatgtggatgacattgctgctcagcaatgtcttgcctagcgatcataactccgatctccctctgccgaagtgtcagttg

SEQ ID NO: 48533 - DNA, 294 bp, Glycine max
  Peptide Sequence Number=SeqID_165311
atgatcgaaagttttcaacaacaacaacaaatgtcagttctagaattgtacgtagaaaaggatgttgctggtggttctatgtttcatgctgcaaattctgttacgtcatgtggacataatgtatctcatcatgagtcggaactaccaagaaatataagcaatttacatgacgatgaagatgatgatgatgattatcttgcgtttaactcatacgttgaagagtctttcgatgaaggtgatagtgttgatgaaatatctgatacagatgatgaagtcaccgacatcgttgaacca

SEQ ID NO: 48534 - DNA, 339 bp, Glycine max
  Peptide Sequence Number=SeqID_165312
atgcataattgcgcatattcagccatccccaaattcgttcttcatgcacttgcagtggcggcagagtccaatgttaggttttgcccaaacacaacacatgctcagagttcaaacgaagcaaagaaaaatcctagtgaaaccatggaagaaatcaaaaagtgctatactctggaatcaatgttgatcactcgaaacttctccttcagagtacttcaagttgtgagccttgcaatttcatggcagaagttgaatccctatggtggcggcgacaattccaaagtctcaatggagactcgagtgacgcaaaagaaaaaggagagagagaaagagaaattttga

SEQ ID NO: 48535 - DNA, 498 bp, Glycine max
  Peptide Sequence Number=SeqID_165313
atgctaggaacctttaaaacagatgtgaaaatactagacaatgaaaccatcactgttgatggtaagcccatcaaggttgtttcaagcagggaccctcttaagcttccttgggctgagcttggaattgacattgttattgagggaacgagagtgtttgtggatggccctggggctggcaaaaacatccaagcaggtgccaagaaggttattatcactgctcctgcaaagggtgctgatatcccaatttatattgtcggaataaatgaaggggactacactcatgagacctctaacattgtaaggggacggtgtccttggatgctatgctcaccgcaggtcatgcatttgaaatcaagcgattacatggagctggaaacgctctgcatgctttgtgaagcaggctttctgaccctagcaatgtgctacacagctgggatccaactctcgttaatgcttgtacttggtttcatgttacctgtgactccagaaatctcgtga

SEQ ID NO: 48536 - DNA, 354 bp, Glycine max
  Peptide Sequence Number=SeqID_165314
atggataagtttgacgtggcctggccaggagcccaaccttctccttctagagggggtggggcctccgcagcccaggagcctgaaccagaggaaccagcagcagcagtagagggggaggttgagctcactccccctaagcccttctattttgatgcaggtgtacacatggctcaggaggaggagactgccacaaccctgattctagagccatccccagcacctatacctgatgatgccataccatctgcaccagcacctgagttagagcagcctatctctcaggattcaccagctgctcaagtgttggatcttaatgagcatgcacaggagcaaccacaggagcaggacatttaa

SEQ ID NO: 48537 - DNA, 201 bp, Glycine max
  Peptide Sequence Number=SeqID_165315
atggtggacgtggccaaagtaggctccacgatttcacaggtcgggctgagagttccctttgttaagaggacaagaggggttacctacaaaaaaaatgatttcggcgctcaacatcatggtttttgtgctgatcctcttggtgtccttcgggtcttacttctattgggtgattgtccgaagctagatacccagcctatatga

SEQ ID NO: 48538 - DNA, 270 bp, Glycine max
  Peptide Sequence Number=SeqID_165316
atggagctaatcgaggagataaggagaacaaatagatgcaaaaggaagcttaagcagttaacattgcatcgcttcgttggattaaattccaacaaagaaagcataggtgttagtagattgtggggcttctctcagcttcatatccaggaggatgacacaacagctgtagttaaaggtagatcccattgggtgaaagtaggagtcatctgcagttgctattctcttagagtgtgtttggatggaggaattttaaattctgagaaattttaa

SEQ ID NO: 48539 - DNA, 503 bp, Glycine max
  Peptide Sequence Number=SeqID_165317
atggatcaagttcaaggtcaagccttcagcaaggtacatgggaagatatgggatctggcaatgatagaattagcaccaaccatagaggagttcgaagggatcttaggatgcccgctaggggggaggaagccataccttttttccagattctatccttccatggcaagaatagctaaagtggtcaagatctcggaacaagagctagaccgagtgaagcaaaataagaatggagtggcatggataccaaggaagcacatggaggagaaggcggaaactctggccaactgcaagtttggtggaagtgctgattttgagctgctcgctaagccaattctctggcttagcgagccattcgctaagcgcaacaagttacggctgtggagagattggagagagttgagcttgaagaggaagctatcttgcaaagcattggatgagattttgagtgattgtgagccttcttgctatggagagctaaatcctcagttggttctttctacggg

SEQ ID NO: 48540 - DNA, 264 bp, Glycine max
  Peptide Sequence Number=SeqID_165318
atggaaactgaacaacatcctccacaacaaaccgaattgcggtgttcgacaccagttaccacgcgaagcagaggatcactcagtgttttgatcaaggatacaaaaggataccaaggaagggggcaaaagggtctttttctggaccccagctcgcccaggctagcatctggctcgcttgggccatggaattacctcttggctaagcaaccagctcgcctgggcgatctaaagcttgcttgggcgagctcactgctacagggttaa

SEQ ID NO: 48541 - DNA, 699 bp, Glycine max
  Peptide Sequence Number=SeqID_165319
atgggggcataccaaataaaagtcactacaagtgccctggctttgttgctaactagtaggcacaatgaattggcaaaaatatatgtccagggccatctgattaagtctcacgagggaataaccacaagatcaaaagctaaatcagctccagatcaatgggtaatgttgccacttcctactaagatagtggctttactggcagatgcattaactgaaatacaagaacaagttttggccgctgatgatgaggatagtgactgggaagaagttcaagcagatggcattgaaaatgataaagaatttctttattcagtgtctacatcttcgggaaaagccacggatgaacaacttgaagcaatggtgaaagtatttaatgaggaccaagatgatcagtatgtagatggccttttaagtgttgctgatcctctcaatcagataaacctggcaaattaccttgtggatttctttgttagcttttctcagtctgacagacagttcttagatcacatttgcaagagcttgtctcagtctcaacgaagtgccattcaactggttggggaatctgtctgcagttctgaaaggtattctctttctgctgcagtgttccccctttatgtgtttggtatactggtttcacgactttcaaagcatgccaatggagaagtgtctctagctgaattgaactcaacggttgtttga

SEQ ID NO: 48542 - DNA, 1686 bp, Glycine max
  Peptide Sequence Number=SeqID_165320
atggagaaagatcacaactattcggtacagacacatatatcttcttttatgtttttggcttcattaaagttttttcttatgtcagatcttttcactctctcatatcatcatcaccatatgttgttgttttgctccaattttgctgaagaatcatattattcactacagacaccaccaccaccaccgttatctatgcctccaagcttcaacacactagactactctctagaccaacaacaacatcatcatttgtacgcaccaaatcaacaccaacaacacctgatgatgaagttccaacaaggttctggtgatgaaaacaacaatattggatcaatggtggattacatgcctcaaacaacaacaacactacccccacatggtttttatggtactgctaccagtgctgccacaacatcctatgacaaactcagttttgcagatgtgatgcagtttgcagattttggaccgaagttggctttgaaccaagcaaaaagctgtgaagaatctgcaatagacccggtttattttcttaagtttcccgtgttgaacgacaagatggaggaggatcatcagcagaacatgatggtgaataatgatgaccctgatggtgatgaagcagaaaatcatcatcatcttgatgagaggttcaatttggtgagtgtggaaggcaaagatcagggaatgatgatgagagaagatgaagagacaactcgtgtttccgacgacaacaacaactcggtgcagattcggtttcttggacacgaagagcctcagcagaagaattgtgcagtgcaggagaacaagaacggcaagaagaagagaccaagaactgttaagacgagtgaggaggttgagagccagcgcatgactcatatagcggttgaaaggaaccgtaggaagcaaatgaatgagcatcttcgtgtccttagatccctcatgcctggttcatacgtccaaaggggtgatcaagcttctataattggaggggctatagagtttgtgagggaattggagcaacttcttcaatgtttggagtcacaaaagaggaggaggctacttggagaagctcaagcaagacaagttggggatccctctcttgtggcacaacaacaacaacagcctccattctttccaactttgcctattccaaacgagcagatgaagcttgtggagatggagactggcctccgcgaagaaaccgcagagtgcaagtcttgtttggccgatgttgaagtgaagcttctaggatttgatgccatgatcaaaatcctatcaaggaggaggccaggacagttgatcaagaccattgctgcacttgaagatctacaacttatcatccttcacaccaacatcaccaccattgaacaaacagttctttattcattcaatgtcaaggtggctagtgattcaaggttcaccgcagaagatatagccagctccgtccagcagatattcaattttattcatgcaaacactagcatgtgctgtattcgtacaagaactacttgtgattcctatagttgtctttatgagataccgatattgattttacaccgtcgtttggatttactattgtcattgtcggaaggggtgactgaacaagatgatatggctagtctttctatcatatatttctctctcctaaaagtgtcacattgtatcaaagagaaactatggatacgttaa

SEQ ID NO: 48543 - DNA, 252 bp, Glycine max
  Peptide Sequence Number=SeqID_165321
atggacagtgtatctgctcttgtgtattgcaatggtaacatgattccaacagatgaagggatattgtttgaatgccctactgatccaaaagtcatcacaataagtgatggttatgttgcatacgactgtttggagcttaaacacgatgctgatgttggaaaaatgtttttcatctattcagaatttagtacaaaaggttccattgagttgaatgcaactttcaagtgttctccatatgaaatccttacctag

SEQ ID NO: 48544 - DNA, 420 bp, Glycine max
  Peptide Sequence Number=SeqID_165322
atggatcatgcaactaacgaggaacgtcctgagttgaagttgtcctctcatgaaaggaagatacataaatttggaatgtctgctatagagattgaagacatagtgattgccacaagattaagtcctctgattgcatgtttcttggacactagtgacatgggacttatatctgcttttgtggaaaggagacacaaggaaactagtagtttccatctttcgataagacaggtcactatcaccctcaatgatgtgacatcgttgctacatttacccattacatgccccttctatacctttgatgctcttcatgtagaccaagctgtggacttattagttgagttgcttgaagtcaattcacaagaagcaagagatgagacatttcaatgccatgaggcatatgttcacctagtcaggctgtga

SEQ ID NO: 48545 - DNA, 876 bp, Glycine max
  Peptide Sequence Number=SeqID_165323
atgggggttaagtacctcgaggcggtcaagcgaaggttgcatgccaccaaacaatggttcccggacaaaattaggggtgtcgaagtattgatcagcaaagtttttcattctagcaaacatgggatcaaaccaagcaccctcttttatgaaaagctagggcagtggatagatcaagttcgacgtcaagctttccgcaagacatatgggaaaatctgggacttgactatgatagaagttttcgtggaagtcatcgcatccttcactcagtactatgaccagccgctaaggtgcttcacatttggggactttcagttggtaccaaccgtagaagagtttgaagggatcttgggatgctcgctaggaggaaggaagtcgtatctgttttctgggttttacccctccatggcaagagtagcaaaggtggtcaagatctcggtgcaagaattggaacgagtgaaacaaaatagaaatggggtggttgggataccaaagaagcgcttggaagagaaagcgaaagctttggcggatcaaggagagtggacttctttcattgatgttttagcactattggtgtttggggtcgtcctctttccaaatgtggatgggctaatggatctagcggcgatcaatgcttttcttgcttatcaccatagcaaggaaagttcggccgttgttgttttggttgatgcctatgacacgtttgaccagagatgcaagaagaacaacgcgagaattgtctgttgcacactcgctctttatgtatggctggtctttcacatttttcatcatgaaagtagacatgtttgtcccctacaaggtcactacatatgtgccgagaaagggaaagcaaattgggagcagctcatggcgggtatg

SEQ ID NO: 48546 - DNA, 195 bp, Glycine max
  Peptide Sequence Number=SeqID_165324
atgagcgtctttagatatagtgtcaacacagaaaagaatgaagaatgcaactatggtggaaggggaccaattgatgttagagaatatgagatcgatgacgaactggctggtgatgtaccggccaatgtcaaagaagacgttgttgatgttttcaagaaggggaccaagaccaacattggtgatgaacttctataa

SEQ ID NO: 48547 - DNA, 355 bp, Glycine max
  Peptide Sequence Number=SeqID_165325
atggcgattattcattattcagcagcttcacgttgttgcatgccatcgctgcatcgcgcttcgccttctcgctcggttctcgcgccctcaatcttcttcttccgcgacgctgctccgaccctcaggctcgacgtctcggttcggtcccagcctccaggttcggacggcttcggcgaacccatcaataacaaacacgcttctcgtgatgcctccgttgggttatccgcttcttcttcttcgtcggtcatcgattttctcactctctgccaccgcctcaagggaatgcatggctctgtggatgaagagaccacgggtgtctcccaactcactgagttagagactaatcccgctcgtg

SEQ ID NO: 48548 - DNA, 165 bp, Glycine max
  Peptide Sequence Number=SeqID_165326
atggggttgagttcacacaaagaactcccccttacctacagtaggttgcatgaaatgaaggagaggaaaggtgttgggagaaggtgtgagtggaactccacatctccacttgtgggcatgtggggtgacatgtttctgaagaggtgtcaacaagtgagggtttaa

SEQ ID NO: 48549 - DNA, 534 bp, Glycine max
  Peptide Sequence Number=SeqID_165327
atgaaccctagatgcacccccttgagctccacgtggcatgtgcatgactttctgacgatcgtcacctcgggctcgtgccctttacttgtcgcgccctgcaagtgttcaccaagacgtaaaatatgtgcttgccaaataatatgtgtgttgtcaccatttgtggaggaagatatagttgggaaggttttagaatacttgtacatatcacttaattattggaaccatatatttgtgatgtcatgtggacttcttactgctagtgtggtaacggctgccttaattagttttggacagggacatgcagaagacataatacatcagagtattgtgtacagaacaacgaattttagtcttctctttgtctgtgctgttagagataatatcatggagcctgtcaaagacgaggtatccatgataagtcaaacaatcttatgtgtaacagacgaccaatgtacatgggacttctcattcacacttgtactcaaacaatctatctctcatgcgagtatctttcaaatgataagtctcccttaa

SEQ ID NO: 48550 - DNA, 435 bp, Glycine max
  Peptide Sequence Number=SeqID_165328
atggctttaatggcattgattgctggcgatgttccaggattgaatcgagaaagatcagtgagacatttctttgtctgtgagatttgtaattttgtactcagtctagatggtataagcaaatctattgtaggagatataacaccatctgatggtgtgcccaaggctgaaaagagcagaatggagctggaagctttgaacaaaatgtgtgaacttcttggtggagggatgagagctgaggagatcaaagaactttgggaagagtatgaaaacaattcttctgtagaggcaaatcttgttaaggattttgacaaggttatggactatttttgcagtagccgcatagttagttttagagaggttgatattggaagcagaaagggtgatgtattagtggttttcattcattttttattgaggggtggaagtggaaaataa

SEQ ID NO: 48551 - DNA, 216 bp, Glycine max
  Peptide Sequence Number=SeqID_165329
atgactcaggccctctgcgccgtcgagtacctccgccgcatgatggatagtaatggttgctcccctgactggcagggtgcagttttacgtgtccccctacacccacacccgatcgatgttccacgagctcaaacgacgtttcttgaagaagaggattatcagcatgagggaagagtcgcgatttcgaaaacgagattttggaaactttcagagtga

SEQ ID NO: 48552 - DNA, 522 bp, Glycine max
  Peptide Sequence Number=SeqID_165330
atggagctacatcaccggggcaagactttgcgaatcaagcgcactagcatgaccaccctgacacagatttggatgacattgttgctcagcaacatcctccccaggatcatgcctcctagacacccagtggacctagagaagtccaacagagcactggggtttccggctttgatcacgggcctctgccagttttatgggtgcacagcagtagggtcaggcacagtagcagtaagaggaggaccagcaacagccagccgcagatgcgccgccaccacctctacggcagccaccatccctggagtctatctccgctcacctgtagaggatggaactccagatacacgcagccaggacctcagtcctttcccgtggcctacccctgagcagttcggggccacagttgcatgccctggagatgatctcaattttcagacaggagcaggacccgtaggggcccacggagacgaggatggagctcaaaaggatgatgatatggctgatgtgctggactacttcctttga

SEQ ID NO: 48553 - DNA, 249 bp, Glycine max
  Peptide Sequence Number=SeqID_165331
atggaagacgcacccttggcccaccattgggtcccgcgtcgtgccaccaccggagggcaggttgcgacaggtagttgttcatcgcctcataatggtgtgccggagactgtcgccaatgctacctatgaggttggtgctactgtggctactgttgttgctctcctggcagtggtggaaaaggttgtggggcggtcaatgggctttgtaggaacactgcatgcaattgatgaaggaccaaagcaaaaatga

SEQ ID NO: 48554 - DNA, 252 bp, Glycine max
  Peptide Sequence Number=SeqID_165332
atggttgtcaggcaggaggtatcggtgtgtcatagtgctccgactccacctatgaatgtagtaaaggtggctatggaaccgaaggctcaggagctggcggctaagtacgaaagtgcccaatacaaagtgcagtgcatgaagagcaccacagtcgtggtgaggttgactatgattgtggtgaaaaatggaaaagcagaagaagagagcaccacgatcatagtgaaatgggtgactacgaccatagtggattaa

SEQ ID NO: 48555 - DNA, 2700 bp, Glycine max
  Peptide Sequence Number=SeqID_165333
atggattccagttccgcggcatctaaagtcggaggcttttcggcgtctagaacgaagggggagtcactggtgagggtttccgatgagtcttggatggagggtttcaagggtgaagacggtagggttgagagagtagaagatgaggttgccgatggcgacaccgagagagttgaggggctcttcctgcgaaggggccagagaacaggaatcggggacttcgattttgaggaaggaggacttacgaggtcgaggagtctatggaagcttctagggaacggaggagaatgggagactgagttgcttatgttaaagccctctactcatgccatcaaaatcattgaagacatgtgttctagcccctacaacaactcaagggataagaggattatgaagagaggcatcagccaggctcaagtccccaccactacacctccattaccaacctgtgataaatgtggaattgtgcataggccaggagaaggcgctgttgatgatgagctagctgcaaccatggatgagataaactttggcgaggcttcaggcaaaattaggaaatgtttaggtctcaacccatgcaaaatcaaagacctagatcaaaaggagagacaacccactcttcaagaaaccatgcagttagacactcttccttcacaacctgaaccaagttataagaagagggatgccaatgttgtgattactagaagcaataggattcaagaggactctgaggagaaggaagagtgttctgctatggtccctaggaaatttcctactaagatgaaagactccagcataacaaacttagagcctactgacatctcttttcaccttgctgatcgtttagttgtctatcctagaggggcgattaaggatgtgttggttaaggtggacaatttcattaagtctgttgatggatttgatgcattgatggagggggtgttctcaagtatagggatgcttgaccctctaaagaaagttctcactaatgagaaccttgactgggagttgaacccaaaagtggaggaaatactgatggacaacaaggaggcctttgggtggagcattcatgaactaaaggatttggaccccacaatttgcacccacagaatcaacactaaagagtggtctctaccgaaatggttacctcaaaggaaacttaatcccaacatgatggagaacacgtgcaatattgtgatggaaaatgagcaccatgagtttatagttgtgagaaagataatcggggatacaaggttagtcttgaacttggaaaacttccaattcatggtgaaaaagagcattgtcttggggcttaagttgtcccatgttgtcatagaggttgatcttgccaaggtggaggagtgcctatgggcattaaatattcttaagcagagtttagtgagtactcctgtggtgacaacccctgactggtcattacctttcaagctcatgtgtgatgttagtgacacaattgttggggcggttttggggcaaaaaaaggatagggtgttttataccatttactatgctattagaacccatgatgatgcccaagagaactacattacaaccaaaaaggagcttctggcagatgccaaacccaagttaattaggtggatcctcttactgcaagagtttgacctagaaatcaaagataagaatgggtttaagaatttggtggctaaccatttgtccagattagaccccttagtcatgcaaccaccagatgatggaagaataaaggagacttttcctaatgaaagtctccttactatggctacagtttcaaagacaacttggtatgctgacattgtgaattatctggcatgcagggtgttcctagatgacatcaacaatcaagccaagaagaagcttatgtttgaggcaaaaaaatatttttgggatgatttgtacctcttcaagattggaggtcatttaggtccttctaggattgctcataagccattatctaggaagatggaaatgccgcaaaataacatgcttgttgttgagatgtttgatgtaggggggatagacttcatgggtttgttccttaaatcctttggtaatgaatatatacttgttgttgtggattacatgtctaagtggctggtagtagtaacactatccactattgattcttgggtggcaataaagtttctaaagaaaaatattttcaccagatttggcacacctagagcaatcattagtgattgtggtactcaattttgtaataagttgtttgatggacctttggctaaatatggggtgattcacaaggattggccactcaagctagatgatgcactttgggcttataggacaacttttaaaacccccatgcttataggtaataataggttgatgcagctgaatgaattggatgagttcaaacttacaacatatgagaatgccaagatttacgaggaaaagacaaagagatggcatgatgctaggataagacaaagaacatttcaagtgggggagaaggtattggtatacaactctcacttgcatttgtttcttagacaactgaagtatagatggagtggtccctttgaattaagcaaagtatttccttatagagtgttagaaatgaaaaagaaggatggagccactttcaagattaatactcttagagtcaaagcatattatgaggtattccaacaggtgcaaaacattgtgcacctctccaacctttga

SEQ ID NO: 48556 - DNA, 312 bp, Glycine max
  Peptide Sequence Number=SeqID_165334
atgattgatgggtctgacgagacggtggtggtgggtaccaattccgagcctttcttcatgagaagggttttgaaagaagcgcctgggaacaacgttaatgatttcaagttattagtgtttatgacattggggcattttgtgaatgtttgtgggtcgttgtctggtgatgttgggtcgaggttgcattttgtttgtttggataaacttgaagctggctcagtagcagcagcaacaacaacaatcaagtaccaattcacaacagcagcagcttcaatagcacaccctttcaaaccagcaatctcaaacttctaa

SEQ ID NO: 48557 - DNA, 1052 bp, Glycine max
  Peptide Sequence Number=SeqID_165335
atgaagccaagaagaagaaatccagccaccacactaatagccactacaccaccggtgccaattccatctccacctccatcagggcttggtggtgatgataaaactcgcgatggcggtggcggggccaaattagtagttgaaggtggtgatggaggtgatgaccttggtgtagaatttgaagttggagctgtcctagaaggaggagtggatggttcgggtgctggtggagccgatgacctcggaggcggtgcattcaccggcggtggcggtgaattagccgacggcggtgacctagtggagtttctaggaggcggcacagccggaggggatggtgaattttgcggtggggaggcccgtggtggcgtggcggccggagagggtggcgaatttcgtggtggtgatggtgaagtgttgttaggtggtggagctggtggttgtggtggtggagctggtggttgtggtggtggagctggtggttgtggtggtggagctggtgactgtggtggttgtgatggtggtggagatgtgttgttaggagggtttggtggaacaggtgctgatggtgatggtggcggtggagagctaggtggcaccggtggcggcgctgccggagaagatggcggcggtgaagatggtggtgatggtggtggggatggtggaggtactaatggaggtggggttccagacatggagggaggcggagaactaggtggtggtgacggcggtgaaggcggcggattcgcaggagaaggggttgttggtggcggagaagctggttgttgcggcgaggaagtggaagaaggggtttgttgcggcggtggagtggtgacggtggacggtggaggactagtggtgttggcagaaggtgatgtttgtggcggtggcgcagccgtggaagtcgacggcgacggcgacactgccgacattaataaaagtaaaacattgaatgagattttcaattcaacctatgagaacttgtttgagggtgtgtcgtgtctgcgtaaggctaggcttctctcactcaagtcaggaacacggttacagggattgag

SEQ ID NO: 48558 - DNA, 852 bp, Glycine max
  Peptide Sequence Number=SeqID_165336
atgctggtctatgttgatgacattattgtcactggtaataacccaacaactgtcaagtctttagttatcaacctcaattctgaatttgcactcaaggatttgggagatttggatctcttgtccaagacagctatggatgaagctaactctatttcttctcctatggttggtggctgcaagcttaccaaaacaggttctgaggatttttctgatcctaccttgtatcgctctgtagttggtgctctacagaatgctactatcacacatccagaaattagtttctttgtcaacaaagtttgccaatttatgagtcagccaacagaacagcattgggttgctgtcaaaagaatcctcaggtatctaaagggcacacttcattttgggctgaaactggaacccaatttttctacaaagcactactttgttcatgccttttgtgatgctgaatgggcttcagatcctgatgatcgaaggtctacctcaggtgttgctgtgttcttaggcccaaatcttgtctcttggtggtccaaaaagcaatctgttgtggccaggtctagtactgaggcagagttcaggagtttagccttggcaacatctgaagtaacttggattcagtcgctgctgactgaactcaaagttcctcatgctccaccagttattttctgtgataaaatgagtattgtgtcccttgctcataacccttttctacactcccccaccaaacatattgagctggatttgttctgtgtcagagacaaggttctcagcaaacagcttcaagttgtccatgttccagcagcagccctgagagctgacatcctcaccaaagctttatcaccctccaatttgtaa

SEQ ID NO: 48559 - DNA, 690 bp, Glycine max
  Peptide Sequence Number=SeqID_165337
atggcttccacaaacaacaattcttctccgccactggttccaccagcgtcacgctcccctgtctcgttctcacacgctgtaacggcgaaactcacggattccaattaccttctatggcgttctcaggttcaacctgtaatcatcgggcatggtcttcttgattacattctcgctccgcaaattccgcagaaatttttcatcattgaagatcgcaacaacaacatccttctttcttcttctcttgagaatcgctcaattactgcttatctattgcacattcaatccctaattgattcacttgcatcaattggagactcgatttcaacgagcactcacatcgacctaattcttgatggtttgactgatgactgtcgcacaatttgtactattctaaataatttgcgtgatcctctaagtctggacgatgtcacttctatgctactggatgaggaatctagtattgaaaagtttcgtaagaagaatttgggctcgttgaatcttgttgagggtttgaattccaattctgcttttgaagctcaggttcatctaactcggggtaacacacactcctcctcaaactatgactatgtgtatggtaatcaagggaggggtgatggtggctgtttgtacggtcgaggtggtcgtggtggagctcgtggcagagggcatggcagatttgctgatgtttaa

SEQ ID NO: 48560 - DNA, 450 bp, Glycine max
  Peptide Sequence Number=SeqID_165338
atggctacaattagaagagcttccaccgttagtgagagacttcctttagataattacaagaaacttgtgtctctgccagagcttccactgactgtgaaaaaggtgactgcctataactgcatttctctgaagacagacatcacacaaggactaaatatcttaaaaattctgagtttggtagtcttgagtatttcatctttccgggagaccatccgattcggcagaataagtgaagtaaatgatcaatttggcaacataacatttaaatttgaacttgaagtcaataaagacagcataaaagggtgtgggattgataggaagaaggacgtacgtgaggaagaagcaagaaggacgtatacgaggaagaagcaggagtgtccaactggcatgagggctaactcaagatgtgagatcctgtccatgcatcccatgaacacacaggggcattga

SEQ ID NO: 48561 - DNA, 1062 bp, Glycine max
  Peptide Sequence Number=SeqID_165339
atgaaaagaaaagaaaagcttgcggggaaggaaaaccaggcagcaagaaaagaaaagaaaagcttgcggggaaggaaaaccagaggcatcaggcagcaagaaaagaaaaatcagagaataaataagaagcaaagcttacctgcgcggggaaggaaaccaatgcggcaatggaggtgcttgcgggaagaagaaggagaagacacagaatggcagaggtgtcctcctgttcaaccgcgtccggtgacggcgccggcgacggacaccgcgtcgcaccggagtcgtacgcgcatgggtgtccggtgcgagtccgacacgggacacgccgatgatgagccgcgtccgtgcttcataggtcaggatattgttcaagaatccgaaaaataccctggaaaaagaagtcggttgtggaaacatgaggaagtgcttgatgtattgaaatataacaagggaactaatgatgttcaaggcataattttagatttggataaattgataggggatctatatttgagctctgatttccttgcaaagatggctaacctgagatttcttaaaatccataaaaagtgcagatgttctcttaagtcttggccacctaacttttgtgcagaacaacttgtagagcttcgcatgagttttacagatgttaaaaagctttcggacggagttcagaatcttatgaaattaaagtcaattgacctttcattttccgacaagctggtggagatcacagacttatctaaggcagaaaaacttgaaaaagtttctcttgcttgctgttatcgcttgcgtcagctacactcatccacgttatctcttcccaagcttgcatatttgaatcaaaagtactgcagaaatattgaaaaccttgaaagcaatgttcattcaaaatctgtcaatgaactgacactcagtcattgtttatcgctcgagaaattttcagtgacatcatatgaaataaaagtattgagcttatctaacacctatgaagcaccgataccgacaccgacaccgacatcggacacgacacggacacggacacgtggacacctgaaatgttga

SEQ ID NO: 48562 - DNA, 1050 bp, Glycine max
  Peptide Sequence Number=SeqID_165340
atgtactgcaaatggaaagctgctctcacggaagcagccaatttatctgggtggcactctcaaaatagaactgagtctgaactccttaagggcattgttcgagatgttttgaaaaaattggctcctacgtacccaaatcagagcaaaagactggttggaattgagaaaagttatgaagaaattgaatcattactgagaattgggtcaagtgaagttataacccttggaatatggggcatgggtggcattggtaaaaccacccttgctactgcattatatcacaaactgtcttatgatttcgaaggtcgttgcttccttgcaaatgtgaggaaaaaatcagacaagctcgaagatttacgtaatgaactattttctacattattaaaggaaaacaaacgtcagttagatggttttgacatgagcaggcttcaatataaaagtcttttcattgtcctggatgatgtgtctacccgagagcaattagaaaaactaattgaagaatatgatttcatgggagcagaaagtagagtcattgttacaactagagataagcacatacttagcacaaatcataaaatatatcaggttgacaaattgaactgtgatcactctgttgagcttttctgttttattgtttttggagaaaaaaaacctaaacaagggtatgaagatctatcaagaagagtaatttcctattgtgaagttgttcctttggctttaaaggttctaggagcaagtcttcgtgaaagaaataaagaagcatgggaatgtgaattgagaaaacttgaaaagtttccagacatgaaaattcttaatgtattaaaattaagttatgatggcttggatcgtcctcaaaaggatatatttttagacattgcatgtttcttcaaaggagaagaaagatactgggtaacaggactactggaagcttttgatttctttccaacatctgggataaaagtccttttagataaagctctcataacaatttcaaatgccaaccaaatagaaatgcacgacttaatacaagaaatgggtcaggatctatga

SEQ ID NO: 48563 - DNA, 473 bp, Glycine max
  Peptide Sequence Number=SeqID_165341
atggcatcttcatcatcatcatcttcatcacatgttaacattaagtctggccccatcgatgctgatgtattatggatgcaacctaagcatgtttcagaacatgtttggaatgaggaagaagataggaaattacatatcagacgagttgtccccacgtatcaaggggaagaacaaattcctgagcaaatttttccttttcttctacaatctggtataagtgtggatggtttaccattaatcggtccaacaaatcttgattgggctgatttatgtgaggaattattgggagtcagaccacatgaagatgaaattagaggtagtgtggttaaattaagttggttggctcaccattttgcccaaataaataatgacgacgacgtagaacaagtacgaaggtttgcccgtgcatggatactgagattcattggaggtgtcttgttcgttgacaaaagcagtaacaaagtttcgctaag

SEQ ID NO: 48564 - DNA, 549 bp, Glycine max
  misc_feature (8)..(8): n is a, c, g, or t
  Peptide Sequence Number=SeqID_165342
atgaccanaaatcgaccgtttgtcgtggggtttgccgccgaaacccagaatgtggaagaatacgcgcggcaaaaactggcgcgtaagaagctggatttgatttgcgctaacgatatcctcgacccgcgcatcggtcaggatttcccgctaccgacctacgccaccccgggctccgccggtctcgacctgcgcgcctgcctggacagcgcggtagagctggcgccgggtgaaaccacgctgctgcctaccggcctcgcgatccatatcgccgacgcaagcctggcggcggtgatcctgccgcgctcaggcctgggccataagcacggcgtcgtgttgggcaacctggtcggcctgatcgactccgattatcagggccagctgatggtgtccgtttggaaccgcggccagaagcacttcaccatagagccgggtgaacgcatcgcgcagatggtcttcgtgccggtagtgcaggcagaattcaacctggtggaagaattcgacggcagcgagcgcggcgaaggcggcttcggccactcggggcgccactaa

SEQ ID NO: 48565 - DNA, 548 bp, Glycine max
  Peptide Sequence Number=SeqID_165343
ggggcggcggcgctgtccgacgcagagctgttggccattttcttgcgcaccgggttgcccggcgtgcacgtgatgcagctggcggagcagctgctgcgccggttcggctcgctttatcacctgatgtcggccgatcatcaggctttttgcagccaaaaaggcctgggggacgccagctatacgcagctgcaggcgattgccgagctggcgctgcgcttcttttccagccatttgtcgcaggaaaacgccatgctcaatccgcggacaatcagcaccgggttattcgccatcaggagatgtttgctggtaccatcagcagcgtcgtcgtctacccgagagaaattgtgcgcgaagcgttgaaggctaatgccgccgcgctgattctcgcgcataatcacccttcgggtaaggctgaacccagtcatgccgaccgcttgataacggaacaggtggtgaaagcctgtcagttattggagatccgagtgcttgatcatttggtgatcggtcggggtgaatgcgtctcttttgccgagcgcggatggctttaa

SEQ ID NO: 48566 - DNA, 594 bp, Glycine max
  Peptide Sequence Number=SeqID_165344
atggctggcgcgccgcacaccggcagcccgctggaactgcacatccgtcacctcccgggcggggtgttcaccgaccacgtgttcggcgccggcgacacgcagatgaaggaacgcgagatcctgcggctggaagggccgttcggttcgttcttcctgcgcgaagacagcgacaagccgatcatcctgctggccagcggcacgggctttgcgcccgtcaaggccatcgtcgagcacatgatccacaagaacatccgccgtccggtcgcgctgtactggggcggtcgtcgcccgcgcgatctgtacatggacgcgctggcgcagtcgtgggcccgtgacctgccggacttccgctacgtgccggtggtgtcgaacgcgctcgaggaagacggctggagcggccgtgacggtttcgtccacgaggccgtgttgcaggacatccccgacatgtcgggccaccaggtctacgcctgcggcgcgccgccgatggtggacgccgcccggcgcgaattcagcgcccagtgcggcctgccgcccgaggaattctatgcggacgccttcacgtccgaggccgatctggcgaaagccgcgacttga

SEQ ID NO: 48567 - DNA, 408 bp, Glycine max
  Peptide Sequence Number=SeqID_165345
atggaatcgcacgaagacagtacaaatggaggcttcaatcacttctcgttctttctaagaaccctaccagagcaatctgaggagaaacttgaggaatctccagaaattgctagagatgtcattattgctgccagaacatatgtgagtccgcttaaagttgtgaactatgaattgtacaatcacacgactataagtccctttaaggacgacgagttaatgctaagtccctttaagggcgacgagttaatcctaagaccctttaaaggcgacgagttaatgctaagttcctttaaggacgatgagttaatggagggagaggccctgacggactcttcggagtgtaggccttggggattacctggtttgagtgcttctttaagcctatgtttatcccatatggttgtgtaa

SEQ ID NO: 48568 - DNA, 1128 bp, Glycine max
  Peptide Sequence Number=SeqID_165346
atgggtgaagcagggaacatggttatttctattcaagttctgaggaatgtcactgacaacttcagtgagaagaatatactgggacaaggaggttttggaactgtttacaaaggtgaactgcatgatggcacgaagattgcagtgaaaaggatggaatctggggcaataagtgggaaaggtgcaacagaatttaagtctgaaattgctgttttgacgaaagttcgccaccggcatcttgtttcccttcttggttactgcttggatgggaatgagaagcttcttgtgtatgagtacatgcctcaggggacattaagtaagcacctttttaactggatggaagaaggactgaagccactggaatggaacagaagattgaccattgccttagatgtggcaagggctgttgagtatcttcatagcttggcccatcaaagctttattcatagagacttaaagccttcaaacattctccttggagatgatatgagagcaaaggtttcagattttggtcttgtgcgtcttgctccagaaggaaaagcttccgtagaaacaaggattgctggaacttttggatatttggcaccagaatatgcagtcactggtcgtgtgactactaaagttgatgtgttcagctttggggtaatattgatggagctgataactggaagaagagcacttgatgatacccaaccagaggatagcatgcaccttgtaacatggttccgtagaatgtatgtaaataaagactcattccagaaagccattgaccacacaattgatctcaatgaggaaacgcttccccgtattcacactgtagctgaattagctggccactgttgtgcaagggagccatatcaaaggcctgacgcaggtcatgctgttaatgtgctttcttctcttgtagaactttggaaaccatctgatcaaagttctgaagatgtatatggcattgacctagacatgtctttaccacaagcattgaagaagtggcaggcttatgaaggtagaagccaaatggaatcttcttcttcatcactcctacctcctagcttggataacactcatacaagcatacctacgcgtccgaatggatttgtggagtctttcacatcagcagatggtaggtga

SEQ ID NO: 48569 - DNA, 825 bp, Glycine max
  Peptide Sequence Number=SeqID_165347
atatgctatttcttctacaaaaacatcacatttggctttactctattcttatatgaggtgtacgcatcattctctgggcaacctgcatacaatgactggtttttgtcactctataatgtcttcttttcgtcacttcccgtgattgctcttggggtctttgaccaggatgtgtcttctaggtactgtcaaaggtttcctatgttatatcaagaaggtgtgcaaaatgtcctctttagctggcgtcgaattttcagctggatgcttaatggctttattagtgccataataattttcttcttctgcacaaaggcaatggagattcaagcctttgatgagaagggaagaaccgctgggagggacatactcggagcaacgatgtatacttgtgtggtttgggttgtgaacttgcaaatggctgtttctataagttacttcaccttgattcaacatattttcatctggggctccattgctctatggtaccttttcctcctggcatatggagcattatctcccagcttttctggaaatgcttacaaagtcttcattgaaactcttgcaccatctccttccttttggattgtgacattgtttgtttccatctcaacacttatcccatacttctcttactcagcaatacagatgaggttctttcccatgtatcatgatatggtacaatggataaggtacgagggaaagacaaatgaccctgaattcgtcgctatggtgcggcaaggatcattgcggccaacaaccgtcggttcaacagctcgcttagcggctaaggataatgattttagagtcagtgacactaaccatagatag

SEQ ID NO: 48570 - DNA, 2553 bp, Glycine max
  Peptide Sequence Number=SeqID_165348
tttaggagggtggctaatttctattttttggtaactggcatcttggccttcacaaaacttgctccttatacagctgtcagtgctatccttcctctgattattattgttggggcaactatgatcaaagaggggattgaagatttccaaaggaaaaagcaggatattgaggtgaatagtagaagagttaaagtgcataaagggcatggaacttttgaatatattgagtggaagaatctgaaggtggggcatatagtgaagataatgaaggatgaattcttccctgcagacctcctactgctttcatccagttatgaggatgcattctgctatgttgagaccatgaacttggatggggagacaaatttgaagttaaaacaagggttggaagtaatttcttccttacatgaggactttcatttcggtgattttaaggctacagtcaaatgtgaagacccaaatgcaaatttatattcatttgttgggagcatggagtatgaagaacaacaatatcccctttctcctctgcaacttcttctcagagactctaaacttcgtaacacagactacgtattcggtgctgtcatcttcactggtcatgacacgaaggtcattcaaaattccactgatgccccttcaaagagaagcaaggttgagaagaagatggatagggttatctacttcttgttttgtattttgtttctaatggcatttgttggatctattttctttggcattgcaactgaagatgacttggacaatggattgatgaaaaggtggtaccttagaccagatgattctacaattttctttgatcctaaaagagcacctgctgctgctatatttcattttttgacagccttaatgttatatggtttcttcattcccatctcattgtatgtttcaatagaaattgtcaaagtccttcagagcatcttcatcaatcaagatatccacatgtactatgaagatgctgacaaaccagcccatgcccgtacttcaaacttgaatgaggaacttggccaagttgacacaatactttctgataagactggaactctgacctgcaactcgatggagttcatcaaatgttccattgctggggtagcttatggccgtggtgttacagaggttgagagggcaatgaatagaaaaaatggttatcctttgattgatgacacaaggagctctcctgtcagaaatgctcccataaaaggatttaacttttcagatgaaaggataatgaatggaaattgggttaatgagccttatgctaatgttatccagaatttttttcgcttattagcaatctgccatacagccattccagaagttgatgaagacacagggaatatctcatatgaaactgaatctccagatgaagcagcatttgtgatagcagctagagaaattggttttgaattctttaaaaggactcagactagtttatcaatgtatgaattggatccagtttctggtgacaaaactgaaaggatgtacaaacttcttaatattttagaattcaatagctcaaggaagcgaatgtcagtgatagtgaaagatgaagaagggagaattttcctactctgtaaaggtgctgacagtgtcatgtttgagaggcttgccaaggatgggagagagtttgaagagaaaaccatggaacatgtgcatgaatatgctgatgcaggtctaaggaccttgatcctagcatttcgtgaacttgatgaaaaccaatacaaggagtttgacaacaaaatttcacaggcgaagaattcgattagcgaagatcgggaaacactgattgaggaagtatcagataagattgagaggaatctaatccttcttggtgccactgctgtagaggacaagctccaagatggggttcctgattgcattgacaagcttgcccaagctggaattaagatatgggtattgactggggataaaatggagactgctatcaatattgggttttcttgtagtttacttagacaaggaatgaagcagattatcattcatttggaaactccagatattaaaacattggagaaggctggagacaagggtgctattgtcaaggcttcaagagaaagtatccgccatcaaatatctgaagctgctcaacagcttactgcctccagaggaacctctcagcaagcatttgctctaattattgatggaaaatcacttacttatgcgctagaggatactatgaagaacatgtttctagaccttgcaattcgttgtgcatctgttatttgctgccgttcctcaccgaagcagaaggcactggtcactagactagtcaaatctggtactggtaaaactacattagctattggtgatggagctaatgatgtgggaatgcttcaagaagcagatatagggattggaatcagtggcgttgaaggaatgcaggcggttatgtctagtgatattgctattgcacagtttcgttatttagaaagattacttcttgtacatggacattggtgttaccgaaggatctcatcaatggtattgctactcttatatccacttctcaacattctatag

SEQ ID NO: 48571 - DNA, 261 bp, Glycine max
  Peptide Sequence Number=SeqID_165349
atgagagctcataatgatccacaactacttgaccttgaacatgaaaggcaaagagagcaaaaaggttgggctccatctctcacaaacacgagcatgatctcttgtagttctacggagacttactgggctgcatctttgggaagctatgatagcagtttcaccgaaaagaaaagaaaaagaactacgatagcagttggtagctatttttggcttggaaaagagcaaaaggttcaaaacattacttataacgggaaattttaa

SEQ ID NO: 48572 - DNA, 1092 bp, Glycine max
  Peptide Sequence Number=SeqID_165350
atgaaactggccaaatacaggctaaaggcccaagtggagaaggacgaaggcccaagtggagaaggacaaagcccccgagtggagaaggatgaaggcccaagtaatccttgtggcgtctatcctgacttatcttcctttaccagaagtggcgtctacccagacttatcttccttcactggaagtggcgtctacccagacttatcttccttcaccggaagtagtggcgtctatcctgacttatcttccttcaccggaagtagtggcgtctatcctgacttatcttccttcaccggaagtggcgtcatccaaaccttcactttatcgacttcgtggaagccatctcgtgcaaaaggatgtgctattgggcttcttatgggtgataaggtgatatattacttgaacaacattgtattaggtatgcctttccaacatggaaggattcctacagtaacaagcaatattggtgtggggactatggactgcaaaaagttcattactatatcctcatggtggcatgaaatttcggccagagattatgcgctactattgttttgcaagaatttgaaatttcagtcttctaatgtgaatgttttagttgaacttgatactcctgtgaagaactgcctgaatatatttggcttggaaagatctgatcttaataaatctactggaaaatcaattccttacttgaagctcagagagcttcctgatgagtcattcaaaatactctgtccaaatattgttgaaaaacaggaagaacttttcaaaggtttggaacaacagttatctggttttgcttctaatgttggaaaatgtaaaattggtaaaaatgctgtagcaaaccaaggtgtgaacaatgtggttgctaaatcagagagttctgatcaacaggtaacaaaagatattgagggatttgatgtggacatgggcggaaatgagggggctaaaattgctgtggatgtagctcacagtcttgatggtccacataatgagttgaaggctagctgtcttaaagatattgtaattgatttgcttcgtggaagtggacccaaagccaagctgaagaaggctgagatacttgaacatacttga

SEQ ID NO: 48573 - DNA, 354 bp, Glycine max
  Peptide Sequence Number=SeqID_165351
atggcgggtccgatgacatgtaggggtaccttatggttatctgcaccttttgtcaaccagaggcaaactaacatcgtcttctacaccctttgtcaatcgtggccaacaagcccgttgacacactcaacgcctgatagcatgcagagactaacgtcgtctgctgcacccttttgtcaaccaaaggcaagcgagcccgttgacacgcagagaccaacgttgtcatctacacctttgtcatccaaagacggcgagtccgatgacatgcgggggtaccttatggttatccacaccttttgtcaaccagaggaaggcgagcccgttgacacgcggagatttatgtcatcttccgcgtag

SEQ ID NO: 48574 - DNA, 303 bp, Glycine max
  Peptide Sequence Number=SeqID_165352
atgatttccaacgaccaaatcatcgataatactgaacatcatcatagattgtacctcagtcaatcctttagcattgaaaaaaagaagagaaaaagacagagaaagaacccagctcccagtttaaaaactgttacgctgccagtttctaagtgcaagaaaccaagaaagagactaaagacaaggagaaaagtagaaaaatcaaagcaagaagacaagcagcagttcactacagggatgacagtaaaagagtatcacataacctctctcaagtttcaagatcaagtgaaagtggcttgcttatga

SEQ ID NO: 48575 - DNA, 222 bp, Glycine max
  Peptide Sequence Number=SeqID_165353
atggtggtgacgggtgacggagaattaggttggaccttgggttgggtcgatcggtccgcctccggtgtgcaccggtcggctcgtcccttctgccggcgatgcgctcctgtccttaactggccgggtcgtgcctccggtgctgttactttgaagaaattagagtgctcaaagcaagcctacgctctgtatacattagcatgggataacactacaggattctga

SEQ ID NO: 48576 - DNA, 318 bp, Glycine max
  Peptide Sequence Number=SeqID_165354
atggagatcaaggataggagcaagggcatcaacaacattactctctctacacacatgcttgaaccaagcgtccattggatgaacaagacaatattttacaacttgaacaatgtgataaaaatggtgatcaacatcacagcgcttttgaatcaaacccacaacttccatggaatcatattgaatctctatgttaaaaaacccacattcacatgccatttactcaatgaaaaatgccccccatctctgcctgaagaacaaagttttctccaaggttacaagcaaaaccacctaaggattcacccttaccattcccgataa

SEQ ID NO: 48577 - DNA, 669 bp, Glycine max
  Peptide Sequence Number=SeqID_165355
atgaagagctcaaataatcaacacccattaaattctgtttcaaagcattttaatctccagcttgttcgcttccttccctatctcctctttttggcctttggtgtgaccattggtatcatcatcagcttctacctcaaaagctttagtcttcagcacactcaattcttacactcttcatcatcacagattaatgcaccaccaccaaatacaatgcccccaccaattgaaaaaccagaagtatctgattctaacctcaatcaagaggggccggaagaatttactccaccttctaatgttgtgcataatacacaagagtctattcagccttccatcgttgtgcatgataccaaaaagtttattcagccttctaatcatgttgtgcataacatgaaagagtttattcatccttctaatgttgtgcatgatatgagtgatgaagaactattatggagagcttcaatgacccctaagatcagagaatacccctttgatcgagtcgccaaggtggccttcatgttcttggtaaggggtcctgtgcctttggctattttttgggaaaggttcttcaaagggcatgaaggatactactctatttatgtacattccaatccttcttacaatggatcagacccggagagtttcagtgttttcatggaaggagaattccta

SEQ ID NO: 48578 - DNA, 381 bp, Glycine max
  Peptide Sequence Number=SeqID_165356
atggacaaaaattctaggataaccaaaaaggttatcaaagaagaggccattggttatttctctcaagaggttagtcgaacagattgggtcgacccaaaagtgcttgagattcagtttttcctggatgaaaacagtattgttgatttgctagaaagtcccttcaacattaataagcagggtggccacgaaggttgggtaatttgctcctctgggaatgatggtagaatgtgttcacagggacaaacaaaagacattgggaaagaggttactagaacttctgaacaagcatatgcttataatgattttctgcttatgtatcttgcatttttcaaggacttaggaattgaacttcctttaactgagtttcaaagaggttactag

SEQ ID NO: 48579 - DNA, 256 bp, Glycine max
  Peptide Sequence Number=SeqID_165357
atggatgaagatcaatggatgtatggaaatacaatgtctgaagaagttgatatggattatgaaaatgaacaagaatgtggtgtgaatgaaccacatgttgattatgatgttttgcagtgggctcgatcagttgcccatgaaaatgaatttgttgcagtcattatgaggaagaaagaatctgttagaagagacattaggagtaggacatgtggttgtcccttcaaacttcgtgggacaccattgattagaggggaag

SEQ ID NO: 48580 - DNA, 504 bp, Glycine max
  Peptide Sequence Number=SeqID_165358
atgtccaatatggaggagaatcatactaacaatgtgtcaacactcaccagaaacatcaggatcaccgtgttgctcaataatctacaaaaggctgccatggacgtattttttgcattcaaaacacaaggagaaaatccaatcccgacaattttagtagatactttcttctccatggaagtatatcatgaaaagaagagagggatgctacaatgttgcaaccatatgttgtattttccaaaggatacaattttaagttgtggggagttttcaaatgtgccattaatgggaccaagaggatgtgtagcatataccccagccataatgcttcaacaactcaaatggactcaagtagttcccaaagttgaagaattgggagggttgagtttccaatacacttcaagcgatactaatgtagatcaggcaaaggttagaacaatttggaataatgttagaaagaaaagggagaaagagttaggaaaacctcgtgtgacagcctcctcatag

SEQ ID NO: 48581 - DNA, 897 bp, Glycine max
  Peptide Sequence Number=SeqID_165359
atggagagtatccttgctaagcttgcaaacaaaattgaaagaaaacataagagggccaactcttccaacacatcaacttctctccaacctcaagccatcataactcattccaaagtcaaaacatttgatcctcctcagagtaaagcgtctccattagcgaaaagcaaagttgaggcctccaacaaaagaatcaaccgccaagtgattgaaactgactcctccacctctttcacaatctttcctagaggagattggatgggattgggaagatataaaaaatgtgaaggcatgggtgatttagtaaattatgggcaatggaagaaagttttgagtttgaaaaatgattgcaacttttttgggaatgtgatgacaggtctgaaaacattggtggagcaaatgactccagcttttgagcaaataaaattttgtgagaagacctatggaagttcccaaccttttgatattttgaagaaaaaactatcaagattgatagtcttgatagaaagctcaaaaaggggtgtggaaaaggatgcaaagtttaaaagcttgaaaggtgaggaggaagctaagcattttaaagatgaaggtgtccaacttgagaagtatcttaatgattttaagtctttcattgctaaggtggtcgaagatgctaagtcgagcaatgtcaagattggagaagttgagtttgaattggtaagagtgaagagtttttatgacaaacttgacaaagattttgccaacattgggattgaatcttttagcaatggcaataagcaggctcaatatcttctgaaaaggaacttaagtattgattatgccataatgcaaagcattgtaagtgaggatgagacatggaagacttttgttggggggagatttgttgcctcagaaccttga

SEQ ID NO: 48582 - DNA, 789 bp, Glycine max
  Peptide Sequence Number=SeqID_165360
atggagttttctatgattttcattgttagcaacattatgctactttttagttcatcatttggaaaaattgctagtcatccctttctgagcccaactccagcactagccccgacactagacttcctgaacctcactgagttactcagtgttgttggtccatttcacaccttccttggataccttgagtccactaaagtgattgacactttccaaaaccaagccaacaacactgaagagggaattaccatctttgttcctaaggacaacgacttcaatgctataaagaaaactaccctatccaacctcacttctaaccggctaaagcaagtgatcctcttccatgccttgccacatttctattctgtgactgagttcataatcagtccaagaccatgggttgtgggaaaggatgtcaatgtgaagaaagaagaagaaataaaggacacaaacaattcaagctctgaagggacaatagagaatccaacaaccagcgaagatgtgaaagacaacaagagattaagggcaattggagttaatacagtagggcttcaaagaatgggccttaaagaaaatgctttatttgactctctggctaaactcagccatgcggccaccatagttgaggccatgccatgccactctgccatgacacttggcaaaaactcatccatgcgaggtgagccattctcgcctaggcgagaaaacccacttgatgaacccttgttttcacagatttcatttgcctgggcgactccagtctcgcctgggcgaagaaacagggcactttaa

SEQ ID NO: 48583 - DNA, 480 bp, Glycine max
  Peptide Sequence Number=SeqID_165361
atgaaaggattacacaacctgtgtgctgtgtgcaataacacaagaccaaaatttgaatgcaacagaaagagagacttcacatttgctgaactacatgcagccacacaaggcttttccccaaagaattttctgtctgaaggggggtttggttctgtctacaaagggaggttttatgggaagaagattgctgttaagcaagctaaacttatttgtgcaaaccacaaaggagagaaggaattcaagtctgaagttgatgcactcagcaaagcaagacatgagaatgtggtcaaactgttaggatcatgcacagaagggaatcatagacttcttgtctatgaatatgtctgcaatggttcattggaccaacgtttatcacaacattctcgtaaacctctttgttggcaagacggggtgaaagtagctattggagccgccaaaggattgctatacctgcataagaacaaactcatatatacatag

SEQ ID NO: 48584 - DNA, 1545 bp, Glycine max
  Peptide Sequence Number=SeqID_165362
atgaagcatttcgtgcgcaacctcccttgtggtatgtataggataacaagtgacaattcaattgagaggttgaaagatccaaaatcagcagtcagtaccaaaacatttgccctcaggcaagaaaatgtaagctataaagaaatgtttccaggaagtgaagaggaggaacgttctcttctgatcagtggagtacagaggtctccacttctagtttcggaagcttgcggtatggttgtcaataccaagagggaaagttttattcaaataaagaacaagaaacaacagggaatcaatcactgtttcacatttcggagaatgaagagacgagccaattacaaacgaccaaacattggattgaagagagatttcagttatgctgagctccatactgctacacaaggattttctccgaagaactttctgtcagaaggtggatttggatctgtctacaaaggactgctgaatggaatgaagattgctgttaagcaacataaatatgcaagcttccaaggagagaaggaatttaagtctgaagtgaatgtacttagcaaagcaagacatgagaatgtggttgtgctgctaggttcatgctcagaaaaaaataataggcttcttgtgtatgaatatgtctgcaatggctcacttgaccaacatctatcagaacactctcgatcacctcttagttgggaagataggatcaatgtagctattggagctgccaaaggcttactatacttgcacaagaacaacatgatacacagagatgtgagaccaaacaatatccttataacacatgattatcatccattgctgggagactttggattagcaagaaatcaaaatcaagactcgatacactcaacggaagttgttggaactttggggtatttggctccagaatatgcagaacttggcaaagtgtctaccaaaacagatgtatattcttttggggtggttctactgcaactaataacaggaatgagaactacagataaaagacttggaggaagaagtcttgtgggatgggcgaggccacttttaagagagaggaactatccagatttaattgatgaaaggatcattaactctcatgatgtccatcaactattttggatggttcgaatagcagagaaatgtctaagcagggagcctcagaggagactaaatatgattcaggttgttgatgctctaactgacatagtggagggcagaacatgtgacataatactaagggattactcccctgcaagatcagattcaacctatagtgcatcagactctgatgaatctgaagacgaaatgcaggaacccttgaggtttgaaagcgagttactaagtcacagttcagaatccatagaaagtaacaacataagtcagatgatgcacatgattgtaagacagccaccatcccctccaattcagagcatctcttcgtctagctcaagctcatataagcttcattatgagtcaactagtgatggtgaagcacacaatgaaggggaaatagaaatatcaaattccaattgggggttactcaattcttag

SEQ ID NO: 48585 - DNA, 987 bp, Glycine max
  Peptide Sequence Number=SeqID_165363
atggagttcactccacaaagagggcttaagcaagaggacacattggcggggttcgtgttcaatattgtagtagaatgcctaactggtctgatgagagaagcccagaagaaaaacctatatgatggctttaaagtaggcagaaataatttggaaatcaatatattacaatatgcagatgatacggtcttctttggaacaacatcgatggaaaatgtaagagcaattaaggtgatgctgaggagctttgaattggtatcaggactaaagataaattttgccaaaagtaactttggggcgattgggatgtttgagcagtggctgaatagtgttgccagctatttaaattccagagcgttgtcaatacactttccttacttgggtatccctattggggcaaacccaaggcgtaatgagatttggggggatccaatagtcaagaaatgtgagagtaaattgtcaaaatggaaacaaaatatctctttcggggtaagggtgtatttgattaagtcagtcttgaactcgatccctatttacttcttttcttttcttagggctccaaagaaggtggtggataggttggtgaggctgcagcggtggttcttgtggggagaacactcgaaccaaaagatcgcatgggtgaattggggatcagtctgtttaccaaaggagaaaggtggcttgagcattaaagatttggaagggagctggtttaaaagcgagtctaaatggaatattgggtgcagatcaaaggtgctgttttgggaagacaggtggaaggatgatggtatcccgttgatggagaattccaatggaggagaatttttctgtgaaatagacatggttgcaaaatttatggaggatatagaaggcttgattgtacaaatgcagcaacaagatgtctggaggtgggagggagactcaagtgggggatatacagtggggagtgcctacaggctacttgatagggacttagcagatgagaattag

SEQ ID NO: 48586 - DNA, 3268 bp, Glycine max
  Peptide Sequence Number=SeqID_165364
caatgatgttgacttggagtttccaaaatttggatttcttcatgcggatgcctcagtggacaggaaaaatgatcaacaatcaaaggactcgtgtcatagtgctgaaccgatgaaaggggattttgtaaaaaatcatttctggaaaaatcatcctttcatgttggccaacttttatcctcttgatcagcaagactgggaagataaaatcctttggggcaattctcctatggagcctcagaagaaactggaggataaagatcataatgtcttaatgtgcagctctcctgtcaaagtggagccctttggctcatgggattcttttggagctaagaccaatttaatatccagaagtctatttcacccccaacttctaaggctagaatccagatctgaagtggatagttctagtcttgcagatggaagagaggcggagatatcagagcataatcaaagtggtcaagtaaagcgttttaccaaggttatatcacaaaacagagacatgatggagggctcctggttagacaagataatatgggaggagcttgatcagcctatggtgaaaccaaagcttatttttgatcttcaggatgatcaaatgcactttgaagttttagatagcaaggatggtacacatcttcgccttcatgctggggctatgattttaactcgttctttacaatcaatcagcggggattcttctgagctaccagggcatggaagtcaatatggatggcgacatgttgctaatgacaaacactattcaaaccgtaaaacttctcagcagctgaaatcaaattccaaaaaacgctcagctcatggtgtcaaagtttttcactcacaacctgcactgaagctgcagacaatgaaattgaaattgagcaataaagatattgcaaattttcaccggccaaaagcattatggtatccccatgacaatgaggtggctgtcaaagaacaagggaaattgccaacacaaggacccatgaaaattattataaagagtttgggtggcaaggggagtaaattgcatgtcgatgctgaagaaactctctcttctgttaaagcaaaagcttccaaaaagctagattttaaggtatcagaaacagtgaaaatattttacttaggaagggagcttgaagatcacaagtcacttgctgcacaaaatgttcaaccaaactccttgttacatcttgttcgtacaaagatacatttgtggccaaaagcacaaagggttcctggtgagaacaagtccttgcgtcctcctggggcattcaagaaaaagtctgatctgtcagtaaaagatggacatgtttttctgatggagcattgtgaagaaaggcctttacttttgagcaatgttggaatgggtgcaagactttgtacatactatcaaaaatgctcaccagatgaccaatctggctccttattacgcaacacagataatagcttggggcacattatttccctggatcctgctgataaatctcctttccttggagatttaaaacctggttgcactcagtcatcacttgagacaaatatgtatagagcacccgtatttcctcataaagttccattaactgactacctgctggttcgttcatcaaagggaaagctatcattaaggcgcattgataaaattaatgttgtcggacagcaggagcctctcatggaggtattatcacctggaagtaaaaatcttcagaattacatgataaacaggctattggtacacatgtgccgtgaattccaagcagcagagaagcggcatatgcctccgtatatccgtgttgatgagtttctctcacagtttccttaccagtcagaagcgtcattccgtaagaaaatcaaggaatatgccaatttgcaggtttgtgcttacgaaagcatgcaagctggcctctaccgtctaaaacatttaggaataactgaaacacaccccactaatatttcatctgcaatgagtcgtcttcctgatgaagcaatagcattggctgctgcatcacacatcgagagggaactgcagattactccttggaacttgagtagcaattttgttgcttgtacaagccagggtaaggaaaatattgaacgaatggaaattactggtgttggtgatccatctggtcgtggcatgggttttagctatgctcgggcacctccaaaggcaccagtgtcaagtgcaatggtgaaaaagaaagcagctgctaaccgtggaggttctactgttaccggtacagatgctgatctacgtagattaagcatggatgctgcacgagaggttcttcttaagttcaatgttcctgacgaagtcattgcaaaacaaactaggtggcatcgcattgctatgatacgtaaactttcaagtgagcaagcaacatctggggttaaggttgatccaacaactatcagcaaatatgctcgtggccagcgaatgtcctttcttcagttacagcagcagaccagagagaaatgccaggagatttgggatcgacaagttcaaagtctgtcagctgtaaatggtgatgaaaatgagagcgatttagaagggaatagtgatctagattctttcgcgggagatcttgaaaatttacttgatgctgaggagtgtgaagagggagaagagagtaccaatgacttaaaacgtgataagggagatggtgttaagggtcttaaaatgagaagacacccaactttggctcaggcagaggaggaaatagaagatgacgcagctgaggctgctgaattatgcaggctgcttatggatgatgatgaagctgacaagaagaaaaagaagaaagctaaagttattgtgggagaagctagattggtaccaaagatgcaatccaaattttcctttgacaatgctgaacaagttaagcaaataacaaatactttacaattagatggaactaatcactggaaagaggatgcaatcacagatcttagggagccaaactcgactttggatagagtgaagaacgagccgcaagagaccgattcgaaccagtgctcgagctcgaggctgggttgcatttcggatcccgcagttgaaaacaacaatcagaggatcgccaagagaaagcagcgagagaagaaggtgtcatcggaggcgaatggaggaagcgtgtcggtggaggaggaggactccggcgtctgcggttttgcaccaatggcagtggacgcggcggcagtgtcggagggtagctgcagcatcttccacgaagttagagagccagaacttaacgaggatgatgaagctgcatag

SEQ ID NO: 48587 - DNA, 851 bp, Glycine max
  Peptide Sequence Number=SeqID_165365
gatcaaatggaacagctgggcttaaaagcgaacaaaagagacaaccaaacaacaatgaaagacagcagctcaacagtggcccaaacagccatgaggcttctccaacaatgttaaagggtagtggggtgaaggaaattgttggctgggaggataaacacaacgaaaatgatgttacagtggcatcaaaactggcttcaagtcctagaacttgcgaactgttaaaagaagcaacaattaattgggacatggcaaaaaatataggagtaaactgttgtaaccaggaagggtcattggtatgcaaaatgatgagtatggaagagagggataagggagagtctcagaggatgggaaatagtgaaatggatatgctatgcctgcaagaaactaagaaggaagtgataaataaggctgtatgccaagccttggggggtgattctgatgtcaagtgggaattgcagccagcatgcaacaatgctggaggaatactgtgcctctggagtgaggagacatttaaattggagaagaagctgattggttgtggtttcatttacctgaatggaatttgggttgctgatggcagaaaagtgtcaatagtgaacatatactcaccatgtaatgcaactttgaaaagaaatctgtgggagcaagttagacggataaggagtgcaaatttgggaggcctatggtgtctattaggagattttaataatattagaagagcatctgaaagagtaggtgtatgtcaaaggccacaagatgagaatattatgagggaatttaatgaacggattgcagaactagaggttgaggatgtgccttgtgtgggaatggcttaccaaatggcaaggtag

SEQ ID NO: 48588 - DNA, 2504 bp, Glycine max
  Peptide Sequence Number=SeqID_165366
atggggtggagtgttgaggctacaactcctttgcatatcaaattaggggatggtttcaaagccaaaactgaaggagagtgtaaaaggatcttgatcaaaattggtcaaatgcagatgaatattgatgcaatgctttttgatttggatgggttggatgatgtcgaagaggaagatgaagagggagaaatgagtgtgatgagtctgtttggtttggtagcagctcaatcaaacagttttgaaactatgaaactaagaggtaagatccaaggggtgcctattctcgtgttggttgacagtggtgccactcataatttcatatctcataagctagtgaaagccatggggtggagtgttaaggctacagctcctttgcatatcaaattaggcgatggtttcaaagccaaaactcaaggagagtgtaaaaggatcttgatcgaaattggtcaaatgcaaatgaatattgatgcaatgctttttgatttggatgggttggatggaaaaggcaaggagaatctcccatgttcagccctgcagagcttattggctaagcccaaactgggaagtgagggtttcttcatggcatctaaggtgcagatggggaaaatgccaaatccagaaaacgggaagttatctgtttttggtgctgtttttcaagagcctagaggtctacctcccaaacgaaaccaagagcatgtgattcatttacttgagggtcagggaccagatgacacatggcgcatgtgtgtggactaccgtgctcttaataagggtcattatgagtacctcgtaatgccctttggtatgatgaacgctccatccacgtttcaagctcttatgaatgcagttttcaagccaatgttgcgtaagtttgttctggtgttttttgatgatatcttggtgtacagctctacttggacagctcacatgtctcacctgcggacttacgggagggattatgggaagttggccaagcccctcacggaagtgactaagaaagaaggttttaaatggggtcggaatgagcaacaggcttttgatgttcttaaggaaaaagtaactacagcaccagttcttgctttgctcgatttcactcaggaattcttcattgaaagcgatgctttgggaaatggtgttgatgcactttctcgtatgcatgattcaatggcttttgagtcaatggtgcattaccccgaatgggaaggcaataaagaggtgattgatgaggtccacagggatgccatgttacaaaagattattgctgatttgaaggaaggcctgcctactaaacccggcctcatgcagccgctgcctattccttcattggtttgggaggatctttcgatggatttcatcacgagactccctaagtccaaaggatatgagactatttttgttgtagttgaccttgttcaagttgcaagggactcacttgaagttgagcatggcatatcacccgcaaatggaggtgctttccatgcttccacaaatactactccttttgagattgtctatgggagacaaccacctattattactcgatttttgccaggagaggttaaggtgcacgctgttcagcgggatttaactgatcgcgacaagtgtttgcgtcagttaaagcatcatttagtatgtactcagactagaatgatgagtttggctgatggtcatcgccaagataggcagtttgtgatcggtgagtgggtgtttctgaagcttcggcctcatgtgcagcagttggttggggccagaattaatcccaaattggctccacgcggtggggaatatcaagtggagagtgagctgcctaaagagttggactgtgacccgagtgctgtttgggagcctttaacagtgctggatactcgcacggctattgaagaggctacttgggaggatgaggctctaatttcacggcaattccctggactcagccttgtgggcaagtctgtttctcaagagggtggtagtgatagggccttaaaaggtgatgtgggcttaggtgatcaaagagttaagcccaaggaaagccctgaagttccgaaaaggtctatggctatgccattgcctgttttatgtgtggaagatggtgtgacaattttacgtttctctgaaatctttggcattcatgaacctctcagaaagggagaaaagagagagcatcgacattctattcctagagaagaggatgaagaggaattcctcaagggcttctcccagagtctctcacttactaaacaggtttgtgtagttcataatgatgtatcagaaagcaatgatgttgacttggagtttccaaaatttggatttcttcttgcggatgcctcagtggccaggaaagatgatcatcaatcaaaggactcatgccatagtgctgaaccgatgaaaggggattttgcagaagatcattcacggaaagatcatcctttcatgttggccaacttttatcctcttgatcagcaagactgggaagacgccccctttttggggcaattctccagttccaa

SEQ ID NO: 48589 - DNA, 348 bp, Glycine max
  Peptide Sequence Number=SeqID_165367
atgtggggcatcccttttatccttgaaccaaaccaagccctgacatgtatcatgtctagccattctacgagccttgagccaaaatctcgactcaccataaaccttgacccaggcaaaaaaagaagaagaagaagaagagaaaagaaggaaaattccccaatcaaagagtgggagaaagcaaaaagaaaagaaaggaaattcccaatcaaagaatgggagaaagtaaaaaaggaagaagaagaaggaaagaaagctcctgatcagggatcgaaggaaaaacagaagaaatgtgcagagaggtctttggaccggacaatatctgaacaatacagaattgtcaccaaatga

SEQ ID NO: 48590 - DNA, 264 bp, Glycine max
  Peptide Sequence Number=SeqID_165368
atggaaacccagcataaattagtaggttccaagttgctagtgaaaggactcaaaaacgctagagaagaagccacagtgttttttggaggaagcaacccagctcgcctgggcgagctgggcggcaacctcctccccctttttcctataaaaaggctgaagggggctgttctaaggatccctcagccccttggctatgtatttcagctattttgggtgaaaaaaattgtttccgtgaagaaaatccaagccgaggtgcttccgtaa

SEQ ID NO: 48591 - DNA, 261 bp, Glycine max
  Peptide Sequence Number=SeqID_165369
ctctgtgttcgcaactctgcctcttcttcgtctcagctccgtcttcgtggctttgcctgtgatgcaatcatccctaggaagggaccagttaccagagccatgagcaagaggctccaagaggattgggctagagctactgaagaaggccctagggttctcatgaacctcaaggcaccacatacaccagttagcccttcgtccattaagcatgaacgcaagttaggctcagaggcaattaatcgaacacgaagcgtgcactga

SEQ ID NO: 48592 - DNA, 282 bp, Glycine max
  Peptide Sequence Number=SeqID_165370
atgcgaaaggatgtggatggccaatgggtgcataaacacgaccttccacctccaattcctgatgaacacacacccttcctgccaccgcaacaggattcctcatctttcttattgaatgacgttctcattgagcttaggtatcttagggatttcgctggtgatcgtttcgatgctatggactcacgcatcacgcgtcttgaagatgacatgagcttcattcgtcgttgctttgatcctcctgcggatccagagaagtttcttttacatcctacttttatctag

SEQ ID NO: 48593 - DNA, 517 bp, Glycine max
  Peptide Sequence Number=SeqID_165371
ggccattgaaggaggtaaagattatgcctttgctaacctagaagagttgttcctagtacccaatatcatcacccctcccaagttcaaggtgctggactttgacaagtacaaggggactacttgccccaagaaccatccaaagatgtattgtcggaagatgggggcatacacaaaagatgatgaattactgatacattccttccaagagaatcttactggtgtttgtataatgtcttcggataggatgcaactacagaacatgtggagggatctggcagcccaagtggcacccccaatgatggaaagggagatggtaatcgtgatggtagacacattaccagtattctactatgaaaatggtgggttaacaccttcaagctttgcggatatggtcttcaccaacgaaaggatcaaaatgggtctaaaaagaggcaagtctgatcatcatgctttgataaatgcaaaaaaactggggcaaatgaagagggtgagaatgagggagaagcccatgctgtga

SEQ ID NO: 48594 - DNA, 288 bp, Glycine max
  Peptide Sequence Number=SeqID_165372
atggagcttacttgtatcactgaagctagaaacaatgcagcaaacacaaatgcaaatgcaaaatttggagatttttggatgagagaggaagaaggaaaagagagtgcttggcttagcacgaggatcacaccgcttagcgaggtttgcagatccgaaaagctacaactcttgctaagccaggatctggctagcttagctaaaatgatgcatcttaagtacaggaggaacatgcgcttagctgataaggacatgcttagcgctcacgtttccgcaatgaattcagcttag

SEQ ID NO: 48595 - DNA, 648 bp, Glycine max
  Peptide Sequence Number=SeqID_165373
atgcagatagtggaatggggaaaattcaacatgattgaagcagagcgtcgccttctggcgaatgcccttcttgatttctcaaaccaacgttttattctgatatcagaatcatgcatccctctattcaacttctcaacaatctactcatatttgatgaactccacccaaagctatgtgatggcttatgatgaagatagtctagttggacgtggacgttacaaccctcgcatgtcccctatggtcaccctcaagcaatggagaaaagggtctcaatggttcgaaatggacagagaacttgccctagaagtggtgtcagacaaaacctacttcccaatttttcaagagcactgcacgagaccatgctatgctgatgaacactacttgccaacatttgttaacataatgtttccggagaagaattctaataggagtttgacttgggttgactggtcaaagggtggcttgcacccaactaaatatgtgagaccagaggtcactgtggcgtttttggagaatttgaggaaccagaaatgtgagtataatggacaagcttacacaaatgcttgttttctctttgcgaggaaattcttgcccacttctttgacaaggctcatgaggttttctccaagtgtcatgcacatacaatga

SEQ ID NO: 48596 - DNA, 369 bp, Glycine max
  Peptide Sequence Number=SeqID_165374
atggagattctgacggggaaatgcccctccttcgaggtggacggcggctgcgccacggcggtggagcttccccggtgggtccggtcggtggtgagggaggagtggacggcggaggtgttcgatctcgagcttatgaggtacaaggacattgaggaggagatggtggcgctgctgcaaattgctatggcgtgcactgcgaccgtgcctgatcaacggcccaggatgagccacgtatcgaaaatgatcgaggagttgagtggggtccacgtgtcacagtctcatgacgcgttggactcagtttcggagtcaccttccgcgcctgaagatgcttgtacaggacgagatggtccggctagtgctagtcaatga

SEQ ID NO: 48597 - DNA, 540 bp, Glycine max
  Peptide Sequence Number=SeqID_165375
atggggctgatggttttggttataattgttctcggcgacgtgttggttcttgctttggtgtctctgatcctctactgctatttctggcggaactattctgtttcgttaaaagaagtaaaagtagagacccattcgaagtcgaaggcagtgtataagaggaaggtaaacagtgaggggatggtgtttttggaaggggtgaggaggtttgagttggaggagctgctgtgtgcgtctgcggagatgttggggaagggcgtgtttggcacggcgtataaagctgtgctcgatgatgggaacgttgtagcagtgaagaggctgaaagaagtgagtgttggagggaagagggagcttcagcagcggatggaagtgcttggaaggttgagacactgcaatgttgttcctttgagggcttactatttcgctaaagatgagaagttgctcgtgtccgattacatgcccaatggtaacttgtcctggctcctccacggtttttacgctactcgagactttttgtttttagttgttccattcgacagctga

SEQ ID NO: 48598 - DNA, 476 bp, Glycine max
  Peptide Sequence Number=SeqID_165376
aggcggttaccggagacgttgaagtcttgaagatgagaaaggttgttgatgttgggaatgcggccacggagagttgccggaatctgaccggagaggttgttgtaggagaggtcaaggcggtagaggtgggggagggaagtgacggtggcgggaaacttgccggagaatttgttgtgggagaggaagaggagcttgagagcggtgaggttggagagggagggaatgggaccgtcgaaacggttgcgtttaaggctgaggatgcggagctcggtgaggaaggtgagggggaggatggagccggtgaggttgaggtcttcgaggacgaggccggagacgcagcggcggcggcggtggtggtggttgttgttgtggaggctgcaggagacgccgtgccaggtgcaggggttggaggacgtggagttccattgagagaggagtttgttggaagggtcggaggaggctttgaacgacattag

SEQ ID NO: 48599 - DNA, 426 bp, Glycine max
  Peptide Sequence Number=SeqID_165377
atggtgggtctcatggtatttttccgcttagggcattacgccaacattcctttctctcatcataagacctactcatgctgtgacgtaaaagctgaagacgctgttgattatgaagatattgatgaagagtatgatggtccagagacagaagctgccaatgaagaagactatttattgccaaaaaaagaatttttctctgctgaagcctctgtatgtttggaatccaaagcttctgtctttgatgatgaaaattatgatgaagattctgaaaaggagcaagactttgtgaatgacgattgtaaagttgataacatccctttagctggggagcagaaagagagttttgtggatgcatctaaagaagagagttcacttgaacatgaattacatgttgactcaccgcagactgaagaattggatgctgat

SEQ ID NO: 48600 - DNA, 348 bp, Glycine max
  Peptide Sequence Number=SeqID_165378
atggagcccacagaagatactttagaagcttggaagaaagatcagaagtttcaaggaaaacaaagaaatgagattttgatttgcttcttgaagcttcatcctgtgcatcctacttgtcgttttgggatattcaactggaggaagtatcctgtgattaacaatattaagcagcttgagagcgctgatctagaaaggaataagaagcatgctcacaaaggtggtggcgatgatgatgaagatcacgacgatgaggatgatgacagtgatgacggcaacaataagatgaagaaaggaaagtgggatgccaatgaaaatgaggaggagtataaagatggacacaaagaatga

SEQ ID NO: 48601 - DNA, 171 bp, Glycine max
  Peptide Sequence Number=SeqID_165379
atgtttggcgaaattcaaatgatagacgacgaagaagaatatgaggagtctggcaagggtaatcgttttcttgggttcatgtttggaaatgttgataattctggtgatctcgatgttgattatcttgatgaggatagaaatgattttgcctccaaacctcggtttgactag

SEQ ID NO: 48602 - DNA, 1437 bp, Glycine max
  Peptide Sequence Number=SeqID_165380
atgtccataacacctttcacactgaaggttcttgagcagtgcaaaattactctccctcccaatgaaactacaactacctctttcctccccctaaccttctttgacattccttggcttttcttctctccaagccaacctttatttttctatgaattccctcatccaacctctcatttcacagctacaatagtcccaaaactaaagcaatctctctcacacacacttcaacactactaccattttgttggtacattttttccctcttctgatctcaccaaaccccctctcatttgcattgatgacatgtcagtcgcgttgacaatagctgagtcaaatggagacttttttcacttttgtagcaattaccctcgtgatctcaaagatttccacttacttgtgcccaaattggcatcaagcttttcacttgaaggcaaagaagagttaattcttgtgctagctattcaaataacactattcccaaatgttggtctttgcattggccatgcttttcaccatgttgttgctgatgggaggaccttccacaatttcttcaacacatgggcctcatattgctgcagctttggatcagcttcttcagcttttccactaaagtcactgccattgtatgatcgaagtgtgattattgatgtaaaaggccttgaagaggttttcttgaaagaatggagaaaaagaagactagtccacgacattgccattggtagagaacctaacttagaagatgtctcaggtatggttagagccactttcttaatgagtgccactgaaatggagaagattaagtgcttcattattaatttttgcaaagaaaagaatcagactcagccagttcatttatctccttatgtgttgacttgtgcatttgtatgggtttgtttgctcaaaaaccaacaatgcttgaatgagagagtgaagcacgaagaccccacatactttggattcattgctggtggcataactagattggactatctagggccaaagacatatttaggtaattgtgttggctttggtagggcatcagtgaaaataaaagagttacttggacaagatgggattgttgttgcggctagagcaattggaagcaccattaagaagcttgattcatcactttttgatggggctgagaaatggattttggactgggaggtatttcatgggtcagagcaacatgtgcatgctaagtggtctccaaaactgaagctttatgaattggattttgggtgggggaggcccaagaaaatagaagagatctcaattggttatacaagagttgtttcacttattcagagcagagatgttgagtgtggaattgagataggcttggctttacctaagagtaagatggacactttcttcattttgttcactaaaggacttagtgttcttccatgtgatcctttgataaatttttcatga

SEQ ID NO: 48603 - DNA, 435 bp, Glycine max
  Peptide Sequence Number=SeqID_165381
atgaagcttctgcacgtcttaaaactcaataaactcaataagctcacctcactttttgttgttgaaagtttaatggtcgctggtaaagatactcttcttcttctcatacattcaaaggtggctgtgtgttgttgtcgcaacattctttcagactcttcttcttctcatacattcaaaggtggagcagagacgctggtggggagggagctagcaatagcaatggggtccaataatcatgacaactcaaaggagtttctagaactcataaagtccacctgcgagtcccgatccaaggccgaggaggatcgcatcgtcctccacgggattgaagccctaaaacgccgcatcaacgaggcagggaacaatgtcttagttgctaattgtttgttaatttttaaaatttataaactaaaaactaaaaatcacctcaaatag

SEQ ID NO: 48604 - DNA, 1623 bp, Glycine max
  Peptide Sequence Number=SeqID_165382
atggctgatggacagagacaacagaggcttagcaagtcatgcattctcctcatagccattgcaggaatagaaaggtttgcattcaagggggtggcatccaacttggtgacttacctaactgatgtcgtgaacttgagcaactcatctgcagcaaagatggttaacagctgggtaggatttacttccataatgccattgctggtggcaccaattgctgacgcatattggcgcaaatactccactataatggtctcatctttcctgtattttgtgggacttgcggcattgacaacaacagcactagcaaggtcatggcatcacaaaaacagatcaatgtcttcttcattcctctccctgtctctctacttaatttcattaggccaaggtggatacaacccatctctgcaagcctttggagcagatcaacttggtgaggaggaagaattgccttgtagcaaagaagataaaagttgcaacaaaaaaactctattcttccagtggtggtattttggtgtctgtagtggaagcctattgggtgttacagtcatgtcctacatccaagatacctttggatgggtgctaggttttgccatccctgctatttcaatgattctgtcaattttaattttctctggtggaagccctatatatttatataaagaacatgatgtccttcaagctaagaagcccctcaggaacatatttcaagccgtaaaagcttctgcattgagatgcttccattgtgaaattacccttccaaatgataagactgaagtggtggagctagagcttcaagagaaacccctttgtcctgaaaagttggaaagcctcaaggacttgaataaggatcctaaaggtggcatgtatctgctagcaaatgccaaggttatggtgaggcttttgcccatatggacaatgcttctcatgtttgcagtgattttccagcagcctgccacatttttcacaaaacaaggcatgacaatgaagaggaacattggtgcaggcttcaagattccaccagctacactccaaagtgctataacactgtccataatactcttgatgccattgtatgacaaaatattcataccaatcactcaggtgatcactaggcaggagaggggtataagtgtgatgcaaaggatgggaattggaatggttctctcaatcatagccatgattattgctgctctagttgaaatgagaaggcttgagattggaagccaaatgagaagtgcagggtcacaatcagaaacagttcctctaagcattttctggctgctaccacagtacattcttcttggcatctcagacattttcacagttgttggcatgcaagagttcttttatggtgaagttcccaggcatatgaggacaatgggaattgcgttgtatacaagtgtttttggggttggaagctttgtgagtgcactgttgatcacactagttgaagtgtacacaagttcaaagggaataccaagctggttctgtgatgatatggttgaagcacgcttggacagttactattggcttctagcatggttaagtacagtgagcttgctattgtatgcactcttgtgtagatattaccctaagaagagtgattcggacaatgaatattga

SEQ ID NO: 48605 - DNA, 222 bp, Glycine max
  Peptide Sequence Number=SeqID_165383
atggtaacaagggacatacatcactcacgacatcctattccgcaattctactctcacacagttcttatcttgggtctaacactaccactaagcctctcatgccttcatggtcttacgcaacatatggatgatgattgggaggacacaccacatgtcggtaaaggacatggtgctctcaccaactatggatatggctccactctagtcaataatgcaaagtaa

SEQ ID NO: 48606 - DNA, 182 bp, Glycine max
  Peptide Sequence Number=SeqID_165384
ggaagcagccaatagcagcgccgccaaagaagaaccagcaagaagacgaaggcgcaggggcgtggtcgcgaatgaagaagacgaacacgcaaggagggagagcgaaagcagcgtacggaaggctactagcattttctttagcttctagcacctttgttgtcgctgcaacaaaatctgattaa

SEQ ID NO: 48607 - DNA, 558 bp, Glycine max
  Peptide Sequence Number=SeqID_165385
atgcaacctcggcattatggatccaacctaaatcaacccaagaaattctctgcccccttcgacccgacaggatacatttactgggactatattgatgtctggaccaatgtcttctggcatcaaaataacaaatttaaacactcctggttaatttattttaaaaacaacacagtttacaattttccgaactggtttctccaatggtggaattttttcggaccaacctcacaaatctatctagaacaagtccaacaaggatttgagcaattcaacagaatgttcaataatcaagaatcaagaattccagctgacttaatgtatggaaagacagagagtagtaagcaattcccacctttgcagggacatgcttttgtcaaatggtggactcaattcgatacttcaaaggcggccccagaccaagtcaagaactggtttcaagcccacccaaaattcgtaaagcctactgatccaaagacttcattgtttctaaatcagaagtccagattagcagccttcctggccagctctaaatctaaagaaagtctagctaagaattaa

SEQ ID NO: 48608 - DNA, 480 bp, Glycine max
  Peptide Sequence Number=SeqID_165386
atggaagaaaagaaaaccgaaagtgaacaaaatgaagatgaaagccaacaaaacaagaaaagaattgaatgtctcggattcgaaaacttacaggttgaagaacgaagaacgcacgaagaatggacgaagaacggtgaagaaggaggaaaatcttcacgaaattgctcacggaaacgtttcagaagcattacgaaagcatctcggcttggattttcttcacggaaacacgttttttcaccaaaaacagctgaaatgcatagcataggggaaaaatggggaggaggttgccacccagctcctccaagcgagctgggttgtttcctccttaagcaacccagctttcaaaatgttcttgaaggggctagattcaaaaatttgaaaactgctatttacacccccatcttgataagttcaccagcctttttcgtaatttacgaaaaagttatggaagccttacggaagcatataggcaatgtatag

SEQ ID NO: 48609 - DNA, 339 bp, Glycine max
  Peptide Sequence Number=SeqID_165387
atgcgtaaccataggacgatcattaagagggagaggggatctttcattgccaaatttgtagctttttcattggtaggtgtgttggctacagctggggatgaggaaggtgtggatgatggtatcgaggacggtccacgtgcatcaaccgaggatagagatggtgtggatgcagcttcagtcgaaggtggagatggtgtagctgcaacatcaggaggcctaactagcatagacacagaagacacggatgaggtaaatgatggtagactatcccgaggtggtaatagtctaaccacatatcgttttttcttcgtagttctccctttcccactagagtcatga

SEQ ID NO: 48610 - DNA, 714 bp, Glycine max
  Peptide Sequence Number=SeqID_165388
atgtgtcctagaacactaagtgcaaactgcaaaggtccaagaacattaaaccttgatcaaagattaaatatcatgattgatgttgcttctacattacattatcttcatcatgaatgtgagcaatcaatcattcattgtgatttaaagccacgcaatgtccttaatgatgacatgattgctcatgtgagtgatttttgcatagcaagacttctctcaaccattaatggtaccacttctaagcaaacaagtataattggaataaagggtactattggttatgctcctccagagtacggaatggggtctgaggtgtctatgaatagcgacatgtatagtttcgaggttcttttgttggagatgcttactggaagaagacccacagaccaaatctttgaagatggtccaaatatgcataactttgtggaaaattcatatcctgataatctttttcatattttggatccatcacttgtaccaaaacctgaagaagcaacaatacaagaagaaaatagtcagaatctcactccaacagttgcaaattacttagtttcactccttaagattggacttgcttgttcagtggaatcaccaaaagaaagaatgaatgtggtggatgtcactagagagctgagaaaaatcagaaaagcctttcttactggtaagataaatggaatattacttaattctctgcatattactagagaacaaatgtag

SEQ ID NO: 48611 - DNA, 231 bp, Glycine max
  Peptide Sequence Number=SeqID_165389
atgggtcaatccaacccgacacacttactattatacgctaaaaatcttggcttggctcaggtcaccgtaggttggcagtacaatgtcttcttcgagttcctttggttgaaaatcttcaaggataatgaggaacttatagcttcagaattagtgcttccaaacacaattgtctttacaaaccactcctacaatgcaacttctaatgacaccttagtcgtgtgtaacttctga

SEQ ID NO: 48612 - DNA, 240 bp, Glycine max
  Peptide Sequence Number=SeqID_165390
atggccattgtcagttcaccatggtcgtggtcacattgccaaggccatactgagatgacatggccacacattgatttttatgaattttgtgaagatggccacactcaatttaccatgtccaagtgtggaatttctccgagaatttcacctcggtcgtgggaaaagagctccttgaaagcacctgtggctacaaaggagcatggagatcacaacgggggtccttttggtctaggattatga

SEQ ID NO: 48613 - DNA, 171 bp, Glycine max
  Peptide Sequence Number=SeqID_165391
atggctgctgttggaggagctgggttcgatgatgaaggaatgtcatcggttcttgccctttttcttgatgccatctacaagaaagggatccaaacaactacaaaaatcaaggtcgttcagatcagaaaatgccgtaacgaattgcgcttagcctatggaagctcggcttag

SEQ ID NO: 48614 - DNA, 213 bp, Glycine max
  Peptide Sequence Number=SeqID_165392
atgaataagagaagcaacaagcgagggagcgcaagggagaaggaagcgagggttcttaccttcgcagaagacaatgtcgcaagggagggagtgcgaggaagaaggaagatggcggcagctgctcagcggaagaacagtggtgggtacgagagggtgtgcggggacgatgagggagacaatgtgaaagcaaagctcactgagagaggggagtga

SEQ ID NO: 48615 - DNA, 303 bp, Glycine max
  Peptide Sequence Number=SeqID_165393
atggaggctcagctaaaacatttcagggtaaaacgttttcccacgccaccgtcactcagtcactcgcacaacctcaaaaagcttttcgcagtccctcgccgcagcatgttgcataactatatgtattccgtcaaatcaaccttggcagcagcattgaagaaattgaccgagaaagggattgtgatgaagaagaaagctggggatgttggagacatgattagggatgttgtcaaggatgaagatgggtttaaggggtcttttgttagggccatggatgagttcttatctgctactgagttctaa

SEQ ID NO: 48616 - DNA, 807 bp, Glycine max
  Peptide Sequence Number=SeqID_165394
agggctacaggccctcgccttcagaggactacaacgtcctcgccttcagaggtttgcaggccctcgccttcagaggactacacgtcctcaccttcagaggactacacgtcctcgcctttagagggctacacgccctcgccttcagaggactacatgtccttaccttcagagggctacacgccctcgccttcagaggactacacgtcctcatcttcagaggactacacgtcctcgtcttcagaaagctacacaccttcgccttcagaggagtacacgtcctcacctttagagggctacacgtcctcgcctttagagggctacatgccctcgccttcagaggactacacgtcctcgccttcagagggctgcatgccctcgccttcagaggactacacgtcctcgccttcagagggctacacaccctcgccttcagaggactacatgtccttaccttcagagggctacacgccctcgccttcagaggactacacgtcctcgccttcaacgggctacacgccctcgccttcaaagggctacacgtcctcgccttctgaggactacacatcctcgccttcagatggctacatgtcctcaccttcagaggactgcacgtcctcgccttcagaggactacatgtcctcgccttcagagggttgcacgcccttgccttcagaggactacacgtcctcgccttcaaaggctctgattatgagcctttgtcagttctatggagtgcccgttgcccccaacaaggtcatcagaccccctattaaccggactttcatcaagaagtattgcgccccctag

SEQ ID NO: 48617 - DNA, 294 bp, Glycine max
  Peptide Sequence Number=SeqID_165395
atggatggagtgacgctgtcagagataaagcaagggtgcacaaaatccttgaacctcttctgcctctgtttcaacgccagaaatcatcatgtccctctgctttgttctctatcgccatcattgtgcccacatcatcctcctcctcctcttttctctttcaaccacccccacacaccccacatacctaaacccaccaccatcattactactcctcacacctcactacaccaaaaagaaaaaaaaggtttgagtgtgggattaacgctcggatttccacaaggtagtttaagttga

SEQ ID NO: 48618 - DNA, 468 bp, Glycine max
  Peptide Sequence Number=SeqID_165396
atggaggtaaatagtaagcagacttctgttgaaaatcagcaagcaatacaggaacaaccacttaagctgatagatagtagtagagctcatcaagctgaaccacgaaattccataaattggaattctcctaaagaagcttctgttgactatcaacaagcaatacaggagcagtcagttgaattgtttgatggtggtggagctgatcaaagtgaaccagaaaattccataaattggaactctcccaaagaagcttctgttgataacgaacaagcaatacaggggcagccagttgagctgattgatagtggtgaagctcatcaaggtgaaccagaaaattctgtaaattggaattctcctaaagaagcttttgttgacaatcaacaagcaatacaggggcagtcggttgagctgattgatggtggtggagctcatcaagatgaacctgaatattggtctggtgattcctaa

SEQ ID NO: 48619 - DNA, 1233 bp, Glycine max
  Peptide Sequence Number=SeqID_165397
atggtcagagaaggtggtggcacatggcaacttcgatggctcggaagaaaggtgggcttgaccagtggtgctagcagtgacagcttttgcacagcgaaatatggttcaccgaataagaacactcgccggaaaagttactggaaaacagaaacagttctccgaaagaagggcaatgagtggaatgccttattagcagaattccatcagtccccaacgggaggtcatatgggagtctgtaaaaccctggcgcgtttggaagataacttcacttggagcaccattagggaggatactcgaacatttattgccagctgcttggattgccaacataccaagtatgaaactcaaaaactagttggattgctttgtcccttgcctgtccctaatcgaccctgggaggatctatccatggacttcatcgtgggactacctgcttatcgtggccacacaagcattcttgtagtgatagttggcaaactccctggcatgcctagaagtattgtttctgatcgagacccactttttatcagtaagttctggcaggaattattttccttaagcggcactaaactcaggatgagtttggcatatcatccacaatcgaatggccaaaccaaagtagctaattgcattgttgagcaatatttacgtgcctttgttcatagaagacattcgtcttgggggcgtttcctcttatgggcagaatggtcttacaatacatcctgtcattcaactacaggcatatctccattcgaaattacttttgacagaaagtcacctaattttcctcagtatatagcaagtacttctaaaattgaagcagtggatgaaatgcttggtcaacaggaagctaacagtctcgcatacatccagtgttccattcttaaaccgtattttcaagcttcttcagcttcacctgagccagtagaaatgccaccttcagccatggaaaaccaacctgtcatttcacctttgaccttcctcacaacaaaatggattcttttgtcttctgggccgaagcaaatggtattggtacaatggcttaggttgcatcctgatgaaatcgcttgggaggagtggtctgaattgaaagtagcataccaccttgaggacaaggtgttacttgatgggcttgggaatgatacaacaaacactgggggtctacaagaagcaagaaccacaaggcctaaaaggaagagtggaccacctgcttatttgaaggattacgcctag

SEQ ID NO: 48620 - DNA, 375 bp, Glycine max
  Peptide Sequence Number=SeqID_165398
atgacttggaaacaatatgtggggttattagcttatagaggcccctgctcacctaggctagcgtctgactcacctgggccatcaaacaacttcagggttaaggaaccagctcgcctgggcgagctcatgacttcaggagtaagcattagctcgcttgggcgagttggaagtccccaaagtgatccttttcctataaataggcgtgctatgggggctgagaaggggttccggcattgggtagtgaaggaaattaagagaaataagagagaagaagaagaaagaagaggaaacgaagtcgaggcactgtcgaatcgcgactgtggtcaatccctacatcattccttgttcggtgttctccgtgcgaccgttggttag

SEQ ID NO: 48621 - DNA, 1146 bp, Glycine max
  Peptide Sequence Number=SeqID_165399
atgtgctctaaaaaggttaaagcaaattgggaagaactcttggcaggcatgacggaagcatccattagttggttcccacggtggaaagaaggaaaggcaggagtgttatgctcatgtgaaggattcccaaatatccctttgttagggatgaggggttgtattaattataatcatgtgctggccataagacagttaggttacccaatgagaggtgcaccgtcggaggaaatcatcgcgcctttcattgtgcgagataaggagcttaggggaagtagcaatggcgtcattggcagctatcacaaatggttgaagtctagaacgcaagggataacttggctcccaaagctaaaaggtctgagtgggaaagaggctaaaattcccgaggagagtaaagaagtgcaagctttgaaagcggagctaaaaaagacaagagtggtgaaggagaagctgaaggtgccagtcactagggtcaggaaagaatgtgatgagctaaaagatatcaacgtgaccacggttgaagcgttaaaacaggaaacgaaaaaagctcgaaaggaagaatggagcaagaacaagttccaaagggctttgtggggcagcagtaacgagctcaaacttagaaaggctgagattgacaaatcaaggatggaaagcatggtgttagaggataagttaaagatttgtcaaaggtcaaagagaagtttgacagagcagttgagcaaaataaaagagaatatgttgataatcattgatcaatataaggagaaggtgaacctagttgctagtcacaggcagatgctggaagatgaacaggcaaagcgagatagaggaagttcaagaatagatgaggatcaagttgctgtgctggacgaagaaacccatcaagaccagtcaaactgggtgcagcggtgctccccgagctttgaattgaagaattggcggatcatagagcgactcgagatttctgtgtcaaatccaatatccaacaatgagtcctgtgaaagtagtgataccgaggacccggatgttgactttgagcaactagtaaaccaagctgaggaggaagaaaatgaggattggggacttcccccggatttgaggagaatgtgttggacaagtggcctcagaaattttaagaaggggggttga

SEQ ID NO: 48622 - DNA, 753 bp, Glycine max
  Peptide Sequence Number=SeqID_165400
atgacccaagagttcggtagcatggagagacaccgtatggttatctgcacctttcgtcatcccgagacgacgagtccgatgacatgcggggacggcaagtccgatgacatgcgggggtaccatatggttatccgcaccttttgtcatctcgagacggcgagtccgataacatgcggggacgacaagtccgatgaaatgcgggggtaccgtatggttatccgtaccttttgtcatctagagacggcgagtccgatgacatgcgggggcaccatatggttatccacacctttcgtcaaccaggggcaagcaagcccagacggcaagtctaatgacatgcgggggtaccgtatggttatccataccttttgtcatctagagacggcgagtccgaagacatgcggggacggtaagtccgatgacatgcggggggtaccgtatggttatctgcaccttttgtcatctagagacggcaagtctgatgacatgtgggggtaccatatggttatccgcaccttttgtcatcccgagacagcggagataccttatggtcatccgcacctttcgtcaaccgaggcgaacgaattcgacgatatcaagatgatgttgtcgtccggagacattcaagcccaacggtgcacgagattcttctctgctgggcggggacgatcaagtgcgatagcacgtggaaacgtcgtgggttccactggttgggatattgactggccgaatgatgttccgcttgaacgaaattag

SEQ ID NO: 48623 - DNA, 213 bp, Glycine max
  Peptide Sequence Number=SeqID_165401
atggcgaatttgtggcatatgatgctaggatggatacctggcatattagatggttgccatgcaataaatccgcattcctttggattcttagtccacgctcatgacttgactgtcgctaccgctagaggtgggataaggcttgcttggctctctgataagaggataaggagccaccttcaagctttcaacgtagcactgtcaggtttgctttag

SEQ ID NO: 48624 - DNA, 363 bp, Glycine max
  Peptide Sequence Number=SeqID_165402
atggaccagggatggagtcctccgtaccacttctatgttgcccctttaagggacattgggaagactcaacataggatcgcgtcgtcattgggtattattggtttgataggaatgcgattagccctaggtgtgcttgttgattgtgtgggcagagtgttcgtccccttgggggcgtctcacacgagcctcaaactcatcatggttggcattcaattttctaagttcctcttcatggtggcattccatatcggcaatgcggtcttgattgaagttgatggagaacatcgttgtgcatcatggtcattggaggagcactggaattttctgggagtggctcttgctgaaggccggagtgtgtgctag

SEQ ID NO: 48625 - DNA, 2376 bp, Glycine max
  misc_feature (2228)..(2228): n is a, c, g, or t
  Peptide Sequence Number=SeqID_165403
atgaatccttttcatcctctgactcaccaatttcccaagttacaagccttggtttcatcaattcgaaaatcgttggtgtccccacaaaacccagttcttgtattggagcttctgggcaaagtgttagaccaatacccagacatcaaaaccttgaaaaatgtgcattccaaggtttttaatcttagttttcacgaaaatccatctctggggatcaaactcatgcgggcttatgctgcccgtggagaacccgggttggcacgcaatgtgtttgatgtaattcctgagaggaatgttattttctataatgtcatgatcagaagctatatgaataaccatttgtacgatgatgcattgcttgtttttagggacatggttagtggtggttttagccctgatcattatacatacccttgtgtcttgaaggcttgttcttgctctgacaatttgaggattgggttgcagcttcatggagctgtgtttaaggttgggcttgatttgaatttgtttgttgggaatggtcttattgctttgtatgggaagtgtggttgcttgcctgaggcacggtgtgttcttgatgaaatgcagagcaaggatgttgtttcatggaactcaatggttgctggctatgcacagaatatgcagtttgatgatgcattggatatttgccgagaaatggatggtgtgaggcagaagcctgatgcttgtacaatggctagtctcctgccagcagtaactaacacttcctcggaaaatgttttgtatgttgaggagatgttcatgaatttggagaagaaaagtttggtctcatggaatgtcatgataagtgtatatatgaaaaactcaatgcctggaaaatctgtagatctatatttacaaatggggaaatgtgaagtggaaccagatgcaatcacttgtgctagtgttcttcgagcgtgtggggatctttcagctttgttgttaggaaggaggattcatgaatatgttgagagaaagaagctatgtccaaatatgcttctggagaattcactgatagatatgtatgctaggtgtggatgtctagaagatgcgaaaagagtttttgacagaatgaagtttcgtgatgttgcatcatggacttcattgatatctgcctatggtatgactggacaaggctataatgctgtggcactcttcacggaaatgcaaaattcaggtcaaagtccagattctattgcctttgtcgcaattctctcagcttgtagtcattcaggattactcaatgaaggaaagttttactttaagcagatgacagatgattacaaaataacaccaataattgaacactttgcttgcttggtggatctattaggaagatcaggacgagtggatgaggcctataatatcatcaaacagatgccaatgaagcctaatgaaagagtttggggggcactgcttagttcgtgtcgggtgtactccaacatggatattgggattttagctgctgacaaactacttcagttggctcctgaggaatcaggttactatgtgttgttatctaatatttatgcaaaggccggtagatggacagaagtaacagctattcgatcactaatgaagagaagaagaattcggaaaatgcccggcatcagcaatgttgagctgaataaccaggtccacacctttcttgcaggtgatacgtaccacccacagtcaaaagagatatatgaagagttaagtgtgctggtggggaagatgaaagagttaggttatgtgcccaagactgattctgcccttcatgatgtggaagaggaggataaagaatgccatctagctgttcatagcgagaagttagctattgtctttgctattttgaatacccaagaatctccaatcagaattaccaaaaacctccgtgtttgtggagattgtcatattgctgccaagcttatctccaagatagttcaacgtgaaattgtcatcagggacaccaatcgattccatcattttaaggatgctgagtcaactcgctctatttccgtactcatcgaaacctcagatctggaagctacgctcctcttcttccaccattgtcgtcacaccgacacatcaccgccaatatcttctccatcaccggcaaagtcgtcgatgttcctcgccggagctgttctaccacaagactgcgtcgatgctggatctgaacctgattcggtcccaaacagtgtgggaggtttaggacttgaacggagcanaagcttctacttctgctctgtgagcacaatgcagaacgcacgaaacaattcatggtgttctagaaacgtgtgtcgtcaaacagcgacgagaatgcacaagaaccaactaagattagacgatgaattgggaacaaaaaagcaaacatga

SEQ ID NO: 48626 - DNA, 201 bp, Glycine max
  Peptide Sequence Number=SeqID_165404
atgatggatatccctggtagggaaatagagtggttaaagagttttaagcatatctggaggggatgtttctcaagaggggggaatacttgtacttgggggcatgtcactcaatttggaactcccttgagactcaagctaatcaccatggggggaggggagttgcctgtgtacgatagggtgacctcgacacttgctgcctag

SEQ ID NO: 48627 - DNA, 1602 bp, Glycine max
  Peptide Sequence Number=SeqID_165405
gtcgactctagaggatcccacgggcagggcgcggccattgcggtccagcaggccgatggcgaacgggatgtggtacggcgccttgacgaaaccggctggggccttcttctcgacgccgaccggctggcattcctgcgacagcgtcacggtgcagcggcgcgccgcggcgtcgtgcgtcagcttgaccgtcacgcgcggcgtgcccgcctggcggtaccagttgcggaacaccgacagatcacggcccgggtgctggcgcgtgtagaccgattccatggcggcgacgaagtcgtcgcaggtcacggcctggccgtcgtggcggcggaaatactcgtccatgccggcgcgaaagcccgcctcgcccagcagcgtgtgctgcatgcggatgacctcggcgcctttttcgtacaccgtggcggtatagaaattgccgatttcctggtagctgtcggggcggatcgggtgggccatcgggcccgcatcctcggggaactgcgccgcgcgcagcgtcaccacgtcgtcgatgcgcttgaccgcgcgggcgctggcggcagcggcctcgtccatgtcctgcgccatcatgtcggcgctgaactcctggtcgcggaagaccgtcaggccttctttcaggctcagctggaaccagtcgcggcaggtgacgcggttgccggtccagttgtggaaatattcgtgaccaatcacggcttcaatgccgagatagtctttatcggtggcggtttccgctttggccagcacgtatttggagttgaagacgttgaggcctttattctccatcgcgcccatgttgaagaaatccaccgcgacgatcataaagatatcgaggtcatattcgaggccgaaacgctcttcgtcctacttcatgctggctttgagcgaggtcatcgcccagtccgcgcggtccaggttgccgcgatcgacaaaaatttccagcgccacgttacggccggaacgagtggtaaagctgtcacgcaacacatcgaaatcgccggcgaccagcgcaaacaggtagcagggtttcgggaacggatcctgccatttcacccagtgacgcccatcctcgtgctgaccgctcgccagcttgttaccgttggacagcaggtacggatagctagccgcgtcggcgatcagggtggtggtgaagcgcgccagcacgtccgggcgatcgagataccaggtgatatgccggaagccttcggcttcacactgggtgcagagcgcctcgccggatttatacagcccttccagcgcggtgtttttatccggatggatttcattaatgatggtcagggtaaagttgtccggcagctggctgatgatcagtgcgccctgctcttcgcggtagtgcggccacggattgccatccaccgccagcgacagcagggtcagcgcttcaccgtccagacgcagttcagcctgctgcgcgccaaggcgttttacctgactgacggcggtgacgcgcgtggtcgccgcatcaagatcaaacgtcaggtcgatatcggtgatggtgtaatccggcgcccggtagtcgtggcgatatttaatttgcggctgttgcgtcataaatccttctcgcatcgttaa

SEQ ID NO: 48628 - DNA, 1296 bp, Glycine max
  Peptide Sequence Number=SeqID_165406
atggatgatattgtaggatacggttttcgtccaacagatgaagagcttgtgaagttctacctcaaacacaagttgctcgatgatgatccctgtgtccacttcatcctcgacgttgacctttgtgaagtggaaccttgggacttaccattgttattagcagattcagctgtgcgattcaatggccgtgaatggttcttcttcagtcctgtcgattacaagtattcaaatagtaaaagggttaacaggacaaccaagtgtggcttctggaaacccactggaaaagaccgtggcattaggagcaaggacaccaacaatgtcatcgggactaagaaaactctagtttactatcaaggccgtgtttctagtggtgtcaagtccaattgggttattcatgaatatcatgctgttacctttcatgaaagccagaggacttttgttttatgtcgcttgatgaagaaacctgggaaaacaactgaaggtggaactgatgcactgatctgtgatgaaggggggcccagtagaagcatggtttctgactatgaaaatcaggcaacaacacaaggaattccatctggaggtacttttacaggaatggaaacaacctttcagggaatgcatctggctgagaaatacttctccccaacacaacagtctcccactggtattgagcaggaagaaccatcctttacaaactatccatttaacaatgcctattttagaaatgaagacaactttatgcagactccatttgaaactaaggaggaagatgcgttcctgaattcaatttttgttgatgagaatttagttatcaatgaagaaagtatgcatgcttttgtcaatagctccacccaatcagagtcattgagaagggtatattgtgaaagcagtgatacagatgctgaagtagtctctgaaagggatgataatattgttgatgtttcaacaatgtgcaacgaatatcctaattcagacggatactattcatcagaaaggtttgaatcatcacatggtgctgtccaagatagcttatgtcttctatctactaaccacgaagcaaaccaagagacaatggaaagtatactccaaaataatttctggggaatggagcaatcctattgtgactctactgcaaataaacctttggagatcaattatactgaaatttctagttctccttccactcggaggagatggataaatcagtatcatccaagaccagactacttcacatcccaaaagactgatgaagatctgagacacagaggaaggtttcaaacaatgcagtatcgcatgtag

SEQ ID NO: 48629 - DNA, 378 bp, Glycine max
  Peptide Sequence Number=SeqID_165407
atgacgacgatgatgatggagtttggaggacccagagtgatcggagattacatagtgggtcctcgaatcggttcgggttcgttcgcggtggtgtggcgtgcaaggaatcgaagttcgggtttggagtatgcggttaaggagattgataagagacaattgagccccaaagtgagggaaaatcttctcaaagaaatttctatccttagcaccattcatcaccccaacatcattcgactcttcgaggcaattcagaccaatgacaggatttaccttgttttggagtattgtgctggtggggaccttgctgcttacattcatcgccatggcaaagtttctgaaccggttgcacgccatttcatgaggcaattgggtcagtga

SEQ ID NO: 48630 - DNA, 369 bp, Glycine max
  Peptide Sequence Number=SeqID_165408
atgtttggcaggatgcttgaaaagtgcattgctaaaggtaaatccagaaatttgatggattctttggagaacatgcctaatgtgacagaaaagcccaagacaggagacaaactgcctaagtgtagcattcattctagtgatagtgataaatacatgtcatgtatcaagagaaacaacattatagctagattacgagctgaccccaaacaaaggctctcggcagttaaagtctttaatattaacatgttctcttggatgaatctacataatgtggctaaatctttctttccttttttctccaaggtcattttatttctaagacatcatatgctgagaatagagaacaagctactagtgctgtcaatttaa

SEQ ID NO: 48631 - DNA, 309 bp, Glycine max
  Peptide Sequence Number=SeqID_165409
atgattcaagttggtgaccgactcagacgagtatgcaagtaccgcaggtggccagaatggctagcggcacagcgtgccccgcaggtagcccttggtattaaagtaaagcagaaaggaaaaggaagaaaaaaagtcacaaagacagcttgcctgtcagttaacaacctcaacagcctcctccaattccctattgattttccttctcctctacatgcagcccaatctgctactttgaccctttactctattgaagcagcccatgctgtttcttcttcctactgtagtattgggctaagggtttatgactaa

SEQ ID NO: 48632 - DNA, 1965 bp, Glycine max
  Peptide Sequence Number=SeqID_165410
atggcccttcctcaatcatttgggtgtggacttgtgcaagcatcctttgtgacaagctctggtctacttaataaagtttggagtgttatctcttctcgtgataaaggcatagtttcgtactcaggaaataatggactgttctggaaagtttctgaggattcgggtttgacggttgtggcgtttgaggtcaacccgggttttgatcttctatctgattttgtttcttcttcttatctcaagaagaataatttcaaccactttgagtttctctgtaccaagaaaaatccagatttctctgttaacaagtctgcagttgatcttttctctgaaaatcttcagaggcttgatgagttgaagtccaagacacgagggttttttggtagagacgtggaggtagttttgctcgaacctgattggaccattttgggtaaaactgagttgaattttactaaaccgtctgcctattactatgaactcttaaaatccaagctcaagagcctgtgtgatggtggtgctgtatgtatccttatcccaatcctaatcctagtgcagattgatagctcccctcgattgattgttacaggatatggtgttggaggaccaattgcttctctcttcacattatcgctactaggtaacaaaaagaaaaaagatgacaaaaagaagtcctctgagaaaaagaaaccccctctctgcatcacctttggttctccccttgttggtaacaataagtttcaagaagccatatcacgtagttctacatggagttcttgctttctacatgtggtctctatcaaagacccagttcccaaaagattgaatcctcaaaccagtgcttacatgccttttgggacatttctcttctgttctgatataaactctacttgttttgagaaccccgagtcagttttggaaattctcgtgagctcaatcaatgatcaaaatcaaggatttcagcccaaagattatagcaacattgtggtaaatctccatcgtaaagcaattttcaaggatgttaccccacgggggcaggactcgactcattcgactaattcactttgtgcaagtatctgtttgcagttgtgggaagcaggattgacaccagatatgcagcaacaacacctgaacattgatataaatgctttggtaacaaagttggaagaattggaaaataaattcatctaccagaagagggtaaaattttatccatccaagaaattgaatgtgatgaagatagaaatgtccaaacttgggtggtacaagaggtattgcaaaaatcataatattggctactatgacagcttcaagaggggtatcacaacaagcgacctagatgctattcagtgtcagcaaagcctcagaaattactggattgacatggttgaagaggcagagatgaaacctcagacagaaggtgctgctttttgtactcgctggctttttggcggaactaattataaaagaatggttgaacccctagatattgctgattactatcgtagtggtgggaaagactacgtggctaagggaagatctagacattatatagtgttggaggagtggctggaagaagagaagaaagatacaagcgattcaaacagtacaaacaaaaagaatgtggaatctattttaacttttgactcttgcttttgggcacatgttgaagaagctatcctttcatgcaaagtgttggaggatgtacaatctagtgtgacagagaaggaagaggaaactgggaagttgcttgaattcgagaagtatgtttatgggttgctcacgaaatatgaagtgtcatcagagattttcctggagcatagcagctacatgacttggtggaatcagtataaggcaattaagaataaggaaacttcatataattcagctctagcagacttcatgagcaatcctgattattataatgtgcagtatgctaagggaacttataatttcctccctggggcatag

SEQ ID NO: 48633 - DNA, 684 bp, Glycine max
  Peptide Sequence Number=SeqID_165411
atgcagaattgtaaacatggagatgttccagttgtcaaaggtgacaaattcaacaaagaccaatgtcctaagaatgagattgagcgagcaaagatgaacaacaaaccttttgggagtgctctgggcaacctcatgtatgctcaggtatgcactagactcgatattgctttcatagttggtgttcttggtatatacctgtcgaaccctaagaatgaccattggatagtttctaagaaggtgatgaggtacttgcagaagactaaggagtatatgcttgtctataggaaagttgacaacttggaggttgtagggtacacaaattcatatcttgatgggttccttgatgataggagatcgacttctagatacatctttatgatgtctgggaataataagacttctagaggatctaagcacttggagttgaactacttaactgttatagatcttgagaaagatggttctatagtggtagatcatgcggacagagattccatgttggttgatccattgatcaagggacttaggcctgttgtttttaaacgacatcttgaaaacatgggcattgacccctatgctagtggtcaacaccaaaattcgagcttaggcataatgatattaaagctcggtgtagttaggatcactgtgtcggtgattggcactagaattggagttggcacatga

SEQ ID NO: 48634 - DNA, 120 bp, Glycine max
  Peptide Sequence Number=SeqID_165412
atggatgaaaaaacgaaggagtgccactgcatgctatttctcacacctgataacgattttgctggcaatgaacagactatcaccttggatgaaattaaagaatcaacagccaacatgtag

SEQ ID NO: 48635 - DNA, 1479 bp, Glycine max
  Peptide Sequence Number=SeqID_165413
aaataccaagatattaatggaagatcggagcatcctggtcgtgtacgtggggctgggacaggggttacaattacgcaatactttggtccatcatcgtgtcggtctaccagttcatcaaacatcattgtagaacagttggctgatataattggtaacctaaaagaagaatggcaaagacaggctgaacaagaaaacattaaaagagaggaggtgtggatgaggagggttgaagaggaaaaacagcgcactatggacacatttaaaggacaaatacaagaagctatcaagttggagttgtcacaaattgtatcacaacattcagccccacttcagccaaatgatatacaagtattagcagcaaggaactccaacaaattagtggcagtgggcaaacggtgcgacagttttggcaccatccacaacgtgccctatgctgatgatgttgttcgcgtgagtgtggtggaagttattttcggtgatgcggaggttccaatccctacatcagaaataaagtttgtcaaagaagctttaggtagttttgttccatggccaacacatttggtcaaacccatcttgcctgaggaagcagagaaggatgtgagctcaccattgaagactgttgaggaggaaaaggcagctgaggttattgatccattgggagagttggtgaagaacttgttcgacatttaccaaaggcctgttgaggtgtcatgggatggtgctaaatttgggatcaataatgtcaaagatggcttcttcatcacacacgctgatgtgagcgagataatattaggagacaagtgtttaaacatctccattctacaactatggcttatgtttattcatgattggagtgcgagcattggttatggaccattgtatgggttccttgaacctcagtgtatccacaatgcaagcagtagacgtcaagagtgtgaaaattacattggaaggtggttgaaggaagcaggaaaacaaatttacatagcaccttatttaaaccaggcccattggcagctcgttgtattgtgcccaggcgacaatgtagtggtttggttttgttctttgaagaagaagccggatgctaccatcaagggtgcagtaaacagtgcaatgaaatcagtcaccaaaactgcagagggaaagccacctcagcatgggcctcagtggattgaagcaaagagtcatgttcaaacaggaaattacgagtgtggatactatgttatgcaatggatatggtgcatcgtaagtggtggattgaaggatgactggattcactggttttctgatcgatcaccgctaacagaagagaccatgaccacactccggcataaatgggcggcctattttatccaaatgaagaaatggggacacatcaaccaagctgtgaccttcaacagatcttattacaaggttcaaattataggacaattgtgcacgtactataacctgaacagccatccacaaggcttgggttaa

SEQ ID NO: 48636 - DNA, 213 bp, Glycine max
  Peptide Sequence Number=SeqID_165414
atgatccctaatgcacaacccgagaccaaagctatgctggtcagtgaacaaagctgcatcgatgttaagcttgaggaaatcagaagaaggcttttcccactcctggatgatagcacgagtagttggttgaatgttgtgtggcctgcgagcgaatcaccattgatggaagaattgtcgagcatgagatactggaattttcggatgagattttga

SEQ ID NO: 48637 - DNA, 261 bp, Glycine max
  Peptide Sequence Number=SeqID_165415
atgaagagaccaagtaataagcacacacaaacaaacacagaccaaggtggttatgtgttgagaaggttgaagaaattaaggacaggaactgctacaacaaacaggaacaacttcttgaagctcaaaggaccagggagagagagaactaaaagtgaagctgctgagaagtgtgaaggccgcgaaagaaacggggccgttgcgtgtgacgtggcgcttcgggattgggaaggggtggttacgtggttccattctccgtactag

SEQ ID NO: 48638 - DNA, 4422 bp, Glycine max
  Peptide Sequence Number=SeqID_165416
atggctgaccatgcaacaaggaaaactaccaccgataggcttgaagaagctattactcgtctctctaatagccaatcctccctcctagataaacatgcggacctcgttgacaagtactctgaactttccggcaaggtggatacacttcttgatcatctccacctccgatctccggctcgagagcaccatgggacctcttcccagtttcatcagcgtaactccgtcaagttggacgtccctaggtttgacggacgtgaccctatggggtggatcttcaagatctcacaacttttcgaataccagaatacgccggaagaagaaagaatcactgtggcctctttttaccttgacggagctgcgttaagctggtaccaatggatgtttaggaatgggtttattacgtcatggtcaggtttcttacaagccctcgaatccaggttcgctccttccttttatgatgacccgaagggggcgttattcaagctaacacaacgaggcacggttaatgagtacttaacggagtttgaacggttggccaatcgtgttattggcttacccccaccattcctattaagctgttttgtttcaggtttagcacaggatattcgaagagaagtgctagctctccagcccatttcccttccccaggccatggcccttgccaagttacaggaagacaagattcgtgaccgccggcaagcaccaccacgaggtcacaatacaccatcaccatcctatgctcctcctagccggaaaccacattctacatacgttcaaagaactccagaagaaatggcccttcgtcgagaaaaggggctttgctacaattgtgaggaaaaatggagttccacacacagatgtaaaggacgcgttcttttattcatcgctgacaacccctccttgctaccagatgagcccaaccccgaacctcctttactgccggaaccgattccagcgtgtcccctcgacctagacacaacctcagattttacttcccctcacgtgagtctccacgccctttctggcctcccctcctccgagaccttccgactcgtcggaatcatcaatcattcctccctcaccattctcatagacagtggaagtacccataacttccttcaaccccgacttgcccagttccttcatctcaaaaccgaaaacacaaacccacttcacgtcctggttggcaacggctctgtccttgaatgcaatcaagtttgccgtgctacttcacttctccttcagggccaccagttcacggtcacgttccatttgctccctatcagtggtgcggatgctgtattgggcatagaatggctacgacaatttgggcctgttattactgactacaccgcgttttccatgaagttcacccatatgggccggcccattgaattacacactgatatctccactggaccaaaaccaatttcggcccctcaagttaaacggttattacaaaccggatccgcttcagccctcttccacttaaaaatgatacccgaccaacaacccgacccattacttcatcttcctcacccgatacctgcggttgaagctcttctcactcagtttcataagctattccgacagccttcatcccttcctcccccacgatccatcgtccaccatatcaacctcctaccaaacacaaccccaataaatgtaagaccgtatcgttacccacaattccagaaatccgaaatagaaaagcaggtcttagagctcctcgaatccggtctaatccaacccagtatgagtccttactcctcgccggtattacttgtcaagaaaaaggacggaacctggagaatgtgtgtcgattaccgagctctaaacgcagtaacagttcgagatcggttctcgatacccacgatcgacgaacttctggacgagtcaggaggcgctgcctggttttctaaactcgacctccggcaagggtttcatcaaatactcatgcacggccctgacgtggaaaagactgcctttcgaacccaccaagggcactacgaatatcgcgtaatgccctttgggttatgtaacgcgccgtccacttttcaggcggcaatgaataccttgctaacgccatttctgaggaagtttgccgcggtttttttcgatgatatattgatatatagcaggacactagcttcacaccttcaccacctcgagctcatcttccagactcttcttcaaagccagtaccatctaaaaaagaccaagtgccttttcgctcagaagcaaatcgagtatttagggcacgttgtgtccggccaaggagtcgagccggaaccctccaaggtccaagccatggtgcagtggcccacgccgtcctcagccaaggaactcaggtccttcctaggactcacaggtttctgcagaaagttcattaagaactatgctatgattacggcccccctcacttccctctgctccaaggaaacattcgaatggccctcgaaagcccagtccgcgtttgatcgattaaaggcagctatgacttcagccccagtccttgcgttacccgatttcgatgaaccatttatcatcgaaacagatgcttccggcgccggcatgggcgtggttctaatgcagaaaggccaccctctcgcgttctttagtaagcaattcggcccacgaatggttcatgcctccacttacgtcagagaactccacgcgatagtagctgcagtccgcaaatggcgccagtaccttctgggccatcctttcaccatttttaccgatcataaaagcctccgcgagctcatgtcccaagttatccaaacacctgagcaacactactatctttctaagcttttgggtttcgactacacgatacaatacaaggtgggttcctcaaacgcagttgcggacgctctgtcccgtactactccctccggcgagttcctactcctatcagtgcctcaccttgacttcatgcgtgacttatgcaacaccctccattccagcaacgaatttcaagaactattctccaaggtacgtgacaaccctggtgactttcctgactatcgcattcatcagggactcatcctcttcaagaatagaatctggctcaacagcgataatccgtccatacctagcctcatgttcgaatttcacgcaactccaatcggaggccatctcggagtgaccaaaaccacccataggttagagtctaacttcttctggtcctcattacgaaaggacaccaaacgattcgtgaaggaatgcaccacgtgtcagcagactaagtctagcacacagcgacctgccggccttcttcagcctcttccgccaccgactggagtctgggaggacatctccatggatttcattacccaactcccttcttctcacggttatactactataatggtagttgtcgacagatactcgaagggtgttcaccttggagctctgccgtcgaaccactcagccttcaaggtcgcttccttgttcatcgatatcgtctgtaaacatcacggcttcccgagaagtattgtctccgacagagacccaatcttcctcagctccttctggcgtgagcttttccgactcagcggaacgagactccgtatgagcacggcttaccatccacaatcggatggtcaaactgaagtcatgaatagggttctggagcagtatctcagatccttcgttcatgctcaacccaatacctggtatcgttatctaacaatggcggaatggtgttacaacacctccattcactccagttcaggaatgacgccatttgaggtcatctatggcaaaccaccaccaacacttccgcattacctccagggagcatctacgaacgaagctgtggattccatgttacactcacgccaagaaattcaccgaaagctgcagcagcgtcttcgtaaggcacaagacgccatgaagaaagtagcagacgaaaaacgccgtgacgtcaactacagcatcggccagtgggtctacgttaagttacgacccttccggcagcgttccgtcgcagggcaagtctcatacaagctcaagctacccgacgaggcaagaatccaccccgtattccactgctcactactacgcgagcatcacggaactccacccacccaacccgatcgctggcccttacagtttatagctcacaaacccgtcgcacgacccttgtgtattttggactctaaactcgacacttcatcctctccgccaaaccaacttgtgttagtgcagtgggcgggacaacctcctgaggacaccacctgggagtcatggccggaagttcgcgaccttcaccaccttgaggacaaggtggtcttcacgggtgagggtattgttagcaaccacctaaacgacatcacgactgggcccgaaactgcagatacaaggcccaaacgaagaacatcgagacccagctacctgatcgactacgagacatga

SEQ ID NO: 48639 - DNA, 1824 bp, Glycine max
  Peptide Sequence Number=SeqID_165417
atggagattcaacaaagcttgaagctcacaatccacaagaaatggccatcatcacccaaaaaaccaccaaaagaatcagaaccaataacccccacccccaacacaccaaagctgaaatggaagaaaatcttcttccaaaccaaaaccaaaacccaaatacaaaccccaccagaagaattcctctgtcctatttcgcgttccctcatgttcgaccccgtcatcgtctcctccggccactcctacgaacgctcctccgtcgaagcctgcaaaaatgtcaattttacccctcaactccccgacggcaccacccccgatttctccaccctcatccccaacctcgccctcaaatcagccatcctcaaatggtgccaatccacccacacacctcctcctcaccccaacaacaaccccgtacaaaccttaatctcctccaaccctaacctcgtacacaccataaacccctcgaacacaaacctcgtacacacaaacccaaacccctccccagagaaaatctccgaccaagatttgattctgaactccctgagcgaaaacccaccacaccccgacaacaacaaccacctcgtacaaaccttaatctcctccaacgcaaacctcgtacacccagagaaaatctccgacaaagatttgattttgaattctctgaacgaaaacccaccagtgaagaacctctgccaccacgcggaaaccgaggttcccataaggccgacacacttgtacacgagctccgaggaatccatagcgacaacctcggcctcaacgccgccgcttcagttctccacgcgcccgagctgctgctactactcttcaccttcgtcttcagaactcgaacccgcgacaatcccagaagaagaagagatcatgacaaagctcaaaaaccctcaactcaatgcaatcgaagaagcgcttatctctctcagaaaactaacgagaataagagaagaaacaaggcttcaactttgcacccctcggttactctccgcgttacgctcactcgttttgtcgaagcacgtgaacgttcaggtgaacgctctggcatcggtggtgaacctctcgttggagaagagtaataaagtgaagatcgtgcggtcggggatggttccgccgttgatcgaggttttgaagtttggatcctctgaggcgcaggagcacggtgcgggcgcgttgtttagtttggcattggatgatgataacaaaaccgcgattggggttttggggggtttggcaccgttgcttcacatgctccgatccgagagcgagcggactcggcatgactcggcattggcgctttaccatttgtctttggtccagagtaaccgatccaagatggttaaactcggttcggttccggttctattgaatatggttaagtcgggtcacatgacgggtcgggttttgttgattttggggaacttgggttccgggtcggacgggagggccacgatgcttgatgcgggcatggtggagtgtttggtggggttgctcagtggggccgagtcaaggagcgggtcgactcgagagagttgcgtgtcggtgatgtacgcgctgagccacggcgggttgaggtttaaggcagtggcgaaggtggctggggtgatggaggtgatgcaaaaggtggagaaggtggggactgagagagctaggaataaggtgaggaagatattggagattatgagggccaaggaagtggaggaagaggatcatgtggattgggaggagttgctcgactcgggattgccttgccggactaggactagactcggtgctgggttggacgactcaactcctaactcggcccagttttga

SEQ ID NO: 48640 - DNA, 444 bp, Glycine max
  Peptide Sequence Number=SeqID_165418
atggttgaaccccttgttattgctgaatactatagttgcggagttggaggagtggtgacaaaagccagtacaagtaatgaggaagatatttgtgatttggattgcaattgggattggggtttctattgggactggtgtagtaatgttgttgataaggatcttgcttccatagcgggttatagttcacatattgaccagcttttgctttcaagcaatgggttgaacgatgtagaagagaatgaagagaatttaaacacaagaagcaagaacaacgaaaaaaataattcctgctatgaagcatgtattgatgagttacatctttcctgccaaggggagagtgttagcaaccacctaaacgacatcacgactgggcccgaaactgcagatacaaggcccaaacgaagaacatcgagacccagctacctaatcgactacgagacatga

SEQ ID NO: 48641 - DNA, 366 bp, Glycine max
  Peptide Sequence Number=SeqID_165419
atggcggaatcaatgcgctccaagtccaacctcaatcgactagaagatgccatagccaaactcaccaccatccagttgtcgatgtccaccaaattagacgacctcttccagaagctggcggttatggaatccacccaacattcaacaatttcttctttgatgcattctccctttccttctccgcctgttccaccataccgaatgaatctcgaagtcccacgcttcgatgggtttgatcttgtcgggtggctctttaaaataaactcgttcttcgactaccatgccacgccgaaaaatgaacggttgacgatcgcttcgttttacatggatggtcctgcacttgcatggtatcaatggatgacatga

SEQ ID NO: 48642 - DNA, 324 bp, Glycine max
  Peptide Sequence Number=SeqID_165420
atgactccatcgttttcggccggctttgtcaccttcttaaagctcaattcagatcactgctaccatttcttctttctggaatcacttaatccatgggtgacaatgatggtcatgatcccttatcaagcaaccttgttatcctcctcattgccgtgccgcagctttcgttgtctcaatctaccatgtcatagctatgtgctggttcaaccagcgcatcgcaaaccgaaacccacaacaacaacggccaccacagacagagggcacttccttggtgtcggtggcgcacatgattccaacccacacatatcacaagaagaaaattga

SEQ ID NO: 48643 - DNA, 1254 bp, Glycine max
  Peptide Sequence Number=SeqID_165421
atggcggaggaggaaaagcatcggctccaagaagacaccgacaagctcttctgctcctacataggcgcgagcttctcgatgttcctcgccatgctggcgaacaactccgtcccagcgctgcagggcaaggtgcggtccctctccctgcgcgcggcggaggcggcggaggagctccggcagatgaagtcgcggcggcaggaggactcgaaggcgaacgcgcgcgtggtggagatcttcgcctcgcaccggaacgcgtggcaggcggaggagaagcgcctcctgcagcagatcgacgccgcggcggaggagatcgcgtgcctgcgggggcgcgtggcggagctcgaggacgccgccgcgcacggggagagggacgtcgccgagagggacgagatgatcgggttcatgtcgcggaggatcgaggaggagggattgggtgggagggagagggagcgctacggtaagaagagtgaagagtggttccaaaaagtagaagatatggtggggtccaccgctacgagtttggaagaagaagaagaggctgatgttatctatgaagaacagcatagtcagcatttcgggaacaataatggctttgattctaagtttatggcatctgcttctaagttctgggctgagaaagcctcactttgtcaggatgtacagtatgaatcccttgaatcaatgtataatacaaagcattttgttgcaagggagtctccctggaaggttgatggtgattctgctggagtttcctctaaacttaaattacttgaacaggacttactaaatctggagaagattggtaagaatgatccatccaaggtgccatccttgattaagaagcaggcaaagagatatcaagcaatttcagaaaaaattgatgatttatgcagaagaatagctaatgatccttgcgaaccctccctcagtacagaatttcgaacgcaaactcaaacggagtttttactggaagcatttcggcttcaactgggagcatctgaaactggacagaagctaatggcactgcaaactgaaattgggaagagccattatatttatagggatgagttaagcgagactacactgaccacaagacggtctttcgactctattaggaacaacttcaaagaaatccagcgaaatctggagatatggttggccagaattattggcgatcttgaggggattcttgcgagggaaggtgcatctcgtgtaagagaatattacatttctagatatccttttgttcaatag

SEQ ID NO: 48644 - DNA, 396 bp, Glycine max
  Peptide Sequence Number=SeqID_165422
atgaccaatctcaagcctaaattaactttcatgccatttttggacatttggctccggagacactacgactgcacccataacttcatccaagaacatttggtagccactctaggtttacgcgcgcaacctactcagcctttacgagtgatggttggtaatggtgatgagattgattgcttggaagtttgcggggatgtcttggtccaagttcaggggcataaattcatagtttattttcatgttttaccattttgcggtgcagacctggtcctaggtgttcaatggcttaagtcactgggtccggttttgatggattatattgacttgactatgaagttcatgcaccatgttgaatcaaatggcctcagaataattaagaagggagggttgaattaa

SEQ ID NO: 48645 - DNA, 237 bp, Glycine max
  Peptide Sequence Number=SeqID_165423
atgggtagctaccatggggagtggtgctggcttgggtgcgagagtaggtggcataggtgtgggcatggaatcggagtcgacataggaagaggagtcgacatgggggtgtctattgatggtgactacacagtagaagaaaacagggggcgatggttgggtaccataatattcaatttcaggagattggcatcaagtttggagatcatagaagcttcgatcacagcaaaaaaaacttaa

SEQ ID NO: 48646 - DNA, 288 bp, Glycine max
  Peptide Sequence Number=SeqID_165424
atggatactaaccataaccctaaccctagggtagagacacttttgctttttgtctatatgtcatacacacttttgctttacgatagtgccttttatccatggcttcctatggtggtgagcttctccttgaagtggcgtctccaatcatctttcttccttctccatttcgctgccattgatcttcaagaagcaaatgactccattgatgaagaagattcaaggcctacaagctccacatggacctacatcacacttttgttttttgatagtgcattagagacactttag

SEQ ID NO: 48647 - DNA, 285 bp, Glycine max
  Peptide Sequence Number=SeqID_165425
atgaaacttgttgacgatgaagatgtcaaagactcacaaacatttgatgttactgaggatcaacctcacccatacttgagtacccctgtaacaaagtttgcctcatctacccaaccaaatgagcctgagtttacagcaaagcttggcttacctaacaaagaactcaatccctttagtgaggatgaagacaaagttctacgcaatcaacctcgggaatatgatgaggaagaagttgaacctatttcaccaataacaactgtaccaccacacttgagtttacagtag

SEQ ID NO: 48648 - DNA, 476 bp, Glycine max
  Peptide Sequence Number=SeqID_165426
atggatttctttcgagaatctatcaacgaccaccaagattttcatatgtcctcgatacggtggcaaccggacaatgaagtcaagagacaaatctttgcacggcttggtaggaactggaagtggttccacactgcagccattcctgatcctaaggcatcagtctccaaggtaaatggaaaggaaaaattcggtaaacccagtactggtgcggtgcttactgcatccttcaaagtcaagaaagcgaaatatgccactgatgtccagtcgaattgttccaaagtaccgatatcgatatggtcgaacattgaccaaaacagaatttggaaggaggttaatagtgtgagtaatatcgtggggtggtgggagctcagtggccatgagttgaatgtgaaagaaggcacttacgccatatgtctaaaccatacgccggagttgctggtgattgatcccacaaatgtcatcgtcacgatcacccc

SEQ ID NO: 48649 - DNA, 582 bp, Glycine max
  Peptide Sequence Number=SeqID_165427
atgaagcactttgttgataacaatcctagagaggcaagctttcatgaaggagactgggttatggttaagatcttctcttatcgtcaatctttagtgactggaacaacccataccaagcgtgcaaaatgctactatgggcccttcaaggacatggaaaatcgtcctgtgatcacacctctagctattatcagtacctattgggagggtcccaaggatgatcctcgcttacaagtgcttgttcaatgggtaggccttcatgtcgatgacacattcggggaagattgggcctctttgaaggagatttatcaccttgaggacaaggtgattttcaatgattccgagagtgacagacaaagcaagacacacgaagcccaaaatgagaggcccaagaggaagattacacctcctcagtgtgatagtgacaatgatagcaacacatgtacggtgtgcttggaagaccgtgaggagttgaggacgttgccagagtgcatgcactctttccacatgccatgcattgatatgtggctgagtttgcattcgagttgccctatttgccgtagcaatgccacaccttctccagag

SEQ ID NO: 48650 - DNA, 348 bp, Glycine max
  Peptide Sequence Number=SeqID_165428
atgggtaagggagagaagagaggatcttccaaggataagcacgagggagagaagaaaggtgtgaagggtaaacacgagggttatgggaggccgagggtttctaaatttttcttcttgacgttccttgattcactctataaaatggacttatggaggatcttccaaagatgggggaggctagcaagcagaggagtaggaaggaaggatcagagacaacaaaaaggtcttggtgaccaaggaaaaagtatgagtggtcaagttgaagtattcgaggccaaatacattgctcattcggacactaattcaaaagcattagaagatctttattccaatagggaggaggaatag

SEQ ID NO: 48651 - DNA, 429 bp, Glycine max
  Peptide Sequence Number=SeqID_165429
atgggtgttcagaactataaatgcaattgtatgtatgggagaaccatgaatgtgattcagatcaatcatcgggtgaaaagaggtgagggtggttttctagtaaagcaaaaaggtagaggagaggtaaaggacaaaaaggtcaacaaatgttcatcgattaatcattgcccgactgggactaatggactgcgagtaggtttaggagatgtggacaagggagtggtagtgatcccagaaacaaaggctagttggtgtgatgatgataggaaagggagatggtggctagatgggacacgtgtggtggagccactaaaagatgttgggcttaacaatgggtccatattgggttttaaaaaatccccattttcgaatggactagggctggaattactccttaataatcatgaggatagcataggcaaaggattg

SEQ ID NO: 48652 - DNA, 582 bp, Glycine max
  Peptide Sequence Number=SeqID_165430
atggacagggcgaggttagtctatgatctggtgaccaagatggacatggatgtgagatctttcatttcaggccagatttctcaaatggcccagtccaactcctcttggcttggcttccctgtcctcatcactgctttatgcatcgctagaggagtcatcccagactcgttgacctttgagtccctcaaccctgccattaatttggcttatatcaggaagaattgttggaacccagatgatcctacgattacctttctggggacccgcaatgctagggctcgaggaccctcagacgcttctgctccttcttcttctgccccctctgctccagcttctacattagcaccaccagctcccactcctacacctccaacaccctccagcacctccgctcaaagctcagacgccatggtgccgatgctgtggcctgaccaggagtctatccttctcctttgggggaaggagacacttgaagacacccctgttgccacaccgattgaggccactaagaaaggagacgacactgcagatgccaattacgttacagatatggaagcagcacagagcacttgggatccctag

SEQ ID NO: 48653 - DNA, 234 bp, Glycine max
  Peptide Sequence Number=SeqID_165431
atgtgtccattccctaatactaatgctaaagaacctatcagtgaatccactcaagctaagcaatctcatgaagtcaccttcatccaacaagagcctttaccacccgtgcaaacaccaagtctacctcttccacctccttccaatgtcctcgaagctattgcatatacactagcactaccttctcaatccccaccaactcaaccacctccaccacctactcaaggacaaccatga

SEQ ID NO: 48654 - DNA, 243 bp, Glycine max
  Peptide Sequence Number=SeqID_165432
ggttgtgcagctagtggaagtattggcaaagaagatgttgcctttgttacactaggtgctttagattatgtcccacaaactggattcatgtttgaggtggccaatggggataacaaagtttcagattggaaagaatgtttggccacattgatggagaaagcagacgactcgagatggcacgacgggagctatagagatggcacgacgagagctggggtcaacaaacgactagagatggcatag

SEQ ID NO: 48655 - DNA, 252 bp, Glycine max
  Peptide Sequence Number=SeqID_165433
atgcctaatctgatgtttatgcttccaagtctcccattcaggatcaagcttcaggcaccaaagagaaaagtggcgattttaaagattgttgtgtctctgaacatcaagccagagacaaatgtggtgcagcaggatgtaacagacaatgaagatagctggatgttgaccaacttcattttcacacctttgttgataagactgaatcaaggtatagccgtagaggacgaggagaacctcaatagacagctatga

SEQ ID NO: 48656 - DNA, 306 bp, Glycine max
  Peptide Sequence Number=SeqID_165434
atgacacgaagcatagagctttgtggtctggacgaccatgagtctcatccaccttggattttgatgcatgaccatctatgggatgtggtggaaaacaaagattatattccatatgatgaacaacttaatgagattcctagaagccagtggacagagcaaccaaagctcaaattttggctaaactccaaggctcagaatgtgatgttgtgtgctctttcaaaagaaaaatataccaaggcatacagtttcagaagtgccaagcagatgtgggacactctagctataacttacgaaggcacgtcatag

SEQ ID NO: 48657 - DNA, 1629 bp, Glycine max
  Peptide Sequence Number=SeqID_165435
atgggctcgttcaccaacttaagatatctcaatctctctgcttcttcatttggtgggagtattccttctgatattggaaagcttacacatttactgtctcttgatctaggtaagaattatctccatggacaaatcccttatcaacttggaaaccttacacatttacaatatcttgatctaagtgataatgatctagatggggaactcccttatcaacttggaaatctctcacagttgaggtatcttgatcttgcgggggggaattcattctcgggagcatttcctttccaagttgggaatcttcctttgttgcacactcttgcacttggtggcaattttgatgtgaaatctaaggatgcagagtggttgactaatctttcttccttgacaaaacttaggctaagttcactacacaacctttcctcttctcatcactggctacaaatgatcagcaagcttattccaaacttaagagagttgaggctagttggttgttctctttcagatacaaatattcaatctctgttttattcaccttccaacttttccactgctcttaccatccttgatctttattcaaataagctcacatcctcaacatttcaactgttgtcaaactttagccttaatcttcaggagctttatcttggtcataataacattgttttgtcatctcctctctgcccaaactttccggctcttgttatccttgacctttcctataataatatgacatcatcagtctttcaaggtagtttcaacttcagctcaaaacttcaaaatctttatttgtataattgtagtcttacggatggaagttttcttatgtcatcttctttcattatgagttcttcatcttctcttgtatcccttgatctctcctcaaatcagttgaaatcatcaactatattttactggctctttaactccaccaccaatcttcataaccttgaccttggttataacatgttagaaggtcccattccagatggatttgggaaagtaatgaactctcttgaagttcttcacttctccggtaacaaactgcaaggagagattccaactttctttgggaacatgtgcgcattgcagagtttatccctctcatataacaagttgaatggggaaatttctagcttctttcaaaattcttcatggtgcaaccgaaacatatttaagagcttggatttatctaataaccagattactggcatgttacctaaaagcattggttttctatcagagttggaggatcttaacttggctgggaattctttggagggtgatgtcactgaatcccatctttctaatttttccaaattaaaatacttgttcttatcagagagctcgttgtctctgaaatttgtcccgagttgggttcctccattccaattagaatcattggaaatcagatcttgcaagttgggccccacttttcctagttggctcaagactcaaagttctttgtatatgcttgatatttctgataacgggattaatgactctgtaccagactggttttggaataagttgcaaaatatgggattgttaaatatgtcttccaattatctcattggtgcaattcctaatatatcgttgagcttcctctcagaccgtctatacttctga

SEQ ID NO: 48658 - DNA, 411 bp, Glycine max
  Peptide Sequence Number=SeqID_165436
atgaaggcaaagatactagaggatgaaatcattatgttgcgtcttttacgttccttctctcgtatttcttttcattctaattcatcatcatccttaaacagttcctctagaaacctaaattttctcaatgagcaagaaaaccagactcacaaggtcgccacaaaacataatctcttcgataaagaggtcatgaacaaggccacatcgtcagtcccccggcccactccaactatagaacaaattaagcaagataactccggaaagataatgatgcaatcctaccccacaagggcattggatttaatggcagcggaatggagaagaataagagttgagaggagacgccacttcaaggagaagatgagtcaagaagaagctcaccaccataggaagccatggataagagcttga

SEQ ID NO: 48659 - DNA, 498 bp, Glycine max
  Peptide Sequence Number=SeqID_165437
atgaaaataaaaccttcaacaaaaagagatttccaaaaaggagatactcacattgaagaacagattaataatctacttattgagacatcggaggaagaaacggaaaatacatcctctacatcctctgaagaaaacctcaatctaatccaacaggacgaccaaccgtcgtctacggacgatgaagagatacaacaaataaacactctaacaagagaacaagatctcttgttcacgataatcaattccataccagacccccaggaaaagaaggttttcttggaaaaactgagaaaatttttagaaaccaaaccaaaaccaaaagattttattacaaataacaaattcgatgttagtaacatattcaaaagattagaaaatatttcagcaaaaccaactacaatccaagatctccaaacaaagattaataatttgaaaaaagaagttaaggaacttcgtcaacaacaagaaattcatcaaatcatcctatctcatctttaa

SEQ ID NO: 48660 - DNA, 953 bp, Glycine max
  Peptide Sequence Number=SeqID_165438
atgggattgttaaatatgtcttccaattatctcattggtgcaattcctaatatatcgttgaagcttcctctcagaccgtctatacttctgaattcaaatcagtttgagggtaaaattccgtcatttttactacaagcttccgagctgatgctctctgaaaataatttttcagatttgttttcattcttatgtgaccaaagcacagcttcaaatttggccactttagatgtgtcacgcaatcaaataaatgggcaactgccagattgttggaaatcagtaaagcaattactgttccttgatttaagcagcaataaattgtcagggaagattcctatgtccatgggcgcccttgttaatatggaagccttggttttacgaaacaatggtttaatgggtgagttgccttcttctttgaagaattgcagcagtttatttatgctggacctgagtgaaaatatgttgtcgggtccaataccatcatggattggagaaagtatgcatcaattgataatcttgaacatgcgaggaaatcacctctccggaaatctacccattcatctctgttatttgaaccgtattcaattgttggatctttcaaggaataatttgtcaagaggaattccatcatgcttaaagaatttcactgcaatgtctgaacagagcatcaactcaagtgacactatgtctcgtatatattggtataataacacttactatgaaatttatggtagttactcattggaaggttatacacttgacataacatggatgtggaaaggtgtggaacaggggttcaagaatccagagttaaagctcaagagcattgatctttccagtaaccatttaaccggtgaaataccaaaggaggtcggatatttgcttgggttagtttctttgaatctatcaagaaacaatttgagtggagaaattccttctcggattgggaatttaag

SEQ ID NO: 48661 - DNA, 360 bp, Glycine max
  Peptide Sequence Number=SeqID_165439
atggagagaatgagagggatagaaagtgtgttgtgggtgagtagagtatccattcttggattcaactaccttcccaatagcgcagaaattaagtgcattgagagtgagagacaagcactcctcaacttcaaacatggcctcatagatgactctggcatgctgtctacatggagggacgatggcaataacagagactgttgcaaatggaaaggcattcaatgcaacaatcaaactggtcatgttgagatgcttcatctccgtggtcaggatacacaatatttgataggtgcaatcaatatctcttcattgattgcccttgaaaatattgaacacttggatctcagctataattatcttgaa

SEQ ID NO: 48662 - DNA, 2085 bp, Glycine max
  Peptide Sequence Number=SeqID_165440
atggagcagaagcacgttctgttgtcagcattgagtgtcggggttggggtgggtgtggggcttgggttgagctcagggcagaaatgggttggcgggaaccgtgactctgatgagctttctgtggagcagattgtgcaggagctcaagaatctggtggttgaaggaagggacggcaacgttacatttgaggactttccttattacttgagtgaaagaactcaagttttgttgacaagtgctgcatatgttcatttaaaacatcttcacttttccaagcacaccaggaacctcccaccagcaagcagggctattttgctatctggtccagcagaaccttaccagcaaatgcttgccaaagctttagcacattactttgaatcaaagttgctgttgttagatattactgacttttctgtgaagttgcagaataaatttggatgttctagaaaagaaccatctttcaaaaggtcaatatccgaggcgactttggagcgaatgtctggtttgtttggttccttttcaatgctttcttcaacaggagaaacgagaggaattctgcgtcaacaaagcagtgcttctgtaagttccaatcctccaaagcttaggaggaatgcctctgcttcatatgatataagtagcacttcttcccaatgtggtccaacatttccagcttcttttcaacgtactgctttaaatagtaaactacccggtcaatttgttagttcatctgtaaagatgaaagctcctttaaagcacacaagtagtttgtgttttgatgaaaagctctttgtacagtcactttacaagcttttggtttctatcacagaaactggttccatcattttatacatcagggatgttgagaagctcattctccaatcaccaaggttatataatttactacaaaaaatgataaagaaactatcaggctcggtgttgatacttggttcccagatattagattcagaagatgattgcaaagaagttgatgaaaggctcactgtactattcccctacaacattgagatcaaagctcccgaagatgaaactcatcttggctgctggaaaggccaactggaaaaggatatgaaagatattcagttccaagataatagaaaccatattgctgaagtacttgcagcaaatgacattgattgtgatgacttgaactcaatctgccatgcagacactatcttactcagtaattatattgaagaaattgtagtatctgcattatcttaccatttgatgaataccaaggatccggagtaccgaaatggaaagctagttatatcagccaatagtttgtcccatggattgagtctgttccaggaaggcaagagtagtgggaatctgaagactaatgaatctaacaaggaaaattctggagaagatattactggtgcaaagaatgaaatgaagtgtgacaaccaagcacctgaaaacaagagtgagacagagaaatccatcccaataacgaagaaagatggcgaaaatcctatacctgcaaaagtggaagttcctgacaacgagtttgagaagcgcataagaccagaggttatccctgcaaatgagataggggttacatttgcagatattggtgcattggatgagatcaaagaatcacttcaagagctggtaatgcttccccttagaaggccagacctcttcaaaggtgggcttctaaagccatgtagaggtatattgctttttgggcctcctggtactggaaaaacaatgctagcaaaggcaattgcaaatgaagctggtgcaagtttcattaatgtctcaatgtcaaccatcacatcaaaatggtttggagaggatgaaaagaatgtccgagctctgttcacactggcagctaaggttgccccaacaattatctttgttgacgaggttgacagcatgcttggacagaggactagagtaggagagcatgaggctatgaggaagattaaaaatgaattcatgacacactgggatgggctattaacaggacctaatgagcaaattttggttcttgcagcaaccaacaggccatttgaccttgatgaagctatcataagacggtttgagagaaggtag

SEQ ID NO: 48663 - DNA, 334 bp, Glycine max
  Peptide Sequence Number=SeqID_165441
atgcagagtgggtcccaatcggaaccatttgatgtagaaatgggagatcgcttagaggatatgattcgtgaccttggacaagagttttttcagcaagcacatgcccctatgtatgatacattgcaaactgattcaaagaagaatttgtatccaaggtgcaacaattcgttgacgttgttgtcagcggtattaagtctagttaatgtcaaggccagatatgggtggagtgacaaaagctttagtacactgcttcaagtagtgcatgatatgcttccaaacggaaatacattgtcaaaaagttactatcaggccaagaagttattgtgtctgatgg

SEQ ID NO: 48664 - DNA, 144 bp, Glycine max
  Peptide Sequence Number=SeqID_165442
atgtcagcggccaataaaaatattcatcgaactgatgaagagcttgtggatcactacttgaagcatgagttgcttggtaatgagtccaaagaacacaaagttgagatattgatgtttgccagcttgagccttgggacttactaa

SEQ ID NO: 48665 - DNA, 225 bp, Glycine max
  Peptide Sequence Number=SeqID_165443
atgtctcctccacctctagaacctcacaatcactccatgctctcaggatggcttcctcttcaagctcagttctctcggatggatgcaagcgatgagcttagcgggatgagctctcgcttagcgcacatgtatagctcatccttcttccagattctttctcgtgctcagctgccagagtggtgcgctcagttgcaagagtggtgcactcagcggatggctcgttaa

SEQ ID NO: 48666 - DNA, 192 bp, Glycine max
  Peptide Sequence Number=SeqID_165444
atgaggggtgtattggcccaagctacacatcggtctaagctagctctatacgaaatagatggctatgtttatgaaaaacaagcaaaaagattaacattgtcatactcaagttgtagaagtggtagaaacatagggaagagagaatcaaacaaactggttgctaagccttcgcaagagatgaatggagtctag

SEQ ID NO: 48667 - DNA, 1661 bp, Glycine max
  Peptide Sequence Number=SeqID_165445
atggagttgatgcaagaagtgaaagggtactctgatagcagagaggaggaggaggaggaagagggagcagcagaagaagaaagcagccgtaagcaccactactaccccttttcttcttctccctctaatttgtatttatcttcttcttctgctccttcaatatcatcaaattatacttctactactactagtgctgttgcacgtcctcttcaccatcatcatgtaataaatatcccttaccaacaaaatccatggctggggatgaatattgttcatcatgatcatctaattcagtctccagaatctcacaattcatcatctgggttagggttgttacaccagcaccaggatgcagcaggttccaatttcatcatcaacaacaatcaacatcatcaacatcaccacacaacaaagcagctagatttcatggacttgtcacttggtagcagcaaggatgaagggaatttgccaggatcttcttcttctgtctatgctcatcatcatgcagcaagtggtagttcttctgtcaatggtaacaacaacctgcagcaacagcaacagcctgctgagaaggagcacatgtttgataaagtagtgacaccaagtgatgtggggaagctgaacaggttggtgataccaaagcagcatgctgagaagtatttccctcttgattcctcagccaatgagaagggtctgttgctgaattttgaggacaggaatggaaagttgtggaggttcaggtactcctattggaacagcagccagagctatgtgatgaccaaaggttggagccgttttgtcaaagagaagaagcttgatgcgggtgacattgtttccttccagcgtggtgttggagaatcgtataggcataggttgtacatagattggaagagaaggcgtgatcatcatcatcatcaccatcatggccctgtcgacccttcaaccacactcttcacacctttctttcttcccaatcagcctcatcacttaatgtccatcagatggggtgccactgacagattgtactccctcccttccccaaccccaccacgccaccatgaccatttgcaacatcaacaacccctcaattacaacaacaacaccatgtatcatccctttcatcaccatggtggtggaagtggaattaatggtactactcatcactacaacaattactatcatgagatgagtagtactactaatactaccacttcaggatctggctcagtcttttacctcaggtcaacacccccatcaatgccattggctgatcaccaaaccttgaacacaagacaacaacagcagcaacagcaacaacaacaacaacaagagggaggtggcaatgtttcacttcctcctatgatcattgattctgttccagttgctcaccacctccatcatcatcatcatcaacatcaacatcaacatcaacaccatggtggcaagagtagtggttctagtagtcctagcactgcagggaaaagactaaggctatttggggtgaacatggaatgtgcttcttcaacaacatcagaagaccaccccaaatgcttcagcttgctgtcctcatcttcatcaatggctaattccaattcttcactaccaccacttcagcttttgagggaagacacactttcatcatcagcagcagcagcagcaag

SEQ ID NO: 48668 - DNA, 207 bp, Glycine max
  Peptide Sequence Number=SeqID_165446
atgttacggaacctcacggattgtgcaacaatgcttccttttgacttacggtatgttacggaacttcacggattgcctaatgatgggtgccaagtacctcgaagtggtcaaacgcgggtcgcatcccaacaaatggatggcccccggatgaaattagggtatgacaatctccttacttcagattacttcttttccaccatgacttag

SEQ ID NO: 48669 - DNA, 99 bp, Glycine max
  Peptide Sequence Number=SeqID_165447
atggcggtgctaagggatgtttcccttgataggagaaggtgtttgaggatgcaacacaaatttagtgccaagatgggtgaagataatctcattagttag

SEQ ID NO: 48670 - DNA, 204 bp, Glycine max
  Peptide Sequence Number=SeqID_165448
atgagtgatgagaatggcgaagaacctcgagaaaaccgtccggttccacgcttgaatgaaaggattctttcatctctgtctaggagatcagttgctgctcacccttggcatgatcttgaaattggacctggagcgcctatgattttcaattgtgtaagttctgatactaaaaaagaatactggttgcttcattttctacaataa

SEQ ID NO: 48671 - DNA, 243 bp, Glycine max
  Peptide Sequence Number=SeqID_165449
atggagattccttttgtctacttcgggattcccattaggttgaatcctaaaaaggaagcaacttgggaacctatcttgagcaggatgcgttttattagcacccaaagaaatttcctcttgggaggggaggataggaggaagattccgtgggttggacacaccaaggaggcttgggaattaaagatatttcgttgtttaaccgagccctccttggaaactggaggtggagattgttatggataa

SEQ ID NO: 48672 - DNA, 367 bp, Glycine max
  Peptide Sequence Number=SeqID_165450
atgaagatgctcttgataccacatgatgtagctccatgtggagcttataggccttggatcttctacatcagtggattcctttgcttcttgaggtctgattgcaaaagaatggagaaggagaaagatgaatggagacgccacttcaatgatgaggacatgaccaagagcaagggcaaggatccacttgatggacttggagggcctatgacaagggctagagcaaggaaagccaaggaagctcttcaacaagtgttgtccatactatttgaatacaagcctcaaggagaaaagtccaagggcccaattggcaacctaggcatcagccttttgggagaccaaatggtggctgacttgttggctgttgggg

SEQ ID NO: 48673 - DNA, 993 bp, Glycine max
  Peptide Sequence Number=SeqID_165451
atggagcgacaccatgagaaggagctcagaaagctaaaggctgaccatgatcatctggaggctcgtgtcagacacccacaggggcgaactactcgtcaacacccctttgtcgaccgcatcatggaagtcgacatacccctaggttggaaaccactcaacctagagcagtacgatggaaccactgatctagatgaacatctggacgttttcctcacaaaagagaatctatacaccaatgacaacacaatcttgtgtcgtgtctttccaacatctctcaaaatggtggcattaacctggtgtagtggacttcctccaacctacgacaagaagatgatgaatctctccaaaaattcatggacagacagtctgtgcaaaaaaaccctagtagcatggatgagttgtgcgaatgagctaaaggctacatccagatggaagagatgtccaagtgaagaaacgagatccaacaagttggacaaaagcgcgataagagagaaggaggaggccttcaacccagaggtacccataaaactacctttttcacttcctctcatgccaaggttatacatgacaaaatactacagatacaatcgtagttacgatcacaacacagaagattgttgggccctaaaagacaagatagaagagctcatacaggttgggtacctagcccagtttgtgaaaaggtcgaatagtcatgcaatggaagcaagacccggaggacaccaagaggagcaccacagacaccacgatgtcgacaaaaaaagagacaaagtagaagatcgaggaagatggagacaccaccatcaaagacgccagcaacaacctccgcaggaacaagaaaatgagcccacccaacaaattaaaggtgtaatcaacaccgttgcggatgaattttcctatggaaggcaacttcaaggatatcaacctaaggacttcatggttgtctccatcataatcgccaaattcatggtgtccaaggtcctcatcgactag

SEQ ID NO: 48674 - DNA, 741 bp, Glycine max
  Peptide Sequence Number=SeqID_165452
atgctaggagattatgatgttggtcattttgaggaattgtgggatgaaatgatacataagtttgaactacatgacaacaagtggatgaatgatttgtatgaaaggaggaagatgtgggctacctctcacattaggggtcatttctttgcaggactaaggactacttcccgttgtgaagcatttcacaatcatcttggcaattttgtccactcaaagattggttttagtatatttgttgaacaatttcaaatgtgtttgacatacttcagattcagggaaactgaagctgatcttgaatctgattatggtagtgacaaactgcaaacaaggtttcactcacttgagaggtctgcatcagagcaattcgctaaggaaatgtgcttttgtatgaagatggaatcttttgggatgccttgtgatcatatagtggtgttgctggtgtttcttgactttcgtgaggtgccaaaatgtttagtattgaatcggtggaccaaaaaagccaagaaatcaataattggaagatatgtggatagctcgactttttgggattctagtcctgtttcaaggcatgctcacttgcatttcctttttacagaaatggcagaagttgcccctcgttatgaagatgactacaacgatgttgtgaacattcttgttcgacaagttatgaaattaggcaaaaacatgggaaccagggtcatgcagaaaataaagacagttagactgtgcatgatacagtag

SEQ ID NO: 48675 - DNA, 612 bp, Glycine max
  Peptide Sequence Number=SeqID_165453
atggccacactcacacttttatcatctctgtctctgcgctcttcttcttcttcttcttcttcttcttttacactctcttcttctttttcttctccctcctcctttgcctttttttgtagcttccccttgcgctctgccacttcatcattgaaggtacaaacaattcagaagaagaagcgcgtggtgaaggcagtggaagaagatacccagcaagaactcaacgctgctgatgactctgaacaaccatcaacctccgaagcaccacccgttgtggttcccgtttccccatcagatactctcaccatgttctttcaggcagagggaacagtgagtgaaacagctattccagctttgaccaaagctttagaggagacagaaggtgttacagatttgaaggttcagcttgctgaaggacttgcaattttagaggttggcaccctaatggaattgaaatctttaagaatgtctcctaatagttatcacttgaagaagcagacaacagtccaagctacaggagtggcttctagtcttgtagaaaccatacaaggttcaggctttaaattacagacattaaatctgagttttgaggatgaagaagttgcagttgcctag

SEQ ID NO: 48676 - DNA, 742 bp, Glycine max
  Peptide Sequence Number=SeqID_165454
tgttgttgcaatggctgaggagaaagacgctttctacgttgtaaggaaaggggatgttgttggcatctacaagtccttcagtgacatccaacctttacttgcatcttctgtgtctagtgaccctgtaagtatttacaaagggtactcgttacctcagaagactgaggagtaccttgtctcacatgggctcaagggagccccttattctattagtgcagctgatgtgaacgaggggctttttggaagacttgttgcttgtccttatcaggatccatattcatctggaggaagagctttcaatgtgagttcctcatcaagaaacttgcaaggagccattcagtttgacactggcctttcgtgtacccttcattttgatggtgcttccaaaggaaatcctggacctgctggtgcaggagctatactgcatgatgggagcaaggtctatcggttgcgtgaaggagtgggcattcaaacaaataatgttgcggagtatcgaagtttaatactaggattgaaacatgcccttaagaaaggttataagcacattattgtccaaggagactctctgcttgtctgcaatcagggtttatggaaaatcaaaaaccagaatatgggtaccttgtgtgctgaggccaaggagctgaaggataagtttctgtcattcaagatcagtcatattcctagggaatacaactctgaagctgatgctcaagcaaacctggccataaatctcagaggttag

SEQ ID NO: 48677 - DNA, 468 bp, Glycine max
  Peptide Sequence Number=SeqID_165455
atgaagctccctagcggcgaaggtccacgacatccgcacgtaggtaacgggaagttgtcgctgttgctgaggatgttcctcacgtggatgacacagctgaagaggtcttccaacaacttgaagaaacagttgttgatgcccatggaatgtcctgaattgaagctattctcccatggaaggaaggttcagaaatttgggaggcctgctgctgagattaaagggttagtcgttgccacaagattaagtcctttgatcgcatgttcattggacactggcgatcagggacttacattggcttttgtggagatgtggcataaggaaactagcaatttccatcttccagtaggagaggtcaccatcaccctcgatgatgtgacctctttgcttcatctgcccatcacaggcgcattccacagcttcaagacttcatgtcgacgaagtggtgttggtgttagtggagttacttga

SEQ ID NO: 48678 - DNA, 450 bp, Glycine max
  Peptide Sequence Number=SeqID_165456
atgctacacagactcgcatcttgtctaggggcaagttgccaacagataccagatcaaggaaaaagtactgctcaagagagcaacaccagagaagacttgctctccaaactggcttgcaccaaaaagaccggtcacctcaagactatcatccaagggacgctccaaactcccactatagacattgagaaaattatggccgaagaagaggaggaaccaaactggatgaccccctacaagaatttcctaatttggggggtgttgccagtagacaagaacgaagcccagcgactaaaaggaaagctattcaaaagagggttaacagcatccctgctcaaatgcctgaactgccaacaggcagactatgtcatgagagaacttcatgaagagatctacgaccttcataccaagggatgctcccttgccaccaaagtggtgtgtgctagctactag

SEQ ID NO: 48679 - DNA, 456 bp, Glycine max
  Peptide Sequence Number=SeqID_165457
atggatacttgtggagatttctttacttggaccaacagacaagctgataataccatatactctaggattgacagatttttgggtaatctcgattggctgcaaatgcatattgattccactttaaaaattttggctcctagtgtttcagaccatgcccttatgtttctcagttgtaaagatcaaagtagcaggctcaggggtagatttaagtatagaaacagtctggctaggttgaatggtttccatgatgaagttaagaagaattggaacttgggtgtacatggtaatcctatgtataaactttggactaagctcagtagacttcaatctgttctgaaaaacctcagcagtcctctaaatggcctaagggagaaaattgatgaagctagaagaaacttgcagcaagctcatgaagatctatgcagagatagattcaatgtggataacattaacagg

SEQ ID NO: 48680 - DNA, 309 bp, Glycine max
  Peptide Sequence Number=SeqID_165458
atggatatgggagacgtggatacacaaccaacaacttcagttcatctcgctttgcattgtcactatgaatggtccaatgcccatgccttcaacagaccagatcgtgatcttagacaacaacaaccccctccttcttggtcaaaatctccctcgggatttctcaagatcaatatcaacactgcgatcaacaaatttgccaattcactacattttgaagggtatcctaaacctagagaggcagaggcagtgggtcttttgcatggtttaatttggtctcatcaatttggccgccaacagattgtgttttga

SEQ ID NO: 48681 - DNA, 309 bp, Glycine max
  Peptide Sequence Number=SeqID_165459
atggagtctatgcttcagaatgatcatctcaaagtcgaaggaaaatggcaacttctttgccagcttcatgtccctcccaaggttaagcactttatttggcatttacgatgggatttcttaccaaccagacaacgattaaaaaccaaaggagtcccttgcaccaacctttgctcttactgcagcacaaatttcgaaaatgcatggcacgttatgttcggatgcaagcaagttgaacatgtttgggaagcttcaggcttgtggagtttgtctctgatcatgtttttggtgctgaaagtctcaaccaactag

SEQ ID NO: 48682 - DNA, 1983 bp, Glycine max
  Peptide Sequence Number=SeqID_165460
atggcaccaaatactgagaagtctagtaacaacgacttcaccttgttgcaagttcatgattcggattctcccatgtttccagagaagcagaaagccacaagccgcaagcagtttacttggtttcttctccttaaactccacagagttctgacatgtttgtcatggctgaccaatggtctcaaagccacttttgctttggtcaagaagcgcgtttcattggctgacatgagtgatgagggccctaagagtagaggaaggttgtacaggttcatcaaaatctttcttgctctctcaattggaggcttggccatagagatcattgctcatttcaacaaatggaacttgcacaacatgattcagccttgggaggttcagggtcttctgcaatggtgctatgtggcttggctctccttcagggaagactatgttgctcctctagtcttgatggtctcaaagttctgcattgtgctcttcttgattcagtcgctggatcgccttgttctctgccttggatgcttctggatcaagtacaagaagttgaagccaacctttgatgcagatgcatgtgatgttgaggatccttcaaacttcccaatggtccttgttcagattcccatgtgcaatgagagagaggtttattcacaatcaatcggtgctgctgctcaacttgattggccaaaagacagaatattgattcaagtgctggatgattcggatgatgggaatttacagctgctcatcaaagaagaggtggcctcatggaaagagaaaggggtgaacattgtgtacaggcacagattgattagaactgggtataaagctgggaatcttaagtcagcaatgtcatgtgactatgtcaaggactatgaatttgtggcaatatttgatgcagatttccagcccaatcctgatttcctcaaactaaccattccccattttaagggaaaacctgacttgggcctggtccaggctagatggtcctttgtgaacaaggatgagaatctactcacgaggctccagaacatcaacttgtgctttcactttgaggtggaacaacaagttaatggctacttcctaaatttctttggattcaatggaacagctggtgtttggaggataaaggctttggaggaatcaggagggtggttggagaggaccacggttgaggacatggacatagcagttcgagctcacttgaatggatggaagttcatcttccttaatgatgtcaaagttctatgtgagttaccagagtcttatgaagcttataagaaacaacaacatcgttggcactctggcccaatgcagcttttcaggctatgtcttcctgctatactaacttccaagatatcagtatggaagaaggctaatttaatatttttgttcttcctgttgaggaaacttatacttcccttctactccttcaccttgttttgcatcatactacccttgacaatgttcatacctgagtctgaactgcccctttgggtgatatgttatgtccccatcatcatgtctttcttaaacatccttccatccccaaaatctgtccctttcctagttccttatcttctatttgagaacaccatgtcagttacaaagttcaatgccatgatttctggattatttcagctaggaagtgcttatgagtgggtagtgacaaagaagacagggagatcctctgaatcagatttgttagccttggctgagagagagtcaaagtcttcaaatgaagaaaagattctgagaagacactcagagtctggcttggagttattaggcaaacttaagcaatcagaagccccttcaaagaaaaaaagaaacagactttataggaaggaactggcacttgcacttcttttgctcacagcatctgcaagaagtcttttgtcagcacatggtgttcacttctattttttgctcttccaaggattgtcatttctcataatgggtttggacttgattggtgagcaagtgagctga

SEQ ID NO: 48683 - DNA, 801 bp, Glycine max
  Peptide Sequence Number=SeqID_165461
gggcaactgccagattgttggaaatcagtaaagcaattactgttccttgatttaagcagcaataaattgtcagggaagattcctatgtccatgggcgcccttgttaatatggaagccttggttttacgaaacaatggtttaatgggtgagttgccttcttctttgaagaattgcagcagtttatttatgctggacctgagtgaaaatatgttgtcgggtccaataccatcatggattggagaaagtatgcatcaattgataatcttgaacatgcgaggaaatcacctctccggaaatctacccattcatctctgttatttgaaccgtattcaattgttggatctttcaaggaataacttgtcaagaggaattccaacatgcttaaagaattggactgcaatgtctgaacagagcatcaactcaagtgacactctgtctcatatatattggaataataacacttactttgaaatttatggtctttactcatttggaggttatacgcttgacataacatggatgtggaaaggtgtggaacgggggttcaagaatccagagttagagctcaagagcattgatctttctagtaacaatttaatgggtgaaataccaaaggaggaagacattttgaaacctttgaagcctctagttttgaaggaaacattgatctttgtggcgaacaacttaacaaaacttgttctggggatggagatcagacaacagcagagcatcaagaaccaccagtcaaagggccattactactgtggcgtccttggagaattgcctacatcagatttctga

SEQ ID NO: 48684 - DNA, 693 bp, Glycine max
  Peptide Sequence Number=SeqID_165462
atgacggttcaaaaccgtcgtagaaagtccaattcaaccgacttaaaaggcactaattctagtagtgttgacataacatggatgtggaaaggtgtggaatgggggttcaagaatccagagttagagctcaagagcattgatctttccagtaacaatttaatgggtgaaataccaaaggaggtcggatatttgcttgggttagtttctttgaatctatcaagaaacaatttgagtggagaaattccttctcggattgggaatttaaggtcactagaatcacttgacttgtcaagaaatcacatctctcggagaattccttcttctctttctgaaattgattatttgcaaaaattagacttgtcacacaactctctgtctggaagaatcccatcaggaagacattttgaaacctttgaagcctctagttttgaaggaaacattgatctttgtggtgaacaacttaacaaaacttgtcctggggatggagatcagacaacagaagagcatcaagaaccaccagtcaaaggtgatgattcagttttctatgagggattatacatcagcttggggattggatacttcactggattttggggcttattagggccattactactgtggcctccttggagaattgcttacatcaggtttctgaacagattaacagactatttatatgtatgcttattgtga

SEQ ID NO: 48685 - DNA, 1458 bp, Glycine max
  Peptide Sequence Number=SeqID_165463
atggagagaatgagagggatagaaagtatgttgtgggtgagtagagtcaatttatgcaaagatggattcaactaccttcccaatagcgcagaaattaagtgcattgagagtgagagacaggcactcctcaacttcaaacatggcctcatagatgactctggcatgctgtctacatggagggacgatggcaataacagagactgttgcaaatggaaagacattcaatgcaacaatcaaactggtcatgttgagatgcttcatctccgtgatgtatcacgcaatcaaataaaggggcaactgccagattgttggaaatcagtaaagcaattactgttccttgatttaagcagcaataaattgtcagggaagattcctatgtccatgggcgcccttgttaatatggaagccttggttttacgaaacaatggtttaatgggtgagttgccttcttctttgaagaattgcagcagtttatttatgctggacctgagtgaaaatatgttgtcgggtccaataccatcatggattggagaaagtatgcatcaattgataatcttgaacatgcgaggaaatcacctctcaggaaatgtacccattcatctctgttatttgaaccgtattcaattgttggatctttcaaggaataacttgtcaagcggaattccatcatgcttaaagaatttcactgcaatgtctgaacagagcatcaactcaagtgacactatgtctctggctaggtcacgcgtgcgtccactcccgaaaagcttacttctctacccttgcgccgctgcagcaatgttgatgaactccgcatctggcggtgacgctccttctcgcgattttgatacgccgacgctggaccttgtatcaacgacgctactccacgcgatcttcgagcatggcgggtacacgtgcttgagcatggcaacgctggcggaaaacggcgacattcgcacggcggaggcggcgtgcgagagggcgtggcactcggtgctgtcggtgtggcgcgaggcttactctatggcatgcctcctcgtgacgcgccaccactaccgcaacggcgagttcagggacacgcttagggttttggatttgggaatcatcatgggaggcacgcttctccgcaaggatttggactccgccattgagaaaatttctgaacaaacaaggaagagtgttagggtttctgatttggggaactctgagcatcgactcgtcgatcgcaaattggtactgaatttctatactttactgagtggatatgctcaaaagttaaacactcgagtgcccattggaaaaggtaaagaaataaaaactgtaacaatggcactatgtttcatggctattgaaggtgtgcaacttacaattcctgaaaatgctctagttgaagggaaaatggctgggaatgctaggtggcaccgttatgcaaacagttattctattgtgggtcacatttag

SEQ ID NO: 48686 - DNA, 2001 bp, Glycine max
  Peptide Sequence Number=SeqID_165464
atgggggagggatattgtacgcagccttacccttgcatatgcaaagaggctgtttccggattcgaacccatgaccaacaggtcaccaaggcacaactttaccgctgcaccagggctcgccctcaagagagaaattttggtattgattgctttgaaaaagggtgctcaacttcttaaatatggtcgtaaaggaaagcccaagttttgtccatttagactttcccatgatgaatcatccttaatctggattacaagtagtggagaaagaaatctgaagctatcttctgtctctagaattattcctggacaaagaactgctgttttccaacgttacttgcgtcctgagaaggactatttgtctttttcacttatttacagtaacggaaagcgatcgcttgatttgatttgcagagataaagttgaggcagaagtgtggattgctggcctcaaagcactgatagcttctggtcaaggtggtcggtccaaaattgatggatggagtgatgggggtctcattcttaatgatagcagagacttaacatcaaataatccaagtgtaagtttggctagcacgtcacgaggcatttgttctcctgacatttctgtgactcttccaaatacttcaccaaagtcctttcggtctgacaatacaatttctgaaaggtcacatgcgccaccagacccaacaaacatgcaagtgaaaggatctgcttcagatgtatttcgtgtcagtgtttccagtgccccaagtacatctagtcatggatctgcacctgatgactgtgatgctttgggggatgtatacatatggggagaggttacctgtgaaaatgttaaagttggtgctgataaaaatgtaaattatgtcagccccagggcagatgtacttctccccagaccactggaatccagcgtagttttagatgtacatcatatagcatgtggtgttagacatgcttctctagtcactaggcaaggtgaagtttttacatggggcgaagaatcaggaggatgccttggtcatggtgttgggaagaatgtggttcaacctcgtctagttgaagcattgacttctacaactgttgattttgttgcctgtggtgagttccattcctgtgctgttacaatggctggggaactatatacatggggtgatggtacccataatgctgggcttcttggtcatggcagtgatgtcagtcattggataccaaagagaattgctggtccattagagggacttcaaattgcatttgttgcttgtggtccatggcacacagccttggtaacttcaacagggcagctgtttacatttggtgatggaacattcggtgtcttgggccatggagataggcaaaatgtttcatatcctagagaagtagaatccttattggggttgagaacaatagctgttgcttgtggagtgtggcatactgcagctgttgtagaggttatcgcaacacactccagtacaagcatatcatcaggtaaattgtttacttggggtgatggagacaaaaatcgccttggacatggggacaaggaggcacgccttaaaccaacttgtgtggctgcacttattgattccaattttcataaaattgcttgtgggcacagtttgacagcaggcctgacaaaatctggacgtgttttcactatgggaagtactgtttatggtcagcttgggaatcctcaatctgacggaaaggttccatgcttggtcggagacaagattgccagggaatcgattgaagaaattgcttgtggagcatatcatgtagctgtattaacatccaaaaatgaagtttatacttgggggaaaggtgcaaatgggagactgggtcatggagatattgaagatcgtaaaacaccggctttggttgaagcattaaaggatagacatgtgaaatatattgcatgtggttcaaattactctgctgccatatgccttcataagtgggtatctggtgctgagcagtctcaggatagacatgtgaactaa

SEQ ID NO: 48687 - DNA, 165 bp, Glycine max
  Peptide Sequence Number=SeqID_165465
atggtgtttgggttgacaatcgacagtggttttggtggaggcttggtttgcttgggagagacagggtatttgtgtccattcgggtcctttggaggtgcaaggagcaaaaaagggaggtgcgagaagaaaaaagggagatccagaaacctttaccggatgtgttaa

SEQ ID NO: 48688 - DNA, 1248 bp, Glycine max
  Peptide Sequence Number=SeqID_165466
atgcttctagcccttgctgctcttcgaaactggcaccttagacaactcgacgtcaacaatgcttttctccatggggatctcaatgaagaagtctatatgaagcctccacctggattggttatggataaacccaacctcgtttgtcgccttcaacgttccttgtatggacttaaacaagcaagtaggcaatggttcacacggctttcatcattcctcctctcacaaggctttcgtcaatcttcagtggatcactctcttttcttatactctcacaatgataacactataacagctatccttgtttatgttgatgatataatcttggcaggagataacctcaagtctatcactcattttaccaagcttcttgaccaaacctttagcattaaggatctgggtattctgaagttctttcttggactcgaggtagctcgttcaagtcacggcatacacttatgtcagcgtaaatatgtgctagatattttgtcagactcgggtatgctaggttcacgtcctgcctctactcccatggactactccaccagattaagcgcttccttgggcacgccattatccgaaaccactgcttcttcatacaaatgtttaatcggtcgtctcatatatcttacgaatacacgacccgatattacgcatgcagttcaacaactaatcttgcgctacctcaagagttctcctggttcgggcattttctttgttgctcatggtgacctcactctcaaagcattcaatgactctgattgggcagggtgtcgagacacgaggcgctccatcactgggttcgttgtttatcttggtgagtctcttatttcttggcgatccaagaagcagtctacggtgtcacgtagctcctccgaggcggagtaccgagccctggcctccactacatgtgagcttcaatggttaagctatcttattcacgactttcgcgttttgtttcttcaacctgccacactcttctgtgacaatcaatccgccattcaaatagcttcaaatccggtgttccacgaacgtataaaacaaattgagatcgactgccatatcgtgcgggacaaagtaaacgcaggcttgctcaagctccttcctgtttcttcttcaatgcagattgcggacatcttcacaaagcctctcactcctgctgtctttcaaggactatgttgcaagctgggaatggaaaatatccacttccagtttgagggggggggtcttagcagaagctcgttatcttag

SEQ ID NO: 48689 - DNA, 156 bp, Glycine max
  Peptide Sequence Number=SeqID_165467
atgcctaatctgatttttatgcttccaagtctcctattcaggatcaagcttcaggcaccaaagagaaaagtggcgattttaaagattgttgtgtctctgaacatcaagccagagacaaatgtggtgcagcaggatgtaacagacaagcttaaataa

SEQ ID NO: 48690 - DNA, 1125 bp, Glycine max
  Peptide Sequence Number=SeqID_165468
atgaaggtagcacaggtgctgcacatgaacggtggcgttggacacgcaagctatggaaacaactcccttgtgcaggaaaaggtgatttgtttgacaaagcccataagagaggaagccataacaagcctctattgcaacaccgtccccagaagcttggcggttgcagatttgggttgctcttctggaccaaacactttgcttgttgtgtctgaattcatcaaaattgtggagaagctttaccgggagctaaaccataaatctccagaatacaaggtctttctgaatgatcttcctgggaatgacttcagcaacatcttcaagtcccttgatagcttcaaagagaagttgtgtgatgaaatggaaagtgggattggtccatgctacttctctggggttcctggttctttctatggcagggttttcccaaatcaaagtcttcattttgtccattcctcttatagccttcaatggctatctaaggttcctgagggtgtagacaacaacaggggcaatgtttacattggcagtacaagcccgacaaatgttgcgagagcttactatgagcaatttcaaagagatttctctctttttctcaaatgtcgtgcagaggaattagttaaaggaggtcgtatggttctaacatttttgggaagaagaagcgatgatccctctagcaaagatggtggctacatttgggagcttatggctactgctcttaatgatatggtcttgcagaagtttctctttcggaatcataaagaagagcagttagatacttttaacattcctctatacactccatctccatctgaagtaaaattggaagttcttaaagaaggttcatttgccatcaatcgtctagaggtgtctgaagtgaattggaatgcttttgatgactggaacgctcttgaatttgaatctgaaaggtctgatacacttagtgatggcggatacaatgtggcacagtgcatgagggctgtggtagaaccaatgcttgttagccactttgatgaagctatcattgaagaggtttttagccgttaccaacaaattttggctgatcgtatgtctaaggagaaaactaagttcaccaatgtcaccatattattgactctaaaagcataa

SEQ ID NO: 48691 - DNA, 1758 bp, Glycine max
  Peptide Sequence Number=SeqID_165469
atgaacgagtcactactaaatacagaaagctacctttatcttcatccaagtgagaacccagccgttgcactggtttctccacctttagattctagcaattatcattcatggagtaggtccatgatgacggcattaagcgccaagaacaaagtagagtttgtaaacgaaaaagcacccgagccattgaaatctgatagaacttacggggcatggagtcgctgtaacaacatggtggtatcttggttggtccattcagtatccatccccattagacaaagtatcttgtggatggacaaagcggaagagatttggaatgatctgaagtctaggtacgcacaaggggaccttctgagagtttcagaactccaacaagaagcttcatccattaagcaaggatctctctcagtcacagaatacttcacgaagctgcgagtcatatggtgtacttgcttggtgctcaccaccatagctcaacgaaagcaagaagatcgcgcgatgcagttcctgcgaggattgaatgagcagtatgagaatatacgttctcatgtgttgctgatggatccaatacccacaataccaaaaatcttttcatacatggcacaacaggaaagacaactaggtaacaaccctttatcaagcttcaatctcgaacctaaagaagtatcttccattaacgctgtcaaaattgtttgtgaattctgtggatgcactggtcataatgaaagcatctgttacaagaaacacgctctacctcccaatcacgatggaaaaggaagaggttacagcacgaggaaaacatgcatctactgcgggaagcttggacacacaattgatgtttgctacaagaaacacgggtatcctccaggattcaaattcaacaatggcaaagcaatagctaacaatatagtggcagcagaagggaaggccacggatgaccagatactatcccaagaatctcaagaaccggttcgtttttcatcagagcaatacaaggcattgctagctttaatacaacagccatcggccgaaaaatcagcatccattaagccacaggttgcctctatttcgtcttgtaccaataatgatccagcagcctttacttttaacctaatatccatatcaaagcttgtgccatttactaactacaaattgattttttcatcgaatatttgcattctacaggataccaataccaaggtgaggattggtacagctgaagtgagtcgcggcctctatcaattcatccccgaagcaccaaaaacacataccatatgttctaccatcacgcacccaaagtgtagaatccttcctgtaaacctatggcactatcgtatgggtcacccttctcccgaaagattacaagccatgcagtcatactatcctttcttgaataacaacaaaaatttcatctgtaatacttgtcattatgcaaagcataagagattacctttcccttctagcacatctcatgcatcaaataaatttgagcttttacatattgatatttgggggccatgctccaaaacatccatgcatgggcaccgatatttcttaactatcatagatgatttttccagatatacatggatccacctcatgcacacaaaagctgaaacacgtaaaattatcattgatttcactgcatatattgaaactcaatttgatagcaaaattaaaattctaagaagcgacaatggaactgaatttctcatgaatgatttctatgctcgcaaaggtatcattcaccaaaccacttga

SEQ ID NO: 48692 - DNA, 177 bp, Glycine max
  Peptide Sequence Number=SeqID_165470
atggaggggatacttaaccttggtgggagaggtggttgtcgtgtgcgtgaagaacggcgtaggctgggtgtaccaggaggtgaagaagacgagttgtcttgtgtagagaaatatgcaaggatgagcacgagggtcgagtttctgtcgatgattctgaagggtactgatgtaacataa

SEQ ID NO: 48693 - DNA, 918 bp, Glycine max
  Peptide Sequence Number=SeqID_165471
atggcgtttgggttgacaatcgacagtggttttggtggaggcttggcttgcttgggagagacagggtatttgtgtccatttgggtcctttggagtatccattcttggattcaacagccttcccaatagcgcagaaattaagtgcattcagactgagagacaagcactcctcaacttcaaacatggcctcatagatggctatggcattctctctacatggagtgacgatgacagtaacagagactgttgcaaatggaaaggcattcaatgcaacaatcaaactggtcatgttgagatgcttcatctccgtggtcaggatacacaatatttgagaggtgcaatcaatatctcttcattgattgcccttgaaaatattgaacacttggatctcagctctaattcttttccatggagtcatatcccagaacacatgggctcgttcaccaacttaagatatctcaatctctctcattgtttttttattgggattattccttctgatattggaaagcttacacatttactgtctcttgatctaggtaagaatctttatctctatggacaaatcccttatcaacttggaaaccttacacatttacaatatcttgatctaagtgataatgatctagatggggaactcccttatcaacttggaaatctctcacagttgaggtatcttgatcttgcgggggggaattcattctcgggagcactccctatccagattgggaatctttgtttgttgcacactcttggacttggtggcaattttgatgtgaaatctaaggatgcagagtggttgactaatctttcttccttgaccaaacttaggctaagttcactacacaacctttcctcttctcatcactggctacaaatgatcagcaagcttattccaaacttaagagagttgaggcta

SEQ ID NO: 48694 - DNA, 474 bp, Glycine max
  Peptide Sequence Number=SeqID_165472
atgatgatgggaggagatctccatgacaacatcaacaagttcaatcagctagtaaaccaatttttgaatgtaaatgataaactctctaatgaggagcaaacactgttgttgttgacctcactaccaagatccttcaaagctttggttcaaatgttatttgtggaaagatcaactttgaatttggatgaggtgatcaccgctattaaagaaaatgagagaatgatgagaactgaaaatattgatgatgaacaccatgcaatagctatggagaacttgaagaaattaagagatatgaacaaagatggcgccaactctcaagctaatgtaataaaaagtgttgaagatgaagatgatgtgttggacactttgaaaatcgacggagaattcgcccatttcaagttagggaatggtgaaaaaatgaaggctgaaggcatagggagtgtgagaatgaagctccatgatggtgttatttga

SEQ ID NO: 48695 - DNA, 503 bp, Glycine max
  Peptide Sequence Number=SeqID_165473
gtcaataccaaaggtgctcaaaagaaaccaatgaccaaagatcaacaaagagtgatccatcttactgggagtatgttgatgctttacattttgtgcaaaatagtaattcttcagtcaaacatagtgcatcatcatctgaacaagcaattccaagaaggactatgccgatgttggatcagttttatccttgcattcaccattccattgaaaactttgtcgatgttaaagttgatgattcatggtctttggtgtacaaccaattgcttaaagaacttgccaaatggcctgatgagtatatcaacctccttggtggcataaacaaatttgaggaattaaagagtctcgaagctatgaaaggcgcctatgataggcagataaagcaaagaggctacatcatcaagggtgatggtcacttctcttacaggaagatgaaaactcctagtttccttatgtcatctctctgcaaaagcctatataagtctctgatagccagtgtccaatga

SEQ ID NO: 48696 - DNA, 273 bp, Glycine max
  Peptide Sequence Number=SeqID_165474
atggaggctgacaacagtggtgacacgataaagataacgcagagatggaggaggaagaaggttcgttgcggcgaaatatacagaatgcacgagggagagaagagggagcctgaagaacaaagaggacgggaaggatatttgctcattgtgttaggcatagctcttgcaaaacttctcgatctcgacactaggaatcatcaccattcaccatggtatttttggaaaagaaaatcaaaaggaaattgtgttagtaataaaggggagcgaaaataa

SEQ ID NO: 48697 - DNA, 1101 bp, Glycine max
  Peptide Sequence Number=SeqID_165475
atggatgtgaataaaactccaggaattgatggctatggtgtgggttttttcaaagatgcttggagcatagttggtagtgatgtgagagaagctatcctagactttttccttcgtaataggcttcataaaggtttcaatagttctgtggtggctcttattcccaagcataaggaagctaagatgattaaagattttaggcctatttcttgctgttctactgcttacaagattatttctaaagtgttaactaatagattgagtaaagttattgacactttagtgggaaagaatcaagctgcctttgttccaggtcagcaacttcatgatcatgttctgctggcttttgagcttcttaggggctatgagaggaaacatggtactcctaaatgtatgttgcagattgatattcaaaaggcgtatgatacggtgcattgggatgctttggagcatatcttgagagagcttggttttcctgatcagtttatcaagtggatcatgatcgcagtcagatctgtcacctatgtctttaatatcattgggaggttcactagaagattagaggctaggagaggaattagacaaggggatcctatctcccccttgctgttcatcctggttatggagtatctcaacagaattctaagccaactggataaaattcctaactttaattatcattctaaatgtgagaagatgaagataactaatttgtgttttgcggatgaccttctccttttttccaggggtgatatcggttcagtgcagattatgcttgacaagttcaacactttcctccgttctatgggccttcatgtgaatccttcaaagtgcaacatatactgtggatctgttgatattaatgtcaaaaagcaattattgtttatttctggttttaaagaaggaaaaatgccctttaggtatcttggtattcctttatccagcaagaaactcaacataaagcattatcaagttcttatagataaaattgttggtcggattactcattggagtgctggtcttctctcttatgctgcaacatttctaggaagtctccaattgcttgggaaaaagtctgcagtccgaagattaatggtggtttga

SEQ ID NO: 48698 - DNA, 1056 bp, Glycine max
  Peptide Sequence Number=SeqID_165476
atgaaggtagcacaggtactgcacatgaacggtggcgttggaaacgcaagctatgcaaacaactcccttgttcaggaaaaggtgatttgtttgacaaagcccataagagaggaagccataacaagcctctattgcaacaccgtccccagaagcttggcggttgcagatttgggttgctcttctggaccaaacactttgctttttgtgtctgaattcatcaaaattgtggagaagctttgccgggagctaaaccataaatctccagaatacaaggtctttctgaatgatcttcctgggaatgacttcaacaacatcttcaagtcccttgatagcttcaaagagaagttgtgtgatgaaatggaaagtgggattgggttttcccaaatcaaagtcttcattttgtccattcgatggctatctaaggttcctgagggtgtagacaacaacaggggcaatgtttacattggcagtacaagcccgacaaatgttgcgagagcttactatgagcaatttcaaagagatttctctctttttctcaaatgtcgtgcagaggaattagttaaaggaggtcgtatggttctaacatttttgggaagaagaagcgatgatccctctagcaaagatggtggctacatttgggagcttatggctactgctcttaatgatatggtcttgcagggaatcataaaagaagagcagttagatacttttaacattcctcaatacactccatctccatctgaagttgaattggaagttcttaaagaaggttcatttgccagcaatcgtctagaggtgtctgaagtgaattggaatgcttttgatgactggaacactcttgaatttgaatctgaaaggtctgatacacttagtgatggcggatacaatgtggcacagtgcatgagggctgtggcagaaccaatgcttgttagccactttggtgaagctatcattgaagaggtttttagccgctaccaacaaatcttgactgatcgtatgtccaaggagcaaactaagttcatcaatgtcaccgtattattgactagaaaagcataa

SEQ ID NO: 48699 - DNA, 480 bp, Glycine max
  Peptide Sequence Number=SeqID_165477
atgaagaagaagaaggttgaagcagttggtgtctcgctaagcgaggcatatgcgcttagcaacgaatgcaaaatttggcaacagagaggctcattaagggtggaccttgagtttaacaagctttggaccatagacgcattcgtcttgggttttggcaaggctcaccaagggacgaaccttgggtttgacgagcctttggagatacgagattcaccaagggcagaccttgggtttgacaagcctttggagaagcgggacttaccatgggcgaaccttaggtttgatgagcctttggagatgcgagactcaccaagggcagaccttagatttgacgagcctttggagaagcgagagtcaccaagggcagaccttggttttgacgagcctttggagaaggcagacattggttttgacgagcctttggagaagctagactcaccaagggcagaccttggttttgacgagcctttggagaagtaa

SEQ ID NO: 48700 - DNA, 165 bp, Glycine max
  Peptide Sequence Number=SeqID_165478
atggcgtttgggttgacaatcgacagtggtttcggtggaggcttggcttgcttgggagagacagggtatttgtgtccattcgggtcctttggaggtgcaaggagcaaaaaagggaggtgcaagaagaaaaaagggagatccagaaagggctttgacccttcttga

SEQ ID NO: 48701 - DNA, 258 bp, Glycine max
  Peptide Sequence Number=SeqID_165479
atggacaagtgttgtccagtgttgagaatgatagcctcgacaggtgcagagttacaggttgtaaggcttgtcaagccccttaacctggataagggttgtccgggctacttctatcaagtttccggggtggacatgcttttggttttgcaagtacattcccttcaccgatgtctttcatctccaactttgccatgggcatgggcagcagtgactccaggttttgtgccccttctccgggttttgatgaaccttccttga

SEQ ID NO: 48702 - DNA, 105 bp, Glycine max
  Peptide Sequence Number=SeqID_165480
atgcaacataatgtggcacgtggactcttgatcactaatgatgctcaagctggtcaagtatcacctctcttagacaacatggagagggtgttgtctggtgattag

SEQ ID NO: 48703 - DNA, 159 bp, Glycine max
  Peptide Sequence Number=SeqID_165481
atggcgggaaataaatatgtaagaaatgtagtaaaggctaaagagatatgcagcgcacaacgtctatggtcctgctactccaagaaagcatgtgcttgtaggttgaatccaactgctggtgcattgaacaataagccgccaagatcttctttctcctag

SEQ ID NO: 48704 - DNA, 519 bp, Glycine max
  Peptide Sequence Number=SeqID_165482
atgaggaaaaaaggttttgattttgagatgaatgatgaatcgatgatgcataaacctttattaataactaagttgggttatgcagctttcctttgtcaaggtactccttttctgccatcaaagtttccagcaagagttgattatcacagagatgtttctctgacatcacaaacgatttttagaataaaaataagagaaaaacatgcaaaccatagttgcaccaaatttgtgacgtctgctgcaaggaatgatcatcatctaagctacgatgatgatttacctcaggagccctttttgctaacattgatcaaggatgtcatatgggggctaagatatatatttgtatttttggttgagcaacctggccagtttaaatacatagagtggccaagctttagtagtacgctgaggactgcgattctgactcttatacttgttgcaatgcttattgttgcattatcatctgttgattcggctctcagctatctattggctttagctcttcggaaaagaccataa

SEQ ID NO: 48705 - DNA, 333 bp, Glycine max
  Peptide Sequence Number=SeqID_165483
atgtccattggatttaatgatgaaatatgtgcaatttcagaattagggtacaacaataacaacaataagaacagcaggaacaactttaacaagggtccagggcatagaattccacagcacaccgcagtgcctattttaggaaaagagctctcgaggcagcaagaggagcaacttttgcaaagatacctaggttttaacttgaatgaagcagaattgaaacttagtcctacaagagggatctgtgaattaagttttggttttaagtatgttgttacaataatgttgtttggtctaagtctagtccaacaagagggatctgaggacaaagcttag

SEQ ID NO: 48706 - DNA, 168 bp, Glycine max
  Peptide Sequence Number=SeqID_165484
atgaagagtgtatccattcttggattcaacagccttcccaatagtgcagaaattaagtgcattgagactgagagacaagcactcctcaacttcaaacatggcctcatagacgactatggcattctgtctacatggagggacgatgacagtaacagagactgttgctaa

SEQ ID NO: 48707 - DNA, 224 bp, Glycine max
  Peptide Sequence Number=SeqID_165485
tgacttctggcttaacaccagtaatgctcgctcagccaggaggttcaagcggtgcgcttagcgaattgattcttgctgagcacatcattgacaactcatctgcttctaggatcttccacgcgcttagccatgatctgttgcgctcagcggatggctcgctaagccagagaattggcttagcgagcggctcaaaatcagcacttccaccaaacttgcctaattag

SEQ ID NO: 48708 - DNA, 180 bp, Glycine max
  Peptide Sequence Number=SeqID_165486
atgggattggctacaaaaattgaatacgaaaaggaaactaagatagttgtattcaaaaaacataaggtagaaaaaggagtttcttcccgtgaaaatgatggattagttaggatctctacgacatcatcttggataactaggttcaataatgtctgcatcatctttccagcagagaactaa

SEQ ID NO: 48709 - DNA, 462 bp, Glycine max
  Peptide Sequence Number=SeqID_165487
atgttgatggtgtcgatgacaatgctagtggtggcaaccaatggtgacgacaatgatagcagtgacagaggtggtattagtggtagcgatggtagccacgatgatagtagtggtgtcaatcatggtgatggtgttggtagcattggaggttgtggtgatagtaataatgtcggtggtgtcggtggtgatgggggtggtgggggtggcaacattagcagtggttgtaacaacaacgttagtggtggtggcaatggtggtgggggtggcggtgacagaagtggtggcaataacaattatggtggtggtgtggtggtggttaggacgatgttggtggtgattatgaagacgttggtggtggttgtggtggcggtgatgaaggtggcattactaaaaaaaactacattctacgacaacgaaaccacgacaattcccaaaaatcgtcttagaatgtctttgcggtga

SEQ ID NO: 48710 - DNA, 594 bp, Glycine max
  Peptide Sequence Number=SeqID_165488
atggttggtgtgccagttatacgtattcctctacgctcacacccgatcgatgttccacgagctcaaacgttgtttcttgaagaagacgtcaccctttacatggaaagatcttctatatcaaagatagcaataagtggggtatatggaggtgaggatggtggaaaatgtttaaggttgacgctggtgtactttactgacaacttgtttgtagataccaccacgaaaccctcattgccttctgcttcttcaccacctggctcgccaacgtggccactgacttccacgccagctccctcctcctctcatgctactgcttcgacgttaggaactgagcctcacctaagagcaatcagcgcggcagaagttgttcccctgtccgaaggggacatcgatggtggtgatgtggatgcatgcggtcgatggtgtgagaaggtgttggtggttttgaaaggtggtggtgttgtggaaagctgtgataatgatggtgttgaggaatgtggcgttgtttcgagttccgaagatgagtttgtgcgtgagagagatagacaaagggattcactcgtagagttaaataatttcaaaagcattccatga

SEQ ID NO: 48711 - DNA, 927 bp, Glycine max
  Peptide Sequence Number=SeqID_165489
atgcctcatcttgatactcgcttatgcatgctcttgtgtgttatacctcttgttggcgatcttattgaggaggaggaggaaaggaaaccggttgatgaaaaagacaatggtcctacagattactggaaagagaaaaaggttgcaggaaaatgtcgtgatgatttagtcttaagtctccaggtattgggtgattatcaaagcttgctcactccacctcaatctgttctagctgctgcaaaagcaatgctatttgtttctggcatcacaatagggagtgcatattttgactgcctcaacatgacagagatgccagttgactgttctggaaactaccatgagtacttgaagctgaaagcaagatttgaatctcttcaaaggacccaaagaaaccttcttggtgaagacttaggcccattaaataccaaagatcttgagcagcttgagcaccaactggattcatctcttaagcaagtgaggtccacaaaggttatgtggagtttgaatgatgtgcattggaacagctcgcttagcgacactagctcaccaagcacaatttcatccaaaggaaataattcactcagcaacaccagctcactaagcgtaattccagccagaggagaaattgcgcttagcgtgaatgtctcgcttagtggcaaccttctacaaattataaatacaaccaacaacgtgaaaaacacaatttttccccactcttctccccaaactctcacccaaaccctaaacccacctcctcatccccctcccatggccatcgacgatcaccacaagccgccactgcttgccgctgaaccaccgcacggagtggaagcctttgatcgaagcggaatcttcaaaacccaactcgtggattcggtagagaatggagccctagaccctcccttcgcggtttcttcgagcaaaccatga

SEQ ID NO: 48712 - DNA, 402 bp, Glycine max
  Peptide Sequence Number=SeqID_165490
atgtctgaacagagcatcaactcaagtgacactatgtctcgtatatattggtataataacacttactttgaaatttatggtctttactcattcggaggttatacgcttgacataacatggatgtggaaaggtgtggaacaggggttcaagaatccagagttaaagctcaaaagcattgatttttccagtaacaatttaacgggtgaaataccaaaggaggaagacattttgaaacctttgaagcctctagttttgaaggaaacactgatctttgtggtgaacaacttaacaaaacttgtcctggggatggagatcagacaacagcagagcatcaagaaccagcagtcaaagggccattactactgtggcgtccttggagaattgcctacatcagatttctga

SEQ ID NO: 48713 - DNA, 2916 bp, Glycine max
  Peptide Sequence Number=SeqID_165491
atggatgctgccctgagttccctttcctcgttacaatttcgcagacttagtcgtaagaacagggatggtttatattaccatatcaccctcttatccagtgttgacaccaccacccaggacttgcctccaagtatacacaccctattggccaaatacgataccctattccaacctcctcagacgttacccccaacccgtgacaccgaccaccacatacatctccttccccaagcgcctctggtcaatgttcgaccatatcgttatcccattaccaaaaacaggagattgagtctcagggcactgaatgcattgacggtgcgagattggttcccaattccgacgatagatgagctactcgataaattgggtggcgcaaggtatttctctaagcttgatttgcttcaggggtatcatcagatacgcatgcatcctcccgatatccctaagactgccttccgcacccatcatggccattacgaattcaaggtaatgccatttgggttgtgcaatgccccctcgtcatttcaggccaccatgaatgctattttccgaccatacctccgacaattcctcattgtctttttcgatgacattctgatatacaacaactccttggatgaccatgtgcaccacctcgagctcacttttcaggagcaggtagaatatctaggccacctagtttcccaccatggagttgaaccattgccatcgaaggtggatgctatccaacagtggctgattctgagaaccacgaaagccttgaagagtttcttaggccttgccggcttctaccgccggttcatcaaaggctatgcaaccattgcggcccccctggttaaggcaaccaccagtgacacacttcggtggaccgcggacactcaggcttcttttgaaaatctcaaacatgctttatcttcagctccggtcttggccctgccggattttacattgcccttcatggtggagacggacgccttcggggttggcatgggagttgtcctctcgcagcagggacaccccattgcctacttcagtaagccatttagtgccaaactcctctgttcgtcaacatatgttcgtgaattgtttgctataacggcggccattaagaaatggcgccaatatctcctcggacatcacttcattatcgtcactgatcacagaagtctgaaggaacttctcacacaggtaatccagaccctggagcagcatacctacttggcccggttgcttggttatgattatgaaattcaataccggtctggcgctcataatcaggccgccgatgctctctcctggttgccggaaaacactacttctctttgggtgttatcagttccttgtctgacattcttcgaggagcttcaacagcaattacagactcagcctgaatacgttcgaaaacgccatgatatcacagagcaaccctccaatcaccctgcgttctctatttcgagtaacatgattcttcacaaggggcgtatctggctcccagaaggatttcacttgattcctactttaattgcagaatatcatgtgacgcccacggggggtcacgccggaattgcgaaaacaattgcaagagtcttggagaatttttcatggcctaagctcagggaggatgtcacacaatttgtgactaactatgcggaatgtcagtgcaccgactacgagactaagtgcttggccgaattgttatgtccccttccggttcctttccggccatgggaggacctttctctcgatgtcatcacaggcttgtcggcataccatggacacacagtcattctcgttattatggataggttctcaaaaggggttcatctgggtacgcttcccacagctcacacagcattagcagtggcatcgttatttgtcgacatcgtggtcaagcttcacggcactcctcggagcctagtatctgatcgagatcccctctttatcagtagattctggcaggagcttttccggtgcagtggtactcagctccgaatgagcaccgcctatcacccccaaagtgatggccaaacagaggtactcaatcgaattattgaacaatatctgagaagctttgttcaccggcaacccagcacgtggggaaaataccttccttgggcggaatggtcacataatacgtcctggaattcagccaccgggacgaccccttatgagctcactttcggaaagaagccattcaattttcctgagtacattgcagggtcctctgctgtggatgctgtggataccttgttacaggaccgcgatgaaactttccaattggttcgccggaagctcttgaaggcccaaagtcgcatgaaggaacagtctgaccgtcgccggcgcgacgtaagttacaattctgatgactgggtttggctcaaattgcgaccccatagacagacatctgctacaggccctctgagtcctgctgggaaactagcaaggagatactatggacccttcaaggttattgaagccataggaaaagtggcttatcgcctgcagcttccaccagagacgaaaattcatgatgtcttccattgctctctcctcaaaccatttcatggtcaattggaagccacctctcccgtgcctttacctgatcaatttcataatgatcaacccattatcactccagcagcaattgtggattatcgcaaaactccttcggaagcttgggaagtcttggttcaatggcatggcttatccccagatgatacatcttgggaggattggtctactctttgccatgactatcaccttgaggacaaggtgatttctcaagggccgtgggatgataaggataacacagaccacagagcaggggtacaaatagaacattcagcagaggtacagattaaggaaaagcccaaaagaagagtcatgaggccagcttaccttcgagattatgcttaa

SEQ ID NO: 48714 - DNA, 279 bp, Glycine max
  Peptide Sequence Number=SeqID_165492
atggaaatctcaagcgggttgtggccgaatcaggataaatccggttttgcattctctcttcccttatcttttttactttctgttatctttacatttccgcaatattttaatgatactagaccattggaaccaaagagattaaaggcacttcgtgtagaagcaaagcttcatggtgaatcaaaggtgattcaaaggtgttttgatgataacaatgatgatgacaaaggtgatgacaaaaagatcaaagatcaatcaaagatcaactcaagtgaatcatag

SEQ ID NO: 48715 - DNA, 501 bp, Glycine max
  Peptide Sequence Number=SeqID_165493
caccactccttgtcctttagatgttgtagcctcttacaacaaaccacttatgaatccattaatgctttacaaatctttagatcggttacccttttcaaattatggagaccttcttaccagtggcttgatattctcatctcctcttgaaacttcaacaacaaccaatgctaaatcttcaatggatgcttcttccttgcttttgagcacatcatcttctgttcttggagaatttagtaagaactctgagggtataataaccacaaactttggtgtgttacaagagcatggtaatgactaccaaataccattactacgtgacaacatgcaagggacatttggtaaccacgatgataacaatgtgttggtaaagattcctaatgtgaatgtggtgcctcgtgttggtgaccaacaattggagacagtgcgatccattgggtttccattcaatattggcgatgcatggaagccaaatatgctttgggatgcttcatctttgtcctt

SEQ ID NO: 48716 - DNA, 477 bp, Glycine max
  Peptide Sequence Number=SeqID_165494
atgcagccctctgaaggcgagggcatacaaccctctgaagttgaggacgtgtcgccctttgaaggcgagggcatgcagccctctgaagccgagggtgtgcagccctctaaaggcatgggtacgcagccctctgaaggcgaggatgtgcagccctttcaagacgaggacatgtggtcctttgaaggcaaagacgcgtggccctctgaaggcgttagccctctgaaggcgaggatgtgtagtcctctgaaggtgaaggcatgtagccctctgaaggcgagggcgtgcagtcctctaaaggcgaggaggtccagtcctcttaaagtgagggtgtgtagccctctgaaggtgagggcgtgtagtcctctgaaggcgaggacatgcagtcctctgaaggtgagggcgtgtagccctctgaaggcgaggacatgcactccactgaaggcgaggacatgcagtcctctgaaggtgaggacgtga

SEQ ID NO: 48717 - DNA, 219 bp, Glycine max
  Peptide Sequence Number=SeqID_165495
atgaccacattggtctctgcgtgtcaacgggctcgcttgcctcttgctgacgaaagcctgaagatgctgacatctcaggaaaaggtgtcgatgatcacattggtgcctgcttgtcaatcggacttggggtctccgaatgacgaggtgcggataaccgtaaggcatctcctcatgctaccggactcacgggtcacgatagtaggatggggtggtcgataa

SEQ ID NO: 48718 - DNA, 294 bp, Glycine max
  Peptide Sequence Number=SeqID_165496
atgacgttgctacttagcaacattctgcctagtgaccataatgtcgatctccccctgcggaagtatcatttgagatcatgcccacaagacacccggtggacccggagaagtccaacaggtccctggggtttccagctctggttacgggcctctgtcagtcctactgggtgcccgtctcccccagcaaggtcatcccatcgtgacatagggatcgtgcctgcaagacacccagtggactcaaagaagtccaacatggtcctggggtttccagctctgattacgggccgctgttag

SEQ ID NO: 48719 - DNA, 474 bp, Glycine max
  Peptide Sequence Number=SeqID_165497
atggaggatggtcgtcgaaccgtcgtggttgctgaagtggattcgaccaaggtggttgcgatggtggttgaggaagacgtcaaaagagaatatcagatctgcggagttggaagaaagggaaaatataaccgtcaccgccgaaaatcaccttcggcgactgcgagcggtggcgatagatcacttaagggaagaacaatccggaattcggctagtggaggttgtgaagggtttaacctgatgaccttgggggtgattattcctggtgtcgaaattctaacgacccattttgatcctatacggagtcagagcgcatacaaacttttgaaaattgcactaagcagtaatgctaacagaaacgtgaaaaatgctatcagttatgggaaacgagttctagaggctgccaaaacaagtatggtgctgcaacagatcttcaaggcctgttatcaacaatttggtgctatatctccctcttga

SEQ ID NO: 48720 - DNA, 354 bp, Glycine max
  Peptide Sequence Number=SeqID_165498
atgaaagccacgcacgactttgtcgtcggcgaagaaaccatgcacgtgaaaataagaataagaataaggaatggtggtggtgggagagaagggttggacgttgaggtggaagggcctgtgaagcttacaagggattatatgaatcatgtggtttcgagaatggagaggaaggtgaagagtgagatggaggcaagcacggtggctcttgttagaaacgccgccgtgggtcaacgttggcctaagggcagcaacgacggagaggatggtggtgatgactcttgcatgcatatgcaatggttgattacccaacgtacagatagaagacctattagtccaaccgcatatcttgcgtga

SEQ ID NO: 48721 - DNA, 399 bp, Glycine max
  Peptide Sequence Number=SeqID_165499
atgagcgtcgaagaaggtcttcttctagcaagcgttaccctaaacggaccaagaagcatgcagcaacttcccgagaggaaaaaccctatttcgcaaggtggtggggttgtcaagtcctcctccttcttagcttccttacatgatgaccgtgaagagtactttgtggcgaagattcgtagcgataggggtgatgggggtttgagtgttgagcttcagaagccttctattcgggtcaaacgtgccttgttgtccatgttggatgatgtcaaagggaaagggtggttgcctaagcctagtagttctgattgtgcgatcgagttttccaacaaaaacaatagtaatactaataataaggtctcaagattagcattagccgccaaagcatcacgtcgcttttaa

SEQ ID NO: 48722 - DNA, 291 bp, Glycine max
  Peptide Sequence Number=SeqID_165500
atgagtgccatgaaattttgccgtgaatgcaataacattctgtaccctaaggaagacagagaccagaaagttcttctcttcgcttgccgcaactgcgaccatcaggaggttgctgataacttctgtgtgtataggaatgagatacatcactctgttggagagcgcactcaggtgttgcaggatgtcgctgcagatccaacgcttcctcgaaccaagtctgttcgctgcagtcaatgcaatcatggtgaagctgtctttttccagtttgctatcttggtattaagaatttag

SEQ ID NO: 48723 - DNA, 285 bp, Glycine max
  Peptide Sequence Number=SeqID_165501
atgagtgctggatatgatggaagaactatcgtgtgggatatatgggaaggcatgcctatccggacatatgagatatcacgtttcaagttggtggatggaaagttttcttcggatgggacatcaattatactttcggatgatgttggtcaactatatatattaagcacaggccaaggcgagtcccagaaagatgccaaatatgatcagttttttcttggtgattatcgacctctgattcaagacactcatggtaacgtactagaccagcattggtatgaagtttaa

SEQ ID NO: 48724 - DNA, 3213 bp, Glycine max
  Peptide Sequence Number=SeqID_165502
atgataccatacccagaaccttatcagagtgaatttcagcaaagacgattaggagcattaggccttgagtggcgcccatcatcactaaggcttgctgttggtcctgatttcagtctggaccctgattatcatatgcttccattggcagacttggatttgcttacagaaccactgcctgagtttatagatgctatggaatgggaacctgaagttgaagtgtttagtgatgatacagattcagaatataatgtcacagagggtttcttttctaagggtgagaaaggaggttcaagctccaatgcttctggtgattcagggtgcagcacagataacagtgaaggggaggacacttgcatggatagcattcgtagatcaaagaggaaaaaacagaaggctgagactgaggttatgacttcttctgggagacgtgtgaaacggaggaatttggatgagcgtgatggcaatactttcggcagtagccgaagtaggaagggaaaaagtgtccaaaaaacatcaagaaggaaatcttctaaatcaaaatcttcccgacctcaaagggctgctgcacgcaatgctctgcatctattttccaaaattactggtacaccaacagatggagaagaagatagtttggttggtgatttttcaggtagtgaatcaacattgcaagagtctaatattgacagtgatgaatccggtggaactttacagaatgaacaactgaattattctaagggaaaagaagtatcatattatgaatcggaggacaccaaatctcacgagttaactgaaactcatgtgaattcgatgaacaagaggttggttctcaagttgccaaatcgtgatatatccaagtccacaaatgagtttggctaccaggctgagttggttggctcatcatcaaaaactgcacaagaagctaccgattttaatgggaacagaccaagttctaaggattcagggtattgttctggaagtacaagttaccctgcagttgaaaaaacagatcaagcaaaactaggccaggtgacagaccatgtagacttgctggggaaaattagatggggaatggttagggctcgttcatctaaacctttgagagtgggagaagctatgccatcagacacagatccctactctggaaaatgtcctaatcatctcgatgaaaaagaaaatgttagcagtgggcatgagaaagaggacaagaactttagtgcactaacccccgaggtaacccctgagttagaaatccataaggatgactatagggtagatagtttgacagagattaatggtaaaaaagaaaatgctatcagtgggcacgagaaagaggacaagaactttagtgcactaacccctgagttaacccccgagttagaaatccaaaaggatgactataaggtagatagtttgacagagattaatgaaaattgtgctggtactacctcacagccttttaatcttactgaagatggaggagagatcacagcttccagcaattgcagggacaaaaatgaatcactaatttctgcttatgtgattcctcaggatattgtaactgcttccatcggctatagtgaggttgaccaactacctgaaccaaatattggttttgcttgtgtttcaacaaaattaaggtctaaaaggggttcaagggatcctgaaagtccatccaagcttgaaacaaaatcttcagtgctaaagaatagtgcatgtagcactaatgataataaaaatttgaacaatgtggttgtggatgacagcaacaacactagagtagcgtctaatcatggagagaatggatctcaagaagtagatcctcaaattagacaaaatagtacttcacaggatttgccagaaccacattcacacagagataaaatgtataaagctgtatatagaagatcaagatcacatagggctgtgactaatttagctgacagtagtggccagggagaatccaattcaaatgggagaaacagtaatttcaatgctgcagcaaacttcagcaatggcacatatgaagctattcatacaaacggatccttagagttggagcccacctcttctgacccaaattatgagcggaataatctcaaagtgctgcaaggaccgggaaattgtattgttaaaagtccacagaatgtttccacaagtggaggacaactcacagaagaagaaaggtgttctaattcaaaattgactgttggtttgaggtccactaggaatcggaggtctagttataatattcgtgagactagtcctgtaaataaaaggaaatcactacaatcagctaccagaggatcatggttgttgttatcaacccatgaggaaggatgcagatatattccacaacagggggatgaagttgtatatctgagacagggtcaccaggagtatataaattattgccgtaaaagagagtcagggccttgggtatcacttaagggacatataagagctgtagaatattgtagagttcaaagtctagagtattcccatcttccagggtctggtgatagctgctgcaaaatgaaccttctgtttgtagatccgaattcaagtgttgttggaaaatcttttaaattaaccctacctgaagtaaccagtttccctgattttcttgttgaaagaattaggtttgacactgctatgcaaagaaattggactcgcagggataaatgcagggtttggtggaagaatgaggataattcctctggtaattggtgggatggtcgaattctgtgcgtgaaagccaagtcttctgaatttccagacagtccatgggagagttgtactgttcggtacaagagtgacctcactgaaacacatttgcatagtccttgggagctttttgatgctgatactgaatgggaacagcctcacattgatgatgacatgagaaataaactgcaatccgctctcaccaaattacagcagtcaggcaacacagtccaggatcgttatggagtgcatgaattgaagaaaatttcaaacaagtccaaatttataaacaggtttcctgttcctatatccattgaattgatacagtcaaggttggagaacaattactaccgtagtttggaggcgctgaagcatgatgtgaccattctactgtccaatgccaccacttttctcgaaaaggatgcagtgctgtcagcaaaaatcaaacgcctatcagaatggttcacacggacactatcatctttatag

SEQ ID NO: 48725 - DNA, 939 bp, Glycine max
  Peptide Sequence Number=SeqID_165503
atgtatacttacaatgtcatcatacgcaatgtggtttctcaaggggacctggagaaagggttagggtttatgcgcaaaatggaaaaggaaggaatttcacccaatgtagttacttataacacgttaattgatgcttcttgtaagaagaagaaggtgaaggaggcaatggctctgctgagagtgatggcagtgagaggtgtcactgcgaatttgatttcgtacaattcaatgattaatggattgtgtggtgaagggagaatgggcgaggctggggaatttgttgaagagatgagggagaaatggttggttcctgatgaggttacctataatactcttgttaatgggttttgcagaaaagggaatttgcatcaggggtttgtgttgctttcggagatggttggtaaagggttgtctcccaatgttgtaacttatactactttgattaactatatgtgtaaggttggatatttgaatcgcgctgtggagattttccatcagatccgtggaagcgggctgaggccgaatgaaaggacttacagtactttgattgatgggttctgccataaagggttgatgaatgaagcttataaggtcttgagtgagatgattgttagtgggttttcgccatcagttgtgacttacaacacacttgtctgtggatattgcttcttggggaaggtggaggaggctgtgggaattttgagggggatggttgagagagggttgcctcttgatgttgctataaatagaggtcatgtgtgtgcatttttttggaactctgatcatttgagaattaaactacaaagttcagacttctttagaggcactaaatttcgtgctcttctcttcctctcccttcattcatcttcttctaccttcaagctcttatccatggcttcctatggtggtgagcttcttctagactcatcttctacttga

SEQ ID NO: 48726 - DNA, 806 bp, Glycine max
  Peptide Sequence Number=SeqID_165504
atgactgtaattgctctaattaaagcactagctagggaaaggatgaatgatgagctgagtcaagtattgctaaacatattgaggagctgtaagctcaatgatgctaaggtagctaaagtacttcttgaggttaactttaaagaagtcctttctgagacttcgacaatctgtttggctgcttctaggatcaatgactatctctacaaaccaacacgagacttattagcatactttgccttcacttatatgctttctaggaaacatcgcagaagcataaacaacatccatagtggtgacagtcttcctcctagtgtgctcagtgtaggtaacaacatcaggaataacattctcgaggaagatcttgaggacatcatgagtttccttgtagataagaccactgattctcttaacatctcctctccaagccaaatgcggaattgtaggtttggtgatacttggatgttgtcgcgaagcaccttcctaaaaccttccctcccttttcacgatactacatcttcactcatgttgaagggtggcaacgtgtttcagagcgcttactgcgtgtttgggaaattagaatgttgttgcaatggtgttgagggtgtatgcttttggggctttgatgttggaggtgtgtggaaggtgatgctgtgtgtgcagatccagtgcatcgaggttgatgtgcaccctcagatctgtgtcgtggtggaggtggcagtctgtggaggaggtaggtggtgcttgtggctggaggtggggatgatagtggaggaagataggttggaggttgtggcaacggaagaggg

SEQ ID NO: 48727 - DNA, 1212 bp, Glycine max
  Peptide Sequence Number=SeqID_165505
atggaagggtggagtatggctttgcagaagtatgctccttctggcaatgcaccttctgttaatataaaacatttgagcttttccagtaaggtgcccaagaaagctgagctcgatgaggcaaatccgaatcataacatggatgtggatattgaccttagggaaatttattttcttattatgcactttctttctgctgggccatgtcataaaacttatatacagttttggaatgagcttcttgagcatcaacttttgcctagaaggtatcatgcttggtattcaaggaccggagcatgtagtggagacaaagatgatgatggtctatcattccctttaaattacaatatgttagtagagaggtattcccatattgaaaaggatcacttggtaaagcttttgaagcaattgttattaaatacagcctccccatcactgggtatgaatcttggaaatgctccaaatgcagctgatgtacctactcttctaggaagtggttcattttcacttctgagctatgatagggacaaaatgaaagaagtcaaacggccacctcctcatatgcgctggcctcatatgaaagccaatcaggttcatgggcttagtttgagggaaattgggggtggtttcccaagacaccatcgtgcaccatctatacgtgctgcatgctatgcccttgcaaaaccttctaccatggtgcaaaagatgcaaaacatcaagaggttaagaggacaccgcaatgctgtctattgtgctatatttgatcggtcaggaagatatgtggttaccggttcagatgaccgacttgtaaaaatttggtcaatggaaactgcatattgtttggccagttgccgtggacatgatggtgacatcactgacttggctgtgagttcaaacaatgctttagttgcatcctcatcaaatgactgtgtcattcgagtttggcgcttgccagatggcttgccaatatcagttttgcggggccatactggagctgttacagccatagcatttagtcccagactgaatgctttataccagcttttatcaaaatcagggagatttgtgggcttcacagccagctgctccttcgtttgtgctgttgccaaacaagcctttgcgacctttagagttgctgggcaaggctctgtgacattcgccgtccccggaaaatcgcctgcaaccttccatcttccatccccttctcttttatag

SEQ ID NO: 48728 - DNA, 231 bp, Glycine max
  Peptide Sequence Number=SeqID_165506
atgaagcctcatcatgatttggagttcaagttgactttgatggggtacgacaaatggggcaacgttcttagctaccgcatagagccagcgagcatagttgaagttattgacaataagggagaccattataatatgatgtttgagaatattgaggagtacaaagaactattatgtcagttagagccttcgtccaaggaagagtatgacgatcttcctgaggatatatcttag

SEQ ID NO: 48729 - DNA, 1284 bp, Glycine max
  Peptide Sequence Number=SeqID_165507
atgactaatcagaagaacattgaagcttccatcaagaatcttgaagttcaggttggccagcttgcaaaacaactgtctgagcatggaagtggatccttttctacaaacacacaagtcaacctcaaggatcaatgcaaaaaaaatgatgaagtggtgacgaatgaagaagtggaagagaaagtgcaactgcagattaatattcctttctctaaggcattggagcagatgccaacctatgctaaattcatgaaggagttgcttagaaagaagagaataattttggaggataaaactgtggagttggaagctgactcacttcttgatttaggtgctagtaataacttaatgcctttgtccttgatcaagcaaattggaggtgttgaaatcaaaccaacatggatggctttacaattagctaatagaactattaagcatccgtatggtattattgaagaagtgttggtgaaagttaacaaatttctattccaagtcgatattttagtgatggatatggatgaaggtagtgaagttccattggttcttgttggacctttcatgaagactgctaatgtggtgattgatgttaatgatggaaagctctatgtcagggtgcaggatgatgaaggacaccttaatccaaccatgaaagaagtagtcaaaaaagaggtggtcaagctattggaagctagaatgatatatcctatatcagatagatcgtggaatgagaaaaatgagcttattctgactcaaactgatataggttggagaatgtgtgttgattatggaaagctcaacaaagccaccaagaaggatcatttcccattgccatttatggatcagatgttggagagattagcatgccaagcattctattattttcttgatggttattcagtatataatcaaatccctgttaaacctgaagatcaagggaagacaacttttacttgcccctttagtgttttcgcttacaggaagatgccttttggtctttgtaacgctcatgctacatttcaacaatgcatgcttgccatatttgtggatcttgttgaaaagagcattgaagtgttcatagatgatttctttgtttttgggtcttcatttgattcattcctttctaaacttgacaccgtactaaagcagtgtatggaaaccaatcttgtacttaactgggaaaaatgccattttatggtaactgaaggcattgttttaagccacaagatctttgttggtgggattgaagttgataaagccaaggtggaagtcattgagaaattgccttga

SEQ ID NO: 48730 - DNA, 357 bp, Glycine max
  Peptide Sequence Number=SeqID_165508
atggggtgttacaaacacagaaagctccaatttcaggaactagaagaattgaggtttcatgcgtgtgagaagtccaagctctacaagcaaaaagttaagatttatcatgataaaaagcttttgaagagaaattttcaacctggacaacaagtgttgttattcaattctagactgagactgtttccaggtaagttgaaatccaagtggtctagaccattcatcattaatgaagtcaagccatatggagttgtggtgctggaggatccaaccacaaaaagaacttggacaactaatggtagtagaatcaagcattgcttaggtggtcacacgaatgagcacttaatattgacgagctaa

SEQ ID NO: 48731 - DNA, 261 bp, Glycine max
  Peptide Sequence Number=SeqID_165509
atgccaatgttgttatgtaaaaatcatgaggaggcgttgaaggagtttctggcaaggcttaggtggttgtggctagtggtggtctatattatctcaagtgacgacacttgtagagaatctgatgctaaagggaaagattctaccatggtgtttaccagtaaagcaataacttcatcttttgacttcggtttggagagcttccacaatcttgttatggattatgaagcactgacaccgacacagacatcggacacgacatga

SEQ ID NO: 48732 - DNA, 402 bp, Glycine max
  Peptide Sequence Number=SeqID_165510
atgacaatcataatggaaaatgctagggaaccccaaaagacaggcaacttccacaagcacatcaacatgtcagtgtctgacttaaacctgcctgcacgtacaaaagagatgatcaaaaacacaaaatggtcccgaaagttatgggcccaacaagtgatgggtcttgaaggctcaagttggcaagggactttggtagagctacaagttcatcacatgccaacaggagtgagaaggggacatggatatgacgtgctaggagaaatgccaatctctggttactctactttctctgcttctttctacttctttttgtcttcctctttggattttatactttgcggtgaggaaagcacaacagtaccattatcacattgtttttctattgtttctacatcagcttag

SEQ ID NO: 48733 - DNA, 957 bp, Glycine max
  Peptide Sequence Number=SeqID_165511
atggctagcaacccctccagagttcagaagaagtccaagtcctccataagaaaacaaggagagttgtctcaagcagctcttaacaggatggatacgtggttcacagatgaaaataagaaaactgatttcaagatgatttacaccgtgaagaatatgaaagaaactttgtacccagagttggtaaaggttttctatacttgtgcccgtgctgacaaggaaggcaatttgcactctaccatcaatggtgtagagattatcattgatgctgaagtttggaaagaagttgcaggactggatatgggtggagtctacaagttcaaagtatctgtggatggctacagcaagatgcagatgtacagagctatgctccttgacctagcaaggactatgagaaactacataggagttggtggtttaactatcgaagataggatgttagtgtatctcattatctacattctcgcaccaaggtccaacaatcatgcacagatgaattggatacttctgattgaagatattatgttaaagagccatcgattagtggattatgagtttccatatgttgtcttagcctctagattcattgactactttaatatcgatgtttccaatgagatagtagatttcactaaagcctctaataagataaccgaaaggcatctcaagaagcttgggatgagatttgttgattatgaatggattatggctagagagccatcggcaacaacaaaaatggaccaaacgggagaagaagaagaaactcaacaagagcctgcacaccaatggaacccttttgagtgtcttatgactcagaagatggatgccattcttcacctccatcaaaagcaccaagccaatgttcacaattccttagaaaacattaccactaggcttaagaacatagaaactagactatcccttagtaaccttctcaacccggatgaggatgaagcgtag

SEQ ID NO: 48734 - DNA, 1059 bp, Glycine max
  Peptide Sequence Number=SeqID_165512
atgaaaaagaaaaaaaaggagatgacaacccacaagcagcgcggcaacaacggcgaggggtggcgacgagggtccagaggattgactacaacgagtgccacggagaagatgatctggaaccttgaaccagaattggaacgacaccgtttacgaccacgaagcacagatctggaatctataagctcaaatctcagagattatcgaccttggaggagatatgtggcttgcgatcggcgttggcggaggataaggtatgcaatcgtcgcgtacgaggtcggagaccttgaggcggtggcagggcgtgtgcggcgcagaacccaggcaaagcaaaattcgcgtggtggtggcggagaaggggtggaggaggaggtggtgttgctcaaacctaacacggcaggggtggggccggggttgacggtggcgctgtcgacgtcgcagaagccggtgatgggaggcctctggtggcgagggactgggattagggattcagattgggctgccgtccgtgcacagaggagtcttaggaggaacaactgtagagaaaaggatctgccaaattcgctagaaaattcaccagaaacaccacccgttatccaattaaaccagatttttggatcatttgtgaagttgaattgctatccaactgctattcccatttctaaaccttgttacacgagcatcttgatcaatggtctagaaagggaaatagcagttgagtggtgcttcaacgataagttattggatttagtatttatcttagcctgttttcgtgtactttgttttgccggatggagatctaatagctatgaagcatcgataccagacacgacacggtcacgtgacacatatagaggtcaacttgccaatatgataacctacagttctatattagatgctttttgcaaaaacgatcatccaaaggctattggattattcaagaaaactaaagaccaaggagttcaaaaccgcctatgtacacatccacgatacttatggatggattgtgcgaagtggaagacttcagaatgcaaaaatgatttttcaggatctactgattaa

SEQ ID NO: 48735 - DNA, 261 bp, Glycine max
  Peptide Sequence Number=SeqID_165513
atggaagttggaaaaatcgccgctaagtttggcggaggttctgagaaggaagcctttcaccagattgatctcagatttatgctcttgcgtgggactcagatcctgagggaggacatggaagatgtgtcgaacccaacaagtggtgctactcatggcagctccaacaagaagagctttaaaactaagttcatgcaggaacaaaaggacaggatgaaagatgcaccaccagagtgtcctgcaggagttttgttcccaaagtga

SEQ ID NO: 48736 - DNA, 674 bp, Glycine max
  Peptide Sequence Number=SeqID_165514
atggaggaatccaatcgggaaaataacaaagatcacatttcccagtcaagagggtccgctcttgacgggtccgctcttggcggtgaagaacacattggagaatggaggaatccaatcgggaaaatgacaaagatcacatttcccagtcaagaggggtccgctcttggcggtgaagaacacattggagaatggaggaatccaatcgggaaaataacaaatatcacatttcccacggaccctcttgactgggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48737 - DNA, 1533 bp, Glycine max
  Peptide Sequence Number=SeqID_165515
atgagtcaaatgacaaatgagattaactacaatgtgcactgcaatgatcaaactgggtcacagttaaatgatgagggcaatggagtaggtatggttctgaagaaagggccatggacagctgctgaagatgttcttttggtgaactatgtccagaagcatggagaggggaactggaatgctgttcagaagtactcaggcctgtctcgttgtggaaaaagttgtagactgcgatgggccaatcacctaaggccaaatttaaagaaaggagcatttaccgcagaagaggaacggatgattgctgaactccacgccaaaatgggaaacaaatgggcacgcatggcggcgcacttgcatggtcgtacagataacgaaataaaaaattactggaacactcggatgaagaggcggcaacgggctggcttgccactttatcctcccgaggtacttttgcaagcatttcaagagagaaagcatggccaaggtactggtgaaattagtaatggtgatggagggcatcatgatttcttgaagaaaaacaattatgagatacatgatgcaatatttgacagtctgaaggaaaatcaaggaatcttaccttttttgcctgaccttcctgctatttctgctaatagctttctgccaaattgtcttggttctcctccatattgtaattttttgccatcaacattacctaaccatgatcattttcaagagtcaaccatgtcttttattggttccagtgaattgaacagcaatgagttttatccatttgaccgtattaaggataataattctgataagatttcagaatcatttggattgtattctccccttgatcgtggtgcctcctcacatggctcaatttgttacagccattcactatcgaatggcaattcctctacttctaagctgatttctgaggctgcaaagtcagagctcccttcactccaaattccagaaaccgaatttggttgttggggtacctctcccccacctccattgaatgagtctcttgatgttttcattcattctcctcaaccacctaatgcactagactcaggttcttcaccacttaatagtggcttgcttgatgcattactttatcaagcaaatactcttggttgttcaaagaataattcttctgacaagagtttaaattcttcaattgcaactcctggtgacagagctgagagttctgctttgaacatgtatgagacagaatgggaggattatgctgaccctttatctccctttggagcaacttcaatcctgaatgagcatcctgttgttagcaccaatggaaactcatgggatgattgggaactttttcagacctttagtggcaacaatgagagattgcagtcagttgaccaggtttgggcccctaagagtggaaatcaatccatgtctctgttgaatctcactctgccagatgtcttgataacttcagattggcacgaactgtattctgaccacgatagcatgaaccaagctgtcatgactgaagctagtgatgatatcagtggacagtaa

SEQ ID NO: 48738 - DNA, 270 bp, Glycine max
  Peptide Sequence Number=SeqID_165516
atggcgcaaaggagaatgaacagtgactcgtacggacgagtcactgttggctttttatatgaaagggtgaagggcattttaaccctttcacccacgttgctaggtgccctagcaaaaacgctgggtgcccccaagcaacgaccttcaatgattggattggaaaggatttccaaaagcaaaaatccaagatcctatccgaactcattggatttgcaatttttcaatccaatccgaactaatgatccaaaccaatccagatttttcaattag

SEQ ID NO: 48739 - DNA, 1008 bp, Glycine max
  Peptide Sequence Number=SeqID_165517
atggcttctacttctgattccgttccttctttcaccgctgtcggatacacacgcactgacgctacttctccaccaaacaaccaccacctatcctcgctatcacacgtcactctcattaccgtaacggtcctcgccgtcgccgttacggtttccttagccttgtacttccttctccgctaccgtaacagtaaccgttttcgtttcctccgtcgagtctctccgtcgacatccgccgcagcgttctcctcctccggcaatcggatattgccggaaaccacttcttcgtcttccgttttcgacttgctcccgacgttcaccttctcctccatcacgcgccgcgccgacgccgctggcggcggcgactgcgccgtttgtttgtcgaagttcgagcagaacgaccttctccgcttgctacctctctgctgccacgcatttcacgcggaatgcatcgacacgtggcttcggtcgaagctcacgtgtccgctctgccgatccactgtcgccgcgtctgaatccgacctcgcgatggttttccggtcgtcgtccgtcgctggcagcgacagcttccggctggagatagggaacattagtagccgccgcgaaggagatatcaccgccgttgccggagaaacgcgcggaaggtcatattccgttggcgcgttcgagtatctcattgacgaggaagctgaggttgaggtcgaggttgcgttcggtttagctgaccggagaatcgtttccggcgagaaaaacgacggtgctccggtggtggctccggcggattctctagctggtgaggtagggcgtggtggtggaagtagaaatggtaatggctggttgaaggattacgttgatcgtctttcgaatacggtgtcgtttcggagttctggaagcttcttcactgggagcagtcgccgaagcgacgtcgttttgggaggagattacgatgtagaagcgagccgtttcggggacgaaatcggtgaaatgttccgatggctctcaggggtttga

SEQ ID NO: 48740 - DNA, 363 bp, Glycine max
  Peptide Sequence Number=SeqID_165518
atggcgggtccgatgacatgcgggggaaccatatggtcccgcacttttttcaccttttgtcatctagagatggcgggtccgatgacatgcgggggaaccatttggtcccgcactttttttcaccttttgtcatctagagacggcgggtctgatgacatgcgggggaaccttatgcacgcagagactaacatcatcttctgcacctttggtcatccagggatagcgagtcaggtggcgggcggagataccttatggtcatccgcacctttcattgaccgagggaaacgaattcggcagtatcaggatgatgttggtcgttcgataaatggcatcagttatcttaagaagggggggttgaattaa

SEQ ID NO: 48741 - DNA, 393 bp, Glycine max
  Peptide Sequence Number=SeqID_165519
atggtgggttgggagctaaagataactatttttaataaggcactccttgcaaaatggaaatggaatttgttccataataaaggttctttgtcggacttgaagtctacatgtggaggggaccaagatccttggtttgataatcttgttgagttgatggctgggaatggagcaaaaacaaagttttggaaacatagttggatggagaagagtggtttaagtgggaaaggtttagtagaggagttctatgccattttggatcaagctagagtaagcggggagggggttgatgagtggttgtggaagagggatggtgagggtatatctcactctgaggggggtatattcacagtgggatgtttgttcatgaaagggcactatgaacaaacatcttga

SEQ ID NO: 48742 - DNA, 534 bp, Glycine max
  Peptide Sequence Number=SeqID_165520
atgcaaaatctttttctccctcaaggtgtttgtgatgcgattgacaggatttcaagacaattcatttggggttctccacctagtcactgggttgattggaataccatctctctccctagatctaatggaggcttgggtatcagacctacccgagaagctagcgtagcccttcatggcaaacatgtatggtcggtgattcatgatccaactaaactttgggtccaaattcaaaaggataagtatttgaagggggattggattttccatcacagagactatgcaggatgtttctacacatggacttctattaaaaagttggcaatgattcttcaacctgggttttcttatcggattggtcaaggttttgtttcaatgtgtcatggaatgttaaagctaaatactaacgggagttcaagagataatcttggtatacctggtattggcggaatcatcagagatagtaatggatcgtgggtcaaaaccaacctctgcgctgaactattggccatactcaaaggtcttcagatggcatag

SEQ ID NO: 48743 - DNA, 492 bp, Glycine max
  Peptide Sequence Number=SeqID_165521
atgaacacctatgaatcatctaagatttataagcaaaagataaaggcgtaccatgacaagaagttacagagacagaacttccagccagggcaacaagtcttgctcttcaactccaaactcggattatttctagggaacctaaagtcaaagtggttaggaccattcgtgatcaaagaagtaagaacccatggagttgaggaattggtggaccctacagcaggcactcttgagaaaagatggatcgtcaacggacaatgcttaaaaatttataaatggaggccaattagaaatattaacaagcattggtgcaggaagcaatggatgttgggcttgaggcacgcatctggcgagactggcactaagcgagacactcttgctaagcgcgcaggtaccaacttgctaagcctcacatcaggcttagcgagaatgagcaatttggatgagaagggtgtggtttgggatgaactcgctaagcacgacacagcgcactaa

SEQ ID NO: 48744 - DNA, 387 bp, Glycine max
  Peptide Sequence Number=SeqID_165522
atggcagctaatggagtttcccgatcaagctcctttactcctgacttaagcaaagccaagtcaactactgcttccatagttggatttatggataagaagtcaaagatggatcccattgatgagtctagtagcacattggatagagttgagggagaaattgagcttcaacatgtgagcttcaagtatccttttaggcctaatataaaaatttcccaagacctcaacttggccattcatgttggcaagatggtagctcttgttggtgaaagtggaagtggaaaatccacaatgaatgccttgttacaaagattttgtaatcctgattcaaggcaaatgacacttgatgggatggaaattcgtgagttacaattcaagtggttaaggtag

SEQ ID NO: 48745 - DNA, 198 bp, Glycine max
  Peptide Sequence Number=SeqID_165523
atgactatttataggaaaaggccatttggtgtaggggaagctcgctcaggtgagctagagcttgcccaggcctacaaagttcctgaaaatgtccattttgcccctttccttgtgccttttgtttttggatctaacaatcaaacattaatcttaagcgacccttcaaccttgcgctacaaccggtgccaaacaccgtaa

SEQ ID NO: 48746 - DNA, 327 bp, Glycine max
  Peptide Sequence Number=SeqID_165524
atgtcgtaccggatgtcacgacatcacgcttcagaacatgcagattatatttgggagtatgaacagattaaacaagtaaataacacaagagaattgttaacccagttcggtgcaacctcacctacatctgggggctaccaagccagggaggaaatccaccaaaatagtgttagttcaagtattttcgggcaagatgtcctggacatcgtatccgacatcgtggatcctgcagcttcaatgcttttagcaacttcagtattttcgggcaggatgtcctggacattgtatccgacatcgtggatcctgcagcttcaattcttcatttga

SEQ ID NO: 48747 - DNA, 453 bp, Glycine max
  Peptide Sequence Number=SeqID_165525
atgacgaatgagaaagttgagaacataggtaaaggaaaatacggcgtcatttataagggtcgcgatcgtgtctccaatgagaccatcgcgttgaagaagattcaaaggggttgttatcctaacgcaaatgtttcagattcgtcttctggggatgcggctatggtggaaaaacatggttataccttaaattggagccttgaagatgcacagttgtacaaaagaattctcatggatagggttgccatgggcgtgtgcatgattttatatttgttctggcataagaagacaagcatgttgttgcctacttggaagacctttatgaggattccagaggcaataagatggttgtggtgtgctggtttcacaaaattgatgaggttgagttggagagtctcatacttcatttccctcacatttgaatacaaacacttcatggaggaattccttagttag

SEQ ID NO: 48748 - DNA, 201 bp, Glycine max
  Peptide Sequence Number=SeqID_165526
atggacgacgtggctctttcctgttctaatgttaggatttggggaagaagtagtaagatgtgggatgtccgcatttttcggatccgtgttttggggagagatgttttggactgtgctgacatcagcaagattgctattgtcactaacgtgggcaagggcggaaaaagatttggtatggtagattttccttcgtcaccctga

SEQ ID NO: 48749 - DNA, 456 bp, Glycine max
  Peptide Sequence Number=SeqID_165527
atgtcttggataccacttttccgaaaaatcctcctacttctcataaagtctctaagcaccgccgccctacctactcggaaccctcatctactcttcgagacaagagcatctagagcaatggctagtgacggaagatcatttttccctctcttgggactaagtgaagacattggtgaaagagaagagataggcatagcagttgacttaaagaagttgctagtcgatctctctctcttgcctagccggggatcttctaggatgccgattgggacagggaaatggaaagcgagaccggatacgttgaatcccttctgcttagttctatttaaactactccttgcccctgccctttcgattgcggatgcgagaacaaacatcagtctcacagccccttctcgagcagtaagagctccctccgccgtccgattctatgcctacccgctcttcaaggattaa

SEQ ID NO: 48750 - DNA, 648 bp, Glycine max
  Peptide Sequence Number=SeqID_165528
atggaaagaaagattgagttcaggcttaggaacgaaagcgagaggtttgaactttatcgcttgagagatagggataggcgcgatagcagcaagactgaaaggagagcggacctaccaatcatcctctcccctttccctaaggggaagtgtaggcatcagagaggccccgtgcagtgcttgcctttctacctctccccgcctcattctttagggctatcagtcaaagtaggaaagaaagcccttacccttaatagcaatagctcgagtggaaagcagatcacagtcacaagcgaaagcttcggcttgaactctgaaagcgagcctaagcgagaactaaaggaaagggcttcttcttatcccctgaagtcacttcactccctgattctttctaggcgagaaggttggcacaaaagctgcgaattctcttgctgcgtttacgcttattccgacaacagattcatcggtcactggatgcgtgctaacagaaaagaagaaagtcataagggaaaaactatcccacaccggaggaacggaaacacccctttaacaagcaagctcaagctacgcacctttgagtttcccggggataagcagattggtgtggaactagatcctctgcacttactactcgtcatcatgggtccataa

SEQ ID NO: 48751 - DNA, 552 bp, Glycine max
  Peptide Sequence Number=SeqID_165529
atgactaccttgacccagacatggatgacgttgttgctcagcaacatcctacccagcgatcataattccgacctccctctaccgaagtgtatgccacctatcaggcaccctctagacccagataagtctaacagggccctgggttttccggcattgatcacgagtctctgccagtcgttcagggttcctatcacacctagtaaggccccagacgcaccgccgccacctcctcaggctgacccagttgggtcatttgacacggagcgatatttacggcatttggttcgccagcaggcggccaaccacagggcgcacgtgcagacccatgactgcctctaccagctcagccttagcctgcagagccagggtttccctccttttccatgccctactccagatcagttcagggcagaggtcgcatggcccggggattggcctgaggcccaggcaagggaggcacccgcagaggctcccggcgatgcagataaggcccgcatggacgaggagattaccgatttgctcgatttcttgggagggagcggagccacatga

SEQ ID NO: 48752 - DNA, 372 bp, Glycine max
  Peptide Sequence Number=SeqID_165530
atgcaagccttaactagccatgttgaaaaattatttgataaaagcttgaagaaatccatgtacatatggatcaaatggagagtcaaagttaatagacaagttactccaaggagagatgatcatgaaagaggttggagccaatatcaagaagatgattatgaagaagaacaacaaatgaggacaatacctaatcagagtaatcaaaggagctactcaaaaggtaaaaaggtgaaactagcagctcttgaaattactaattatgctcttgtttggtgggatcaaatgaagaaagagacattgagaatgttttgtaataacttgggaagagatgaaaacaattatgaggagacaattacaatattggagaagtga

SEQ ID NO: 48753 - DNA, 213 bp, Glycine max
  Peptide Sequence Number=SeqID_165531
atgttgttaataatcccatctacatctttagttcctattcctaacatatacgtctttatacgcacttccatgagatgttattgctctaaaggttatcttcaagagacggtaatggctcatggtttcataaagggcacaaaggtgtttacaatggtgatgcatggtggttccttggttgcgagtggggctggtttcagtcaacaatggtggtga

SEQ ID NO: 48754 - DNA, 249 bp, Glycine max
  Peptide Sequence Number=SeqID_165532
atgtcgttgcgcggggatgcgattagccaagctggggcaaacaaagccgtccggccccctaccggattgggaatgcgaaggcctttccttcgaaaggagaccggggaaataaagagctatgctattgaccgaccctttcgtagtgacttcgaatcaatagtcctatacttttttctcattttggctgctcgccctaccgaagtactaaaggctttcgaggcttacacctccctattacacgacaaaaag

SEQ ID NO: 48755 - DNA, 195 bp, Glycine max
  Peptide Sequence Number=SeqID_165533
atgaagagggagatgcttgactcgactggaaatgacgggtcgacaactccgaatcacaagctatttactactgtattgtattacacggtaacggggccacacgatatgaatggctgcttaaggaagaggcccaaagcaagcaaaggaaggcttctttcttcccaagacactgactatcgtgacccaaacttttaa

SEQ ID NO: 48756 - DNA, 351 bp, Glycine max
  Peptide Sequence Number=SeqID_165534
atggctggaaacaatccttatggtttggtaggaataatcagaatcaaagtccagagcacttgttgggttaaagatttttttgttgctaaatgttacggcctaaatgctgaactattgaccctacttgttcggatgggtgttcaccccaaagtgttcccggaccgcatgcatacatacagattgtcctcggctcgggctgaggagtgtccacatgagttcgttgaggtgtctacacagcccgagcaaaaaaccgattccggggaggaatcgaagattggccattggatccgacttcgatcggagaaagcctctggaattggaacagatgtggttcgcccggttgcttactga

SEQ ID NO: 48757 - DNA, 555 bp, Glycine max
  Peptide Sequence Number=SeqID_165535
atgtcgatggaagctcacttcaaaaaattgcttgcatatgaacatgagttgattcaacaatctcatgcaaaagatattgaaaagaaaaggaaagcgattgcactcaaagctagtttctcaaaggaagaccacaaaaaagactctagtgatgatgaagatgtagagaatttgaatttgattgttaagaagtttggaaaattcctcaaaagaaagtggaaaccaacaacaccttcatatgctttgaatgtaagggcacatcaagccgaattgtctgtttacctcaaaaaacatattgttgtaaagaaagggaagaaggatggaaaaccaaaaaagtcctatatagcttgggaaaacaatgcatcaatatcctccaactcttctagtgaagaagaaattgcaaatgtgtgcttaatggatgattcaacagatgactcctcaaccattgaagaaattgaggtagattctgaatttgaggaagttaaggaagcctttaatgaaatgaatgaggaagcacaaaagcctattgttttaacaataagcttagaagctatctaa

SEQ ID NO: 48758 - DNA, 378 bp, Glycine max
  Peptide Sequence Number=SeqID_165536
atggtcatatcaagacttagcgctaatcccataatggatccttcactaaagtctataaaaggaagcctttactcggaatgggaagaatcaaaagaattctcagactgtgtcgttttgaattctttgacaagggagaagggagacacaaaagaattcatgcggttagtccttccttcttttggaaaagggagaagagaggcacaaaaagaattcaggcgattagtccttggtgaattctttttggcaaagggagaagagaatgaaaaggatgaatggcacaagttttcaaggtttagaaaaccagaaaacttcagaaaacttttggtacaaagaagaagaagaagttcaaagagactgaaggcttgtaaaggattgtag

SEQ ID NO: 48759 - DNA, 306 bp, Glycine max
  Peptide Sequence Number=SeqID_165537
atgaataatcaagttcaccaagatgacaagaaaaaggcaaaatatgtttggcagctacatgagaaggtgaagcaagaaattgagaagagaactcagcaatatgccaaacaaaagatcaatgataatgcttataaacttgatcttccaagtgagtatcaagtaagcgctacttttaatgtgactggtatatctttgtttggtgtaaatcatgagtttgattcgaggaagaatcatttcgaaaaggaagagaaagatggaaagcatgataggtctaataatctcaaagaaccttggcaaggaatataa

SEQ ID NO: 48760 - DNA, 156 bp, Glycine max
  Peptide Sequence Number=SeqID_165538
atgggttgtctcttggagaatcttgaacacaaggatgagtatcccaagaaaaaccccgggaacaatgggatgaagaagaaaggaaaatggcaatggcaaccaaaagtaacaacaattgcagaatcaagagatctcactattgagtatgagatatga

SEQ ID NO: 48761 - DNA, 1038 bp, Glycine max
  Peptide Sequence Number=SeqID_165539
atggctgcttcagaggagaatagtgcactgttcccaatattcattttgacgataatggccattcctattgtgccatatacaataacaaagttgtgccgtgctgccagtaagaaatcaaagagcattcactgtcattgctctgagtgctcgcggtccgggaagtaccataaatcgatattcaagaggatttcgaatgtctcaacctgtagtaactttacattgttactactttgggtggttatgattgttctggtttattacataaagaccatgagtcgtgagattgaaattttcgatccatttaatattctaggattagagcctggagcggctgagtctgaaataaagaaaaagtataggagactttctattcaataccatccagataaaaatccggatccagaggcacacaagtacttcgttgagtacattgccaaagcttatcaagctcttacagatccaatagctcgtgaaaattatgaaaaatatggccatcctgatggcaggcagggattccaaatgggtatagctcttcctcagttcctgctaaatattgatggggcatctggtggaatacttctgctttggattgttggtgtgtgtattctcttgccattggtcattgctgttgtttatctctccagatcatcaaagtataccggaaactatgtgatgcatcaaacactttctacttactattaccttatgaagccttctttggcccccagcaaagtcatggatgtcttcatcaaggctgctgaatatatggaaattccagttcgtaggactgatgatgaacctcttcagaagctttttatgttggtaaggagtgagttgaatcttgacctcaaaaacatcaagcaggagcaggctaaattttggaagcaacatcctgcactggttaagacagagctgttagttcaagctcagttgactcgtgaacttgcagccttgtctccatctttacaaagtgatttcagacgaattttagaaacagcaccccgcctacttgaagaattaattaaggtgactaactga

SEQ ID NO: 48762 - DNA, 978 bp, Glycine max
  Peptide Sequence Number=SeqID_165540
atggctatggattttaacaaccaggagatggcagagggtgacgagtttgtcgagcccccaagtgtggacgagtgttgtccgatgttgggtgtggtaacctcaacgagtgtgagtgaattgcaagtcgatgtggcttgtcaagccccgagcctggacaagtattggctgcctacttttgtcaagttgttcatgatggacatgtctttggtgtgtcagagtgcattgacgacagggcgtaacatctgcttgttgttgcaaccgtgtgcggcgcacacacagtactcttgcatacgtgtcattcgtagagtgggcacgtattggagtagtggtcttgcgtgggtgggggagcgtcgtggtgtgaaatggagtggacgtacttcatcttacaaaatgtcttcctttttgtctgattctaccatcgaggatacttctcgaggtgcctccgacagtgagctctcctcttcggagagggaaggcacgaccttccactactgtcggggagcttatcccggttactgtgatactccccccttatgcttctggggtgtgaggagaggtagtggcagtggagatgttagggcatctccctgtgtgcgatgtagccgaagtgttgggtcgctgtcgtctaccccttccgtcactggctatgagtgggtgagggatgacgttttgaagtacaagttctctttcacctcggcggtgagtgtcgctatgcttcaacgccaggtgaaactggcaaatcttgaggactcctacaatttggtcattcaggcttgtgagagtgatgtcttcttgttcttgagggcgacacctagtcacatggtcttagctactggtgttgtggctgatggtatgccactgatgttcaacagggacaaggagccttgcttcctattctattggcagtcagaccctaccagtgatcccttcactgccttggatggtaaagtgcctaaccttgtgctcgtttatgtctga

SEQ ID NO: 48763 - DNA, 1296 bp, Glycine max
  Peptide Sequence Number=SeqID_165541
atgggaggtattggcaagacaatccttgcggaaaaagtattcattaaactacggtctgaatatgatgattgtttatttttagctaatgaaagagaacaatcaaggaaacatgggataatttctttgaaggaaaaagttttttcagaactactaggaaatgttgttaaaattgacacaccaaattcgttgcccaatgatattgttagaattggtcgaatgaaagttcttattgttcttgatgatgtgaatgattcaaatcacctagaaaaattactgagaactcttgataattttggatcagatagtagaatcattgtaacaactagagataagcaaattcttgaagctaacaaagctgatgagatatacctacttagagaattcagtttcaatcaagcacttgaacttttcaatttgaatgcctttaaccaatgtcatgatcaaagggagtatgacaacctatcaaaagcgatgtctagcaaaaatggaagccacggtcggttgtgggatcctgatgacattcatgaagaaatgaaaaatgacaaggttcaccgtcttcaacattctgttgtcagtcctcttattcctccaaagaatcttacacaagaatatgcagacatggataaagaaaatccagcttatgcagcatgggaatatcaagaccagtcattacttgtttggcttcagtcgtccttatctgaggcaattttgtcaaaagttgttggttgtgttcatgcacatcaagtatgggaaaatatagataatcactttcatgctaagacaaaagaaaaatccagataccttcacatggaacttaggaataccagaaaaggtgaacactccataggtgaatttctcactcgtataaagacaattgttgattctttactagctattggacaaactatttctattcaggaacaaatagatgttattcttgaaggaggaggtgacaggtctggctatgggtatagaggagacaaaaattatggtaacaatgataatagaaactatggaaataatgagaacaagaattttgaaaatggtgaccacaagaattatggaaatgctggaaattatggaaatactgataggtataaaatacaatgtcaagtctgctacaagtttggccacaatgcaattgattgctatcacaagtttaatccaaattatgtagctcatcagtataatcaagaccagtcttggaatcagcacaaaaactactcttatcaaaggtctaattctaaagaccaggacaataactctcagtcacaacaaaatgcacaagctccttag

SEQ ID NO: 48764 - DNA, 1203 bp, Glycine max
  Peptide Sequence Number=SeqID_165542
atgtccccgtcctccgaacaccacggcggaaaccatcgctttcccggggaagaaatcaacggcttcggcaatggccaagcggaaatgtccgctccttccacggcctcctcgtcggcggtgcgctgcatcgtcgactcaattccgtcgaaggagcgggagaagctccggagaatcctcgtcgcctcggcgaagggtttctcaatcggagccggcctcaagggaggcctcgctctcttcgcgatcttggcgcgattgacgcgcaaaaagccgccaaggaagggaattgtggtttcgaacggcgaagcgattgtggcggctctgaaggaaacgctgagatacggtttgtttctcggaaccttcgccggaacgttcgtgtccaccgacgaggttatcggtgctctcgcagttttatggactagaaatggtggtggtgattgggattttgtgttgtggttgttcaggacagcaaagtggagggctctggttgccggggcggttgcagggttgtccatgcttctaacggggttagaagatcagcatacgagtttggccatttacattctcatgcgtgcagctgttttggcgtctcgttgtgggattaagagcaaacgatttgggaaaatctgcaagcctctcacgtggaagcatggtgacattttcctcatgtcttgtgattttataaacatagctttatctgatttgatggcctcatacagtttaaggttgttggatgatgtggatcctggttgttttgttcagttcatggataaagcatgcctgccttacacaatattagccaagggtctttttggcactgcaagatcaagcttgtttctgtctgtgtattgtgcttctgcctggattttgaaaagatgtaacattccaatggtggccatgggaacgttcccaactggccttgcattggccattgagaagaaaagcaggcgaatagaaatatcattatactgccttgcccgggctatcgagagtttcttcacatgcatagcggatgcaggatatctgccacaatcaagaaggatcaagagagctgatgttgtggttttcagcttgtcaacagccatcataatgcattgttatgcagaggagagggaagtgtttagatccaaatacttaaatgtccttgattgggtatttggtgtacctcctcctccttgtgaaaccccacgatgcaaagatgggtag

SEQ ID NO: 48765 - DNA, 309 bp, Glycine max
  Peptide Sequence Number=SeqID_165543
atgagatgttcgaagaaccaccatttcctagttaaccatgcattaggaaaatgcaaggatcatgcatgcaaactgtggaaacataatgcgtgcagttggtggaacaaaagcatgctaaatgaaggaatgatgtgtccattaagatgccatgaagagatgcatgatgcaatcaaggaacaagccaggagatatcatcctcttaggcaatacactgtggcgatagggactatcagcgataatgcatcactaaaagtggaaaactctagacgaggcttcactgttatcaagcaagtcggagacccagcatga

SEQ ID NO: 48766 - DNA, 1296 bp, Glycine max
  Peptide Sequence Number=SeqID_165544
atggggttgaaccaagcacatgtttttaaggaaaggttcatcaagtcaaggtcaagtatggaagtaaccaacttgcaaaagttggggcagaagatggatccagttacatcgcttctttgtctataccaacacatgattgagataaatgatttacaaaaaaatcaaggactcgtgacgtccatgaaagaatgcactttacggtgcccttaccaaacacgtgccagagctagagtaatgagtgaagtagaggaggtgcaagaccagatgaaggctgacatggaagccatgaaagaccaaatggcagccatgaaagaccaaatggccgccatgatggaggtcgtgttgagcatgaagaaaatcatggagggcaatgcggctgtggtcaccactacgagtgtcgccattgaggtagacccgactcacctatcgggcctcaatcaagtaaatcatcctgcctcggatatggtaggtcaaggaggcaaactgttaagaagtatgggcggcccccattttgtgcaggttcaaaacaagcattccttcccacaatacggcttgcctcccaactatacgccactcaatgtggcacacactcccaatgaggatgacaacaactctgcatctatgcccattgagagccaacaccctcaatatgatcatgcgcatgtctctcaacccataggggagacacatgaagcatctcgagaccacaatctagtcgactccgagccttgcctcgaatatttcactgaggggcaggcattttgtggcgtacccttaccaaaaagtttggagggccctcagtacctcccacaaccacaacccttgccttttgtaatgggaatagtccctcttgccatggtggaaagggaaaaattcaatcatatagaggaaaggctgagggccattgaaggaggcggaggtcatgcttttgctgacatggcagagttgtgccttgtacccgatgtcatcatccctccgaagtttaaggtgctagatttcgataagtacaaagggactacttgccccaagaatcacctgaagatctacaacaagaaaatggggtcatactcgaaaaatgaaaaattgttgatgcatttcttccaggaaaatcttactggggcaaccgtcacctggtatgctaatctagaaccttcccgagtccattcttggaaggacctaatggtttccttcattaggcagtatcagtacaattctgatatggcttcgaatagaatgcaactacataacttgtgcaagaagaagcatgagtcgttcaaagaatacgcccaaaggtag

SEQ ID NO: 48767 - DNA, 139 bp, Glycine max
  Peptide Sequence Number=SeqID_165545
cattgagaagctccagctaaacaatgctgacttgggtgatgagggtgcaaaagcaattgctgaaatgttgaaggaaaattcaagtttgcgggtccttacagaacatctcaaattctgtagcatacctaagaaaaattga

SEQ ID NO: 48768 - DNA, 531 bp, Glycine max
  Peptide Sequence Number=SeqID_165546
atggctccaactaaagaagaagaatcaaagctgaaggagtttcaagatgaatcgcccttcaagcttggcctggctgagaaatttcttaaagtcgtgcttgatataccttttgcttttaagagagtggatgctatgctctacattgcaaaatttgattctgaattagaataccttaagaagtcctttgaaactctggagattgacctttcagtatcaaaggagctaaatgttggtaatattttcagcttatttggaaccatacaagaggacttccttttttcttatatttactgtgttttaaatggcaatcttcttgataagaaaagaattgaggaggataatccagataatcacattcacgcctcagatcgaatgaagctgatgcatcatgtcggctttgtagacactgaagatatgaatctcacatctggaaaaaggaaattttctagtatggtaggatactcaagcagcaagttagcagaggcgagaaaagatgttgaaagcgttggttactacatcgatgctggctag

SEQ ID NO: 48769 - DNA, 318 bp, Glycine max
  Peptide Sequence Number=SeqID_165547
atgggaagagtccctcctgctatggtggaatggggaaaatttgatcatatagaggataggctaagggtcattgaaggaggtggagattatgcttttactgacatgacagaactgtgcctagtgcccgacgttgttatccctccgaatttcaaggtgtcagatttcgataagtacaagggaactaatctggaaccttcccgagtccattcttggaagtacctaatggtttccttcattagctacagaacttgtgcaagaaggagcatgagtcattcaaagaatacgcccaaaggtggaggcatctggcagcttaagtag

SEQ ID NO: 48770 - DNA, 291 bp, Glycine max
  Peptide Sequence Number=SeqID_165548
atgaagcctttacaaggaaccactcagatgttgatacgtggcattgacatgtggcagtcaatgtttgaggttttagatgttgctgtctctcttgcgaaagttgcggatgtggacagaaatctaggggatgaaaagttagctacagatggatttcaagaagccatagatttactggaatcactcacgttgaaatctgaagctagtgggctcgagcagcggcggcaatccgtcatagatttccttagaagccaacttccagataaacaagaacaagctgaggcaacagtctga

SEQ ID NO: 48771 - DNA, 258 bp, Glycine max
  Peptide Sequence Number=SeqID_165549
atggcttgttggcatccaaaggtgatccaagtgcttcatggatattttttaggaatggtgagagatcgtatacctctcctaagagcaattggctacttagagtggtcatcagttggaactattgcatggatagctgaaggtgatggacatgaagcagatgactctccatatgacataggactagataactctctcagtgtctctcatgctggtgagtggtgtgaggtcatgaagaaggactggaagggctggttgtag

SEQ ID NO: 48772 - DNA, 510 bp, Glycine max
  Peptide Sequence Number=SeqID_165550
atggagaattggaggggtgctcggttgatggtggtggcgagtgtggtggcaatagggtggctttcgttggtggtcatgggaagtccggtgcttcacaaggtgggagggtccaaaggttggatcaatcacgatgtgaactacactgaatgggctgctcaagagcatgtctatgttggggattggctcatcttcaagttcgacagacgatacttcaacgttctggaggtgaacaagacaagctacgagaactgcatagacagggacttcataaaaaacatcactcgaggtggtcgtgacgtggtgcaaatgacggaggcaaggacctactactacctctccgatggaggttactgttttcatggtatgaaagtggctgtgcaagttcaagagtaccaagatcccgcactcgcaatggtggcaccagctccttcccccgtcgtgtctggttcttctgtgttcacatgcatttggatcattgttgctaatgttgtgctttttgtgaatttgatg

SEQ ID NO: 48773 - DNA, 823 bp, Glycine max
  Peptide Sequence Number=SeqID_165551
atgaaattcaaggccttcgtgaccgacaacggcgtgcagctcctggagaggcggttcctcccggccctggagagaacgggaaaatcgtgccacctcttcctcacgcgcgaccacgccatgttcctccacctcctcaacggcgacggcgtccagtgcctcgcgcagttccgcaaggaggcgctcttccacgactaccgcatatccagccagaacgacgaccgcatcgccttcgctctcgacctctccctcctcctccgcgccctccgcagcgccgtcgccgtcgcctcctccgcctccgcttcctccgcccccacgcgcctcgagatcaagctcgtcaagaaacttccccctaattccacccagcccatgccctacctcacattggaaactcgcgggtataagtctgcggttattcaggatattcccatctccaaacccttgtcgcgggcgcaggttaccgagcttcagagcgcgctcgatacggcgcaagatctccctcaaacactcgttcaggtgggcgatgttgtgaatgtgttcataagtaagcatggggatttgagcgtgcaggtttcaaccacgctgattagtttgggtgctgagtttcggagactggtggtgattggagagaaaactaatgctcctgctgaagatcaaaatctcagtgctcagacaagatcatcgaggtccatttcgagaggagatgggcaatatgtgcagggtagttgcctgacggtgatatttcagttctttgtcccaggttctcgccagactgataaatcaatcagcttgcattgcaggcttcctgttcttgaccctggttctg

SEQ ID NO: 48774 - DNA, 216 bp, Glycine max
  Peptide Sequence Number=SeqID_165552
atggcgatatctacgcttagcgcgtgtcttgggcaagcgtgccttcactttccagcattatccttcactttccagaattatcctaacgttaagcgtgcattgttcgttgagcctgtgtatcacgctaagcgtctgagacgcgctaagcgagcagcttcacatcttgaatttgcttcttgggctttactttgtttttctccgccaattattcactaa

SEQ ID NO: 48775 - DNA, 132 bp, Glycine max
  Peptide Sequence Number=SeqID_165553
atggagtattgtagtgccgatagtgttgacaaatctgatgaactactcaatcttgcttttggagtactaacacctgagtttctgaactccttgaaaacatcagggatacctaatcacaagctaagaatcaag

SEQ ID NO: 48776 - DNA, 1293 bp, Glycine max
  Peptide Sequence Number=SeqID_165554
atgcctctaccaccaacttgcccaatggaattttctaccatgcctgaacattttgtggaagatgccatggaacttttaatatttgcttcccggattccaaaggccttagatggagttgtgctggatgaatttatgaacttcataattatgttcatggccagccctgaatttatcaaaaacccatacctgagagcaaagatggttgaagtcttgaactgctggatgccccgtaggagcggctcaactgctacagccaccctatttgaaggtcaccaactctctcttgagtatcttgtgaggaatcttctgaaactttatgttgacattgagttcactggttctcacacacagttctatgataagtttaacatccgccataatattgctgaactcctcgaatacttgtggcaagtccctagtcatcgtaatgcttggagacagattgctaaggaggaggaaaagggtgtctatctgaatttcttaaactttttgattaatgatagtatttatcttcttgatgaaagtctgaacaaaattcttgagctaaaagaattggaggctgagatgtcaaatacagttgagtgggagagacgaccagttcaagagaggcaggagaggacccggttattccattctcaagaaaatattattcggatagatatgaagttggcaaatgaagatgtcagcatgcttgcatttacttcagagcagattactgctccattcctacttcctgagatggttgaaagagtggctagcatgctcaattactttctgctgcaattggtgggtcctcaaagaaaatcgcttagtctgaaggatcctgagaagtatgaatttcgtccaaagcatttgctaaaacagttgtttagtgctggggctgatgttcttcacagaattggcgaggatgggagaattatacaggaatttattcaacttggcgcaaaagctaaagttgctgcttcagaggccatggatactgaagccactctaggggagataccagatgaattccttgatccaattcaatacacattgatgaaggatccagttatcttgccttcttcaaggatcacggttgatcgtcctgtcattcagaggcatcttcttagtgatagtactgatccattcaaccgttctcatcttaccgcggatatgttgattcccgacgatgagctaaaagcaagaattgaggagtttgtcaggtctcaggaaatgaagaaacacttaagcctacagagcaccaaggccacaattcagactacaaatggggaaacaatgttgattgattag

SEQ ID NO: 48777 - DNA, 306 bp, Glycine max
  Peptide Sequence Number=SeqID_165555
atggcggttcgcggtaagtgtaggcacaacatcgatgatgaaaaccagtgtgcgacgatcttgcttgatgggtgcatgacgattcttgaacatcttgagaacgaaagggtgcgaatggtaggagaccctcctttgatctcaagcgcattgatagatgccaattttgtggttgaacgaaaccaattctatcacttgagaatggacaccgatgatgacatcaacaatggaaaggaagtcgtagttcaaagggaagaagaggaagacacaatcattggggtatgcaggaacaatgttaacagggtgtaa

SEQ ID NO: 48778 - DNA, 801 bp, Glycine max
  Peptide Sequence Number=SeqID_165556
atgtggaactttgcatcgaattgcattgctggaactgtgggactgaaaaatgattcaaagcctactcattctgcttcggaatgttctgatgatgaaaactctgttataggcagagaggaagggctggaatgcccaatatgctgggaatctttcaatattgttgaaaatgtgccctatgttttatggtgtggccacaccctttgtaaaaattgtatcctcggactgcagtgggctgttgtgaaatttccaacactgcctgttcaacttcccctttttatctcctgtccatggtgcaaccttctgtctttccgtttagtttaccggggaaaccttaaattccctcgcaaaaactactttcttctttggatggttgagagcatgaatggtgatagagggaaatcgcattcacctttctgtggtgataatcagcaacactcaattaaagataatttaaccatgggaagccaagtaagccatggaaaccttcggagggggctagttcgccatccagagacatcgagttccaaccaatatcatggtaatactggtaatcacctcaatacagaaagatttcatgtttatcttcggaagtcactgatcttctttgtccagttgacggctaagttcccattggtcattatattccttttaattgtcttatatgcaataccagcaagtgcagccattttggccctaaagtccgacaccctgtttaagaaatgcatgtctcacacatattgggcagacataaaggagtttggaaaaggtatagtggcacttgtatggatgacagtaacttaa

SEQ ID NO: 48779 - DNA, 1941 bp, Glycine max
  Peptide Sequence Number=SeqID_165557
atggtggtgacaaagcaaggtttgtttcatcaaaagatggtggcacccattgctgtttcttctccaaagtccacacttttgcagaaccccatctattttggtgacctaagttcaagttttgttggagggtccttgaagtgtctttgcttcaatctaaaaccgaggccacaaagaagagaattgaccaacttggttgtagcttcagccaccccaagtgttacaaacagcaatgctagtggcaggttttacttcaacttcactggttttcctttcccacttggtccttttctcaacaggcgctctattaggactgaggctgtgaagggttgtatatggctgttcgaacaagagcaggcattaggattcagcagtgtttccacaaacatcagaatgacagttatcaaactaaaatctgggggcttatggatccatgcacccatagctccaactgatgagtgtattcagcttattaaggaattgggggctccagttgaatatattgttctccctacttttgcttatgagcacaaagtatttgttggtccattttctagaaaatttccccgtgctcaagtatgggtagcaccaaggcaatggagttggccattgaacttaccattggaattcttcggcatttttcgtgctaaaaccttgaaagatgaaaatttatctgttccatgggctggtgaaatagagcaaaagattctaagctcgccagaagttggaattggaccttatgtggaggtagctttctaccacaaaccttcaaaaacactattggtgacagatgctgttatttttgtcccaagacagccacctgagtgtataagcaaagaatccttgttagcatctgcaaaaaatggtttggctgtaaaacttcttagtaaaggaaagaaggtacccgatgagcctgtagttgacgacaaaaggaaccggcaaaaaggatggaaaagaatggttctacagatactgtttcttggtccatcgaaccttttagaacctaatgcaagctttgatcagatgtcacaaaagttgattgtttcacctattgtgaagactctggtcttcagtaaagttcctgaaaaggttagagagtgggttgatagcattttgcgagattggagattcaagagaataatccctgctcactttgctgctccgataaatgcaagtaggtcagatttcagggctgcatttgcatttttggatgagtttttgggagaaagtaatgctgcatggccttcactttcccttctcttctcatcaatcatgggaaaagcagccagctattttcctccggatgacatgaggaccctatcatcccttgaccagtttttggtgtctgttggagctgtgaagaaaactgtttcaggcaggaaaaggttcttggaatctaaccaaaaaagacctaccttggatggagtggcattcaatcaagtgtctagggaggagaccttgtgcttaaaaacatcgtttattgagggtgaggtcagggatgctatctgggagtgtgacagctccaagagtcctgaccctgatggattcaacttcaaattcatcaaggcattttgggaggtgatgaaacatgatatcatgaggttccttcatgagttccatgccaactctaggctaactaaggggtgtaatccgtcttttgtaactctcatccctaagtttgatgatccagagcagttggaggactttagacctatatcactagtaggttgcatgtataagattctaacaaagatcttatcttggaggatcaaaccggttctagcaagggtgattgatgattgtcaatcggctttcttggagggaaggcaacttctacatagtgttttggtggttaatgagaccttagatgaagtcaaaagaattgtgaagcaatgcatactttttaaagttgactatgggaaggcttatgattcagtctcctag

SEQ ID NO: 48780 - DNA, 1815 bp, Glycine max
  Peptide Sequence Number=SeqID_165558
atggccaatgaaagtggtgaattaccagtgaccccagaagttactgagtcacctggggttgaaataagaggacattcagatggcaaggctagttctggaactagtgttgaaaaagttgttcccaattatctcagagcttccactggttcttgtcatgatttttgtaaatacgggaggaaacatgcatttgattcgaaagaaagatgttctatacctaatagagctacaagaaaacagcttcaccacagttcagaaggtagtgttggtgggacaatgatgtcatttgctaggctcagtgcatctgtggattctactaagccgacaaagatgtcaacggtcaaactcaaacaatcagttgattccaagacctggatttctgatacctctgaaacttacaagcgggaactgccaacaaaatcatttgacagccaaaaagaaacagggaatgaagttctggtgaataggaacaaatcatcattggccaaggtcaaaccatcactccttccaaagtcccatacatctccatcagcgagacaagaaatttcatcaattaaggaggtccgatccccatcaaattcaacttccataaaggtgggaactccatcaaaatcaacttccaggaaggtggaagctccaccaaaatcaaccgccaataaaatggaagctccattaaaatcaacttccaataaagtgggaaatccatcaaaatcaacctccaaggtcaaagcttcatcaaaacgaactaccaatatggtgaaaacctcatcacagttatcttctctcaaaggtaaagaaatgaagttgtctgaaaaacatgtaaattctttaaattcaagcagtgtcagaaggaagcaaatatcttctatgaattcctcggaaggtgttggtggccaaagatatagtaagatcaagacagaaaaggaggtgacctcctccaattccaaagcagcttcaaaaaaactgatggcaccttcaaaggctttattaacccccagaccttcccttattagagttgcaagtataaattcaagaaagcataagagcctgaaaattgcttctcatcttaagaatcagcggagtgcccgaaaggttgaacatgaggaacacaacaacaacgaggtagaggaaaagactttgtacgtcatcaagatgggaagtgaaaacaaaacttcgctatctgatcaaaatgcaagctatgatgatgaatcataccttcctcagttgtcatcaccaaagtcttcagtatcctcaatttctaaatccttatcccaagaagaccaagaggaatctgaatatacaactagtgaatttgagcaggattctttttcaggaaaccatgaaactgaatgcattgaaaatgaggagacattggctgctgagaagaaaggcaagcccaaaaagggtggggttgtatattccaaagacaatgacaaccaaatgataaaattaaagttcagaaggggaaaagtggttgaaaatcaaactgagataagtagtccaaggaggcttaaatttcggagagcaagagtgccgagggagaaagccaatgttaacagcaatgtccgtaaaagctttgaaagaaatgtagcctgtgataacagcaatgatgctacaactggtccagagaaggttgttttgaggcatcaagacatgcaggaaaaaaaagatgcacagggattattaaataatgtaattgaggaaacagcaagtaaactggttgaagctcgcaagagcaaggttaaagcattggttggtgcctttgaaaccgtgatctctcttcatgagaaaaaaccttctgcagacacagtcagttga

SEQ ID NO: 48781 - DNA, 429 bp, Glycine max
  Peptide Sequence Number=SeqID_165559
atgacggttgtctcaaaactatcatcattaagcatgcgcggtaccaatcccaaacttctctccgatgacatcatcgttgatcctattgacctcgattccgagcaaggtacggatcatccagggtgttttcgcttcagcgtgggttgcgacaacaccattttgagggaagtggtggaagaggtgaggatggtgtggaacgtggtgttgagagggtggagaggggttttcacgatgatggagcacgtggggaaggtggggtttgtgcccgacggcgaggggtggttttcgcaggagttgccaatgtcggggtgttgctctggtgcggtggtggtagatttgaaggtggggatgtgtgaagcggatggtgagaatgtgaatcagattagggtgaacgaagtgagtgtggggattttgagcattgtggattga

SEQ ID NO: 48782 - DNA, 183 bp, Glycine max
  Peptide Sequence Number=SeqID_165560
atgactgagaagcttcttagggcagagatgaaggttgctcgtcatagcctattgggacgagcggttctagaacaaggtagcaagacttgggctggaccaaaaaccatttcaattgttgggtgtactggttcaattggaactcagggtgttgcccttgctcctacgtatcctcaggtgcgatga

SEQ ID NO: 48783 - DNA, 552 bp, Glycine max
  Peptide Sequence Number=SeqID_165561
atgtcccctcaggatctaaaaaatgactggatcagattacacaatccagcaaccttatcctcagaaggttcaatcaaaattgccgtgtctttgaattttgctgtccaaaaataccagcaaaataagaaaataaaatacagagaaagattggaaagagaaatggcaaaaaatattctctcaacctcaaaccccatcctactacctagttcatcaccatcctcatcctcatcctcatttgtaaaaccaatacatgtttgctccaatccgataatcaaaagcacttcgaagagggaattaactctttgcaaagcaacaccacactctccaattgttgtgacaaagagaggcttgtccatcagcttcatcaccagctttgtgctttcattggctggtaagaagaatgcaaatgcagcaatactcgaggcagatgatgatgaagaactcttggagaaagtaaagcgtgacagaaagaagagacttgagaagcaaggtgtgatcagttcttccaaacaagaaacaggtttgagagtctgcaccctgaagaggctatag

SEQ ID NO: 48784 - DNA, 309 bp, Glycine max
  Peptide Sequence Number=SeqID_165562
atggtcactaacaatatcattcgatgtggtgatgacgatgcaaacaggaaaagaaaaagaccctacagcaaaaatcatatcaatgagggtgttgtatgtgaggatactgaatgcttgaagccaatagttgttcatattgctagggagaatcttgttttcctacaacaatggttcactaaattccctgagcactcaaaaataggcttcttcattacaagggagaattatggaggtcaccactatgctcaaaccaagagcaaattcaatctcaagggaatagcaatgagtagtagagaagggaaaatctga

SEQ ID NO: 48785 - DNA, 186 bp, Glycine max
  Peptide Sequence Number=SeqID_165563
atggggcaattcggtccacaaaaagcacagaacaacacacactcaaagcagcaaaaatgcagagagagagagaccgggttggaggaagaagacccaagaaatgtaagaaacagcaccaaggcttgcaagagaaaagtgttatatacttcaggacatgcattgagtagtaacaaccttggtgagtaa

SEQ ID NO: 48786 - DNA, 408 bp, Glycine max
  Peptide Sequence Number=SeqID_165564
atggagtaccgcaacaaacttgttctcgcccctatggttcgcgttggcactctcccatttagattactagctgctcaatatggtgcagatatcacttacagcgaggaaatcatttaccacaggatgctcaagtgcgaccaccaaatcaacgaactcattggatccactgattttgtggagaaggggacaaaaaatgttgtgtttagaacctgcgatgaagaaaaggatacggttgtatttcaaataggcacatcaaatgctctgagggccctagctactgctcagttagtgcaaacaaaggatcaagccgatgttttgatgatgccaaaagatcacatgcgtctcaaagctttattcaagacaaagcaattaaagatattcaagatagatgatcaagacagtctatag

SEQ ID NO: 48787 - DNA, 444 bp, Glycine max
  Peptide Sequence Number=SeqID_165565
atgaatgatactatcatttgggatgcttctgcgaatggtgcttattcaaccgaattagcctataagtggatcactgaagcctactttacccgtaacaacctcttagatgttgaatccttggtttggcaacttccgctccctgaaaatgttaaattgtgtcctagtcataatgattttcttgtccatagatttgtttcttttgaccattcttgtaacaagtgcggttctagtaatgaaactacctggattgtgtcaaagctagagcagtttggagtgcacttcaattctctttatccaatgatgatcccttggtggatgttccttcttgctccaagtagagcttgtaggccttggatcttcttcatcaatagagtcctttgcttcttgaagatcaatggcaacaaaatggagaaggatgagtcaagaacaagctcaccaccatag

SEQ ID NO: 48788 - DNA, 348 bp, Glycine max
  Peptide Sequence Number=SeqID_165566
atgacaataagcttgaaaattttaaagcaacatgttcaaggaagttcaacagcaatcacatggctcaagagttggagagacccccttacctctgtaaaaatcaagcttagagttgaaaatggaggtcacttacctaagcttgatggaaaaagggttcaagaacacttggtaaaacttggaagaagaagaaaaatatggtctcctttttctcctgaagctttagcaaaatgggataattggcctagactttggcttttaaaaacaacacttattcttggacagcccttgaggtgctctccacgagctcagccatgccttatatggcttcttgcacttttccaaaactaa

SEQ ID NO: 48789 - DNA, 444 bp, Glycine max
  Peptide Sequence Number=SeqID_165567
atgcattcaaaccaaaatcaattcatacaccaattttcacaaaaagataaaagtgtttcactgcaatatcatcaaaatcaagttaaactgttccatatgcttcagaacaagcataccaacaaatcacagaaaagatcaacagaatctgagcatcctcctcatctatcaaatggagaaactagggaatcagtgagagcaacaacttctccggatgaggaatcagaaagattagcagctcctccaactggggaatcaggggggtcagctgcttctccagctggtgaatcagggggggcagtagtttctccatatggggaatcagagatgataatcagaggtggagatgggggagctgcttcaagctcaggaaaagaagatggattcaccaccggagattgtggatcagctggcactagttcaacccgtgcaggggtgggatcatga

SEQ ID NO: 48790 - DNA, 834 bp, Glycine max
  Peptide Sequence Number=SeqID_165568
atgacttcctcacacaacaagcatcccttgcccactgccgttcacttctttaagataatcctcagaacaagtcttgcacatggaatacttaagctcccaaaagattttactacaaaatatggggatagcatgtcaaacctggtgtttctcaaccctccagatggcattgaatggaaaatatgttggaccaagcttgatggcaagatttggtttgaaaagggttggaaggagtatgccacatactattccctggatcatggccacttgctgttgtttcaatatcagggaacttctcattttgacgtgcacatattcgacaacagcgccattgaagtagactatccttcttcccctggtactcgtgatggaaaggaaagacatgtggagattagtgatgattctgttgaaattttggatgctcaattttcatgccagaagactagagtgaaatccacagtgccatctcctcaaccttctaaggaaatgaaattcggcccaactacaaatgttgaaagaagccccagggtaaacttgcatcagcatgtccaaactggaaaagaagagggtaaaggaatttttaacactgaatgcccaaaagtggagcagttaacttctaccactctaaagaaagccacaactttcaggcttgtcatgaagccatccttcattaatggagagtacctgctgatccagagctttgctttcaaggttcagagggaccaagtttccccatttcacaagcctatacaactcgaatgggaacgattccaaaacgaggtgaaagaggacattctgaaacgcaatttaggcacaaaaaataccgaaaaaggttaa

SEQ ID NO: 48791 - DNA, 2352 bp, Glycine max
  Peptide Sequence Number=SeqID_165569
atggcctcggcgacgtcgtttttgggcctcggtcttcgcccctccgtcccaatttgcgccaacagaaacaacggcattcgattctctcagtttcaagtctcctttggctttcgtgagaactccacttccctcaagactttgaattcaacaccgttgaagaaaagagaagctttctcaaatgggtcttcgagaacgcgaagaaacccgttgttctctgttcgctgcacagtttcatcaagtggaaagattacacaacaggaattcacggaaatggcatggcaagcaattatctcggcaccagaagtggctaaggagaacaagcatcagattgtggagactgagcacttgatgaaagcattgttggagcaaaagaatggacttgctcgccggatcttttctaaggttggggtagataatactcggcttctagaggccactgataagcacattcagcggcaacccaaggttgtaggggaatctgctggttcaatgctagggcgtgatttggaggcattgattcagagagccagggacttcaagaaagaatatggggactcatttgtgtcggttgagcactttgttcttggttttgcccaagataaacgatttgggaagatattgtttagagattttcaaatatctcagcaagctctaaaatctgccatagaatccataaggggacgccagtcagttattgaccaagatcctgaaggaaagtatgaagccttggaaaagtatgggaaagatttgacggcaatggctaaagcaggaaaacttgacccagtcataggaagagatgatgaaatacgcaggtgcattcagattctctccaggaggacaaagaacaatcctgttctaattggggagcctggtgttggaaagactgcaatctctgaaggacttgctcaaagaattgttcaaggagatgttcctcaagctttgatgaatcgaaggcttatatcccttgatatgggtgcacttattgctggagcaaagtaccggggagaatttgaggatagactgaaagctgttctgaaagaagtaacagaatctgatggtcagactatccttttcattgatgaaatccatacagttgttggggcaggtgcttcaaatggtgctatggatgctggtaatctcttaaaacctatgcttggtcggggggagctgcgatgtattggtgcaacaacattagatgagtatcgaaagtatattgagaaggaccctgcacttgagcgtcgtttccagcaagtttatgttgaccaaccttcagttgaggataccatttcaatactaaggggactgcgggaaagatatgagctgcatcatggagttcgcatttctgacagtgctcttgtggatgctgcaattctctcagatcgatacataagtgggaggtttttgcctgataaagctattgatctggttgatgaagcagctgctaaactaaaaatggaaattacttcaaaacccactgcacttgatgagattaatcggtcagtcttgaaactcgagatggagagactctctctgatgaatgatacagacaaggcttctaaagatagattaaatcgtcttgagaccgaactctctctcttaaaagagaaacaggacgaattgactggacagtgggagcatgaaaagtctgtaatgactaatctgcaatcgattaaagaggagatagacagggtaaatcttgagattcaacaggctgagcgagagtatgatcttaatcgcgctgctgaattgaagtatggtagtctaaactccttgcaacgccaacttgaaagtgcagagaaagaattgcatgaatatatgaactctggtaagtctatgttaagagaggaagttactggaaatgacattgctgatattgtaagcaagtggactggtatccccatttcaaaacttcaacaatcagatagagagaagttgttgtatctagaggaagagctccacaagcgtgttgtcggtcaagatcctgctgtcaaggcagtagctgaggctatccaacgttcaagagcaggtctttcagatccccatcgcccaatcgctagcttcatgtttatgggaccaacgggtgtaggaaagaccgagctagccaaggcccttgcttcatatttgttcaacacagaagaagcacttgtacgaattgatatgagtgagtacatggaaaagcatacggtttcaagattgattggggctccacctggatatgttgggtatgaagagggagggcaactaacagagacagttcgtcgccgaccatatgctgtcattttgtttgatgagattgagaaggcacactcagatgttttcaatgtattccttcaaatcttggatgatggaagg

SEQ ID NO: 48792 - DNA, 384 bp, Glycine max
  Peptide Sequence Number=SeqID_165570
atggcaatttcaggatacatgttaatcccagtgaaggctattgcttcttctattattacctgttgggttgcaaaggctcaagtcaataagatatggaaaataattgacaacgttaatggaagtgcaattgggaggttcaaaatggttttgtttgatagtcagttatttatgtgtcaacattttaactctatatggtgttcagaattcatgaacgaagagtatgaaaagtgctttgaaatagtcaacatcatgttgaagatcacaagaacatcaaaggagattttgaacactgttaatgccaaggaccatacttacggtgaagttagtaagtcgtttgcccatgaggtgaaaggacatgcttcgacgttattggcatttggttga

SEQ ID NO: 48793 - DNA, 336 bp, Glycine max
  Peptide Sequence Number=SeqID_165571
atgtctccgtatagggtggtttttggtaaggtatgccaccttctggtggagattgagcaccgtgcttattgggcagtgaagggttgcaacatggcatttgatgaagcaggtatggaaaggaaaattcaattccaagaacttaaggagatccgcttagaagcctatgggaactccaagatttacaaggagagagtgaagagatttcataattctatgattcataggaaggagttccatattgatcaaaaagtgttcttgtttaactctcgcctcaagcttatttatggtttcatgcttgatgtgaaccatggttgcaattgtggaagtgataggtag

SEQ ID NO: 48794 - DNA, 615 bp, Glycine max
  Peptide Sequence Number=SeqID_165572
atgcagaattatgttgaactatttcaacttttcccaaaccttgacaaggtggtttttctggatgatgatgttgtggttcaacgtgacttgtctccactctgggaaattgatatgaatggaaaagttaatggagctgtggaaacttgcagaggggacgatcagtgggtaatgtctaagcattttaggaactacttcaatttttcccatcctcttgttgcacaacatttggatcctgatgagtgtgcttgggcttatgggatgaatgtatttgatctgcgtgcatggagaacaacaaacataagagagacatatcatacctggctgaaagagaatctaaggtcaaacctgacgatgtggaagcttggaaccctaccccctgctttgattgcattcaaaggtcatgttcacccgattggcccctcttggcacatgcttggcttgggttatcagaacaaaactgacattgagagtgtgaggaaggctgctgttattcatttcaatggccagtcaaaaccgtggttgcaaattggctttgatcatcttaggccattttggaacaagtatgtcaattatacaaatgattttgttaggaactgtcacatcttggattcatag

SEQ ID NO: 48795 - DNA, 255 bp, Glycine max
  Peptide Sequence Number=SeqID_165573
atggcgtcaaggtttacctccatttcgaacattgtcgcaagtaggatacattggaagctgaaatgtaggataatgcgtctatgggtagtgactaacttcaacaatccgtccacagaaactagcttggagatgctattggttgatgaaaagggtgacatcatcggtcacgtcgttgagaaagacaacatcaaagaaacacgtaaaaattgcaaactaggcaaactcattgacatcatgcttcaggatcttgaataa

SEQ ID NO: 48796 - DNA, 537 bp, Glycine max
  Peptide Sequence Number=SeqID_165574
atgacccttctcgagaccactcaacactccccatcttcttcctctacagacccacactatgtgtctccatctctgaatcctcatcgtatgaagttggagttaccccgttttgatgggtcgggaccattggggtggatcttcaagatcacccaatttttcgattatcattccatgcctgatcatgaacgcttgcctattgcctcgttttatatggagggtcttgcactagcttggtatcaatggatgacccgtaaccaacaaatctcatcatggcctgacctcctgcaagctttggaagctcgatttgcatcgtcacattacgaagaccccactaggactttgttcaagctaacccagtgtggctccctcaatgactacttgttggacttcgagatgttagtcaaccgcattgtcggtctagcccctccttttttactgagttgcttcatctcgggtttgtcactagagatacgctgtgaagtccaggcattgcaacctcctaccttggttcaagcagtggccctagcttgtctctag

SEQ ID NO: 48797 - DNA, 600 bp, Glycine max
  Peptide Sequence Number=SeqID_165575
atgcaaaagcacgtaacaatttgtcacaggaaagaatcaacacaacagggcacaaatttcagcaatgcatgtcagaaagcatcatcatcatcatcatcactaatccagagttcaagtgcaggtaacaagagcagtgagtatgaagacaaagggcaacaaaaaagcaaggatgaggatggtgtggaagagggttcgataggaaatgtggcaagctgcgaccttgatcttcatcaagtcaataaacccattgttgctcgatatcgtgatgcttctcatgctaggcgagaagtgaagctgcatcgtcgtctatgctgccgcaccaccaccagatcgttgccccccacaacaaccctacaaccacctgaaaccatcttcatcacccatgtccccaccatcatcagatccgcgatgttccttcttcaaggagggtctcctccaacaccgcattggaggtttcagccaattgggttatccgatttcaccccaaaggattcaactttcttctcgcttctcaagttcctcttcaatggatcaacaacaacaacaacagtgagagagaaacagagacacacccaacagagagagagaaagaaagaatga

SEQ ID NO: 48798 - DNA, 1443 bp, Glycine max
  Peptide Sequence Number=SeqID_165576
atggtgaagatttgctgcattggtgctggatatgtggggggtccaacaatggcagtcattgctctgaagtgcccctccattgaagtggctgttgttgacatctccaaatcccggattgcagcatggaacagtgaccagcttcctatctatgagccaggccttgatggtgtggtgaagcaatgtcgtggcaagaaccttttcttcagcactgatgttgagaaacatgtctatgaggcagacatagtgtttgtctctgtcaacaccccgacaaaaactcgcggtcttggagccggtaaggccgcggatttaacgtactgggagagtgcagcacgcatgattgctgatgtatccaagagtgacaagattgtggtggagaaatccactgtccctgtgaaaactgctgaggccatagagaaaattttgactcacaatggcaagggaatcaagttccaaatcctttcaaaccctgaattccttgctgagggaactgcaatccaagatcttttcaatccggaccgtgtcctcattggaggcagggagaccccagaaggccaaaaagccattcaaacattgaaggatgtatatgctcattgggttcctgagggaagaatcctaaccacaaacctgtggtctgctgaactgtccaagcttgctgctaatgccttcttggcacagagaatttcatctgtgaatgctatgtcagcactttgtgaggccactggggcaaatgtcacacaagtgtcctatgctgttggcactgacacaaggattggaccaaagttcctgaattctagtgttggttttggtggctcctgcttccagaaggacatcttgaaccttgtctacatctgtgagtgtaatggcctgccagaggtggctgagtactggaaacaagtgatcaagatcaatgattatcagaagagccggttcgtgaaccgtgttgtttcgtcgatgttcaacacagttgcaaccaaaaagatagccattctggggtttgcattcaagaaggacactggggacacaagggagacaccagcaattgatgtgtgcaagggactactcggtgacaaggcacgcctaagcatatatgatccacaagtcactgaggaccaaattcagagggatttatggatgaacaagtttgattgggaccaccctattcacttgcagccaactagtcctacaactgagaagaaagttagtgtggtttgggatgcatacgaggcaacaaaggatgcagatggtgtctgcattctcactgagtgggatgagttcaagactcttgattatcagaaagtgtatgacaacatgagaaaaccagcatttgtttttgatggaaggaacattgtggatgtggagaagctacgtgatattggtttcattgtgtactcaattgggaagccactggatccatggctcaaggacatgccagctgtggcataa

SEQ ID NO: 48799 - DNA, 2205 bp, Glycine max
  Peptide Sequence Number=SeqID_165577
atggaaatacatgaagctacaacctctctcagctccttctcgccagatgcttcatctattgcctcaagtattaaataccatgcagagttcactccattgttttctccagagaattttgatcttcctcaggcttttcttgcaactgcacaaagtgttcgagatgctctcattataaactggaatgctacctatgattactatgagaagctgaatgttaagcaggcatattacctttcgatggaatttttgcagggtagagcactattaaatgcaataggaaatctagagttaactggtccccatgctgaggctttgagcaagctcgggcataaattagaaaatgtggcataccaggagccagatgctgcacttggaaatggtggtcttgggcgtcttgcttcatgtttcttggactctttggccaccttgaactatccagcttggggttatggattgagatataagtatggcttatttaaacagcgaataaccaaagatgggcaggaggaagttgctgatgattggcttgagatgggcaatccctgggagattattagaaatgatgtttcatatcctgtaaagttctatggcaaggttgtttcagggtcagatggtaaaaaacattggattggaggagaagatataaaagctgttgcacatgatgttcccataccaggatataaaactaagactacaatcaacttgagactttggtctacaaaagctgcatcggaagaatttgatttgtctgcttttaatgctggaaggcatactgaagcatctgaggctctagcaaatgctgaaaagatatgctatatactctaccctggggatgaatcaatagagggcaagatccttcgtctcaagcaacaatatactttatgttctgcttctcttcaagacatcattgctcgttttgagagaagatcagggacaaatgtgaattgggaagagtttcctgaaaaggttgcagtgcagatgaatgatacacacccaaccttgtgcatcccagaactgatgagaatcttaatagatgttaagggcttaagttggaaggatgcttggaatattacacaaaggactgtagcatatacaaaccatactgttcttccggaggcattagagaaatggagcttggatcttatgcaaaaactgcttccacgccatattgagattatagaaatgattgatgaggagctgattcggaccataattgcagaatatggcacagagaattcagacttgctggagaaaaaattgaaggaaatgagaatactagaaaatgttgaattgcctgcagaatttgcagatatagtggttaagtccaaagaggccattgatattcctagtgaggagctgcaaagttctgaacaagcagaagtagaagaaagaaaagatgatgaagtggaagcagttgctaaaaagaatggaacagatgaaagttccattgaggatgagaaagaagagttgcctgagccagtaccagaaccaccaaaattggttcgtatggcaaatctgtgtgttgtaggtggtcatgcagtgaatggggttgcagagatacatagtgaaattgtaaaagatgaagttttcaatgcgttttataagttgtggcctgagaagttccaaaacaaaacaaatggtgtgacaccaaggagatggatcaggttctgcaatccagatctgagtaaaataataaccgagtggataggcactgaggattgggtcctaaatactggaaaattggcggagctacggaagtttgtagacaatgaggatctacaagtgcagtggagggaagcaaagaggagtaacaaagttaaagtggcagcattcatcagagaaaaaacagggtattctgtcagtcctgatgcaatgtttgacatccaggtgaagagaatccatgaatataagcgacaattattgaacatatttggaattgtttaccgatacaagaagatgaaagaaatgagtgctgcagaaaggaaagcaaattttgttcctagagtttgtatatttgggggaaaagcatttgctacatatgtgcaagccaagagaattgtgaaatttattacagatgttggggcaacagtaaatcatgatcctgaaataggagatctacttaaggttgtttttgtccctgattacaatgtcagtgttgctgagatgcttattccagcaagtgaattgtcacaacatatcaggtag

SEQ ID NO: 48800 - DNA, 867 bp, Glycine max
  Peptide Sequence Number=SeqID_165578
atgacagcaccttatactttcagggatcaagttgatggtttattcaaaaacttaaggatgagctactcagcaacaagaaagccctatgttgtgttgactccatttccatttccatttccatttcaagatggacatggtgatgctgatgttgctcgagacataatctctctttgtgaaacaataagagaacacttgctcctccccttttgtgatcttcttgctagacttaaagattctgccactaagagtcttgttcccccagttacctgcttggtttctgattgtgccatgacttttactatacaagctgctgaagaactttcactccctattgttctaattcaaccggccagtgcatgttcgttattgtctgatgagagttgtgtggactggattccaggcttgaagaactttagactgaaggacctgcctgactttataaggacaacacagatcaaaataactatggtagaatgtttcattgaatcagcaaataatgtgcacagagcttctgctgttattattaatacttctgatgaacttgaaagtgatgtgttgaatgctcatacctctatggtcccctctctttaccctattggtcctttcccttcatttttaaatcaaagtccacagaagaaccacttggcatctctaggttccaatctttggaaggaagataccggcgtgccaatgttgtgttggcctttttatgttgatcaaccaacaaactgtggatctgtatgcaatgaatgggacattgggattgaaattgataccaatgaattgatggtgggagagaaaggaaagaaaatgaggcaaaaggttatggagttgaagaagagggcagaggaggacgttcatacatga

SEQ ID NO: 48801 - DNA, 285 bp, Glycine max
  Peptide Sequence Number=SeqID_165579
atgccttgtatgcttgacgaagtagtcttgttaagttgtgctagaaatattcatttatcatgttcacatgtggcagatcgtaacaatgatcctcaactagcagacttcattgagagcgagttcttgtatgagcaggttaaatcaattaaaaagattgcagagtatgtgactcaactgagattagttggaaagggtcatggtatgcaaatatcctcttcatctagccaaaaagtgtgtggcactttgatcaaaggcttcttcatgatgaagatctataatctttga

SEQ ID NO: 48802 - DNA, 287 bp, Glycine max
  Peptide Sequence Number=SeqID_165580
atggcactagcaagcaccaacaccgatcaatccacaaccaccactgcttcaaagaaaccctcaaaaaaatctgagaatctgaaccctaacgtgcctcatcatcgaagcccttcttcaaagtcccctgctttgcaatcttccaagtccagtaccagcaacccaattgcgcaatccacgcagaacaatatccggcagaagaagtttgtggtggcgaagaagaagaagaatcagaagggtactcaaaacgacgccttttcgtgcaagtgcaaacacaacggtggtgccaa

SEQ ID NO: 48803 - DNA, 300 bp, Glycine max
  Peptide Sequence Number=SeqID_165581
atggagaagtacgaggtagtgaatgaggagatagggattgggagagacgcggtcgtaagacttatgcgttgcaaagaaactaaggatctcgttgccgtcaaatacatcccacgggaagacaggattattgatgagaaggtggcaagggaaatcataaaccttagatctcttcgtcatccgaatattgttcggttcaaggaggtggctttgactccaacgcatcttgcaatagttatggagtatgcagcgggtggagagctgtataaccgagtttgcaacggaagaatacgtgaagacgag

SEQ ID NO: 48804 - DNA, 201 bp, Glycine max
  Peptide Sequence Number=SeqID_165582
atgattttgtcacttgaggacaagctagcaattggtgtctcgctaagcgaggcttgtgcgcttagcgagaatcatgcgctaagcgaggcactcaacccgcttagcgagttgggagaatctggaggagaatctgagaagcatctgcgcgctcagcgcatcatcaccatcgctcagcgagacatttgtctcttcctgcgctaa

SEQ ID NO: 48805 - DNA, 585 bp, Glycine max
  Peptide Sequence Number=SeqID_165583
atggtggttacggcataccaaacatcccatgagtgtccagaagaaacaattgtagacattcttgtggcaggattctctggtcaattaaaaggatggtgggataattatctcactaacgaagaaaagtcaaaaatctacagcgcgattaaaacggatccaaatgggaaagttattacaaatgacgataatgaagaaatctcttacgctgtcaatacccttatttttacaatagcccaacattttattggtgatccatcactttggaatgataggtcagcaaaattactatccaaccttaagtgtaggactttagtagactttaggtggtacagagacaccttcttgactaaagtttacaccagagaagatagccaacaacctttctggaaagagaaatttctagccggacttccaagatcattaggagataaggttagagataaaattcgtagtcaatctatcaacgaagatatttcatacgatatttgttgcaacctacccttcggcgggagggcgacgcaagggctcatgggtgcgtcttccaaggaaggaaggcgcgcggagtcgccaccaacgtttatttga

SEQ ID NO: 48806 - DNA, 360 bp, Glycine max
  Peptide Sequence Number=SeqID_165584
catgcacagggacagacagatattctcatagctaggttccctgaccctaactatggtgttaaaatgggttcttctcagtgtgggttttcaatggagaacaatgatggtttgtggtggctaatggtggatgcttcctctagaagcttcattaagaggcttctagcacactccagtcatcttctcaaagatcccaacggtaaaatcatggtaaagtgtcttgtgaagttgcaaacaaaatttcgagaagatccaacggttaatgaaggctgggcagcgtttttaccgaggcagcttcatgtagctttctctagaagcttcatcaagaggcttcctctagaagcttcctcgtggcttctttga

SEQ ID NO: 48807 - DNA, 331 bp, Glycine max
  Peptide Sequence Number=SeqID_165585
atggaatgtcccggaactcgttcgagtcgtatcctcgtaaaaatggaggttaaggaaccttggcaggggttatggctaccattgcattatgaagtggtgtttgggcattgggcatgtggtaagcaggcaggccttgtggctgatttggggatggcttttgtggatgattggacccactttgatcctttcatcggtgaagaccaaatccgcaaagggtataccaccaactacttgcccttcagtggcatatccgaggcaaggctcgaattttcaataagtgtgggagtagagctattgacatcctcagtgggagtgtatgctacattgggtg

SEQ ID NO: 48808 - DNA, 357 bp, Glycine max
  Peptide Sequence Number=SeqID_165586
atggcaggagctgataaaaatggagttaaaattgtgaaacatgtaaaaggggggttgaatccaagctccatccatcagttagacttcaacaacccctacattggagaagtggccaaaattggactagtggttgctgtcgttgcccttactgtgactattcttgcttctgtgattctctctgccctaccaggactcattgacctcagtgaagcttacaaaatttggaaggttgataagatagactttcttgcatgcgctggagcattctttggagtactatttgcatctgtggagattggtctacttgctgcggtaatcattgccacttccatatcttctcactcccttctgaaatga

SEQ ID NO: 48809 - DNA, 210 bp, Glycine max
  Peptide Sequence Number=SeqID_165587
atgtcagacgtcgtattgaagatcgcaacggttagatcgtggacatctgtcctattaacctccagaccaaattttaggaagatccaacgggtgttacaaaggccgcgcgctaagcgcgagatcagtgtgctaagcgtagcaattgtcttcagccaggctcagtgcacgactggcgctaagctcaacgtcgtgaattcagagcctatttaa

SEQ ID NO: 48810 - DNA, 101 bp, Glycine max
  Peptide Sequence Number=SeqID_165588
gaaattctcaagtacggttctaaggaaaggaattgactcacctattccgaccgaggagaacaggccattcgacagggagactcggaagttgcggagtcttg

SEQ ID NO: 48811 - DNA, 510 bp, Glycine max
  Peptide Sequence Number=SeqID_165589
atggaggacagtccagctagtcccgaaaatggcatctacaccccatctaagacatcgactttgtcgacacacccttacatcaaaagactcgaggtttcacccaacattgtccaccctcacgtcggtctgctcctcggctttgcaggcaagagagtcgagaccagaggctacatggacttgatgaccaccttcagtcaaggtaagctctccaagagcttcaccatcagatatctaccggttgacgcagacacatcatcctttgccttaatcagtagaaagacactcaacaagcttggggccatagtctccacaccccacttgacaatgaaattccctacactgacaagtgagattgtaactatcaagattgaccaaaagcaagcgcgacagtgctatgcaaagatcctgaaggtagcactatatcctcccatccgagagccgaccatgtctcacatcacagtgactaaagactctcaagtcatgacagtggacgaagggtctcaaaactga

SEQ ID NO: 48812 - DNA, 210 bp, Glycine max
  Peptide Sequence Number=SeqID_165590
atggatgaatgcgagaggattgtcgagaggccgcggggtatgttttaccgcggtcccatgatgggcgccaaatgttcttaccaaaatcaagaaccgtggcacatcgggatggacgtggttgagtggggtcccgaacttcacacgttggcttggagaggtgctttgacaggagggggacctacaaaacaaaggacttcgatgcccaagtaa

SEQ ID NO: 48813 - DNA, 288 bp, Glycine max
  Peptide Sequence Number=SeqID_165591
atgggtggtagtgactatgggggctcgattgagcagctcatcatggatcgggaggtcatcttgataggcagttccttgtctgaggatactcgtcgtggtgcctctgatagcgagtcctcttcttttgagagggtgagggtctcgcgtcgaacagatggggcatttctcaccctcaaggaggggagaggtagtgtcgatggagatgtgagggtgtctcttcgcgtgcgatgtagcttgagtgttaggtctttgtcatccacccagccagcaacggctattagtgggtga

SEQ ID NO: 48814 - DNA, 267 bp, Glycine max
  Peptide Sequence Number=SeqID_165592
atgggaagatctccatgttgtgatgaaattggcttgaagaaaggtccttggacacctgaagaagatcaaaagcttattgaccacattcaaaaatatggtcatgcaagctggagggctcttccaaaacttgcaggactcaacaggtgtggcaaaagttgtaggttaaggtggacgaactacttgaggcctgatattaaaagagggaaattttcccaagaagaagaacaaacaattctggatctccatgctgtccttggaaacaagtaa

SEQ ID NO: 48815 - DNA, 222 bp, Glycine max
  Peptide Sequence Number=SeqID_165593
atggagatgtctaatctcgcatcaaaactaagtttaaacaagttagaccttggtgatgacctattcacacacttggttttgatctcacttcttgtacacattaggcaattcaaagcgagttataacactcaaaaggaaaaatggtccctcaaagagcttatatctcaccgtgtgcaagaggaagaaaggttgtggagggataagaccgaaaatgatcactag

SEQ ID NO: 48816 - DNA, 213 bp, Glycine max
  Peptide Sequence Number=SeqID_165594
atggtgcagatcttatggtttttcggcgccgaagctaagaaaatagagagtgacacaacgaagaagtcaagccgccgtgagctccctcagcaccacgacgaagaagccgaggcgacgaagaaggaacgacagaatgagagagagagagagagagagagagagagggtacgctacccgataaaagagagagaaagtgagaaattaaaaatataa

SEQ ID NO: 48817 - DNA, 156 bp, Glycine max
  Peptide Sequence Number=SeqID_165595
atgagggatgagtattttcctccaaaggaagatgcaattttgcagaatgaaatgccaacaaacctttatatctttgttattggtgctacagacaatgaaaatagtcacaagaaggtttctttgataggtgctactcttcatcctttctcggcataa

SEQ ID NO: 48818 - DNA, 99 bp, Glycine max
  Peptide Sequence Number=SeqID_165596
atggatccaaggcccattaagataccccaccctttagacatccgaatagccaagaactactcccacgactacggagagtccaaagactcaagaagataa

SEQ ID NO: 48819 - DNA, 1056 bp, Glycine max
  Peptide Sequence Number=SeqID_165597
atgtcgacctttggcgccgcggcgaatacgaatcccaacaaatcctacgaggtagcccaaccaccctctgattctatttcgagtctttgtttcagtcccaaggccaatttcctcgtcgctacttcatgggacaaccaggtgcggtgttgggagataacaaggaatgggactgttgtcaacagcactcccaaggcttcgatttctcatgaacaaccggttttgtgctccgcttggaaggatgatggaacaacagttttttctgggggctgtgacaagcaggtcaagatgtggccactaacatctggtgggcagccaatgactgttgcgatgcatgatgctcctgtgaaagatattgcgtggataccggagatgaatcttttagcttctggaagctgggacaagaccctgaaaaaaggatttagtaagggaagaggacttggaactaaaagggactactatatggaagatatattcttgaagaatagcatgtttggtaatgaagtttatgattgtctatttggtaacactgtgacacttgctatgaaaacttctagaattttggttatgttgaagtattgggatactaggcagtcaaatccagtgcatactcaacaacttcctgatcgctgttatgcaataacagtgaaacatcctctgatggtagtgggaactgcggatagaaatctgattgtcttcaacctgcaaagtcctcagactgaatacaagagaattgtatctcccctgaaatatcagaccagatctgttgctgcttttccagatcaacaaggttttttggttggctccatagaaggaagggttggggtacatcacacttttgcaactgctggatctgatggtgcttttaatttctgggataaagacagtaaacagagactcaagaagcttttgattctctgtttcatagtaggacctatctggggggagtggggcacttggtctctattttgcctgttatcactcaatggaaaatggaaggatgaatccctttatccgatttggatggttgtgtttcttttcgggttcttaaagccctga

SEQ ID NO: 48820 - DNA, 255 bp, Glycine max
  Peptide Sequence Number=SeqID_165598
atgtggatggaaattagtgagcttacgtcttccgatatgtgcatcttcaatcgccactgtgaggactttcttgtatcaaggaggaaagagagtgatggaaagcacaaatctagcttcatcggcattgaaggcagctttgtgaaggacaatggtgaccacgatgttgccaatgaaaagaaaggagatttcgatggttgcgcccttttaccttttcccttttcaaccgcaccaacacaagtgtttcattttcactga

SEQ ID NO: 48821 - DNA, 219 bp, Glycine max
  Peptide Sequence Number=SeqID_165599
atggagcttattgaaaatatgattgctagtgatcatgccattctgcgtgatcggactcacattcccacaaagagaagcctgctagagctttcctctcaaattgcactattggcacagaacaagttgctatctgagcagcttgagacattgacagaaactttgaaccaagaagaccttgttggtgatatatttatgatgttagaggacacaatcaattga

SEQ ID NO: 48822 - DNA, 453 bp, Glycine max
  Peptide Sequence Number=SeqID_165600
atggccctacagttgggcttgaagattgatggattgccagtaaccgatatcatcatcggttatcaaattcccgttgatgctgatgatgttgtcattgcacaacatgctaaagctcatatcatgatgctcataggcagctgtttgatggcagatacatcaggtgcaagatcatgggcgtgggaccgcatgaaatatattaccccaaaaatagatcacttatccatggaaaaattcttgtggactcgttatgacaaaccagaaataaggctattaattaatgatgttgagtattatcctgttcatcaccaacatcaatcatatgcagaacccaatgtacctctagtggatgttcctagatttatgtcccaacatcatccatcacaagcacaatatcaatcagtaggcttctctgtatatgcatctcaaggatgtcaacaaagtttcaaccaatag

SEQ ID NO: 48823 - DNA, 1068 bp, Glycine max
  Peptide Sequence Number=SeqID_165601
atggctcctgtgccgagcagaaccgtggccacggcctctctcgcctcgctccttccttcttcccccttcgcgagggcttctcttctcagaagcgcttttctgccgccgcaaatagggcgcgacaggaagtgcttctcccccgccgcagggctgcggtggacgcagcggcgccaggggaggagggacgggctcgccgtgcggtgcgaggccgccgtggcggagaaggacgaggccaccggtgagaagtttgagtaccaggccgagggaaagccttactttataaagtatgaattccatgtattgccgaaggcagagttatcaatggcggatggtggaacatggtggagggtgagtcgattgttggatttgattgttcacagtctgtatagccacaaggaagttttccttcgtgaacttgtcagtaatgctagtgatgctttggacaagttgagattcttaagtgtgactgagccttctttgcttggagatgctggagatctagagatacatatcaagtctgatccagacaatggaactattactataacagatactggtattggaatgactaaagaagagctcattgattgtcttggaactattgctcagagtggtacctcaaaatttttgaaggcacttaaggaaaacaaggatctaggagcagataatggtctgattggtcaatttggtgttggattctactctgcttttcttgttgctgggagggttgtcgtgtctacaaagagcccaagatcagataagcagtatatgtgggaagcagaagctgacagtagctcttatgtgataaaagaagaaactgatcctgaaaagtttctgcgtcgtgttaaagcacccaaattcttctttactggccaggaggatgacaagtatgaattctcagagccaagcaggattcagggtttggtgaagaattactctcagttcgtttccttccccatctacacatggcaagaaaagtcaagaactgtggaggaatggcatgagagttacttatgtgtagtgataaggtctcattcattggattccaatgttgttaatggcggatga

SEQ ID NO: 48824 - DNA, 927 bp, Glycine max
  Peptide Sequence Number=SeqID_165602
atgtcatatttgtgcttttctgcatttgctctttattttgctgaatttcctcatctacccaaaaaagaagagcaaggagcattgaatagttccctttgctctaaatttattttgcagtttccacgttacctgagctttgtgaggggtgtggttgattcagatgatcttcctctcaatgtttctcgggagatccttcaagaaagcagaattgtaagaataatgagaaagagacttgtaaggaaggcatttgatatgattcaagaccttgctgaaagtgaaaataaagaggactacaaaaaattctgggagaactttggtaggttcataaaattaggttgcattgaagacactgcaaatcataagcgcattacaccactattgaggttttacacttccaaaagtgaggaggagcttaaaagcctagatgattatgttgaaaatatgggtgaaaaccaaaaggctatcttttatctagcaactgacagcttgaagagtgcaaagactgctccatttttggagaaattggttcaaaaagatattgaggttctttatttggtcgaacctattgatgaggttgccattcagaacctacagacatacaaagaaaataaatttgttgatatcagcaaggaggatttggaattaggtgatgaggacgaggtcaaagagagggaaaacaagcaagaatacaacctactctgtgattggataaaacaacaacttggtgacaaggtggccaaagttcaaatctcaaagcgcttgagttcatctccctgtgtgcttgtatcagggaagtttggttggtctgcaaacatggagagactaatgaaggcgcaagcccttggggacactgcaagtttggagtttatgagggggaggagaatattggaaattaatacagatcaccctattatcaaagacttgagt

SEQ ID NO: 48825 - DNA, 210 bp, Glycine max
  Peptide Sequence Number=SeqID_165603
atggcttctttttcagtggaagaattcataggaaatggaattttgaaggaactgctccaaaagctgttggaagaagggtgggatgatgatgcacttggaatcagatcatacctgcacgatcgcggactaatgcaatatgcagataagatggaggactgtgggaaagctctgtcagagcttatcaatttaagcaccacagatctttcctaa

SEQ ID NO: 48826 - DNA, 302 bp, Glycine max
  Peptide Sequence Number=SeqID_165604
ggctaggcgttcacgctcctttagcaggactgacgtggagggtagacacgtgtctctaagtgccacaagattgttccgtgttgagggagtctgcctgatgtccgaggtagtagtcttgacaagcagaaggtggcgagtgttgcccggtgttaagagtggtaaccccgacgagtgtgggagttataggtctgaaaggcttgtcaaacccccgagcttggacaggtgttgtccaggctatacttttgtcaagttgttcggggtggacatatttttggctttgcaggcgaggtctaacatgtcag

SEQ ID NO: 48827 - DNA, 444 bp, Glycine max
  Peptide Sequence Number=SeqID_165605
atgtgggacactcttgctgtaacctacaaaggaacatcacaggtaaaaaggtataaactaagtcttctcactcgtaagtatgaactcttctctatggaagaaggcgaagacatacaaagtatgtttagacgctttcaaatcattcctaatgaattaagatttctaggaagaacttacgacaactatgattatattaacaaaatcttgagaagtttgtctagaaaatggagaccacaagtaacaacgctaaaggctctaaagaatcttaagtctatgtcccttgaagaactagttgatactcttaaggttcatgaacaagaacttcagcaggacgaagaacttaagaaagaaaagtctttggctctcaacagtcaaaagatcaagaaagtgtcatcgtccagagagcaagcatccagaagcttgttgaaaaccctcaaagcataa

SEQ ID NO: 48828 - DNA, 189 bp, Glycine max
  Peptide Sequence Number=SeqID_165606
atgatcgaaaccagagaatgtgaatgtgagcttgagccttgtttgcaaatggaagcgcttagtggtagcatgagaaggtggtctcaacaagggtctcggggaacaaagctaacaaaaactcaagaagatgttcatatattgaactctgagctgcataggaatggaaacagggacgaggatgagggctaa

SEQ ID NO: 48829 - DNA, 1989 bp, Glycine max
  Peptide Sequence Number=SeqID_165607
atggaatatgcacaagcacccaaagattatgaggaccttataataagtaaacataatctttgggtggaatgtgaagaacataaaagatctgtgaaattcttaaatgaaaagcttttgaagaatgaagaacttaaaggtcaacctcaagatgttgtaaaacttaatgaggaaattggaaccttaaaatctacattggccaaatttgtcaatggaacagaaaatcttgacaaactgttaagatatagtcaatgtccctcggacagatctagcaatgaatatgaaggaaagatttatgttcatgatgaagacactattatttgttacttttatgatgtctttaacagtaggaagcaaatgcctatcatggtaccagggcagtggctgctcatgtcacatgacaggagaaaattttatgttccaatgcctgactccctatcatggtggaaccgtcacattcagagggaaccaaaaaggaagaataacaggaatggtggatatgatgtttcctttaacaaagatgagtgtatcatccaaaacagagataggtcccaactcttttggagggaatcaaaaaggaagaataactggaatgggctcaaatacaatttggtgagcataagtcaattatgtgacagtggatgtgatgtttcctataacaaagatgagcatatcgtccagaatagagacgggtccctactcttctctatcaagagaaaaggtaacctctataagataaagttaggagaactatcagatcaaaaggttaatctccaaactgcaaaaggacaacctcataagaggattaccaaggataatggaacatttcttggattctctgaaacatttaaggcattcaaagtgtacaactcaagaaccttggtagttgaggaagctattcatgtgaagtataacaaaaatgagcataataaaaatttatcaaagctaaatgattcttttgcaaatcttagattggatgatggtattgaagaaaaagtgtcatccagtcaaagtttagaagatggagtgtccactcaacatctagatgatcctcaagaagaatcaagggaacccactggacgcatcttaagaaagaatcatccagaaagccaaatcattggtgacccaaaagatcgtctacaaataagatcatcatcacttagatcacaagggcacactggatttatttcagaagtagaactcaaacatattgatgatgcaatgcaagatgataagtggaagttagtagaactactaaaaggaaataaggttattggagagaaatgggtcttctgtaacaaactggacaaaaatgataaggttgtgaggaacaaggcaaggctagtagccaaagggtactcacaacaggaaggaaaggaagatttcaggctcacaagcttttgtgatgttgactatgttggagacaaagttgaaaggaaaagcacaactggaagatgtcacttcattggtggaaaattggttgcattgatatgcaagaagcaagaactcacccacagtagagatcattccaaccatggagataaccctgataatgaatcgtcaatccacatagagcacttctttgatattcaagaacttgaaaaagttggtctcaacaagacccttctcttttgcggggcaagacacttcttcaacgaacctcaaactacttacctagaactcattaggatgttcaacagaaaaactaagtttagaagtaataaggtgattgtatccaaagttcttgaagtacagataccagtgtccagtgactccattcctgatggctctcttattctttctcaaagtaagtacattggagatctcttgcagaagacaaaaatgactaaaactcagcctatatcttctcctatggtagcaaattgcaagctaaccaaggcaagaccagattgcttttccgatcctactttgtacagatcagttgtaggagccttgcagttgtggaagcaatgttttccaagattattttga

SEQ ID NO: 48830 - DNA, 1110 bp, Glycine max
  Peptide Sequence Number=SeqID_165608
atggcctccaaaactatatgcactaccattcaggtgactctcatagtcgcttttctaacaacccaggttgttttctctgatgacaatgtgccaattcctgctaacaaggaacaattgggcacatggtttagtactaatgtaggacctttagatcaaagaaaaagcactatagaccccgcattggtggctgctgaagaaggtgctaaggttgtgaaggtaatgcaagatggaagtggggaattcaagaccatcactgatgccattaacagtgtacctaatgggaacaccaagcgtgtaattgtgtttattggagctggaaattataatgagaaaatcaaaattgagaggacaaagcctttcgtcacattgtatggggtaccagagaaaatgccaaacttgacatttgggggaaccgcacaacaatatggcactgttgatagtgctacattgattgttgaatcagattattttgtggcagctaacatcatgatctcgaacactgcaccgagacctgatccaaaaacgccaggaggtcaagcagtggcattgcgaatttcaggtgacaaagcagcattttacaattgcaagatgtttggattccaggacacaatttgtgatgataggaataaacattttttcaaagactgcttaattcaaggcaccatggattatatttttggaagtgggaagtcactatatatgagtaccgaactaagaacgcttggcgacaatgggattactgttatagtggcacaagcaagaaaaagtgagacagaggacaatgcctactcatttgtacattgtgatgttactggaactggtactgggactttcttgggcagagcatggatgtctcatcctagagtggtctttgcatacagcaccatgagtggtattgtgaataaattagggtggagtaacaacaatcaccccgaacatgacaaaactgttcgttttggagagtaccagaacacgggacctggtgcagaccccaaagggcgtgctcctataactaagcaactaagtgaaacggaggtcaaaccttacataacacttgcgatgattgaaggctccaaatggctacttcctcctccaactcccaaagtctaa

SEQ ID NO: 48831 - DNA, 201 bp, Glycine max
  Peptide Sequence Number=SeqID_165609
atggaggatgagtcatctgaggccaccatcctagagtcatttgatataggagaagaagtagaggagacacagatgccagaggacccgactacaccagtcctagctgtggacacttctcctccaactactccagtgcttcagctgacatatgaggaggatggtcaaacacaggacacccagaaccagtcacaggaattttga

SEQ ID NO: 48832 - DNA, 792 bp, Glycine max
  Peptide Sequence Number=SeqID_165610
caaaggtacggaaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaatgtgccgactattcatggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaaattgttgaagaaagaacaaaagaaacatcttgttctttccaggcgatcggaaaataaagaaatagtgaatttattcaagataattatgtacttacaaaataccgtctcaattcatcctatttcatcatatccgggatgtgatatggttccaaagggtgaactggacagttccaataagatttcattcttgaacaaaaatccattttggggtttatttcatctattccatgaccggaacagtgggagatacacgttacaccacgattttgaatcagaagagatatttcaagaaatggcagatctattcactctatcaataaccgagccggatctg

SEQ ID NO: 48833 - DNA, 167 bp, Glycine max
  Peptide Sequence Number=SeqID_165611
ttcagatgaaaatcttcatggagtctattaatagaggcatttggagtgcgatggttaatggatataccatgccaacgcatgtagttgataacaagactatagagaaaccttacgaatcttgctcacaagaagagattaataagggtgaatacgattcaaggcaatga

SEQ ID NO: 48834 - DNA, 165 bp, Glycine max
  Peptide Sequence Number=SeqID_165612
atgtcctgcgtggtcattaagaagagcccacgagtccttggtcagtgtgtagtgactagcaagcagaggcagtggagcaaagttgggtcccttgttcagctgatgctgaggggcacaaaacaattacaattacacaaggcaccagaagctgaagcagaagcttag

SEQ ID NO: 48835 - DNA, 468 bp, Glycine max
  Peptide Sequence Number=SeqID_165613
atggatggtatagttcaactgcagaggcaacttgttgattatactgcttccctatttcatgagggttttctagatgaccaatttaaccagcttcagcaacttcaagatgaaagcaacccagattttgtggttgaagtggtgactctcttttttgaagatgcggagaggcttcttaatgagctcacaaaaacactaggccagccaagcattgattttaaaaggttggatgctcatgttcaccagttgaagggtagcagctccagcattggagcacagagaattcacagagtctgcatttccttccgaaactcttgtgaggagcaaaacgttgaagggtgtcttaaaaacttgcaacaggtgaaacaggagtattccttggtgaaaagcaagcttgaaactctcttcaggatggagcaacagattttggctgcagtggatcatggttgtgaaattggatttatcatttaa

SEQ ID NO: 48836 - DNA, 1602 bp, Glycine max
  Peptide Sequence Number=SeqID_165614
atgagtacagagtcacgtcgttcggactctgcaatgcatcgtccacattttcaggtgatgatgaacgatttgttcaacttgtttctctgcaaattcatcgcggttttctttgatgatatcctggtctatagtccgccacttagaaagcatagccggcatttggaggtcgtctttgattccctctctcaggggcaattctacttgcgccgctcgaagtgtatctttgcccagaatagcatacattaccttggtcacatagtgtcatcacaaggtgtagtcccagacccggtcaaaattcaggttatggttaaccggcctacttcaggttctcaatctgaattgcatgaattgtttggccttacaaggttctatcgtaaattcattaaaggttatgtagttgtcatctcacctctaacaaccctattgtggaaggataattttcaatggcactgcaaaacgcaattggctttcgataaactcaaacgcctaatgacagaagctcttgttctggccacgtcggactttatgattttgttcatactggaaactaatgcttcatgttttgccataggaacagtcctcctccaaaattcacaccccatcaaattctttagtaaaacattatgcccgcctcttctaacatcatctacttatgtctgggagcttcatgctataaccacgatggcgattcaaacctcgaagcaacaaatatacctcgtcaagttgttgggttacgactatacgatccaatacaaagcagggtctgtgtctcatatgccagcaaacaaagtacgagacgaaaaagccgacaggcctcctccaacctttaccaacactttctttaacctaggaggtgcttactttggtgcccttccctcacactatacgacacacaagattgtcattctcttcttcgacatcatcggcaaattgcatggttttccccaaagcctcatcccggacagagaccccttgtttatcagctcattttggcgtgagttgtttcgtttgagtgacacgaagcttcgcatgagcagttcttaccaccctcagatggacgaacaaacaaaggccatggacaccatattagccacccagaccgcgttgcataacactttacagcgtcgcctagcaaaagcccaagttgttatgaagctacaagccgacctcctccgtcgcgatgttcagttttttgtaggagattgggtcacattggctaggtcgcataccgcctcaagttaccagcctcttcccgtattcactcggtctttcacgtgtcattgcctaaaccacaccaaggacccatcccggtcgatcaagttcctttcccccccaatgaccatcgataatcatctaattatcgaacctctgtcaatcctcgattggaaatgggacatggcaacggctccacccaccaagctagcactggtacaatgggttggattgcctcctgaggacacgacatgggaggacttatgtgcttcttacaaccttgaggataaggttgactttcaagaagggggtgatgatagcaacactaccttaataaccaggcctaagaagacacagaagagatccacataccttagtgattatgcataa

SEQ ID NO: 48837 - DNA, 468 bp, Glycine max
  Peptide Sequence Number=SeqID_165615
atggtgtgcaaactcctgttccagtgggaagctggaattcgaagtggagttagaagaaactcaacaccaatttgtgcttcaacaaccgcggaatgggtggaagaaaaggtgtttgagatggtgaaggcaaaagaattgggtgctgaccttgtagaggctcggttggacttcttgaaggacttccatcctgctcaacatcatcaatctctaatcaataaccgaggggagtctgatggtgatgaaagccagcgacaagatgctctacgtcaagccattgaattggggtctgagtttgttgatgatgatcgagctaaagggaagaagcctgagagtgtgaagatcattgtgtcttcacacaacttggaaagaactccatccgtggaggaaataggtaaccttgctgcaagaattcaggcttctggggcagatgtggtcaagattgcaacaactgcctttgacaacacttaa

SEQ ID NO: 48838 - DNA, 981 bp, Glycine max
  Peptide Sequence Number=SeqID_165616
atggagtgcaacaaggatgagggtttaagggctaggcaaattgctggagctagaacgcaaagaggtgaatttgtggaggcactcaagtttgctaccaaggctaaaaacattccccagattattacggtttgtgaggttcacattcctgctcagaaaaatctctctggctctgaaatggactggtatgcaattcttcagattgaaaggttggctgatgaagcaaccctaaagaaacagtactggaagcttgcactgctacttcatcctgatattgataagaataagtttgtcggtgaagaagctgcattcatgttgattggggaagccaatggggtcttgagtgaccaaacaaagtgtactttgtatgacatcaagttcggagccgctgcgacaggtgctgcacctaagacctcacaccattactcaaatgggaatgcgtttgatgcaaaacataatgcaaatgcaacaaataatcagaagagttctggttcatgccatttctctaatgggaatgtgtttgctgcaaaatatgatgcaaaggcaagtgttcatcagaagaattcttatccaaactccactggtttcaacaaccaagctggacaaatgatattctggacatcttgccaacattgtaatgctaagtaccagttcctcatccgatttgtaaatgcatacttactgtgtcaacaatggtgtctcaccatcagcgtttgcttcagtaaatatccagaaagaggctccaatgcatggtcccccaaaaccagcctcgaaaaatactggtggaaaactagtaaagatggctatgttcctgcatccagagatatgatgccacaaacctctaaaaatgttggaagtaaaagagcaagacaagcaacaccagactcaggagaaattctccaagctagaaatggtgaagatatgaaagagttaatgcatggcgatcttccaagaaaaagcaacatgtttcaaattaatgtgtaa

SEQ ID NO: 48839 - DNA, 1697 bp, Glycine max
  Peptide Sequence Number=SeqID_165617
acgtcgatctcggtttcgggataatcatgagtgaagcacctcttctccaaatcgaacccaaggaactcgaatttatttttgagttgaagaagcaaagttcatgctcggttcaattgactaataacaccgaccactatgtagcgttcaaggtgaagacgacgtcgcctaagaaatattcagtgcgtccaaatgttggagttctcgcgccgaaagctacttgtgaattcatagctctcttgagaataagtttagtcattgtgggttggatggttatgggagaagttacaatgcaagcccaaagggaagcacctgaagatatggtgtgcaaggacaagttcttaatccagagcacaaaggttcatgctgaaacaaccagtgaagatgttacttctagcttgtttgttaaagatggaagtaaatatatagaagaaaataagctgaaggtaaccctgatcagcccacccaattcaccagatctctctcctattaatggagacttcaagaatgggcttgaccatgaaaaagttcagatatatagtaaagatgaaatccaatccccggagcccatgatcagaggacacttcactaatgtgcatcaatatagagttgcagactgtcttcacctttcgtgtttccacaagttcccttcttttctggtgttgtcatctttgatgcttttggtagtctttgtgcatgttctaaaaaatccagacatggttcatgaggtattagagctagaagaggatatggagttgaggcaggagtattatatggggcacactatgaagcatgtaggggatccaaaagaagaagcagggttgaaagtgtcaaaaaatgagttgaatatgctaaaggatgtagaagaattgaaaccacaaaaaaagttagaggtagaagtgtcagaagatctggatttgaacaaagtaaagaatgcagaggagtggaaaccagagaaagcagcagagttgaaagtgtcaaaagttctggatttgaacaaagtaaagaatgcagaggagctgaaaccagagaaagcagcagagttgaaagtgtcaaaagttctggatttgaacaaagtaaagaatgcagaggagctgaaaccagagaaagcagcagagctgaaagtgtcaaaagttctggatttgaacaaagtaaagaatatagaggagcagaaaccagagaaagcagcagacttgaatatgtcaaaagttctggatttgaacccagtagatgatgtaaaggaactgaagccagaaacagaaacagtgttaaaaatgtcaaaagatctggagttgaaaatagtaaagagtgttgaggaactgaagccagaaaaagaaacagagttaaaaatctcaaaagatatggagttggaaactgtaaagaatgttgaggaactgaagccagaaaatgaaacagagttaaaaatgtcaaaagattgggagtggagaacagtaaagaatgttgaggaactgaagccagaaaaagaagctgagttgatagtttcaaaaagtatagaggaggtgaaattattaaaagctattgaagagatgaaattaaagctagatggacttgagtcaaaactaaatgaggcagatcttattaataaaggtccaagaaaagttcaagtcggcttcccacttctatatgtctgtatggtggcacttatctgtgtcttcttgggataccgtttacactcttga

SEQ ID NO: 48840 - DNA, 957 bp, Glycine max
  Peptide Sequence Number=SeqID_165618
atggagttcaacaaggacgaggctgtgagggctaggcaagttgcagaagctagaatgcaaagaggtgaatttgtggaggcactcaagtttgctaccaaggccaaaaaattgtgtgctgacgttgtaaacattacccatgttattacaatttgtgaggttcacaatgctgcaaagaaaaaactctctgccactgatttggactggtatgcaattcttcagattgaagggttggctgatgaagcagccataaagaaacagtacaggaggcttgcactgctacttcatcctgataagaacaagtttgctggtgcagaagctgctttcaagttggttgggcaagctaaaggggtcttgagtgaccaagcaaaacgttctttgtttgacaagaattttggagcctccgtgagaggtgctgcagtgaaatccaccggttccaagaagcaagttagacagaagacattctggacatgttgccaacattgtaatgctaagtaccagtactccataccatttttaaatgcaactttacgctgtcaacagtgtttgaagtcctttaaagctggtgctattccttttgttgtccagaaagaatctccagtgcatggtcctccaaaaccagcctcagaaagtactggtggaaatccccttggtagagaccatgctggtacgtttgggcggtcaaatcctgtgcctatgaaaaaatgtgctgctggagttggtgttcattgtgaaggtgaaaagagtaaagatggctacgttcctgcatccagaggcatggacccccaaacctctaaaaatgttggaagtaaaagagtatggcagtcagcaccagattcaggagaaagtttcaaggctggtaatggtgatgagatgaaagatgcttatgttcaagaaaatgctgttgatccttcgagacttaatgcagggagatcttccaggaaaaagcagcatttttaa

SEQ ID NO: 48841 - DNA, 1716 bp, Glycine max
  Peptide Sequence Number=SeqID_165619
atggccaaaaagaaagtctctcaatctcacgaccccaaagaatcccaaaacgtaaagcaacccttgccaatggctactccaaccgatggctcctcagaactgcagattcagaacctcaaaaacctcaacgccgtccttctcaaggagaccacccaacgccgccagcagattcactctctccagtccgcgctccagcaatccgccgtcacctacgacaccaacctcgcctttgacgtccaaaacgctgtcgtttctgtcttcttcaaaaaccagctcgaggaaatgaaccttcgcttcgacacgctcgtcggagagaaggactacgaggttgcggttctcaagcgccagctcaatgacctcgccgcccgtctcgagaacgaaaccagttctctcgttaaagagcgtgacggactcgttcgcgagacgaagcggctggaggagtgctttgacagagagaggaagcttcgggatgaagcggagacggctaggtctgaaggcgaaaaggttttgtctcggaaacagagagacattgcggaacttgaaacggagagagatttcgcggtgaagagttctcaggagtcgcttagttttattgaaacgctgagggaggagattgaagcggtgactagggacaagagtgagattcaaagccgaaacaatgccctagagaacaaaatcggttatctggaaaatgagttgaagcgactcaaccagtctacgaagaaggacgaggagattactcgtgcaaagattctcgaactggaaggtaaccttggccttgcgttgcagaaggaagaggagatgaaagtggagataagtgctcttctcaaggagaagaaggaggtggaaaagagcgttgaaacgttaacagaggaaaaagatggtgttcgtaaggctttgaatgttcttcagaaggagttagaggataagcagcacgagcttgatgaagctgttagagtgaggagtgagatcgaggaggtcaagggcaatctcgagaatgaaattgttgagttgctagggaaagtggatgagttgaaagagtcttgggaaaagtctgaagaggaaaacaaagagttggtttcgcaggttaagcattatagaaatgctgtcgatgaagctgtgcttgagaaggaaagcatcaagaaggtgtttgatggggagaaaaagaaagtggagaatttgcagttgcagattgcagggatagagaaagtggttgcgaagagcaatgctgaattgggacaggtgagaagcgaaagagacaagctagttgagaaggaaaagaagctggaaggcaaagtgagtgttttgaggaaggaaaatgaatcattgcagggtatgctcgccgaggctcgaaaggaatccaaggatttgaatgccaaggttgaagtttggtgcagcaattcaaacaaagcactggcattgttgaagactactgctgctgcacttgtgtatcaacacaaggaaaggggtggtgaggaagtggcgtccaatgggaatcatgtggaggaaattcagccatatgctcaggaacttgatgcaataaagaaggcattcaaaagcaaggatgagatggtggatgacatgaagcaacaacttgtttcactcaacaaatctgtggctgaggcacacaagagtaagagcttgtggactatgatatcctctgcaactacaatttttgctgctgtcttagctgcttatgttgctagaggacgctga

SEQ ID NO: 48842 - DNA, 1506 bp, Glycine max
  Peptide Sequence Number=SeqID_165620
atgactcatcagctaagttatgttatgaccattgaccagggtttaaaccctaaaaaggacccacggcgagaagcttccaactcctctctcacgcgcggacctccccctccggcgacttctgcaccgacggacgttttcaattttcatgaccagaattgtgccctttcttatgttagggtaaaggataaagggatgatctacacagcaattgacacattctacctcacagatgagcagctagcaatctcaccttctagaaaagatggcatagatgaagccactgagaccagccttagaatctatggttgtgatctcatccaagaaagtggcattttgctcagattgccacaagcagtcatggctactgggcaggttctattccatcgtttctattgtaagaagtcatttgcacggttcaatgtcaagaaagttgctgcaagctgtgtatggttggcttcaaaactggaggaaaaccctagaaaagccagacaagtaattattgtttttcaccggatggaatgcaggagggaggactttcccatggagcatttagacttgtattccaagaaatatgttgatttgaaaatggagttgagcagaacagaaagacatattttgaaagaaatgggattcatttgtcatgttgaacatcctcataagtttatatcaaattaccttgctacccttgaaacacctccagaattgaggcaagaggcttggaatctggctaatgatagtttaaactctaaagagccaggtctatcctgtttgagaactacattgtgtgttcgatttaagagtgaggttgtggcttgtggagttgtatatgctgctgctcgcaggttccaagtaccccttcctgagaacccaccatggtggaaggcatttgatggggagaagtctgggattgatgaagtatgcagggttctggctcacctttatagccttccaaaggcacaatatataccagtctgcaaggatggggactttacattctccaacaaatcatcggaatcaaagtctcaatcaacacccaaagtgatgcccactttatccatatttattgatgttccgcaaaatagtcccccagctgatactgacaactcagtgccaaagggaactcaaggagaagctaatattgaatccaatggtagcaagggtgcaattgtaaaggtagccattgataagctgaaagattctaaaaggtctgatgatgaatccaaaggcatgagtacagaaggagaggcaagagatgaacccatattgaagtccaaggctgaccgtaaaatagaggccattgagcgcagggcagaccgggacagggatagagaacgatatagggatagggaaagagacagagatagggacagggacagaacaaaatccagagatagagatcgaggaagggattctgacaaggaacgtgaacgagaggaagctgagaggggcaaactcaaggatcgggatcaccgttctagggagagagcaaaggattcaggtgtctag

SEQ ID NO: 48843 - DNA, 1515 bp, Glycine max
  Peptide Sequence Number=SeqID_165621
atggtggccttggacggtgaggggaacttgagggcaattagcatcacactcaagcaatttcctgtcgccaactataactttcagtgccgttgtggaagaagtggggaggttgagaaattttgcaacatgcgcttgaatgaagttatgggtactacccctatcaataaggatcataacccggtggtgagagacttggtcgtagatgcggaaggtttcaggcgcaggcaattcggacaaagtgttaagacttatctagggctggtcattggtgtgttgtttgagcaagggtatgacaggcggatagcagaagcctttgtcccgacgcgtggccaactcctccaaagaaaggcgtttagtcgcagaggtgaaacaagggagaaactcgatgaagggtttgtcggaaagggaaatggtgatctagagtggcagggacaatccaatagtttatcctcctggagtttagtcaaggcgatcgcttgtggaaacgatggcgtgaatctgaactccaaggcctggagcatcgccgcccaagatgtgaggaagccattccttgacatccattggtaccaagaaagaatggggccctccatcccatgggatcttggccatcgaagtgagagacctctaacttcatatgaggactggatgaagtggttgactgaagaggtggcggcgatttgggtgaagaaggggggcagcgtggttcggcgtcaaggtgttttttccctgcgtgaggcggttgactgcctcgaggcggttagtggtagtctggcgggtagtgtggtcaggcatggtgggagcagggaagaggcaacagatacatatgggataacagaaaatgataatagaattgagagtggggaatctaaattggttgcgacggctttgctgatgttgtgggcaacaactatcaaagaattgttggatttgtacaattttagacagattggggttggcaccaaagtgcatggtgctgtaggaaatcctattagtgatagcaaaagtcctcatctttataatgcaactttcaagtctgtgggttttgatggagtttacttgcctttgttggtcgataacgtctcagattttctcaacacatactcatctcctgatttcgttggatacaactacacaattcctcccaaggagaatggacttagatgttgcgatgagatcgatcctattgccaagatattgaggaaggactatacgaggtttcaatttattcataggtctttgttacaactgtttgcagattcaaacagaagatccatatctggttgttcacctttgtgtggtaaactctttgtggttatgggagctggaggggcaggaaaggcaatagcttatggtggaaaagaaaagggtgcaagagtagttgttgccaatcgtatatatgccaaagccaaagaacttgtaactaaagtgggaggagaggctattactatatctgaattagagagcttccataccaaaggtttggtgttagtgctgcatattctgaaattaccataa

SEQ ID NO: 48844 - DNA, 639 bp, Glycine max
  Peptide Sequence Number=SeqID_165622
atggtggttggcaaaaatctgcaatggcgctgccatttaacaacattgacacttagtagggcatgggagtgctctcctgggaaagagttcgcatggaacttgttatccctctttactacttctggaatgctgtttctagaagtgagcttgcttgcttttttacttcaaggaaatagtaccagtggcttagaagcgttgacgcgaacttttggtatatcagggattattgttggttttgatatcttgttgaagtggttaccctactcctcacgtgaagtggaacttgtgggttatccacaagctgctgcttacccttgtttatggtttcatactgttcatttttatgatagcatagtttatcttcctctttttgcagcaaggcctgcttactataagtatgttaccattatgttcatcttgaatgcaattgcgctgtttgcttgtggcattactggaaacggcgctgcttttggtttctggttatatcatttcacggttgtatgttaccatgctgcctatcttcccctgctgtatataaccttcctggctgacttttttcaggaggaagatttgcatttggagaatgtgtactactctgaaatgaaagatgctggtttctttgaagcagattggaactga

SEQ ID NO: 48845 - DNA, 220 bp, Glycine max
  Peptide Sequence Number=SeqID_165623
gtggcttgttggtgcttgcacgcttagcgcaactctggctcgcttagcgcgcattagtaaatttcggcttagcgctcatcttttcgctcagtggatggactcaagcggtgcgcttactgggattagccctcgcttagagaacatgcacaactcatccttcttccagattctttctcgcactcagccaaaggagtgttgcgctcaacggatggctcgctaa

SEQ ID NO: 48846 - DNA, 599 bp, Glycine max
  Peptide Sequence Number=SeqID_165624
tgtctagaaaatatgttgcgttgcaaatttgtgatgacgaagatgttgaaaccatgcttgaaagttttcaacaacaagatcaaatgtcagttatggaattgtacatagaaaaggatgtgactggtggttctatgtttcattctgcaaattctcttacatcatgtggaaataatttatctaataatgaggcgcaaccgctaagaaatatgagcaatttacatggtgacgaagatgatgatgatgatgataattatcttgtgtctaaatcatacgttgaagagtctttagacgaagatgatagtattgacggtatatctgatacagacgatgaagtcacacatgattcaacccctaagaattgttcacccagcagaaggtataatttcctctataaaaaaataggtgtacaaggaattcaaaatccattttggaatgatgctttgcattataacaatatcaactggagtcatcctgatgaggaggacatttgtggtttggagatgccatcaagttttaatgttggccaagaattatatgttggcatggattttgatagtaaagatgcggtcaaaaatgcagtcaaacaatatgttatgaag

SEQ ID NO: 48847 - DNA, 869 bp, Glycine max
  Peptide Sequence Number=SeqID_165625
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatttcctgctgcacctgtacgaccgcgccctgctcaacggcgccgcgctgcgcgcggtgggctacaccaagaccacgcccaacccgccgggcggcgagatcatccgcgacgcgcagggcaacccgaccggactgctgctggccaagcccaacgccaccatcctgtacgccacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 48848 - DNA, 381 bp, Glycine max
  Peptide Sequence Number=SeqID_165626
atgaaacaaaaaggaaaaagaaagaaagaccgcgaaggtcgacatgttatagttaagaagtataaatcattcgtaaagagcaaacatatcttctggaaacaagggactgatgctaagagtttattttccggaataaccgagataagaatggatgaattcattgaactgatgaaagaacataacttggaaactatcacaatgccaaaaacgggatgcttgagtgcccacctggctgtagccatgactaattttgcacgttgttttcaaattatcattgtcacgcgtgccttatggagtgatatgggagttcggccccgagaccgacaccttgacacccaaatttgttataccccagatatcaagattgggttcccacgataa

SEQ ID NO: 48849 - DNA, 534 bp, Glycine max
  Peptide Sequence Number=SeqID_165627
gataagtctagcagggccctgggatttccagcattgatcacgggccattgccagtcgttcggggttcccgtcacccccactaaggtgatccgaccgccgatcaccaaggccttcatcgagaagtattgcacgcctaggcaggcgcagggtgatgcacctcaggccgcagacgcaccgccaccacctcatcaggccgatcccgctggatcactaggcatggagcgttatctatacacttggttcgccagcaggcggccaaccaccgggggcaggtgcagatacatgagtgtctctaccggttcagcctcagtcaacaggggcagggtttcgctccttttgcatgccctactccatagcagtttggggctgaggtcgcatggcccagagattaacccgaggcccaggcaggggaggagcccgcaggatcccctggtgaggcagagagaaatttttggcgttatggctctcaattatttcgtcaccgtttttgctacttgccatttcatacgttcttttcatttaccttgtggttag

SEQ ID NO: 48850 - DNA, 300 bp, Glycine max
  Peptide Sequence Number=SeqID_165628
atggttccttcatctcttgttctcagtcaaacccaagtagatgtaccctctacttgtatcacaaaggatgtaccctccaatgtgttaagacaaagatctcaggcggttaaacctttgaaactttgtgaatggggatacaaaagaattctcaggcgggagaagggagacacaaaagaattcaggcggttagtcctttgttcttttggaaaagggagaagagagacacaaaaagaattcaggcggttagtccttggcgaattctttttggcaaagggagaagagaatgaaaaggatgaatag

SEQ ID NO: 48851 - DNA, 150 bp, Glycine max
  Peptide Sequence Number=SeqID_165629
atgccgctttgcacgggtttggtcggtggcggtgccgttttatccgcaggcgggaagtacagcggccccttcagtccacagccagtcagactaaacagcgtgatgagaacggcaagcgttcggaaagcgtttttcattataaagttgccc

SEQ ID NO: 48852 - DNA, 261 bp, Glycine max
  Peptide Sequence Number=SeqID_165630
atgaacgaagaacggatgaagaacggtgaaaaacgacgaagagcgatgaagaatttccacagaatcgcttacggaagcgttacggaaccgaaatgcatagccaagggtcttgaaccttttgaaacagctccccctcccctatttatagaaaaagggaggttttcggagattttacggaagtattacggaagctgcggaagcctccagaaactatttttcaaaaacgtggaggagcttgccgcccagttgcttcctccttaa

SEQ ID NO: 48853 - DNA, 510 bp, Glycine max
  Peptide Sequence Number=SeqID_165631
atgggaaagttggatcatctagaggaaaggctcagggccattgaaggaggtgaagattatgcctttgctaacctagaagagttgttcctagtacccaatatcatcacccctcccaagttcaaggtgctggactttgacaagtacaaggggactacttgccccaagaaccatctaaagatgtattattggaagatgggggcatacgcaaaagatgaggaattgctgatacattccttccaagaaagtcttactggggtagctgttacctggatgcaactacagaacatgtgcaaaaagggggcacagatctttcaaaagaatacgtccaaaggtggagagacctggcagctcaagtggcacttcaatgacggagaaaaaatgatgacaatgatagtagacacattaccagtattctactatgaaaagatggtgggctacacaccttcaagctttgatgatatggtcttcaccgacgaaaggatcaaagtgggtctaaagaggcaaatctga

SEQ ID NO: 48854 - DNA, 240 bp, Glycine max
  Peptide Sequence Number=SeqID_165632
atgtcggttgaaaaatatcggtcggggctatttaacgaccgatgtcgggaaatgttcgatcggcaacaccgaacagatgatgtgaacctgagtaggagcagatcgtttgatacaggctacggaggtttggatgacgccacttccggtgaaggaagtcagggtagacaccacaaggattaccttgataagtctgagattggttcacaaggaactcagagagaaggggatcctctagagtga

SEQ ID NO: 48855 - DNA, 306 bp, Glycine max
  Peptide Sequence Number=SeqID_165633
atgggctctaaaatctaccctgaggttcatgagaaccctagggcattcttcagaaactctagcccaatcctcttggagcctcctgctaatggctctggtgattggtcccttcctaggaaggattgcatcaggtattgtagccttggtgctttcactactctctcaactgtcaggagcggcaatgagggtaagtgtaagaacgagtacctttgctacaaatttgaggtcgaattttatttcaagatggagggaatgataaaggctaagaaagcaagaaaagccttaaaccaaatggtgacaacttga

SEQ ID NO: 48856 - DNA, 562 bp, Glycine max
  Peptide Sequence Number=SeqID_165634
atggaaattttttctttcttgatttttattgtttcttatatgctcgttccatctctcaaaatttcggcagctaccctcagtgtgtcacagtatgtcacagacggtgagaccttggtgtccaacagtggagtttttgagcttggttttttcagcccgggaaaatccacaaagcgttacctggggatttggtataaaaatattactagtgatagagctgtttgggttgcaaaccgggaaaaccctatcaatgattcctcaggcatcttaacattcagcaccacaggcaatcttgagctcagacaaaatgactccgttgtttggtctactaactataaaaaacaagcacagaatccagtagcagagctcttagacactggaaattttgtggtaagaaatgagggagacacagatccagaaacgtactcgtggcaaagctttgactatccttcagatacacttttgcccggaatgaagttgggatgggacctcagaaccggtctggaacgcaaactaacgtcttggaagagtcctgatgatccatctgctggagatttctcttggg

SEQ ID NO: 48857 - DNA, 198 bp, Glycine max
  Peptide Sequence Number=SeqID_165635
atggagcaagttagcataggacaccataattggggtgaattctaccggctttttgctgcaaaactccctccttggttggtgggttttgtggttgatttagggatggcctttgtggataactgggtggtgggtaaggagaagggttgttattggctgagtaatgacattgttgggttgctgggaaacttagccgtatag

SEQ ID NO: 48858 - DNA, 657 bp, Glycine max
  Peptide Sequence Number=SeqID_165636
gtactagtacctatcttcttcagagggctacatgtcctcgctatcagaggagtacaagtcatcaccatcagaggactacacgtcctcgcctttagaggactacacatcctcaccttcatagggctacatgccctcacctttagaggactacacgtcctcgccttcatagggctacacgctctcacctttagaggactagacgtcctcgccttcagaggactacatgtcctcaccatcagagggctgcacgtcctcacctttagagggctgcacgcccttgccatcagaggactacacgtcctcaccatcagagggctgcacgtcctcaccttcagagggctacacgtcctcaccatcagagggctacacgtcctcaccttcagaggactagacgtcctcgccttcagagggctgcacgcccttgccatcagaggactatacgtcctcaccttcagaggactacacgccctcgcccttagacggcgccacgccctcacctttagaggactacacgcccttaaacatcataggactacactccctcgccttcaaaaggcgattggtcctgaacttcagagggctgcacgccctcgcattttgagggctacgcatcctcacttccaatgggctccatatccacaccttaagataatttaa

SEQ ID NO: 48859 - DNA, 279 bp, Glycine max
  Peptide Sequence Number=SeqID_165637
atggcacgcagcgtctttgcttcgtgcccctattttagggacctatcgggaggaactaagaggcttttagtgataattcccaaggtggtcatatctctcttgatggtttctagagtccccagtggagttgccaactgtcgtaacctacccttcggcgagagggtgatgcgagactcacaggtgcgtcttccaagaaaggaaaatgcgcggagtctccaccaacgtttatttgaggaaaacgtcggaaaaaccggaaaaggtgtggtctacgaactttaa

SEQ ID NO: 48860 - DNA, 583 bp, Glycine max
  Peptide Sequence Number=SeqID_165638
ggatcttaggatgctcgataggaggaaggaagccataccttttttctgggtactatccttctatggcgagaatagcaggagtggaataccaaggaagttcttggaggagaaggcggagactctggcaagccaaagggagtgggtaacattcatcgacgtattagcattactagtgttggagacaattctatttccaaatgtagacgggctggtggatctagcagcgatcgacgcttttcttgcttatcaccacaacaaggaaagcccaatcattgctattttagcagatgcgtatgatacattcaacttgagatgtgagaagagtagtgcaaggattgtctgttgtatgcctggtctttattggaaagaaggaggggcaggagcgttatgctcatgtgaaggatttccaaatgttcctttgatagggatgaagggtcgtattaattataatcccgtgttggccataagacagttaagataccttatgagcggtgcgccattggaggagaccatcgcacctttcatcgcacgaggttttgatgaagctaatacaaagatgcttcagaggatccgtaaggcatga

SEQ ID NO: 48861 - DNA, 360 bp, Glycine max
  Peptide Sequence Number=SeqID_165639
atgcccgggcacatgaacgtgctgctggccgaagcgggcgtgccctacgacctgatcgccgacatggacgacatcaacccggagttcgccaacaccgacgtggtgctggtgatcggtgccaacgacgtggtcaatccggtggcacgcaccgacccggccagcccgatctacggcatgcccgtgctggacgtggtcaacgcgcgcaacgtggtggtgatcaagcgcggcaagggcaccggcttcgccggcatcgagaatgcgctgttctacgccgacaacacccgcatgctgtacggcgacggtgcggaagcggcagcctcgctggtgagcgaactgaaggcgctcgacggcgggcattga

SEQ ID NO: 48862 - DNA, 303 bp, Glycine max
  Peptide Sequence Number=SeqID_165640
atgtcattgcctagcgctgttcatgcatcctccaccttcgagtctggagccccgcgaagttattgcgtagcgctgttcgccaattctccattctccactttttgtcggagccccatgaatgtcattgccaagcactgttcatgtgtcctccaccttcgagtctggagccccgcgaagttattgcgtagcgctgttccccaattctccattctccactttttttcggagccccatgaatgtcattgccttgcactgttcatgcatcctccacccaaagagtttggagctatgcttcatgattga

SEQ ID NO: 48863 - DNA, 309 bp, Glycine max
  Peptide Sequence Number=SeqID_165641
atgaaagttgcagacattattaagacaactttccctaagaccgataatgctaaaaggtttatgaggttagtggaagagcactctcaaacagctaataagtctcttgctgagacattaatgagtacattgaccaccatgaagtttgatgattcacatactatacatgaccatgtcattgagatgacaaacattatagaagaaacagagctcaagaatcaaggaagtcactcagtccattatgtaagccaccaagggaatcaaggagctggaaagaaaattgtgaagaaacatgataaaggcagagagtaa

SEQ ID NO: 48864 - DNA, 792 bp, Glycine max
  Peptide Sequence Number=SeqID_165642
atgacttattcagctccactgattcacactattcaacaagaggttgaaccaattttccaagctgaaaatgttgtagccttcgacaagatggaagaactccaagaaagatttgatggtatgcaaagggaagtcgaagccctccgaggaagagatctgttcgggaaggacgcctgtgaattatgcttggtcccaaatgttactatccctcacaagttcaaggtgccagacttcgagaagtataaagggaactcttgtccccgcagtcacttggtgatgtacgcgcggaaaatgtccatgtatactgacaatcataagctgcttattcatttctttcaggacagcctgactggggccgctctgaagtggtatatgaatttggacagtgcgagcattcgtactttcaatgacctgggtgaagcgttcatccggcagtataagtacaatttggacatggccccagatcgtgatcagctccgtgcgatgacacaaaaagagaaggaaacgttcaaggagtatgcccagcgttggagggaagtggctgcccagattgtcccgccgttggaagaaagggaaatgaccaaaatatttctgaagaccctgagccagttttattacgagaaaatggttgcaagtgcaccaacagacttcactgaaatggtcaacatgggtgtgcgattagaggaaggtgtccgagagggacgtttgactggggaaagtgcccctgccgcaagtaatgccaagaagtttggaggccactttgcgaagaagaagatcaagaggtgggaatggtag

SEQ ID NO: 48865 - DNA, 300 bp, Glycine max
  Peptide Sequence Number=SeqID_165643
atgtggtccctcactaactgtaaatcaagtaaagtgcaacttaataatcccacaactggtagatgtggtttcttgagctggtgggcgtttgagcagcacgggaaacagtgtgcttatttaatgcctggtttttacaaagacacaagtgtacattggtcactggtatgggttcattgctcttggagggatattaacacaagcagaattatagggtgctgttgtcaagggattattggtctcatgcactatgtttgtcaaaatctggattcaacgaaacggaaagatgcaccacacaggtaa

SEQ ID NO: 48866 - DNA, 333 bp, Glycine max
  Peptide Sequence Number=SeqID_165644
atgctcgtaagaaatttacattgtcacaaagtccattctctgagcctaaggtgctttacttcaggaactcctaatgtacttaagcctggggatgtcttgagaaaagcaagggtatatactgacgaagatgttctccagtactccaaggtgagttgtgattcgaatcctttgcatactgattctgctgcagccaaagatgttggatttgaaggtccactggtacatgggatgcttgtggcatctctctttcctcatatcatctcatcacattttgtaagtttcatacttaccctctctttaaattttgatatgcctcctatggaaatgagatag

SEQ ID NO: 48867 - DNA, 306 bp, Glycine max
  Peptide Sequence Number=SeqID_165645
atgacctcctttcctcttctcttcaaactacaccccatggatgacctcctaaagttcatccccaagaccgtcgacaatgtctggaaggagattgtcactgtcgccaccacccatgacgttgtctccaccaacatcgtcaatgctaacgcaagcgaggctcctgcgatgacccttgaggatttcctcaccaaggttggtgctgtcaaagaggaggatatcagaggggttcttccccacaagatcaggccacgaaaaacccaccctcaagatcaaacgccaattgcagcagagaatgctgccttgtag

SEQ ID NO: 48868 - DNA, 714 bp, Glycine max
  Peptide Sequence Number=SeqID_165646
atggaagcaaaagctccacttattccacctctgaaaaatctcttcctcctaataaggtgttgcagcaatgttggtggttgtgagtggacaatcatcagtgaagcctttggtgaagacagtgaaggggaagaaggtggttatggggtggctacagggggacccttagcctggggcttatgctacagcaaggaattgagtcctgataaattctactgcgatgactactataaattaacctacccttgcactcctggcgcagcatactatggccgtggtgccatcccactttactggaactacaactatggaaaagccggggaagccttgaaggtggatctgttgaaccatccagaatacatagaacaaaacgccactctagccttccaggctgcactctggcagtggatgaccccaccagagaagcacctaccatcaccccatgatgtctttgttggcaactggaaacccacaaaaaatgacacattgtccaaaagggtacccggatttggtgccacaataaacttgctctatggggatcaaacttgtggtcagggatcagataatgaggccatgaacaacatcatttcacactatctttattatcttgatctcttgggtgttggcagagaagaggcagggcctaatgaagttctctcctgtgctgaacaagctgcttttaagccctctggctcaccatcttctgccacaaattga

SEQ ID NO: 48869 - DNA, 1662 bp, Glycine max
  Peptide Sequence Number=SeqID_165647
atggaggaagcaaaaagcagatggcttcgtcccaatgagattcatgccatactctgtaatcacaaatatttcaagatcaatgccaagccagtaaatttgcccaaaagtggtactattgtactatttgaccgcaagatgcttaggaacttcagaaaagatgggcacaattggaaaaagaaaaccgatggaaaaactgttaaagaagcccatgaacacttaaaagttggcaatgaagaaaggatccacgtatattatgcacatggccaggataaaccaacctttgttcgtagatgttattggttgcttgataagagtctggagcatatagtccttgttcattatcgtgacacacaagagttacaattgcaaggttctcctgctacacctgtaaattcaaattcaagttctgtctctgattcagctgcatcttggattccatcagatgacttggattctggggtgaacagtgcatatgctgttgagcttaatgacagtttaactgccaaaagtcatgagcagaggcttcatgagattaatacacttgaatgggatgacctagtggtttcaaatgccaacacttctactacatctaatggaggcaatgttccatattcatttcaacaaaatcaaagtttactgaatggaagctttggcaatgtatccagtgatccttcagcagaaattccttcttttggtaatttaactcagctagtttctgggagcgatagtgctccttatagtttcccagaaagtgctgatcttttgaaaagtagtcctttatcttcgggtggtgttgacaccttgggcactttggtcaacgaaggcttgcaaagtcaggacagctttggaacatggatgaacatcatgtcggatacaccatgttccatagatgaatcagctcttgaagcaacaacttcttctgttcatgtaccatattcatcactggtggcagataataagcaatcttctctgccagaacaagtatttaatctcactgaggtgtcccctgtgtgggcatcttccaccgagaaaacaaaggtcctggttggagtttaccggtgctgggtatcaccacactctcctggattggtcactctctatttgagctttgatggccataagcccatcagccaagttgttaattttgagtatcgtactcctattttgcatgagccaactgctttaatagaagagaaatacaactgggatgagtttcgacttcagatgaggcttgctcatttgctctttgcttcagacaagagccttaacattttctcaagtaaagtatcaactaatgctctgaaagaggctagaagattttccttcaaaacatcatatatctctaaaagttggcaacacttgatgaagtcaattgatgacaaaacaattccattttcacaagtaaaagatgccttgtttgaaacttcattgaaaaacaaattaaaggaatggcttttggaacgaattatcttaggcagcaagagtactgaatatgatgcgcaagggcaagctgcaattcatttgtgtgcaatgctgggatataattgggcaatttccttatttacatggtcgggcttgtcgctggatttccgtgacaaatttggatggactgctcttcattgggcagcatattatggaatgtatggtacatggatatcctag

SEQ ID NO: 48870 - DNA, 465 bp, Glycine max
  Peptide Sequence Number=SeqID_165648
atggttctaatatattggttggttatggcttatgacttcttcactgaccctataaattcagcacctttacttccatgctatcttgttcatcatggagtgccagattttctgatgagtataactcaactatcagcttggtttttggtggatgctgtcgtgtacctggttgacgccttcgataaagagaggttcgcggaatctaagaaggagctcgatgccttgctttctgatgaatccttggcaaatgttccatttcttgtgctaggcaacaagattgacatcccttacgcagcttcagaagacgagctacgatatcatctaggcctgaccaatttcaccacaggcaaaggaaagattaacctcacagactccaaccttcgaccccttgaagtgttcatgtgcagcattgtgcgcaagatggggtatggtgaaggcttccagtggctttcccaatacatcaagtag

SEQ ID NO: 48871 - DNA, 342 bp, Glycine max
  Peptide Sequence Number=SeqID_165649
atgcagcgatcagaagagctgggtttatttgtttttgatgaagaagacaatgaaaacatactttcacattgtatctctcctgatgatatttataggaaacaagaagatacaattatttcatggagagatccagaatatgctgcagaactggctcttagctttcaagaacctggtggttgctcttacatttgggacaatatttgcaatgtgcaaaggagtatgcattttaatactttaaatagtgaggcatttcacagtgtaaacagtgagtcaagggagttgcccgctgttgaattgtcaacgcttcctttgattcttaagattaactgtgggtattgttga

SEQ ID NO: 48872 - DNA, 819 bp, Glycine max
  Peptide Sequence Number=SeqID_165650
atggtggttgagagtggcaatacagatcagtcatggcttgtggaactaattttaagctatcaagatttttttaggaagctcatggaagtttttagagtttgtgaagacttggaaaatatggatggccttcacctgattttcaaaataatcaaagggattgttttgcttaatagtacacaaatttttgagcgaatattcagtgatgagtttatgatggacattgttggtgcccttgagtatgatccagaggttccccatgttcaacatcaccgtaaattcttaaaggaatatgttatttataaggaggtatatttgggttctgattatttattctattttgggagagaagctaggtggcaggatgttgttttggctagagtattggatgaggctactgttgcaaatcttaactccataatacatgcaaacaatgccattgttgtttctttattgaaggatgacagtacatttatccaggagttgtttgctaggttaaaatcacccaccacctctcctgaatcaaagaaaaatatggtccgtttcttgcatgagttttgtagtttaagcaagagcttacagatggttcaacagcttcggcttttttgggatctgatgaatgagggcatctttgacatcgtcactgatgtcttgcaaagtcaagacaagaagcttgttcttactggaacagatatcctcattctcttcgtgaatctggatcctaatcttctgcagtcttatgttgttcgacaggagggaattacacttcttggactattggtaagtttctgtatgcaaatgaggccacatctttctagatga

SEQ ID NO: 48873 - DNA, 489 bp, Glycine max
  Peptide Sequence Number=SeqID_165651
atggctcctggatccatggatcttgtggtggattaccagttcaggttccagttccatccatcatgggaaacatccattcttccgtggttgccccacgcaaaaccaagatgggggaaagggcgtgaagttgtggacacttggagtaccgagtactactcatttggaaagaaaacctgtggcaataattacaaccacgaacaagagttaaccatcacaattcttttaggaaaaatcaatgtaaacggaccaagaactatgctgcgtcttccccagcgcaaaaaccctattccgcaaggtggtggggttctcatcaagtcctcctccttcttgtatggtcgtgacactgacgatcaaaatggtcttattgtcattttaagggcaaggagacgtgatgacgacaaagagcttcctatcatgatcactgtgaagcactatttttgttgccgcgtgttgctctcatggtgtctctgttgtggcaaagattcgtag

SEQ ID NO: 48874 - DNA, 1551 bp, Glycine max
  Peptide Sequence Number=SeqID_165652
atgactaggaatctagatattggagtgaaccaggttagaggcatgacaacagactttggagatgacatgcattgccagtttcttgagattcttcgctgtctattagactcatgctcattgtctggagcacagaaggatacaattattgacattttctatgagaagcatctgggacaactgattgaagttataacagcatcatgtccttcagaaaatgttgctcatgcgaatagtaaatcaatagatcgtggcctagttaagtatcagagtgggacaaagccagagatactatcaaacatatgtgacttgctatgcttttgtgtcctacaccatccatacaggataaagtgcaactttcttcttaataaagtgattgataaaattttgttactgacacggagaagagaaaaatacctagttgttggcgctgttcggtttgttcgtactattctatcatgtcatttatttccttccatcaacttctacatgagctgcatttttgttagttctcgtctgctggaattcctttcttgtaaaatcgtattatcgcttattgagttgtacatttttgtcattttggagctcattgcagtaaattttattgagaaggatgagcatctggtagatcattttgttagaagcgactttctcaaaccaatagtagatgcctttgttgctaatggtaatcgctacaatctgctcaactctgctgttcttgaacttttcgagtatattagcaaggagaatctgaaattattattgaagtatttagttgattctttctgggaccagttagtgaaatttgagtatttggtttccattcattcactgaaagtaaaatatgagcagtgtttggataatgatgggacaaaaggtactgctattatgattgaccttcgaagacgacttgatgagcgtgctctggataaagaagaggaagactactttaatgacagtgacgaggaggatacaacctctgcatccatttcacataatcagaaagtgcagcaacaacaacctgtgctatccaatggagttgctgcaagctattcaaagttaagtccaaggcctggtggactggttgactatgatgatgatgaggatgaagattacaggccacccccaaagaggccagaagcttctgaagaggatgaagggataatggagtctctcaggcagaaaagaaaattgccttctgagaaccctgagcttgcaaagaagttgtcaaaaaactcaaaatcaaaagatagtgtttttgcttccttgtgttcaacattgagccagactgtgctgcctggtaagaaaccttcagtcaatgttcatactggtccttgtagagaagacaataaagaggagtcaaatgtttctagaaatttctgtgagaatagcaatgcaacggctgaagtgaaccatgtagagaaagagactgccgcctatagaaatttttctgatgggttgtacggcacttcagataatggacagttgggtggtgaggaacatacattggtttcaccaaaatcctccccagagatggccgtaaatggatcttaa

SEQ ID NO: 48875 - DNA, 351 bp, Glycine max
  Peptide Sequence Number=SeqID_165653
atggggacaaggggtagcatcagttacaatcccgttcttgctataaggcaacttggctaccctatgagaggggaaccgcaagaggaagagctcgcgcctgtcatttcacaaggtttcaataagaccaacagggagacacttcagaagatctgcaaggcatgggaggtggtggaaaagaaggacaaagaactgaggggcagtaacaatgggcccatcggtggctaccgaaggtggttgaaagcccacgtgcaaggttcggattggctcccgagtttgagaagccacggagcaaagcatgctagctataatagggaagtacaaagaagagttaaaccagtctttgacccatga

SEQ ID NO: 48876 - DNA, 395 bp, Glycine max
  Peptide Sequence Number=SeqID_165654
gatcactgacattgtggtgcctcggaagctattatcggagagaaatgtgatagtctattacacagagtttgacgagttcaatagcatagacattgctattgcaaaggagttttatgcgaaactttatgacctcgaggataaatcacctaagcaagtgagggtgagaggtcacttagtgaaatttgcactcctgaggcctgatcctcaggagttggctgctaagctttgtatccctgggaggggattcgagcttaatgctgatgggcagccattgaagattctgaggaagaacatgaccactctagcttatacatggagcattctttccttttctaacctcattcctacttcccacacatctgatgtgaccttggacagagccaagttgatttatg

SEQ ID NO: 48877 - DNA, 264 bp, Glycine max
  Peptide Sequence Number=SeqID_165655
ggtacatcctttgtggtacaagtaaagggtacatctacttgggttgttgtaattgagaacaagagagggtacatctcttgtggatcagttcaagtggagggccacttgatccaacaagaggacactctgaaggcccagaatgcagcacaggaggccacaaaggatgcaggtgtagcagaggcagacatggacactgactacgtggcagatgtcactgcagcacaggggacctgggacctatggcccacacccacacaggattga

SEQ ID NO: 48878 - DNA, 192 bp, Glycine max
  Peptide Sequence Number=SeqID_165656
atgagggcaaaaggctcacttttggggcacttttcagcccctgggcccactagaaaacttaagagtgaagaaaccagctcgtctgggcaagctaggttacttctggaggaagcaagcagctcgcctgggcgagtgtttacgctgaaatttgtgaagctctttgaaagaaacgaaatgctggaagtaaattga

SEQ ID NO: 48879 - DNA, 373 bp, Glycine max
  Peptide Sequence Number=SeqID_165657
gtatatcatgaattcaattattacagtgttgtatttcaacggaagagtatatgaagacaatgatggtgtaatatttgaaggcagtaaaaaggccattcagattaaacgcggaattagtttcaatgctttgaaaaaagaattggagataagatttttagtttcaggaaaatatgttgcattgcaaatttgtgatgacgaagatgttgaaactatgatcgaaagttttcaacaaaaacaacaaatgttagttctagaattgtacgtagaaaaggatgttgctggtggttcgatgtttcatgctgcaaattctgttacgtcatgtgggcgtaatgtatctcatcatgaatcgaaactgccaagaattacatcttga

SEQ ID NO: 48880 - DNA, 570 bp, Glycine max
  Peptide Sequence Number=SeqID_165658
atgcagagatacccaagtggttatccgtacaaaacgatttctgttaatcctgactcgagaagtcaggtggcaagcgaagatacccaagtggttatccgtacaaaacgatttctgttaatcctgacccgagaagttaggtggcaggcggagatacccaagtgggcaagcgagcccgttgacacacagagacaaacgttgtcttctgtacctttgtcatccagagacggcgagttcaatgacatgcgaagaaacccaagtggttattcgtacaaaacgatttctgttaatcctgacccgagaagtcaggtggcagagacggtgagtccgatgatatgcgcagatacccaagtggttatccaaacaaaccaacttctgttaatctcgacccgtgaagtcaggtggcaggcggaagtaccccaagtggttatccgtacaaacgtacttctgttaatcctgacctgtgaagtcaggtggcaggcagaaataccccaagtggttatccgtacacacagttctgctaccccgacctgtgacaagtcaggtagcatgcggagacgccctatacggtaa

SEQ ID NO: 48881 - DNA, 820 bp, Glycine max
  Peptide Sequence Number=SeqID_165659
ctgacggtggcgctcaatcggttgccgaacggcaaaccggaccatttcatctcggttatcgtcgatatcagcgagcgcaaggcggccgaggccgatctgttcgcgttgcagcatgagctggaggaacgcgtcgaaacccgcacgcgggagctgaacgtggtggtcaaaaaactcaacgaagagattgaaacccgcgtgctcgccgaatatcagctcagtgcggagaaggagcgtctgcgcgccattaccgacaacatgccggccttaatcagccagatcgacggcaatgaacgctacctgttcgccaacagcgcctacaaaacctggtttggtctggaggagtccagcctcaggggaatgacggtgcgcgatttcatgggggaaagcgtttatcggatagcaaaaccgatgatcgaacgggccctcgcgggcgaaatggtgagttttgagaatgagttacagacccggcaagggctgctgatgatccacaccacgctggtgccgtgcgaagcgcagggcttttacattctcgccatggacatcaccgaactgaagcggctgcagcagcggctggaatatgacgcaacccacgacatgttgaccggattgaccaatcgccgcgcgtttctacgccggttgtcgggcacgctgcaggcctgttgccatcagcggcagatggcgctgctgtttatcgatctcgacgggttcaaaacccttaacgacagctacggccatgacttcggcgacgcgatcccgaagacgttctcctcattgctcagctcctgcgccggcgagcgccacagcgtctcgcgtgtggccg

SEQ ID NO: 48882 - DNA, 234 bp, Glycine max
  Peptide Sequence Number=SeqID_165660
atggagaattggcgaagagcgctacgcaataacttcgcggggctccagactcgttggtggaggatgcatgaacagcgccaggcaatgacattcatggggctcccgccaggcaatgacattcatggggctccgttaaaaagtggagaatggagaattggtgaaaagcgctacgcaataacttcgcggggctccagactcgttggtggaggatgcatgaacagcgacaggcaatga

SEQ ID NO: 48883 - DNA, 306 bp, Glycine max
  Peptide Sequence Number=SeqID_165661
atggccaaaatacaatgcccaaaagaaggaaaaacctattctaatatttacaaagataagcgggctcatactttgcccatgggctcaaaatctaccctaaggctcgtgagaaacctagggccttcccttggatctctggcccaatctacttggagtcttctatccaatgcccttgcgggcccaagacatgtgaggagatacatggagaaaaatgaagaaacaacaatggaggagaaggtaaagctgaaaattaatggaggcttaaggagcacctacttgaagctcttgtgctctgataccacttga

SEQ ID NO: 48884 - DNA, 228 bp, Glycine max
  Peptide Sequence Number=SeqID_165662
atggcgcttacctcgatggtggacagtggcgcaggtccttacaagaagctcctcaatgcatgtcactgcaactccgcaatgccctggaacacggtagcgcaacaaacaccgcaaacaaagaagaacaacaacgccatagggaaagggaaggaagtgttggatgaagaagaagaacaacaacaaaagcgcaagaaagtgaagcactgtctgggtgcacaaatgctttaa

SEQ ID NO: 48885 - DNA, 843 bp, Glycine max
  Peptide Sequence Number=SeqID_165663
atgtctaaagaaattgatatgaatgttgaaaatgaggaagatgctggcgtgaaagtagaacacgttgattgcattgatgcctttaatacttctcaggcatgggagggaaatggccagcatgagaagacacgtcgcgatttccgacgagggcatagtagtggtgattgttgtggtgtgggaagaatgtccttggaatctgggttcaagtgcttcaagggaagaagggtcaacatgaagataaattatgaaatgctctatccttgggccaaacaagaggtggtgaagcaaaaatctatatattctgactgggctactttcgcttttgggaaggaaaagcttttcctccctaccaatggtgacgatgatagtattatcattgaaccatgtatgacgtgggagcctgcttgtgccaattggcaaaggagtgacagagccttcatattctccaaacttgggattaggttacctctgactatgcttgagaagagggttttgcagaaatggctcgactttttgccgaaaaagagaaggctgactaagccattgccattgctgttactacaaaagccaccgtcaatgctactgtacattcaagtggactttgaggatggtcttctggctggctcaactagaatagatgggcagtcaccgattgaagagatggggaataattggaaccccatggattttgtaaatccacacaaaatgagggcagcttgttctgggatgtggctttctctcatttgggaggaagtgccggattttaatgccatgatggagcaagtgaaagttgtggccaacgatgttgcctttggagctatcggcccttcaaggaagtggtga

SEQ ID NO: 48886 - DNA, 255 bp, Glycine max
  Peptide Sequence Number=SeqID_165664
atgaagaagggagttgctacgtgcacccagcattattgctggggcacccaacaaatagtgaagtggcgaaactgcccttcatcaattattcttccggaagaagttttttttcggaaacttttcggaaaacctttttccggaaattttccggaaaaacttcttccggaagaagaatttgtgacttccggaagtacccacaaactacttccggaagaacgtcatccggaatgtttccggaagaaggttcttctggaa

SEQ ID NO: 48887 - DNA, 243 bp, Glycine max
  Peptide Sequence Number=SeqID_165665
atggcaatggagccgtttgacatttattcaatcaacggaaatattgatcctcggaaaaaaaatatgctttggctcggagggggtagcaatgtggaagcaatgtctttcaagattgttttgataatgccaaataatcaagagttaagcaaattccaaagattcaagaatcaagaatcaagtttcaagaataatcaagatcaagattcaagaatcaagagaagactcaatcaagataagtactaa

SEQ ID NO: 48888 - DNA, 993 bp, Glycine max
  Peptide Sequence Number=SeqID_165666
atgacttatacaaaccctaccatgttccccctcttcctctccctatccttctttcccttgatccaagcccagctcaccaccaactactaccaaaaaacctgtcccaaattctacgacatcgtccgaaaagccgtcaccgacaagcagctctcgacgccgaccaccgccggcgccacgctccgcctcttcttccacgactgcatggttggcggctgcgacgcctccgtcctcgtcacctccgactccttcaacaaggcggagcgtgacgcagccgtcaacctccccctctcgggggacgggttcgacgcagtggcacgtgccaagggggcactcgagctcgagtgccctggcattgcctcctgcgccgacaccctcgcagcggccgcacacaacctcgttattgcggccggcggccccgccttcgagctccgcctcggccgaaaagactccctggagtccaaagccacagaccccgaaaaccaattccccttaccaaccatgtcaatgtcggaagtcataaaaatcttcacatccaaaggtttttcggttcaagaaatggtggctctggttggtgcacacaccatagggttatcccactgcaaccaattttcccaaaggctcttcaaatttaacaagagttccgacattgaccctgcgtataaccctgaatacgctgcggggttgaagaaactgtgtgaaaattacacaaaggacccttccatgtcagcgtttaacgatgtgataactccgacgaagtttgataacatgtattacaagaacttgcggaaagggatggggttgttggccactgatagcgccatgtttggtgattccagaacgaggcccttcgttgacacgtacgcggaggacgaaaataagttctttcaggatttcgcacgtgccatggaaaagcttagtgttttgcatgttaagactggtacaaaaggagaggtgcggtcgaggtgtgactctttcaacacgcttagttattga

SEQ ID NO: 48889 - DNA, 309 bp, Glycine max
  Peptide Sequence Number=SeqID_165667
atgactagaagcaagaggattcaaaagagctctgacaagaagaaaggttctttcccagaagctgcaaatgatgtccttacaaagaaggaccaagcccctaagaaatttgaggttccttctaatgggaatccaatgccaaagaaggaaggggatgaaaagaaggagatattcaaatatcctcagtgttccactgtggtccttagaaaactaccccctaagatgaaagaccccaataaatttactattccttgtttgataggagggtggtacatttaccacgaccgtggtaatcaccatggccatagttag

SEQ ID NO: 48890 - DNA, 300 bp, Glycine max
  Peptide Sequence Number=SeqID_165668
atgtgctctaacctctataataacttaggggataagaggattatgaagagaggcattaaccaagtggacaaagatgattgccaaattgaatgtggaaaagcatatgcaagctctaaaatgaagattgagacacttatgagagctcaagctcaagtctccatcactacacctccctttccaacctatgatagatgtacgattgtgcataggccaggagaatacactgctaatgatgagttagctaaaaccagggatgagaataattttattggaggaagaaacaactcttataatcaataa

SEQ ID NO: 48891 - DNA, 177 bp, Glycine max
  Peptide Sequence Number=SeqID_165669
atgggtgatgaagacaaaaggaaagttccaacaatcctccacacaaaaagatgcaagattaaaaaagaaacacaaggaggaaagatgactcagacaatgagaagagttgcagtttggacaatgagcaagccaacatctatgatggaagcttgcttatggggcttctatggaggctga

SEQ ID NO: 48892 - DNA, 4848 bp, Glycine max
  Peptide Sequence Number=SeqID_165670
atgaagaggttacgatcaggggagacaaaggagagaagaaactcttcgtcttccatggaagaacctccattaatggcggacgatgagcaccagaacgtgaattcgcttgctgatctaccagctacaacgaaagcagccaccaaatctgggctcacacattctctcacaatcaagcttgatgagaagaattttctcctgtggagtcaacagattccgttgcaatttgcgtcgattgaagattgcgcacttggaatcaactccgatgagtatcaacaatggctaatcaaagatcaaacactcttcacttggttgctatccaccctctccgatggtgtacttcctcgtgtgctgagttgtagacacgcacatgaagtctgggacaagatccacaaatacttcaactctgtactcaaatctcgtgctcgtcaattgagatctgaactcaagaacacgaagaaactctcaagatccgtcaatgaataccttctgcgcatcaaatcgattgtgaactcactcgttgcggttggtgacatggtttctgaacaagaacaagttgattcaatccttgagggactgccagaagagttcaattcgtttgtcatgatggtgtatagtcgatttgacacaccaactgtcgaagatgttgaagcattgctccttcttcaagaagcacagtttgaaaagttcaagcaagaacttacgagtccaagtgtgtcagcaaatgtggcacatactgaaaccaatgccagtgattcaaattctgagcatgagagtcaagaactgggaacagagcactacaatgtcaatgccaatcgtggaagaggtcgtggtaaaggccgtggccgaggtcgtggaaaaggtcaagctcaaaatcaaggcaaagtcaagtgccagatctgtgctaaaccaaatcatgatgccattaactgctggtacaggtatgatcctcaagccatgaatcaaaactcacgcggtggttaccaagtaggaccctccaacaggcctcagaacttcaacccttacatgaggcctactgcacacttggccatgcctcagccctatgccatgcctaatatggatcagttctccaatggagcttggtaccctgattctggtgcctcacatcacctcacctataatcccaacaacctgtcctacagctctccctacactggtcaggaccaagttgtgatgggaaatggtcaaggtgtgtcaattcactctctaggtcaatctcaatttcattcacctaatgaacctaatgtgaagctcactcttaaagatttactccatgtgcctaatatctctaaaaatctgttatcagttagcaaatttgcccaagataacaatgtcatatttgagtttcatccttatcattgttttgtcaaatatcaggattctaaacaagttctccttgaaggcactgttggagctgatggcctttatcagttcaagcctttcaagtttctcaccaacagtggtgctgcctcaaactcagattcaagctcaatgtctagttccagtcaattttctgttttcaataatcctgtcaattgtaataacactgtttctgttatgcaaaatggcaatgtatttcaaatgtggcaccttcggctgggccatgcccacaccagtgctgttaagaacattctaaatctgtgtaatatacctttttctaataaaactgcaactcttccttgcactttctgttgtatgggcaaatctcatagactgcactctcctttatccaatactgtttacactaaaccgtttgaagtcattcactatgacttatgggggccagctccctttgtatcctactatggctacagttactatatcacctttgtggatacttataccaagtttacttggatatacttcctaaaagccaaaagtgatgcacttaaagcctttactcaatttaaagcacttatccaaaaccaatttcaagcatctattaaggccatacaatctgattggggaggtgaattcagagccttcacaaccctgctcaatgagttaggtatccaacacagacttacctgtccacatacctctcatcaaaatgggactgttgaaaggaagcacagacacattgttgaaatgggacttacactactctcacatgcagctttacctctaaaattctgggatcacagtttcactcaagctgtatatctcattaacaggttaccctccagtgctatcccactgtttcagtcaccttaccatgcattgcatcaatctcaacctgattattctcagatcaaagtgtttggctgtctctgttttcctcacttgagaccctataacaaccacaaacttcaatataggtccagtccatgtgtctatctaggagtatcacctcaacataaaggtcacaagtgccttgatgcaactggtcgaatttacatctccaaggatgtgatatttcatgagtctcaatttccctacttgtctctatttgcttcatcatccagtaattcacacatgtctcacacttaccctgcacaaattctgtttccctcagtaaacacaaacacaaatctgcaccctgagacatcatcagctcctgacactgatccacctgatccagtctcaccattaccaggatcagtgtcaccatcatcttccacacctctaactatatctcaaatcaactccctcatatctcaaccaatatctactacttcaccaagtgtccctacacctcctgcagatcctgtgccagcaatcagacctgcttctcaaaacatatctcaccacaatgctcaccccatgatcactagggccaaaactggtaatctcaagcctaaagtatttgtggctgctcttgaacccaaatctgtcaaaagtgctctcaatgatcctgcctggctgcaagctatgcaggcagaatataaagctctcatggacaaccaaacctggacactggtgcctcttccacaacatagaaaggcaattggatgtaaatggatatttcgggtaaaagaaaatcctgatggtactgttaacaagttcaaagcccgacttgtagctaagggcttcctgcaaactgctggctttgatttcacagaaactttctcccctgtcatcaagcccatcaccatcagaattattctaactctggcggttaccttcaagtggtctgtgcaacagattgatgtgaataatgccttcctcaatggcatactacaagaggaagtatatatgacccaacctgctggctttgaggcttcagacaagtccctagtctgcaaacttcacaagtctttatatggcctaaaacaggctcctcgagcctggtatgacagattgacacaagccttactgcaactgggatttgtcaagagcaaatgtgatccatctctgcttattcacactcaaaatggtgcatgtacttatgtactgatttatgttgatgacattctaatcacaggctcagcatcacacctcattagtgatctcattcacaagctaaatatgaagtttgcattaaagcaactgggccagattgactacttcttaggcattgaggttcatcacttaccctcaggagctcttctacttaatcaaactaagtacatcagagacttgttatgcaaggcacatatggaagactctgcaccaattggctcacccatggtaagcagctgcagacttagcaaatacggctcagacaccatgactgatcccactctctacagatccattgttggagctctccaatatgctacattgacaaggcctgacattgctttcagtgttaacaaagtgtgtcaattcatggcacatcctctggagtctcattggaaagctgtcaaaagaatacttaggtacctcaatggcaccctcagtcatggcctactgctcactccatcacccaccagtcctccattctctttaagagcttacagtgatgcagattgggccactgatcaagatgacagacgttcaacatctggttcatgtatctattttggccctaatctcatctcatggggatcaaagaaacaacaactagtagctagatcaagcactgaggctgagtatcgcagcatggcaaacaccactgcagatttactctggattcagtcccttctccgtgaactccaagtgccatttcttactcctaccttactgtgtgataacctcagtgcagtttccctatctcacaatcccatcttacactccaaaaccaagcacattaagcttgatattcattttgtacgagaaaaagtgctctccaaacaactcaatatactacatgtgcctgcccaagatcaactggctgatcctctaactaagcctctgtcaccttctcagcatactgcaattcgtaccaaactcaagataggactattggcaaaatacactcagaagaagcttgatcaacgtgacgggaaggagagagataagtcggtaaaagggatccattatcaacacccagttcaatgtggtagagcaacttcttcagcaagaaaaccttatggtcggtcggtcatcatagtttcggcccaaccaccacgacctacacccgatatcacattcactaatgcaaactttgaaggagtctcccaaattgagaacgatctcgttatcatttttgcagtgattatgggattcaatgttcaatgcatcctggtaaaccatggtagcttagctgaagggatgtattggaaagcatttgttggcctgaaagtcccaaaagatttgatgaggtcgtgtgcgggggtgttgttgggagcattcgtgtcgacgacgcacctaaaagtaaaatttctgcttgaagatgggttagtcagcaccattagcatcaaccaagagattgctcgtaagtcgtaa

SEQ ID NO: 48893 - DNA, 588 bp, Glycine max
  Peptide Sequence Number=SeqID_165671
atggaatcaagcaatgtgaagaacaagtcaagtggaaaaagaaagatgtctagtgaggatacaagaagttacttcgcatggaacttggaaatggaacgtgtgctagctgatgtgcttagagatcaaagaaatttgggcaataaaggtgatggaaattggaaagcagtagcatacagtactgcagctcaaattttgtccaagcgttttggagttcactttatggcagataatgttaagaatcgttttaagctttggagaacatggtatggaattgtgagtgacattcttagtcaaagtggatttgactgggatagcacaaagtacatgattaccgttgaaaatgaaattgcatggaatgaatatgttaagtcacatgaagaggccaaacgatttcgattcaaagtcattcctaattgggatgatattgttgacctatgtgcaaaggatagagctactggactcagagcagaaaatgcattagatgcagatgatatcatgagcaaagaaacaaatgaagaggaagcaattcatagtgtgagttttgacttagagggatcaagttctgccacgagaaaaacattcgcccaa

SEQ ID NO: 48894 - DNA, 756 bp, Glycine max
  Peptide Sequence Number=SeqID_165672
atgtatcgaccaccccaaagcagtgaaaattttcaaaatccaccgcaatatgttatgtgtccaccaccacctcctaccagtgaaaattctcaaaatccaccacagtatattatgtatccaccacccccacacatgtggtatatgcatctttcatccaatgtagagccacctactagtggtagttctcaaaatccacaaatttatagtcaaccatcaactcctaccaactcaaacacgtgttataggccttctttatctaatattgtgctccctagcaataaaattgaatcacccgtcggtgtagacgaagtcgaccaaacatcaaagcaatattgggaaaggataaaaaatgcgtacaacaatgacaatgtgcgtcaaagcggacaattttgtgaaagaagttggactcaattaaaatctcggtggaacaggatccatcctcccgttcaaaagtttaatgggtgctacaaacaagcagataaacataggagaaatggaagttcagagaaggatgttttggctgatgctcatatgatttactcacaagatacagaatttatgtcaaagtattcaaaaagaacaaaggtttctacttctggaaattactcgtcatcttctaacccagagacacccattgaagtcaaagaatatgatacgctatcgccaatgtctcgcccaattggaccaaaagcagcaaaaaggaaaagcaaaggaaaagaatgtcctaacactctcgatttatctggcatagaatgt

SEQ ID NO: 48895 - DNA, 360 bp, Glycine max
  Peptide Sequence Number=SeqID_165673
atgttaaccgataaaagaaaagaggaccgttctaaggcgttggaccttaaaacggttttcagtgatttttgcggacaaagcttaattttcttgttaaaaacggaagaaaaagaaactgatattgaacgaaataaagatgagaaccaaaaaacaagaaatgaattaaaagtcttggatttggaaacttacccgttgaagaatgaagagcggacgaagaacggaggaaaacctccaaggattgcttacggaaacctctcggaagcgttacggaagcacctcgccttggattttcttcacggaaacaatttttttcacccaaaacagctgaaatgcatagccaagggaatcagagacccttag

SEQ ID NO: 48896 - DNA, 99 bp, Glycine max
  Peptide Sequence Number=SeqID_165674
atggcatgggtgacaggagatcctctagggttcatcagtgaatttactgctcagacaaataaattcatccttatcaccatctgcttcaagaggaaatag

SEQ ID NO: 48897 - DNA, 372 bp, Glycine max
  Peptide Sequence Number=SeqID_165675
atggccaccacaccccccgttttgttgaaaaatgggattccggggcttccgggacacccaacgtttttttggagctgggttgcttctggaggaagcaacccagctcgcctgggcgagctaaggtcgcctgggcgagctgggcggcaacctcctccccctttttcctataaaaaggctgaagggggctgttctaaggatccctcagccccctggctatgtatttcagctgttttgggtgaaaaaaattgtttccgtgaagaaaatccaagccgaggtgcttccgtaacgcttccgagatgtttccgtaagcaaatccgtgaaggttttcgtccgttcttcatcgttcttcatccgttcttcattcttcaacgg

SEQ ID NO: 48898 - DNA, 478 bp, Glycine max
  Peptide Sequence Number=SeqID_165676
accacctagggtagacagactggtggtccacgtcgatcttgcgatcgggaaggccgacagtccccacaagaagaaactaagaacatatttggggattgtcactcgttataaggtcgatgtgacatatgagaattggaagcaagctgaatttgatatccctgaagcatctggtggtaggacaaaaaagaaaatacttcagattgtgagggagtggtggacacagtttaagtctgatttgacgttaaaatgggcacttgcagccgacaaggacagtttggatgacactgtttgcgaaaaatacgacactagcaaggagaaatgggcccaattttgtcagagccacagagacccctcatgggagggttatgaatacttagaagagaagctgatggctaagaagacaaagaaaaaactggaggaagctgctcaatctgaaatcaccaaggttgtgattgaccctccatctcccatcaaatga

SEQ ID NO: 48899 - DNA, 1950 bp, Glycine max
  Peptide Sequence Number=SeqID_165677
atggaagaagggttagggcaaaactcagttcctcctcatggtcccattgataagtccaagattctggatattaaacctctgaggagtttgattcctatttactcaatgtcttctcaagctccacctgctggccagtatccttctgggttttctccgtttttcccatttggtgcacctcagcaaactccaactggggtgacgacaaggggtgctgccacacctgctccattaagggcatataagaacccactaggggcaggagactctagttcaacaatgaacgggttcaatggtcaagatacttctgggaagaaaaaacgtggatcaccgtcgcgccacaccaaatcatctgtaaataagcctaagaaaagtcaagagccacctgctgatttaagtggcttagttggtattagccctgcccaaagagaagatggtagccgtgaagtggttaatattgtgctcatggcgtatgatgcacttcggagaaggctctgccaacttgaagaggcaaaggaattgagctcaggttcgatcaagcgtgcagatttgaaagcttgcaatactttgatgaccagaggaattcggacaaacatgaggaagagaataggagcagttcctgggattgagattggtgacattttttatttccgaatggaattgtgtattgtgggcttgcatgctccctccatgggtggaattgatgccttgcatatcaggggtgagtttgaggaggaaactctggctgtgtgcattgtttcgtcaggagaatatgacgatgatgctgaggatagtgatgttataatttatactggtcagggtgggaacttcttcatgaataaagataagcacacaactgaccagaagcttcaaaggggtaatcttgctttggataggagttcgcgacaacacaatgaagtaagagtcatccggggcatgagagatgattcatggatagaaaaagcaaaaggtggcggtggtgtatttaagtataagttggtgagaatacctggtcaatctagtgcctttgctgtttggaaatcaattcagaagtggaaatctggctccccttcaaggactggacttattcttgcagacctttccaatggagctgagggtattcctgtctcacttgtcaatgaggtcaataatgtgaaggcacctacttttttcaattatttccattctcttagacatccaaaatcattcagtttaatgcagccttcacatgggtgcacctgcattaaagcatgtgtcccaggtgatttgaactgctcttgcattaggagaaatgaaggtgatttcccatacactggcaatggcattctcgtgagccggaagccattggttcatgaatgtggccccacatgtcagtgttttcctaactgcaaaaatcgagtgtcgcaaactggtttaaagcaccccatggaagtgttcagaacgaaggatagagggtggggtcttcgatcgctggatcctattcgtgctggtacttttatttgtgaatatgcaggagaagttgttggcagaggcaaggtaagtcagcttgtgaaggaaggagatgagtatgtttttgatacaacccgtatttatgatcaattcaagtggaattatgagcctaggcttttggaagaaatcggttccaatgactctactgaggattatgccatgccgtatcctttaattataactgccaagaatattgggaatgtagctagattcatgaaccatagttgctccccaaatgttttctggcagcctgtcgtgtatgaagagaacaaccaatcatacctccatgttgcattttttgcactcagacacattccgccaatgactgagttaacatatgattatggacttgcccaatctgatcatgccgaaggtagcagtgcagccaaagggagaaagaaatgcttatgcggatcatcaaaatgccgtggttcttttggttag

SEQ ID NO: 48900 - DNA, 207 bp, Glycine max
  Peptide Sequence Number=SeqID_165678
atgattaaattaaaatcccaattcatttttgccctaagcgctcagtctcgcaaaccctctttctcctttgtcttcctcaccctatctcctcctccgcacactgtcgtctcgcaccaaacctgtaactgcactgctgaacctgcaaacgagttggggttcgttactatcacgattaaggatggctcaggtcatggatacccggtatag

SEQ ID NO: 48901 - DNA, 478 bp, Glycine max
  Peptide Sequence Number=SeqID_165679
tcccatggcaagtactttgtctactccttcgagtgacgctacgtcaattgtggcacctgttattggtagccaatatgagttatatgcccgttcaatgcctccaagtgttgttggccaaattggtttgccaaatatgactccgtttatacctccctctagaaggtcaatcatgacaaaggagcctcaacctgaagtcactatagctgatttgatgaacatgaagaaaatggttgaagaattaacaatagacttcatagaaaggttcataaaagctggaagtcattgttcagtacaatttccagaagtagagtgtgcagccatggcaactaggaatatgcattctaggttgaaagaaaaattagtggctcaagagtatggcgaccttagccagctagcttccaaggctaatcaaatagagcagtttatacatgagaaagaattgcaagggctaacaaaggacgaggatctcattggttaa

SEQ ID NO: 48902 - DNA, 276 bp, Glycine max
  Peptide Sequence Number=SeqID_165680
atgggactatggaagtattatcttacccatctcttcgacctcttgacactctcatggcccatacagctggttgttattgcatcgcaattgatccaatattttgctgttggaagtgcttattcccttgtaagtctgtgggacatctcagaaatgctctacatgcgtaccttcacaaagctggattcctcaactggatgcaaaataaacttggtggaaaacaagacaacagaaaaccaaatgcacataaaacaacaactactactactacatgtttga

SEQ ID NO: 48903 - DNA, 3684 bp, Glycine max
  Peptide Sequence Number=SeqID_165681
atgcctgatcctgcacacaatgcctgcccccctaactgccttgaggaggctctacttcgcctcacccaacaacaactccatctcacctccaagattgacgaactcctcacccatgtcacaccagctttctcccctacaccacccccaccacccttccctcaccgtcaccctgcacctgcacccaaccacaaaatgaaattagaagtgccaagattcgatggcaccgaaccacttggttggatctttaagatcaaccaattttttgagtatcatggcaccagtgaccacgacagactcaccattgcggggttctacatggaaggaagggccattgcttggttccaatggatgacaagcaacgaccagttcacttcttggcctgtttttcttcaagctttgcaaacaaggtttgccccgtctcaatacgaggacccaacaggctcattatttaaacttacacagagaggtttagtcgccaattacctgtcagagtttgaagatttggctaatcgcgtcattggacttctggcccccttcctcttgagctatttcgtgtttggccttgcgcttgatattcgtcgcgaggaggagaagcttcacgatcctcgcatgtcgctgcagtctcgccctatgaacccatcaccctcgccgccacccgtaatttcctcccctcgtctctcacccttacaaccactgttatcctctccatcgcgaccctcccaagctccgatcgtaagatgcttgactcccgaggaactcgcctcacgccgtaagcgtgggctctgtttctcctgcgatgagaagttccataggggccatcgctatgcccctagggttcatctcttaatcgttgaggatgatgacccaccagacccagacccctctaaaatagatggcactaactcggctccagttccccctgatgggcctgacccgtacccagcccagataatttttaattctcttttgggccacgttgcaccggaaacactcaggttggtggtgacccttgctcgccatgctatcctcttgttgattgacggagggagcactcataattttatacagcaggccttcgtcactcagcttggtcttccctgccgagccactactcctttaagagtcatggtaggcaacggtcaacaccttgactgctcctatctttgcgaggcagttaccattgacattcaagcgaccttatttacggtggacctccatgttttgccaattgctggcgctaacgtcgttttgggggtgcaatggcttaagtccttaggactcgttcttacttattataatacacttcgcatgcagttctttcatgatggtcaattaatcgaactctggggaaaccatgcggccaccacgcctactaccactaccactcacctttcccctgaactccaagctctcctcatccaattcgatgctttgtttcaacctccacaaggtttacagccagtgagggatactgatcaccatatccaccttattccgcaagcaacctctgtcaaccaaggcctcattcagcccaacacgagcctgttctcgtcgccgatgttgttggtcaagaaacatgatggctcatggcgtttctgcgtggattatcgtgccctgaatgtcctcaccattaaagacaggttccccatccccattattgatgaacttctggatgaactgggcggagcacgttgcttttccaaattggacctgttacagggctatcaccagattcgaatgcatgcggcgaacatccctaagacaacttttagaacccatcatggccattacgaattcaaagtaatgccatttgggttgtgcaatgcgccctcttcttttcaggtggagtacctgggtcacatggtctcgcaccaaagagtagaacctgttgctttgaaaatcactgcaatccaccaatgtccccaaccacgctccatcaaagctctgcgaagcttccttggtctggaaggattttatcgtcgcttcattcgtggatatgccacaatcgcagccccgttagtcaaggtcaccgctattgatcccttccactggaccctacaagctcaattggcctttgacaatctcaaacatgccttgtcgacagtgcctgtgctagccttgcctgacttcaagcttccattcacagtggaaacagacgcgtcgggagtcggaatgggggcttcttcgagcctccacgtatgtctgagagctctttgccatcacctcgacggtcaagaaatggcgacaatacctcatcggccaccgcttcaccattatcaccgaccatcgcagcttgaaggagcttttaacccaaattatccaaactccagaacaacatatgaaccgatgacatttctgatcttatcgatgccatgcttgactttcattgaggaactgtgccgccaactctcggaccatcaggagtaccaacttctgtcacaatggattcgtgcctacccaaatgaccaccagggatactccatctcccaggaccttgaggccatgctggcgttgctaaaaccattgtccgcgtatctgaaaatttttattgggaggggttatgcgatgatgttgctcaatttgtcgccaagtgcgtggatgtgccctcttcctgttccttctcgcccgtgggaggatttatcattggacttcattgccggtttgcctccttttcatggtaacacagtgctcctcgtggtagtagatagattctctaaagggatccatttgggtatattacccgcgtcacataccgctctcacagtagcctctttattcgttgacattgtggtcaaactccatggaatcccacgaagtctgagtaatggtcagactgaagtccttaacaaggtgatcgaacagtatctcagggcctttgtgcatcgccgaccaaaaatgtgggggaagctgctaccatgggtggagtggtctcacaacacttcatggaatgcaggttccagcaccacccctttcgagattacctttggccgtaagcctttcaattttccagaatatattgccgggacttcaaagatcgccgttgttgaagagagcatctcagatagggagatcacattccaagccattcgcaagaaactcatcaaggctcaggaacgtatgaagctttatgctgataagaaacgacgcgaagtcacttatgaatgtggagagtggggaagtccagcaactatcggcaagttggccaagcgtttctacagaccatttcagatcatggagaggataggcccagtcgcctatcgcctgcagctactggagaacgcacgaattcacccagtctttcattgttccatgctcaagccgttcaaaggatcatcggaaaatatcaaaccagcgaagctacccccaaattttgctgatgatcaaccccttctttctcctttagcaattttgggccgacgacgcacatcttcagagtcgaactcaccgtgggaggttttggtgcagtggcaaggcttatccccagatgacacttcttgggaggattggtctcaattgtgccgggactttcaccttgaggacaaggtgactctacaaaggctgagggatgatacaggggcaacaaaggaaatgactcaagcaatgaacataaaagcagaaaaggaggtgttggacctcgaatccagtaggcatttagagcctatcacaaagcctcaccctaactag

SEQ ID NO: 48904 - DNA, 843 bp, Glycine max
  Peptide Sequence Number=SeqID_165682
atggctggtgatggtggttatcttggacgcgaaacaagcacatggcacacaagcagaaagaaacatgagatgacatacttttcaaggttgggtctaatgtacatcaccctcacaatacaagcctaccgaggtacacaaactcaaggtgcatacttatcactttgggatgttcattcgtcatccaagtaccatgtatgtgaaagtgataaggatgttttgcaattgactaatgattgcaaagggtttgaaattgttgaaatctatgtgaagcatgttattgatgttcctataattggtgaggagtttgtcaatgaaggaggaagtgattttgttacaattgatgatagtgacagtggcggggagggtgatgtacaaaggaagggtgtgggtgatgtttcggatgctaatgcacaaggtgaatgtgatcatgttgttgttgctgatgtagagggtgagggtgatgtagttgttgttcatggtgagggtgatactaattcttttgaagatgaagattatgttgctgaagagaattctaacaatgagtacacatctatggaagatagtgattatgaggagaattgggattggactatagtgttggacacagatttgtttggtgaaactaaaccaccatttagccatccaccacctggcacaacaattataatcttgaggcctatgtggctacctgttatagcaccacttggtagccaagcatcacatgctacactaccaatcagtcaaacttcatttggtagatcaacctgccataatgtatctgaatctacaccacagactatgtaccagtctcctaggaaaaaaacttgcttggatgtggagtga

SEQ ID NO: 48905 - DNA, 906 bp, Glycine max
  Peptide Sequence Number=SeqID_165683
atggccaacttagaatcccaccctcattccccaacttcatcctcagcaataccacacaccgctttcccttctaacccttactgcattaagcttgaagtctcgcattttgatggctctgatccactggtatggatcttcaagatcacccagttctttgagtaccaatcgacccctaaccatgaacgtctcaccattgcttccttctatatggacaatcatgcactgacgtggttccagtggatggctagcaatagtcaactttatgacaaccccactggtgctctgttcaaactcacccaacgtgacacggttaacacctatctccctaagttcaaggcccttaccaatcaaatcattggtcttcctccacccttcctcttgagctgctttatttcttatttagtgtcgaaaatccatagggagtgcaagcgctacaacccttcggcgttggtccaagcaagcaggttgtctccggaggagttaggtacacatcgcaagaggtgtctctgtttcaactatgacgagaaggtccatcgtggacataagtgtgcctccaaggtattcctattgatcgctaaggatgatgatgatgggcaagaagatcaccaacatgtggaccatgtacccaatccacaagaggttatcgctccaaccccgacccagatcagcttacataccctctcagaccacttagccccaaagacattatacttattgggccagattgcatatcaacaggtgattatattaattgatgggggtagcacccacaatttcgtccaggagcatttggttcacaccctaggcttaccaactcagcctacgacaccactttgggtcatggtaggtaacggtcatcaacttgattgtcatctccttaatgaggcagtcacaatgcacgtctag

SEQ ID NO: 48906 - DNA, 303 bp, Glycine max
  Peptide Sequence Number=SeqID_165684
atggtgtgccaaaatcaccaacttcataaagtaaacattaaagatgaactagaaagcattcaagccttcctcaaagatgtaaatagaagggttgttgcagatgaagcaaacaccaacaatggaataaggacatgggtgatgaaggtcagaaaagaatcagttcgtatagaagatgtcattgatgcatacctcagggtgattcatgtagtcaaagaccaacctcctggatgtttggctttaatctgcaagattacaagcttgatcagaactttgatttctcttcatcagacaacaagagattaa

SEQ ID NO: 48907 - DNA, 198 bp, Glycine max
  Peptide Sequence Number=SeqID_165685
atggacttttctccattgcagaaatgcatcgatgttattcgcatattggcatatgggtcatcgactgatagtgtcaatgattatgttcaaattggagaaatcataactttactatgcttggataagtttgtaaggagaggatatttatccagactaggcaacgcttgtgaagatcatcccaaggccacaaggtcataa

SEQ ID NO: 48908 - DNA, 1050 bp, Glycine max
  Peptide Sequence Number=SeqID_165686
atggtgaatcattggcagtgggtccaatacaaaatatggaaactctttagcaataagccaaatttggcacttgtggccattggtggtctattgtcaacaaaatccattgtggtcggcgcttgtggccattggtggtcattgtcaacaaaatccaaaactgagtctgagtggaaaaagatcagccaaaatgtaatgattctaaactttgagttgtggagtattggccttctaaatgatttaacaaagattttatctcttggttatgatgacctaccttactatttgaaaccatgcattttgtattttggtatatatcctaaggactactccattcatcataagaggttaactcgacaatggatagctgaaagaagtctggttcaagattccatagttggctgtgaagggaaatttaaaagttttcaagtccatgatgtattacatggagtgatcattgcaaaagcaaaggacttaaactttttccattttgtccatgaaggtgatgaatcagccgcaagtggaataactagacgcctatctatggacactaggtccaacaatgtgcctaggatttctaaccgcaatcacattcatactattcatgcttttggagaaggaggatttcttgagccttttatgatgggtcaattatcttcaaagtcatgcttgaaggtacttgaacttgaaggtacatcgttaaattatgctcctagtaatttaaggaatcttgttcacttaagtcgaaactatcaagcagagttttctgttttgggatttacaattggtgtgctagtgaaaaaaggtattaaaaacttgacttccctagaagttcttactcatgtggagctagatgacaggggaataaatctcatccaagagatgagaatgttaaatatgttaaggaagttaggcttaaggcgtgttcggagggaatatgggaatgtaatatgtgctttagcggtagagatgacacaccaggaatcacttaatatcactgcaatcaagattatcaaactcgagagtctatgcaaactcatgagagttctatag

SEQ ID NO: 48909 - DNA, 357 bp, Glycine max
  Peptide Sequence Number=SeqID_165687
atgcatctcttccatatccccaaccatgtcactcttttttgccaacattttaatgaccccctagatgatgaaccctttgttaagatcaaatgttcctttgctattggagttgctgctattgcatcctttggatatcagaaggatatggatgatcagagggtgcggaaacaagaccttccacctactgttcccgatgaacgtacgccctcaccaccgccacaaagggattcctcgtcttcactactgcatgatgctctcactgaactttgggatctttgggcctttctaggtgatcgttttgatgctatggattcatgcataacacgtcaagaggatgatatgagctttattcgttga

SEQ ID NO: 48910 - DNA, 1581 bp, Glycine max
  Peptide Sequence Number=SeqID_165688
atgtcgtcgacgacgcagaatcgtcgttcgtcctttacttcctcgacagcgtcgtctttggcaaaagcgaaacgacttccatcttcggtgtcgttgtggtcgtcgtcggggaaggcgaagagggttactactcagaacgtggctgtgaagagagcgcctctcgccaacctcaccaatcagaggaacgcgtcttcttcttcttcttcttctttgtgtgctcggaacaaggtgcaaggtggttcaattaaagtttccaagaccaagaaagaggctcctgcaagaaccagcatcacaaaatcaacaatttcttggaacaaattacccgagttaaaatctgttaactcaagctcagttgttattccaagggctaattctttaccacgaaggaaggatgctgctcccacagttgcctcattcgccgtgcctgtccatagcagtatcgatgtttctcctagtaaaatagatggaaggtccgtttctatggatgagacaatgtcttgtgattctatcgagagtcctgatgaagttgaatatatggataacagggatgtttcagatgttcattcaattcagagagagataacaagcaatttaaacatttctgataccaaagagccagaaggagacgtatgtagtagggaaataattgttgagttggaagaaagagtggacaagattgtcaatattgacaatatttactccgatacgcagctttgtgcaacctatgtttgtgacatctacaagcacctacgtgaatctgaggaaaagaaaagggcttcccctgacttcatggacagaattcagaaggacataaatgttggcatgcgtgctatattggttgactggcttgttgaggtggctgaggagtatcgtcttgtacctgaaacattgtatttgacagtgaactacttagatcggtatctttcagggaatgctatgaataggcaaagtaaatatgaggagatttgtgctcctcaggtggaagaattttgttatataaccgacaatacttacttaaaagaagaggttttgcaaatggaatctgctgtcttgaattatcttaagttcgaaatgacagctccaacagttaaatgtttcttaagacgatttgttcgtgcagctgctcatgatgtccaggagatcccttcacttcaactggagtacctaaccaactttattgccgaattatctctcttggagtacagtatgttgagttatcctccatcactgatagctgcttctgtaattttccttgccagatttatacttttcccttcaaagaaaccatggaattctacattgcagcattacacgctctaccggccttctgacttgtgtgcatgtgtaaaagatctccatcgtctttgttgcagcagccatgattctaatttacctgcaatcagagataaatacagtcagcataagtttgcttacttcctcctcatacttcacttgtgcacagtacaaatgtgtagccaagaagcacatccctccttcaatacctcgagaagttttccagatcaactgaacaaaggaattcaacgacaatccaataattgggatgcacatgctaagttttga

SEQ ID NO: 48911 - DNA, 513 bp, Glycine max
  Peptide Sequence Number=SeqID_165689
atgaaaggcggtcgtatttggctgcctcaaggatcaccattcattccaactctactaatggattttcattcatctccgacaggtgggcacatgggaattgcaaaaactctcacgcgaatcagcgagaactttagttggtctgggataaagaaggacgtcaaacactttgtagtagtttgtgtcgactgtcaacatacaaagtatgaaaccaaaaaaacagtgggtttgctttgcccattaccaattctattttggccatgggaaaatctctctctagattttactatgggcttaccggcatatcacgactataccactatccctatggttatggactgtttttcgaaaggaattcacttggggatgcttccacctcaccatacatctcacactgtcgtgctactttttatggacattgtcaaaaaactccatggaatgcccataagcctcatcttggaccgcgatcctctattcattagtcaattatggcaggagctgttccgattgagttga

SEQ ID NO: 48912 - DNA, 275 bp, Glycine max
  Peptide Sequence Number=SeqID_165690
atggatatgaggaggcatttggaagagatcacgcatataaagctaatagatcatctaggcaagtatccaggcaaataccaactgattatgttagagaaagtccctgaggtatcttggtgggatgatcttcctcttgggtctctccttcaagcctgtggtgggaatctactgcatcttctccttcctaccaccccttatgccatccaaaagtaccttgtcatcaaggtgataagtggccttcaacgtctctcattcctcccacaaagtttcatcag

SEQ ID NO: 48913 - DNA, 1152 bp, Glycine max
  Peptide Sequence Number=SeqID_165691
atgagaaacccatcactaccaacattagcaacaaccaagaccaaggtgaagaacaatagtaacaaaagtaccaacaacaacaacaacattggtaccaactactctccatgctgcaacaatgttgggttgaagcgagggccatggacgccagaggaggacgaggtgttagcgaattacatcaataaagaaggagaaggacggtggagaacgctcccgaagcgcgccggccttctccgctgcggcaagagctgccgcctccgctggatgaactacctccgcccctccgtcaagcgcggccacatcgcccccgacgaggaagatctcatcctccgcctacaccgcctcctgggcaatcggtacacataccatcttccgtttaagggtttaggtttaactgatcaattattcccacaaaaattagggtggtctttgatagctgggaggattcctggaagaacagacaatgaaataaagaactattggaatacccatctaagtaagaagcttattaaccaagggattgatccaagaacccacaagcctcttaacccaccatctattgccgttccttcttcttcaacaacttctactattccaccttctaaacctcctccagtgatcatcaccaacaacaacattaacccttttcatcacgatctcaccaacatgtttaaccaaggagttcatcttaatcatctaggtcaacatcaccaacctcctccactttctaatccctgtgataaccataacccagtaccagctgctgccaccgatgatgtttctgcaatgggtttcatggacaacaacaacgaggattgcaacaacgatggtatcaacatcaattattactccgacgatgtcttttcttccttcctcaactctttgatcaacgatgatgcttttgaggcgcagcagcagcagcaccacgtgcaaacagagatccccacacccagtgagcgtagcattaatccactgccatgtgatgatcgtgtcgatgatcatcatctgggttcaatcaccactgcttctgcatcgcaaggttatgacgatgagcttggggttctgtgggaatcgccactcgtgagtgctactttcagccaacacgttaacgatcacatcacaaagagggttcatgatcaccacaatcaatag

SEQ ID NO: 48914 - DNA, 285 bp, Glycine max
  Peptide Sequence Number=SeqID_165692
atgcaaattctgacagatgctcatccattttgtggcgttctggtcgacatggatgccggcatggcagaggctggggcagcacacggtgagcttgaggagggaggaccaagtggagggggaaacggaggccagggatgggaaggtttgggagcagaagtggcgaataaggtgagtgttcgcaacaacccaccatggtgcctcccaagcaagaaagagaaggaaagaaatgagaatctagtggtgccaccgtcacaatggcccacgatggcggattgcgaagattga

SEQ ID NO: 48915 - DNA, 258 bp, Glycine max
  Peptide Sequence Number=SeqID_165693
atgtcattgaaaaacctcgtcgtgcgcctaggagttcatgacaagacaaaccacacactaataagtcaggtcactctcactagaatttccaagcgtcacagagaagaagaagaagagattgtaacctccaattcactgtcaaagtgcgagactaatttatctctgcaagaacattatttcgcaaatcccaacgatgtgtttgggtgtatgcgggaaaagagaaagatcagtgcgagggatatttcttccaccatgtaa

SEQ ID NO: 48916 - DNA, 702 bp, Glycine max
  Peptide Sequence Number=SeqID_165694
atgcccaactcgcacccagacacgaacatcatccctccaaacttaaacccaacccacaattccagtattacttacactcatggcaacacattacctcacaacctcatcccttttccaccccaaaactcaaccaactctgaccaatcttttttattggtgagccttggtaaagaggagtggaggtttagcttttctttcgactgcaggagatcttttcaaaagctttttcattttgaaaattcatggcttttggaaccttctcttaatgctatagttgaagaaagacaagttaaagtggccttcgagtcccaaattaatctttgtcgtagagaaatgaaaatccttaaagaagaaacaaataaggaagaaaaaaaccattttgccattgctaaagataaattgaacaacttaattgctcaagaagaggcctactggaagcaaagggaaaaaatggctgaagaggaaactagcaccttgacaaacatcactgacgcatatggaaaggattatggtcaattgataaatttgcaaaaattagagggatttggaggcttgggatttagacattcttatggctttaaccttgccatgccatggtgttcaaagctaaatactttcccaatggaaaattcttggacatctctctcgaggacaatccaagttatacttggcgtcgcatccatgctccgcagactttggtaa

SEQ ID NO: 48917 - DNA, 318 bp, Glycine max
  Peptide Sequence Number=SeqID_165695
atggatggaaacttagacagttctgtgacgataatttgttcctctgcaactagcacggctgcgtccactcccaccactggtgcaactacatgctcttccgagagaaggaagatcaatgtcgagtgcgccttctgcacgtgccagcccacgtgggatctccaagctgccttctgccctagacgtgacttcggctaccatctcgatgaggaggtgctgaagatgaagaaggcgcaaaagaagaccgtgcaggcggatgaggaggaagagaggttgctcgaggacaaagatgacaacatgaggaacgaccaacagagttaa

SEQ ID NO: 48918 - DNA, 279 bp, Glycine max
  Peptide Sequence Number=SeqID_165696
atgaaggaaataagaaggagggtgatgtacatgcctggaccgagggacggagcgttgtggggtggtaacgctgatacggggggacagaagaattgggcctctggtgcacggggacatgaggcgtgttccggaggaggaatatggaagaacaaggtatgcttgaatggtggtttgagtttgaggacttcggtggttggggctgtgagctccctcaaccttcagctcataaagcatctccatcgccatctctacgcttctcaatgtactaaatacatctga

SEQ ID NO: 48919 - DNA, 296 bp, Glycine max
  Peptide Sequence Number=SeqID_165697
gtgttgagggaaggagcccagagtatgaaaaacctcgggatttgaggtcaaatcctttccaaggtgtagggaatgagcttagttatgagagggcatcatctccaagcttcttatccaaggctcatcttggtggtgaagctcctccttccatggcttattccttactacaaagactactcagaatgccccgaaatacaaggctaaaaccctatactactggaatgaccaaaatacaaggcccagacgaaggaaatacctattctaatatttacaaagataagcgggctcatacttag

SEQ ID NO: 48920 - DNA, 904 bp, Glycine max
  Peptide Sequence Number=SeqID_165698
tgaggaggaactggaagaacatttcagtcgctttggaagtgtctcacaggttcatttagttgttgataaagatacaaaacgatccaaaggaatagcatatattctttatacagctccagatatagcagccagggctcaagaagagttagacaattcaatctttcaaggaagattattgcatgtaatgcaagctttacaaagacattcagataatcaagagaacaatgttttgaaggaccaaagatctaaaaccctcaaacaacagagagaggaaaaacggaaagctgatgaagctagtggagatactagagcatggaatagtctgttcatgcgtcctgatacattcagaaaccattggtcacttgatcctacacttttagcaatattttctcatggggttgtggaaaacatcgctcggaaatatggtgtcaataaaggtgatttacttgaccgagaagctgatgatcttgctgtacgtatcgctctgggagagactcaagtgatttcagagacaaaaaaggcatttaaaaatgctggagtgaatgtggaggctttggaggaacttgctaataataaaacagatggattaaaaagaagtaatcatgtgcttttagttaagaacttgccatatggttctacagaaaatgaacttgcaaagatgtttgggaaatttggtagtttggataaaataattctccctccaacaaagacattggcactgtggattggtgaactttgtcttcagcagtcaagtattggaaacattatcgctgtcactgttacattgtttaatgatatttatgtcaagctgagttatttggagatgatatttcaggttgttttcctcgaaccagcggaagctcgagcagcttttagaggtttagcttacaagcgttacaagtaa

SEQ ID NO: 48921 - DNA, 309 bp, Glycine max
  Peptide Sequence Number=SeqID_165699
atggatgctaccatttttaaggagcaagatctttatggagcagatatcaatattcgtagggatcaaggtaatttcatctcaacaaaaacagttctagcaaaagggaatattgaaccaaaggaagttgaggcttggtcattgctgcaagcactcaagtggctatcagaactgcagtttcatatcttcatccttgagatccactgcaaagctatcatggattgtctaaacttgaatcacaaaggattatcggatttttattatctcattcaaagttgtaatactgttcttcattgttatccaaactctaag

SEQ ID NO: 48922 - DNA, 453 bp, Glycine max
  Peptide Sequence Number=SeqID_165700
atggttgaaatgacaacctcctcaaaaacgtcggggtgggaggctttgagaatgtggaggcatgaaccgccgaacatgaaaggcatcaccacccacagattgtgctcgcagggagacgaccacactgagagtgatctcggagcgcgtgcagagagggctcggggggaagacgtccatgccgagagaaagaagtgcgaaggttttggcacagtggaggagctagccgtaggagaggcgatggtcggtggcggagtcgataatggcagtggaggattccgggaacaacgagttgcaacgaaggaaaaggacaaaggaggcagcggatacggcagtgttgggaagagggaggcagagcagaggcttgaggctgtggaaggttctggaatcgcggttgaagataagataagagagagagagagagaaaatgaagggcgagtgtgtatacgtttgtag

SEQ ID NO: 48923 - DNA, 447 bp, Glycine max
  Peptide Sequence Number=SeqID_165701
atggaggccacgaaagagcaaatggccacaatgatggaggccatgatgagcatgaagaagataatggaagccaatgcggttgcaattgccgctaccaacgttgttgctaaggtgaacccgatgcccccatctggcctcaaccaaatgaatcatccaacctcaactatggtaggcaaagatttgagaggtacgggcggccctcatttagtgcgaaaaacaagcatgccttcctaccatatggcttgcctcgcaactatacggcacccaatgtggcgtacactcccaatgagaatgtcaataactccgctcctatactcattcaaagccaacaacctcaatctgatcatgcacatgtctcttgacccatgggggagacacatgaaatgccccaccacaatttatttgactttgagccttgcctcggatatgccattgaagggaaagtag

SEQ ID NO: 48924 - DNA, 759 bp, Glycine max
  Peptide Sequence Number=SeqID_165702
atgaccggccctctccatgagtcgatctcttgctttctcataagggtggacccttgggtactagtacctatcaccttcagaggactacacgtcctcgcctccagaggactacatgtcctcgtcttcagaggactacacgtcctcgccatcagaggactacacgtccttgcctttagagggctacacgccctcaccatcagaggactacacgtcctcgccttcgtagggctacacgccctcaccttccgaggactacatgtcctcaccttcagaggactacacatcctcgccttcagaggacaacacgtcctcgccttcaccttcagagggctacacgccctcaccatcagaggactatacgtcctcaccttcgtaggactacacgccttcacctttcgaggactacatgtcctcaccttcagagaactacacgtcctcacctccagaggactacatgtcctcacctttagaggactacacgtcctcgccttcagagggccacacgccctcaccttcagaggactacatgtcctcaccttcagaggactacatgtcctcaccttcagaggactacacgtcctcgccttcaaagggtcatataccttcgcctttgtagggctacaggccctcaccttcagaggagtatacgtcctcaccttcaaaggactacgcgtcctcaccttcagaggagtatacgtcctcgccttcagtggactgcacgccctcaccttcaaagggcgacacgtcctcaacttctga

SEQ ID NO: 48925 - DNA, 210 bp, Glycine max
  Peptide Sequence Number=SeqID_165703
atgagcaccacatcttcaaccgcatcaactgagatgaaaaatggcatcatgcgacgaccactgatcatgcaatttatcgctgccttcaacaatgacaagccttctatcatactcaatgggcaccaaactatcatgagtttgtacatctcagatacaatggagccatttatgaaatacgagtcagacaacacagagacaaagtgtatttag

SEQ ID NO: 48926 - DNA, 410 bp, Glycine max
  Peptide Sequence Number=SeqID_165704
acccgcgggccgttaaacccgccgctgcgggcgattgccaatcagggagcgcacagggggcggccaatcgccgccgccccctgtacccccgggctctggccgccaaaatcgccacttcgtggtaccttcgacttatcccgtcaggcttcgggacgggccgaggcagcgtccgtgcaaaacacggccctcagcccgcatccatgcgggctgccccggccttccgggaacgtctcagcgattttgaggccaccaacaccggcaccgccatccggcgcgaaaatggctcgttacccgcggttattgcccggcggcgctgcgcttgcgcgggcctacagatcacatgccggcgtagtccggatgaggcgttagctgccacccgaggggctagctcgcgctatcaggcatcctga

SEQ ID NO: 48927 - DNA, 528 bp, Glycine max
  Peptide Sequence Number=SeqID_165705
atgcttccggttctggttcttcttctttttgttgtacttctgatttgggccaagggatttcagtttcttcgtcttgggattttagccgtgcaaggtttggcttttggctctattttgattagattaagggcaaagcttagatgtagttccttaggtgcttttggtgcacatgtgtctagtaggaattctgggggtagaaggagcaggagaaatagctcggagtcatctgggacttttggtgggaggaggtggaagcagaaggagaagctaaaagttaccaggcaaaaaccattcaagttaaggactgagcataggggaaagttgaaagaggaagagttggtgaagaaagtacaagagatgatggctgaagaagagaagatgaggataccaattgcacagggtattccgtggacaacagatgaacctgagtgcttgttaaaacctacagttaaagaaagcacaaggcctattgacctaaagcttcatagtgatattcgggcaattgatcgtgctgaatttgaccaacag

SEQ ID NO: 48928 - DNA, 288 bp, Glycine max
  Peptide Sequence Number=SeqID_165706
atggtgagaatggcaatgtgggtcggtgagaatataagccaaagaggcgttgagatcgaagagggtgtgcgtgtgaggaatatgagaagacaccgaaaaagggtaaaaactaaaaagtgcaatgaggtcactgattttgcatttgtctcggagacatgtttgatgtttccctctagagccaagtgcacaacgttggtgtcttcaacgatcgaaacagcttccaagtgcactgatcgatctatggccactgcttttgctattatcgtggccgattttgtaggtctttga

SEQ ID NO: 48929 - DNA, 874 bp, Glycine max
  Peptide Sequence Number=SeqID_165707
atggcctctttctcggtcccatgccccaagtgtcctacaacttcttcttctccccctttggggttgaaatctctaaatgtttcatttcaaagggtgttgagcttgaagccttctctttcattcggatctttgtctgctgaatctgctgcatcaaggattcagtgccttaacaggaagcaattttctgttctgaaggctactaaagttgaaaattccaattctgcccctgtaatggtcaatggacctaatgttgcttcatcgaaagaaaaagaagtgcataatggaaaactctctggtggtactatcccagatgatgcttcaattattgcattcatgtctcaagtttcagaccttgtaaaactcgtggattcgagagatattgtggaacttcaacttaagcaatcagactgtgagctcatgataagaaaaaaagaagcattgcagcctccaccagttatagccccaacatccccaccaatgcactatgccacagttccttctccgccaccaccaccagcagctgctcctgctagctctgcacctccaaaagcagttcctgccttgccttcccctgcaaaagcaggcacatcttctcacccaacgctgaaatgtccgatggcaggaaccttctacaggagtccagcacctggtgaacctgcatttgtcaaggtgggagataaagtgcagaaaggccaggttatttgcattatcgaggctatgaaactgatgaatgaaattgaggctgatcagtcaggaacaatagctgaggtattagctgaggatgggaaaccagtcagtgtggacacgttccatgagtaccagaagggaccttacttcgaacttgatgtgaaatctcccttgttggagcagcatg

SEQ ID NO: 48930 - DNA, 2067 bp, Glycine max
  Peptide Sequence Number=SeqID_165708
atggttgcacagctacttgagagtatactattcataattgatgctgtgcttcccatgcttgggaagttgcctccgagtattgttggggaactcgagcaagatttgaaacagatgattgtccggcattctttcttgacagttgtccatgcctgtatcaaatgcctctgctctgtgagtaagatgtctggaaaaggggctgctgtagttgaacaacttattcagttcttcttcaaatgtttggatactcaggcagttgataacaaacagaaagttggacgatctctcttctgtcttgggttgcttatccgttatggcaatcaattgttagcaagctccagtagtaaactcattgatgttggacgcagtgtcagattgtttatgaagtatctctctgtggaggattttgttgtcaaggttagatcactgcaggcactaggatttgttctaattgctaagcctgaatatatgttggaaaatgatgttggaaaaatactggaggaaacattatcctctgcgtctgatactcgcattaagattcaaggattgcaaaacatgttcgagtatcttctagaagctgaaagccaaatgggaaccgataaaaatgatgaaaatgttgctggttattcagttggagctgggcatagtgtacctgttgctgctggtgctggggatacaaacatatgtgggggtatagttcagttgtattgggataatattttgggcagatgtttggatttcagtgaacaagttcgtcaatcagccctgaagattgttgaagttgtgctgcgccaaggtcttgttcatccaatcacctgtgttccataccttatagcccttgaaacagatcctctggagtcgaattcaaagttggctcatcatcttctgatgaatatgaatgacaagtaccctgcattttttgaaagccgcttgggtgatggacttcaaatgtcatttatgtttatgcaatctatttgtggaagttctgaaaatgttgatcataagattcaatctaagatccctacttctggaaaagggaagcctgaggctgggtcacttgctcaagctaaacttggggtttctcgaatttacaagctcatccgagggaatcgggtatcaaggaacaaatttttgtcctcaatcgtgcggaaatttgataatccaagatggaataaattagtaatagctttcttaatatactgcacagaagtcctagcattgctgccattcatttcacctgatgagcccctttatttaatctatgctatcaatcgagtagttcaagtaagggccggaccactagaagcaaactttaaagcctggagttcaagcatttcacgtcataactcaccttatgggaatggaatgtatcaacaggggccagatgagcctactgttacaagccaagtaatgtcattggatttgaatggaacatttcagcaaaatgtagatgttcagccaaattccaatgacatgagaaccctggatttaaatggatcaaatcatcaactgccagattatcctttatcgtatatgggtagctcagaagcaaagctgcattctgcaggttacacagatcctttttccttctcaaatgatgatctggagaaagttcaggccgattgtttatcagcaattgcattgcagcttcttttgaagctcaagagacacctgaaaatcatgtatagtcttgatgatgcccgttgtcaggcttattctcctaccgaacaaccgaaacctggagaggttatctccagacagaatattgcttttaatatcggtgattcacagttcagtttgcctacaagtccgcaagaattgatacaaagatatcaggaatttaaacatgctttgagggaagacactgtggactattcacattacactgcaaatataaaacgaaagcgacctacagccacaccaagaagagttcaagttcggaaacctgtatacgtggcaggtgggtacgatgatggggatgatgatggggattatactggtggaagtgagatgcacaagataagttttagtggccgcaggagtagccttagaaactcaaggcaatattga

SEQ ID NO: 48931 - DNA, 308 bp, Glycine max
  Peptide Sequence Number=SeqID_165709
atgtcattgcctagcgctgttcatgtgtcctccattatcaagcgcggagcctctggtgactgggaaatatgttcttctgttgttttccggatcggttccttcgccaaacatgtcaaaaaagaaggagtagagacgagaatcgtcatcacagaaagggcaggatggacgaaatcagtgtcttatctttgctttcctcttatctccgatgagagatatttggcaccctttgttgcacaatatgtgaagtcccgagacatgccgaaaatcaaaaggaagcaggcttacgcgatccgtgaaaattccgtgat

SEQ ID NO: 48932 - DNA, 2580 bp, Glycine max
  Peptide Sequence Number=SeqID_165710
atgagtttccctgccacctctggcgcctcggccgccgcgctgtcgtcctccggccaccgcggaatcggcctctccaacaccgtccactccgagctcgccgcgtgcctcccgctgccgtccctcccggtcttctgcggcgcctccgatcaggacctccgcctcgtggactcgccggcgcgcctcaaccgcgtcgacgtgctcgctcagtccgccaagatcgccgagctgctccgccacaccgatgtgtcgtacttgaatttaagaggtgaagccaaaggtgttccgtatatatatgttgagcctttagaactccatgacgaagttatcaggtgcaatcctgaagcatttgaatacagcactgcaggtcctgtcaaggagcagatctatggtagtgcagtatctgaaaaaaggaaaccggaatcaagttttcctatccaaagagagactcaaaaagactataatgcaacacatagtcgccagcttgataatttttccacaaatgatatctcttcgttgtcttctaaaaaatcaaaaataaaaaagaaaggtggtgatggaatatctgtagcacctgattctgctgagcttcaaggtgcctacattgaaaggtttcgtgagtttttggaggacttgtgcaacaaatctgaatttaatagtgacgatcgagatgaagcagaatggttgccattgcctcttacagatcttagattacttgtcaatgaaataacatctattcgtgaaaagaaacttctgcatttggttcctgtagaagtcctagttagactattaaaagttctagatcatcagatacatagagcagaaggcctgtcaattgaggaatgtgataattcagattcagaattagtttcatctgttttaattgcattggagtccattcatgctgcactagcagtgatggctcatactgatatgccaaagcaactctataaagaagagatcattgagcgaattctggagttttccaggcatcaaataatggatgttatgtgtgcatgtgatccatcataccgtgcgctacatagacctagtgaaaacactgcatttgaagttgatgattatgaagataatgatgctgaatttggttcagccagcaagaaacggcgtactagcaagacttcgaagttgaagaaatcagtatcaagcagggtctctactgctgtaaatactattcttcagaagctgtgcactattcttgggttactcaaagatttgttgttaatagagaggttatcagatagttgcatactacaacttgtaaaaacaagcattacgacatttttggttgataatatccagcttttgcaattgaaggcaatcagtttactcagtgcggtactgatacttctcctttatagctctgtgattgttatctttcatgctcatatgatgatattctatttatacacacaacatcgcacttatgtgatggatgaagtggttcaacttctgtggaaattaccatattcaaaacgagctttaaggtcttatcacatacgcgaggaagagcaaaggcagatccaaatggttactgctttgctgattcagttgattcattgtagtgctaacctccctgatgctttaagaaaagcttcaaatggtaatgctgtattagaagcctctgttgatgctagttatccaattaaatgccacgaggcagcgacagaagcctgctgtctgttttggagccgggtacttcagcggtttgcaagtgtgaagactcatgatgcttcggagctgaaatccataatagagaatcttgttacagatttactgacaactttaaatttacctgaatatcctgcttcagctcctattctagaggtagatcatgtgtgggtactctgcgtcctactacttcagaatgctgggccaaagtctaaggatgtctctgcacgttccctggcaattgatattcttggtacaattgctgcaaggttgaagcgcgatgctttggtttgtagccaggaaaaattctggatacttcaggatttacttaatcaggatgctgctgctcagcatcatccaaaagatacatgttgtgtctgtttggggggaagggtagaaaatttgttcatatgtcatggttgccagaggctttttcatgctgattgcctgggcattaaagaacatgaagtttccagtcgaaactggtcctgccagacatgcatctgtcataagaaactacttgtattacaatcatgttgcaattcccagcaaaagaatgatgtgaaaaagaattgcaatacagattctgaagtttctaagcaagagattgttcaacagttgcttctgaattaccttcaagacgttacctctgctgatgatctgcatcttttcatctgctggttttatctctgcttgtggtacaaagatgattcaaattgtcagcagaagtccagttactaccttgctagaatgaaatcaaaaatcataatccttcttcaacatccatggcttccacttctcagagtttcgtcttgcactcgtttccgacctccatcgccgagaagctcaacgattccaactacctacactggtgacaacatgtcgaaccagtaa

SEQ ID NO: 48933 - DNA, 804 bp, Glycine max
  Peptide Sequence Number=SeqID_165711
atggaacgtgtattggctgatgtacttagagatcaaaggaatttgggcaacaagggtgacggaggttggaaaaggtcagcattgaatgctgtagccacagtgttatctacaagcttcaatgttaatgtcacatcagataatatcaaaaaccgtatcaaattatggagatcgtggtatggtattgtaagtgacatccttggccagagtggatttgattgggatggcactaagcacatgatcacagttgagaatgaaaatgcttggaatgaatattgcacttcgcataaatcggctaaaccgtttcgatacaaggtgcttcaaaattgggatgatatagtggatttgtgtgctaaagatagagccaccggtcatggagctgaaactgctatggatgctgatgaagcgatgagtagagaaacaaatgaagtggaattcatggggttaggtgctactgccatagatttagaagaaccaagctctaatacaaaaggaaaaagacaaggttcgacttcttctggcacacatcctcacaagagaaagatgggagaaaaagaaggaatagccgcttctttggataaaatgacgaactcttttaaccgaatggtggaaaaaatggatggtaaagttgatgatgaagatattcaagaagtattatgtgaggcagctttgataccagatcttaatagacaacaatgggctaaagctattaaatggttagctgacgatccaaaacagttagctattgtgaaagcccttccaattcaccaaaagacagattatgttttaacacaccttggagaatga

SEQ ID NO: 48934 - DNA, 162 bp, Glycine max
  Peptide Sequence Number=SeqID_165712
atggataatctcaaaggatctcttagtgcattctttttaaaaacatgggtaaaagtatttggaggaaggttttgtgttggtaggctaatagtgcagttatgcacaatgacatacaacttgacattttccaatttagaggcttacaagaatttgatgaggtaa

SEQ ID NO: 48935 - DNA, 495 bp, Glycine max
  Peptide Sequence Number=SeqID_165713
atggctgatactatatcaacattttccataattgacatggaaaagaaaagagcaagccaagaacataaattgctaattaagcagttggagagaaatagaaaagaggatgaaaaagagaaagagaaagaaagcatgcacaatgaactgcaaagagagccactactcaatgttggtggtcttgagttttatgtcattgcaccaaatcttcttgcatctggggctaaggatgcagagtgtttcaaggatagaattgatgtacaatgcttgcataggtggcaaaaattcttaaatccaaaactcgtcaaaggtccatggtctaaagagcgcgacacttgcgctgagcatgcttgtacaactgaatcaagtggtcgtgcgttaagcacaagatgcatgcttagcacaattactcgtgatagctatcttccaaggtggcgtcttgcattatgcggcttgcttgggctaagttgttctgactcgctgagcaagacactttag

SEQ ID NO: 48936 - DNA, 141 bp, Glycine max
  Peptide Sequence Number=SeqID_165714
atgtgtggtggttcacgaaacgttgtcgtcacggtgctgatggaggagagcaaccgtctactattgaagctcgtggacgagattaatgacaagttgaatgaagaaactaaggatttgaaattgatgccaaaatttgtttga

SEQ ID NO: 48937 - DNA, 264 bp, Glycine max
  Peptide Sequence Number=SeqID_165715
atggaatgccacattcaggggacacttttttacgtgaaaagcatgccatgcagtgaccaactcgccagaaccagtggcgagtttggtctcaaaagcgtagggaaccgccagtcaaactggcgagttccatggtctgacgctgcagctacgtcgcaggcgctttttcagtgcaggctaggttgcaggaacttttttcagagaaaggggagttgcaactgccattggcgagttggctgcaagttgcaactcccattggcgatttag

SEQ ID NO: 48938 - DNA, 1578 bp, Glycine max
  Peptide Sequence Number=SeqID_165716
atgaatatgaacgaagagagtggtgaaggaagcgcgaggagggtccaagtgcgcttcgtgacgaagttaggcgagccgtacaaagttccgaccactgccatcgccatccccgccgacctcgctcgattaggcctctcctcactcgtcaacgcactccttcaatccaacgacgctgaccatcagccggagccgtttgattttttaatcgatggcgagttcgtccggatgtcgctcgagcagtttcttttggccaagggaatctctgcgcatcaatgtgtgtatatcagtgaagcaaataaatgctatgcttgttatggtgatagtgtcaaatgggatgatgcagtggaatggggggtgcttgtgaaggaagttgcggctgtagaaaggatattggaaattgagtacgcaagggctgtggctccgcggaaggaggaggacccttctctacatgatgattgggtcagtgctgttgatggttcttcttctcggttctttttgaccggatgttatgatggtttagggagggtatggaaaggtgctggattatgtacccatatattggagggacatagtgacgcaattacttccattagtatcatcaatcccaaaggtgaggaaactgttacagtagctactgcttcgaaagacaggacattgaggctatggaagctcaatgctggggatcatgtaaacaatcctatgagggttagggcttacaaaatcttgcgtggtcataagtcttctgtacagtgtgttgcagtgcagactgctggagagatggtttgttcagcttcttgggattgcaccatcaatctatggcaaactaatgactttaatgcggaagatgacctagtgtctaaaaagagaaaaattggagctcaaggagaggcttttactacccttgtgggccatacacagtgtgtgtctgctgtggtttggccacaacgggagtcaatttactctgcatcttgggatcattctattaggaaatgggatgttgagacaggaaaaaacttgacagatttattctgtgggaaggttctcaactgccttgatattggtggggaaggttctactctgatagctgctggtggttctgatcctgtcattaggatttgggatcctcgtaaaccaggcacttctgctcctgtttttcagttttcttctcatatgtcttgggtttcggcttgcaaatggcatgatcagtcttggtttcatttactttctgcatcctatgatgggaaagttatgttgtgggatctgagaactgcgtggcctctttcagtcattgaatcgcacagtgataaggtattgtctgctgattggtggaaaagtaacagtgttatcagtggtggagcagactcaaaactttgcatttcttcagaaattcctgcacaactgccaagtgttttatcagttgtgaacaaagtcttattttgtgttgctaacggctatggattatcaatcatctttgggatgctagatcccaataccaactgtgctgctgatgcaggacagaaggctgcccttctaattctctttttctctgaaatcttaactgcccatccaatgctctga

SEQ ID NO: 48939 - DNA, 390 bp, Glycine max
  Peptide Sequence Number=SeqID_165717
atggagctgggaagagatcacaatggagcttttgttcgcgcgaagacggtagcaacaagtggaagtccgaacccgagggaggcgaaagcatgggctcttctccaagcattaaaatggatacctcaactagatctcaccgaaattgtcattgaattcgaatctgactacaaaactgttgtggatgtcctacacactcgtttcaagggagcttcagagttttttattctatacatgaaaactgttaaccaactctctttttatccgagcattggatgggcagttaagatttcagagaaaaagagaattagaagggcagccttctgtcctgcatcagcagcacagttggtattgggatctagcatcccaaagatgattgatactgcatcatag

SEQ ID NO: 48940 - DNA, 262 bp, Glycine max
  Peptide Sequence Number=SeqID_165718
atgtcatgcagtgaccaactcggcagaaccagtggtgagtttggtctcagtgagcaaatcgctcatgctgctggcgatacggctagtcctgccatggcagtgcagcagcacgtcagtcaaggccaaatcgccaatggtaatggcgatttgccttgcccacggatcgccagcatggctagcggggctgtggtttgtttcactccttatacgtggtttgtctcatcttctcctcttcatattacgcgtgacttctctatacttg

SEQ ID NO: 48941 - DNA, 213 bp, Glycine max
  Peptide Sequence Number=SeqID_165719
atgcacattaagaaggcgatcaaacgagcccggtgtcggctcaggctactcaagaacaagaggcaggcaatagcaaggcaactgagaaaggacttggctaagctaatacaaagtggccatgaagaaactgcatttaaccggatttgtttgttaatgccacatactcatttgttaaccactgcttgcgtgactatattctttgaaactgattaa

SEQ ID NO: 48942 - DNA, 180 bp, Glycine max
  Peptide Sequence Number=SeqID_165720
atgaggaaaaaaggttactttcctgttgaacaactaggtagaaattataaatgccgtttaattttactaacttggtgttttaggtgcatgtggatgcttgggccttgtgcctacagtattgctgatggtgaggccaagcctgtggaaggtgaactttcaaaatcattgttggagaactaa

SEQ ID NO: 48943 - DNA, 291 bp, Glycine max
  Peptide Sequence Number=SeqID_165721
atggcaatgggcgggtcgggtacgggtattgtctccccaatcccttaccccgactcctcaacatatcctcatacctgtacccgatacccgacagattttaagtggcggggcggattcgggttcggggttgggatgggtctagtaatcccatacccgtacccgacttttggttatccgggaaaacccgaacccgtacccatacccgatcaactcgagtattacccgtcaaagtcgggacggattcgggcgggtacccacgagtacgggttttcttgccatgtctacttataa

SEQ ID NO: 48944 - DNA, 564 bp, Glycine max
  Peptide Sequence Number=SeqID_165722
atggtgtacgtgggaatgtccttgctgaaatacttcaaaatagagaaggtggacaagcttatgttgctcatgagcaaactgaagtatggagacatgtccaattacggcttgatcaggccaaaggatggacccttctttctgaagaaaaagggtggaactacccctaccatagatgtgggttgtgttagtaggattaagaaaggcgaagtgaaggttttcccagctatttcaagcattaaagaggacaagttgattgagtttgaggatggacaaaatggtcaatttgatgtcatcatctttgctactggatacaatagcactgtgctgaagtggcttaaggattacagagggctgttcaatgagaatggaatgccaaaaccagattttccaaatcactggaagggagagaatggtatctactgcgctggattttcaagaaggggattagatggcattgcttttgatgccaagcgtattgctgctgacataaaaaagaccgtgaatataaagaacttacccagtgaagaggacaactttgcttccttcaaactcttagaaaaataa

SEQ ID NO: 48945 - DNA, 591 bp, Glycine max
  Peptide Sequence Number=SeqID_165723
atgtgtaagtgccccacatgtggggtatcacggtacaaagtcaaggatgatgaaagttgtgatgatgcaaccacaaaaaacaatcgtccagcaaagatggcctgttttgatgatcatttacaacctccctcattggttgtgcatcaagcgaaagtaatgatgatagcagttccaaggcagccagggaatgatattgacatgtatttgacttcattgattgaagacttgagaaaattgtgggaagaaaatgaaagtgtgccaaaaccattagctagaaaagaagattatgattgggtgaaggacatcgtaagtatctttgggaagacccaaaagaagccatcctctgagacaaacatatggaacaaaaagtcaatatactttgatcttccatactggtccaatcttgattctcatgattgtcatgtgttaatgcaacaactattggcgatagccattcagaatatcttgcctgacaaagttagggttgccataactagtttgtgctttgtttttaatgctatatgtagcaaagtcattaaccctcgacaatcggatgatttggagaatgaggctaccattgtcctttgttaa

SEQ ID NO: 48946 - DNA, 504 bp, Glycine max
  Peptide Sequence Number=SeqID_165724
atgcagggcttcattacaaacaatgagagagctttagtggagctatttggggataaggagaataatagtaaagctgttgcatgtttaaatgtgatggctactcggattgctatactttttgcttcattaagagaatttccttttgtccgctttcgtgttgccaagtccctagatgcaaccacaatgactaccttccatgatcttattcctgcaaaacttgttgctagtgtctgggactgtcttatgaaatataaaaaaactatacctaatttccctcagactaaaacctgcgagttgctcatcattgatacaactattgatgaaattgctcctgtgatacatgaatggacatatgatgccatgtgccgtgatttgtcaaatatggaaggaaataaatatgttcatgagaaatctactgtattcttaatgttcctagcaagatcgatggtccacctaagcgaaaagaggttctcttggacgatcatgatcctatatggctcatag

SEQ ID NO: 48947 - DNA, 229 bp, Glycine max
  Peptide Sequence Number=SeqID_165725
atggctgcggagttagagcaacagacagtggagctatcctccctcgtcacacgccccgctaacgataagtcctccgattcgagactgtttgatgaacttgcggaacttgatgtggtggcttgcaattctatgatcatggggcttgctaagtgtggggaggctcatggaggcattggagcttttccgcaaaatgtagtgacaaagggtttagccaagtcaatttacaatg

SEQ ID NO: 48948 - DNA, 402 bp, Glycine max
  Peptide Sequence Number=SeqID_165726
atggatcgaagttggatgaatgaaagtcgcttgagccctgcgtatgaggaaggcgtggaacagttcctacaatttgcttcagaaagaagtcgaccagatgaaaacgggaagtttttttgtccatgtatctattgtgtgatagacatgcagaatgggtcccaatctagacaagagtcttttcagcaagcacatgtccctatgtatgatacattgcaaactgattcaaagaaatctttgtatccgaggtgtggggtatcacggtacaaagtgaaggatgatgaggcgtgtagtagtgatgaaaactcaaagggcccgccaatgaaggtgttgtggtatcttcccatcattccaaggtttaagcgtctgtttgctaatggagacgacgcaaaagacctgacatga

SEQ ID NO: 48949 - DNA, 165 bp, Glycine max
  Peptide Sequence Number=SeqID_165727
atggcgacatacgaatggcaacacgtgagtcagcttgttccgccaatacgaatggcgataccagcccagtcagctttcgttccgcttttggcaatggcggtacacatggatatcgctgatggcagtggcgatacatgcttgccgccactagcaatgggagattga

SEQ ID NO: 48950 - DNA, 855 bp, Glycine max
  Peptide Sequence Number=SeqID_165728
agttttaactgtcatgcaggactaaacatcaaaggagaatgtaggctcattacttctcagattgaccaaaagcaaaaccaaagtggctttctgccaaaacattcagatgcaccgcttctttgtactggctgtgggacaagaactgagttgtctatcaaggagtcaatgaagttcagctactctgacatacaaaatgcaacaaatgatttttcaaaggataacttattaggtgaaggtggatatggtcacgtatataagggtgtgcttaaagatggacaacaaattgcagcaaagtggcaccaaaggtatgccattgccgttgggactgcaaagggattgcgttttctacatgaggaatgccgtggtggtcctattattcatcgggacatgcgaccaagcaatatccttctcacccatgattttgttcccatgctaggtgactttggtcttgccaaatggaagactggtgatgatactctacaaacaaggataatgggaacattaggataccttgctcctgagtatgctgaagacggaattgtttctgtgggaacagatgtgtattcttatggcattattctgctacaattgatatcagggcgccaggttggcaattccaacaatccagaacaacaacaacaacaatctctccgacaatgggctgagccaatgataaagaatttggctttacatgaactgattgatactcatctaggggaatcatatgacacgcatgaactctacctcatggctaaagcagcatacttctgtgtacaaaggaaacctgagatgcgtccatcaatgggagaggtagtttattggatccttacttttacttcatttttatttggctaa

SEQ ID NO: 48951 - DNA, 225 bp, Glycine max
  Peptide Sequence Number=SeqID_165729
atggagtttgaaaaagcagctgaccccgagcttcctgggcatcttctgctggaacaatatcgggcccaactagtatctgcagttcgtactaccttggacacatcttctagtcctagcttactggaggcaggtttgcacttggctaccaagagtattgtggagtatcaacaggaaaatattggtagaaagtggctgaagaaggcagaaagaaaacgaattctataa

SEQ ID NO: 48952 - DNA, 600 bp, Glycine max
  Peptide Sequence Number=SeqID_165730
atggcatttgcgatgatgcagagtggtagcagtgatgatagtagcagaagcgtaaagagaggggacatagtgtgggtcagagtccacttccctcacaaatggcgccccgcactcgttctctcttcccgcgacaacctcggcgtccaagtcaccttctccttctccgaaaacgacgccgtttcgccctcgcccaccttcttcgtcgagtccgaggttgtccccttcgaggaggcactcccttctctcatctcccgccgcaaccttgacgcgccgccgcttcactccgcgctccggttgttgggcctgagggtcctttccgggctgcggtgccactgcataacgggccgggcccaggcccaacaacaaccggcccgcgagttcgatacggttggggttttgggttttgttttggacgccgccgtttcgccgtgggtggagcccgcgcattttgcacacgccgttagggttgttgcccaggttcacgcttttcgaagctattgctctgtaaagcacaggaaaatgtacaaacaaaataaaaaagcagttatattagctgtgaatatgatattacattctaattctaaacgatggagattctga

SEQ ID NO: 48953 - DNA, 258 bp, Glycine max
  Peptide Sequence Number=SeqID_165731
atgacgaatgactacaaggggaacatgattgatgatccaataatcttgttcattttccagaacaacgctctcaacaaattcagttggcatattaagaaagtcaagaactttaaggttaaccaaggctttgatgcccgagggtaccttcttgagatgagtgattttgattattgcaaaagattcaagacaaggcaaggagtgaagtcagtgaagccgggaaaagctgatgatggaggtggatctggtgctcggcattag

SEQ ID NO: 48954 - DNA, 705 bp, Glycine max
  Peptide Sequence Number=SeqID_165732
ggcctggagacttcttggttcatcatgctattgctcttggtttacatacaactacattgatcttagtaaagggtgctttggatgcgcgtggttctaagttaatgccagataaaaaagattttggttatagttttcctagcgatggcccgggacgaggcggtacttgcgatatttcggcttgggacgcattttatttggcagttttctggatgttaaataccattgggtgggttactttttattggcattggaaacacattacactatggcagggtaatgtttcacagtttaatgaatcttctacctatttgatgggatggttaagagattatctatggttgaactcttcacaacttatcaacggatataacccttttggtatgaatagtttatcagtctgggcatggatgttcttgtttggacatcttgtttgggctactggatttatgttcttaatttcctggcgcggatattggcaggaattgattgaaactttagcatgggctcatgaacgcacacctttggctaatttgattcgatggagagataaaccagtggctctttccattgtgcaagcaagattggttggactagcccacttttccgtagaccgcgagctaattatcgagactttggattatccggacacatacttcgtgaaatggttcatgcatgtttattgcccggtgcaacaagatccagttg

SEQ ID NO: 48955 - DNA, 1023 bp, Glycine max
  Peptide Sequence Number=SeqID_165733
atgctggggtggattctcggcatgttagatggctgccaggcgaacaaatctatgttccttcataggacttcagctatatgtttgtgctcatggctagtgagggccttttttgacggtgttttctcgagggttaatgttgaatgtgtcaccagggaattcttcgacaatgctcatgacttgactgcttataacttgattgttgctaccaccaaagaggggatgaggtttgcccgattctctgacaggaggataagaggcaaccttcaagctctctacatagcattgtcggacttgcttctggtatgccatgacagtgacaatttctcccgtcaaggtagggaacttcattttgaggactttggccaccataaagttggtaatgacaatagagatgaccatagggtcatccttgttgatggggttgttgcctttgaaatcattgtcaatgaaggttataagaggaagaattctcggcggcttgacgtcaacaacgttgacatcgagatctttgatggcatggagacaatgcttttgggactggttcatcttcctgctcttgttagggttggtgctcacgtctttgttggtgatgcctcaatctccctttatcctttcttttgtctccccttctatcttgtctatgacctcttcttttgcgatggtcctcattgtgcccttcggggcccaacagtcttcggtgttgtgaccatggttgtggtggtacctacaatgcttagttctatccagaccagcattgattgcttgctcaaggatggtggcccaattttccgtcaaggggctgcgactctccctggttcttccccatggcgttcttctatttctgtgatgcgggcttggagttgtcaaagtggatcattatccgtcatggtggtcgttagagtagggttggaattttatgggggtgtctctctcttgagttcgggtcgtgtgttggccatatgtgcaggtggtattagagataaggggagcaacatggtgaatagcctaaaggctaaagcttga

SEQ ID NO: 48956 - DNA, 573 bp, Glycine max
  Peptide Sequence Number=SeqID_165734
atgactgagaaggtagcactgacactcataacctctgctcgatgcctcatgccatactttcagagtcaccaaatcattgtcatgatggaccaccccatcaagcaagtgttaagaaagcctgggctgggaagtgaggaagacataatccttgaaagggccaacaatattactttggagtgggccctcaaatttaattttaggggggcatcaaacaaccaggttgcatctgaagcactcatagcaagcctaaaattggaaaaagaagttggagcaaggaaactcaggtgttatggtgacttacaacttgtccagggacaggttgcaaacagatatcaagccaaggaggcagtgctgcttagatactatcatgccctaaagacccttgtaaatgattttgattgtttcgagatgtaccacataccaatggaaagcaacactatggcatacttgctctccaagttggcaagcactaaaaagactggacacctcaagaccatcatccaagacgcactccaagcaccaaccagagagaccaaggaggtcatggtcgaaaaagtggaggaactagactag

SEQ ID NO: 48957 - DNA, 1065 bp, Glycine max
  Peptide Sequence Number=SeqID_165735
atgggcgattttgaatggcgacccttggtgaagcaacttggaattgctagtgaagacatgccttctcccctcactatcactcctgagtcttcaggggaggaaggaggtcaggctagagttgaccctccccgatcttctgaagctgacgatgatgaagttgtcaaggttacgctcgacgttcttccttccacaacaaccaagaggaagtgcaatgaaggggctagagggtccggtcagcataagaagtcaagggcccccttcagtctccgagctttgaaggaggctaccgagttgatgtccagttcaattatgtttgcctcattggttgttcctgttgctgttccggtttccactcctttttctttggtgctgctacttagtgttggtgtggcgacgactagtgtctcgtctcctcctccttcagccttgccaccctcagctccgaccgtcatgccttcgactatgccttcttcttctttgcgtccaagtgtttcgttggactgtgtatatacttcccaggaggcaaactcaattcggggtacaaaactcgaccgatgctgcgaaggtcttccttcaacggacttttgctatcttggaggaaaatgggcaaagacatatacagaggctttgaacaaaattgaatctttagaggttgacgtcatcaaatggaaggctactgttcgaactgtgttgcagccggagcgtcccaaagtagccactgccactgttgcccttgttgaagctgtcaggaatcatttggcaagcaaggtggagcacactactgaagagaaagaaaagcttattgtgatagtggccaaatctgccaaggtgattgctgatctcgaagctcgactgaaagaattagagcttaatgaagtcatggagcagcacgagaaagggttctttaaggccatcaagcaggctaggttcttcattgagggtcttaacttaggtctttttgacccatttagggatgtgaaggatgatgaactacttgacgaggaagagattgatgttggggaggaggacatcaatgaagaagaaaatgatgggaccaatgtttag

SEQ ID NO: 48958 - DNA, 420 bp, Glycine max
  Peptide Sequence Number=SeqID_165736
atgggtacctgcaaaaaggaactccgatgctcaatgatgggtggaaaccttagatcgttacctaagaggttgttgcaactttataacaacctcattagtcagatcatcatcacaaccatcaccatcaccatccctgccaccacaatcaccatgatggttgcgataaccaccatcatgattgtcgttgttgctgtcaccatcatcggcaaggatagtagtggcgacaaaagtggtgattatgttgctagtgatgtcgatagtcatggttgcaatcatagtattgttggtggtggtggtggcagtaatgacgataacaatcatgttggtggtgacagtggtagtcatggtagtggtcatgacaattgtggtagaaattgctatgatggtggtcgtggagatgataagtttgagatgttttag

SEQ ID NO: 48959 - DNA, 243 bp, Glycine max
  Peptide Sequence Number=SeqID_165737
atgtatttctatacaaaacttcctaatcccttgagtttgagtagcgaggaattgatcatggttgaggaagcaagacaagccgcagagaaagcctatgatatggccaaggtagatgaaggggtgaacagagctgtagcagcttctaatagagcagccaatgcagctagagtagctgctgtaaaagctgtgcaaaaacagaattatcatgttaacagtgaaagcttctcaattcctgttgtgtaa

SEQ ID NO: 48960 - DNA, 261 bp, Glycine max
  Peptide Sequence Number=SeqID_165738
atgaatgcgggtggccgtgggagtagttttatcacaaccgtggtgggcatcaaatgtacttacataaatctggagcagattgacgtcaaggttgaccgtcatcaagttccacgatctcctacgtcggatttcttatcggcccaaaagcctggctgctcagcgagtagtatctatgttcctatattatggttgatggggaggactgacgtgtatattttaatgccacgtctcttgccatatcaatttgtggacctcgaataa

SEQ ID NO: 48961 - DNA, 594 bp, Glycine max
  Peptide Sequence Number=SeqID_165739
atggtgaggaaggctaatggaaaatggcacatgtgcacaaaatacaccaacctgaacaaagcgtatcccaaaggcgtgtatcccttacctagcatcgacaagctagtggacgatgcgtccggcttccaactgttgagctttctagatgcttactcagggctcatggaccaggtcttcaagcatcaaataggtcggaacgtcaaagtctacatgaacgacatggtcgtcaagacatattgcatggcccaagatgtagcaaatttggaggaagtatttggggaaattcataaattcgacatgcgcctcaaccctgaaaaatgcaccttcaaagccaaccctgataagtgtatggcgatattagaaatgcagagtcctaccaatgttccttccaaaactcatagaaaaatgaagcctttcttcaagctactcaggaaaatcaagccgttctcatcggacaaagcatgtgaacaagctttcctagctttcaagaaagttattgcaacaccacaagttctaaatcaacctaagcctggatcacccctactcttgtacctttcaatggtagaagaaaccattagttcaaccctcatctaa

SEQ ID NO: 48962 - DNA, 360 bp, Glycine max
  Peptide Sequence Number=SeqID_165740
atggggaaggggtacctgcaaaaaggaattatgaagctcaaattatccagtgttgagggtagtaaccttgacaaatttgacggtcacaggcctaacaagcccccccagcctggacaagcattgtctgggctatggttgacaggcatgagaggaagtgactctaggggttctgttcgacaacccatggtagagcgggaagtggttcccatcgaagattcttcatcggaagaggttcctcatgaggtctctgataatgggtcctccccttttgagaggttgataagctttgacaatgtgggtgagggtagttacgagctacacacggggatagaatctcccacggctcttacggaggattaa

SEQ ID NO: 48963 - DNA, 333 bp, Glycine max
  Peptide Sequence Number=SeqID_165741
atgaagctcaccaagggtggaccttgggtttgtcgagcctctagagatttaaccagggatgcgttcatcttgggtttggtgagactcaccaaggacaaaccttggattcgacaagactcaccaagggtggaccatgggttttacaagccttggagatttgacaagactcacccagggcggaccttaggtttgacgagccttggagattcgactagggatgcgttcattctagatttggcgagattcaccaggatggaccttgggtttgatgagcctttaaagattcaacaagactcaccaagggcggactttgcgtttgacgagcctttgtga

SEQ ID NO: 48964 - DNA, 600 bp, Glycine max
  Peptide Sequence Number=SeqID_165742
atggatatgagtattgtatcagcacaaagtattaaaagaaaacatcacagatctgataaatcagaccgttcgaagcgaaagaaagacgagggacgtacccgtgagcatgatgatggaagattctggaaagctgaacttgttgatgaggaggtacttcatgcatttggcgtcgttgatgcaacccttgagctcgtggcgggagaagcggtaggagatgccgacgatgacggccttcttgcggccgtgggggttgggcgggggcggcgcggggctgtagggggagggcggagacgcgtgggtggcagccgggggctgaggagggagggcgcgtgggtcgccgatgagggtgatggcgtggcagagggcgcagcggatggatcccgcgccaagtggcaactgcagaggggtgcggcagttggagcagttcaccagcatgttgctgtacatcgttgggtgaaggagaccgtgaaaggggctacgcgtatgtactccgggaaatatgattcgaagatgggtttgaccttggtgatggcttatggtgtcacattcggtcacttttcgggagttgaaactgcattttatatgctttccgggaattaa

SEQ ID NO: 48965 - DNA, 285 bp, Glycine max
  Peptide Sequence Number=SeqID_165743
atgttcctccagaaggcggttgcttctggaggaagcaaccagggttgcctgggcgagctgggtggcaagctcctcccctattttcctatatatagagggaagagtgaaggtgaaaggggttcaaccctcctggtatctgagattcacataaaattagtgacaaaaattgtttccgtgaagaaaatccaagtcgaggggtttccgtgggtgatttcacgaagattttcaaccgttcttcatcgttcatcgttcgttcttcgtcgttcttcggtcttcaaccggtaa

SEQ ID NO: 48966 - DNA, 1464 bp, Glycine max
  Peptide Sequence Number=SeqID_165744
atgttggatcaggtattgcggttgtttgagatcacgccgaattacgacctgaacatcatgaaacccggccaggggctaacggaaatcacctgccgcatcctggaagggctgaaaggggtgctggaagacttcaaaccggacgtggtgctggtgcacggcgataccaccactacgctggcgaccagcctggcggcgttctatcaacgcatccccgtcgggcatgtcgaggccgggctgcgtaccggcaatctgtattctccctggccggaagaggccaaccgcaaactgaccggccacctggcgatgtaccatttcgcgccaaccgagaactcgcgccaaaatctgttgcgcgaactgctgccggacaaccgtattttcgtgaccggcaatacggtgatcgacgctctgttctgggtgcgtgaccgcgtgatgagcgatgccgcgctgcgggctggcctggcacagcgttatccgttcctcgacgccgacaagaaactgatcctggtcaccggtcatcgccgcgaaagctttggcggcggttttgagcgaatttgcagcgcgctggcggagatcgcccgcaatcacccggaagtacaggtggtgtatccggtgcatctcaatccgaacgtcagtgagccggtgaatcgcattttgaaaggcatcgacaacgtcatgctgatcgagccgcaggattatctgccgtttgtctatttgatgacccaggcttacatgatcctgaccgattccggtggcattcaggaagaggcgccatcgttaggtaaaccggtgctggtgatgcgcgataccaccgaacgcccggaagcgatagatgcgggcacggtgcgtctggtcggcaccgatgtgaccaaaattgttgaagcggtgacccggctgttgacggacgaaagcgaatatcacgcgatgagtcgggcgcataacccatacggtgacggacatgcctgtgacactatgagttttgacactatttcggttatcggcctgggttatatcggcttgccaacggcggcggcgttcgcttcccgcaagaaaaaagtggtgggtgtagatgttaaccaacatgcggtagataccattaaccgcggcgcgatccacatcgtcgaaccggatctggacaaagtggtcaaggacgccgtcgacggcggtttcctgcgggcggtgaccaaaccgctggcggccgatgcgttcctgatcgcggtgcctacgccgttcaagggcgatcacgagccggatctggcctatgtcgaagcggcggcgaaatcgctggcgccggtgctgaaaaaaggcgatctggtgatcctggagtccacctcgccggtgggggccaccgaacaaatggcggactggctggcgcaggcgcgcagcgatctcagcttcccgcagcaagcgggcgaagcggcggacgtgaatatcgcctactgcccggagcgcgtgttgccggggcag

SEQ ID NO: 48967 - DNA, 678 bp, Glycine max
  Peptide Sequence Number=SeqID_165745
atggtggaaagagagaaatttgatcatatagaggaaaggctaagggctattgaaggaggcagagattatgcctttgccaacatggcaaaattgtgcctagtgcccgacgtcgttatccctccgaagttcaaggtgccatatttctataagtacaaggggactacttgcctcaagaatcacttgaagatgtacagtaggaaaatgggggcatactttaaaaatgaaaaattgttgacgcatttcttccaagaaagtcttactggggcagccatcacctggcagtatcagcataattctaatatgtctccggatagaatgaaactacaaaacatgtgtatgaagaagcatgaatctttcaaagtgtacgcccaagggtggagggatctggctgctcaagtagcaccctcaatgatggagagggaaatgataacaatgatagtggacacattaccggtgttctactatgagaagatggtgggttacatgccttcaagctttgaaaatttagtgtttacgggtgagaggatccaagtaggcctaagaagaggaaaatttgattacgctgcttcgatgaattctggtgataggaggcctagggaaaatggagggaataagaagaagggagaaacccatgttgtggctgctgttcctacatggccaaattttccattagcctaa

SEQ ID NO: 48968 - DNA, 354 bp, Glycine max
  Peptide Sequence Number=SeqID_165746
atgatgtcagaagaaacgacgtcgattgactacgtaatggaggcggcatctaggtctcacttctccgccctgagactcgacggccaggtcccatcctccgccaccgccccgtcctccactctcgattcaaccctaaccctcaattcccttcccaatcaacccttcgccataggagtttctagaggtactgcctcgggtaaaaccaccgtcggcaatatgatcattcagcaactccacgatcactgcgttgtccttgtaaataaggacttgttttatcacgggttgaatcctgaaaagttgaaacgtgttcacaagtacaatttcaaccaccctgatgcttttgacacaaagtag

SEQ ID NO: 48969 - DNA, 122 bp, Glycine max
  Peptide Sequence Number=SeqID_165747
atgcttttcctctgtcatcgagctcctccacacggccacacaggtgcgcgatctcctccgtcgtggcatcaatctggtgtcagaggcacttctcctccgccagccatgcgttccggtgcgag

SEQ ID NO: 48970 - DNA, 162 bp, Glycine max
  Peptide Sequence Number=SeqID_165748
atggcggtggtgggagcagcaggtccacttcagcttcaagtacttcacggcgggaaacaaaacgtcagggtggtagcgggatggagttcacggcgggatgaagtagttcaggcaatagcgggggcgctaggacggtgtacctacaagcaccgtcttttatga

SEQ ID NO: 48971 - DNA, 423 bp, Glycine max
  Peptide Sequence Number=SeqID_165749
atgtgtgtcgactacacagatctcaacaagaattgtctaaagaacttgtatttgctccctagcatggacaagttgattgacaattcattaggcttcaagttctttacatcaatggatgcgtactcaagatacaatcaaatcccattgcatcattctaatcaagaaaaaatatccttcacgatagaaagagaaaatgattgttataagagcttgaccaaggagctacacatcaaagatttggaggaaacatttcaatgtttagacacattcaacataaagttaaatcccaccaggtggacatttggagcaagtgctgggaaattcctaggatttatgctaatggagcgaggaattgaggtaaacctagacaagtgtaaggcagttctaaccatgcaaagtcataagaatgtgaagaaggtttag

SEQ ID NO: 48972 - DNA, 165 bp, Glycine max
  Peptide Sequence Number=SeqID_165750
atggtgggtttatgtgtgatctgtggatgtggagagttgacttgcaccatcgcccgaccgccacctagtaccacatatgatggagtggtacctggagatatgtcgtgggggtcaggagaccttggggacgtcaggtggggtgctattgcccaaaaccaagcttga

SEQ ID NO: 48973 - DNA, 504 bp, Glycine max
  Peptide Sequence Number=SeqID_165751
atgaatcttagaggagaagagagagagtctgtcatcgaaagaaaaacccaaaggttcaatacagtgttcagaaaagtggaacaaatagctgaagaggctgaatctctgagagcaagtttggataaatataacttacggaatcagaaacgaatgagagaagctaatgagagagcagaactcttgggacgagctaatggggattctgctcatgttttgagaatttatgacgaggaggcacaagcattacagtcagttcgctcttcttcccaggaactggaaaatgcaaatgcacttggggaggccatcctttcttcaatacatggccaaagagaacgcttgaagagtgcacatcgaaaagcattggacatcctcaatacagtggggatatcaaactctgttttgaggctaattgagagacgaaaccgagtcgaccaatggatcaaatatgcagggatgctattgactgtcattttcctgttagcgtttattatgtggagacattga

SEQ ID NO: 48974 - DNA, 1005 bp, Glycine max
  Peptide Sequence Number=SeqID_165752
atgggtgttgaaatcgagggaaagatcctcccagatgccgaacgggatggtgatacccaaatgacctctgataggggtggtatggaattcgatcaacaaggccttgatgaagggattaccggaattctaccagatggtatgcagcatggtctgcctgaattgaagcaagctacgattgaaaaattggactcttctgaagggcttgttaatgagacactgaccctcgggaagtggttcaatgcgggaaagagtgaccgtcacgacattggaaacactggtcttgctcctgtgatccgtaagtatagtaaattggtggccgagcaaatactagcaccatttatggatagcagtggtgatagtgtgcaattcgcaaacgaatccacgcaaatccttctgattggagggaatgggtcagtctacaatagtcttgatcttggattgctcgggttcaactcctttgccggaaatgatgtgccccaagtacttcaattgtctctgggagaacaaacatttggagcgtttgagcaaggtttcgctgtagacttggatgtcgtcaaagaatacagcggtgaacttgcacaagaatggttgaaggagtgcattcatcatggcctaaaaagtttaagcttggagaaccaagaggcatggtcgagatcatccaagagctcatcgatcgtcgacatcgaaaagcgatctttcacggaggttgatgtgatagacgatcttttgaggaggtggaaggtgagtcggtgtctagaagatgggagcaaatttggtaaggatagcttcaatggtgggtatcggaagatgcttaacctatggggccgaaacgtttgtaggcccagaagcaatgttaacgtgaagctccacaaattggcccaaatgggtgaatcacatagtaaaagtgatgtaatcagtagttatcgggctcaaatgcttaaaccattcaattcccaaaatgacatcgattccactaatgggaacatgtggagagtcactgtgaat

SEQ ID NO: 48975 - DNA, 989 bp, Glycine max
  Peptide Sequence Number=SeqID_165753
tcgatctcttgctttctcataaggatggacccgtgggtactagtaccctcacctttagaggactatacatcctcgccttcagaggactacatgtcctcgccatcagaggattacgagtcctcgccatcagaggactacacgtactcgcctttagaggactacatgttctcgccatcagaggactacatgtcctcgccttcagaggactacacgtcctcaccatcagagggctacacgccctcaccttcagaggactactcgtcctcgccttcagagggtcatgtaccttcaccttcaaaagactacacgtcctcgcctttagagggctacacgtcctcgccttcagaggactgcacggcctcaccttcagagggttgcacaccctcaccttcagaggacttcacgttctcaccttcagagggctacaccccctcatcttcaaagggctacacgccctcaccttcagaggacttcacgtcctcaccttcagagggctacaccccctcatcttcaaatggctacatgccctcaccttcagaggactacacgtcctcgccttcaaagtgttgcatgccctcatcttcaaagggctacacgcctttaccttcagaggactacacgccctcaccttcaaagggatacatgctttcatcttcaaagggctgcacgccctcaccttcagaggactacacgttctcgccttgagaggactacacgtcctcgctttcggagggctgcacgccctcgtcttcagaggactatatgtcctccccttgagaggactacacgtcctcgccttcagagggctgcgctctccctcgccttttgagggctacgcgtcctcactttcaggccaactgtgcaagcacaaccagaggaaggctatcgcgcagctattgtgcataccggggcaagctttcacccgtgccactggaaagagacgagtgtggatcatgcgcaccaacatgaccactcttaaacagatataa

SEQ ID NO: 48976 - DNA, 603 bp, Glycine max
  Peptide Sequence Number=SeqID_165754
atggctgacccacaactcctaaatgattacagacctatttctttaataggctcaaatgaggtgatcgaagaagctaaaaggagcaaaaaatcatgccttgtgtttaaagtagactatgagaaggcatatgattcagtatcatgggatttcttgttatacatgctgagaagaacatgctttagctccaaatggatcaaatggattgaggggtgtttaagatctgtatctatttcgattctagtgaatggaagcccctcagctgagttcattccacaaagagaactcaggcaaggggatccattagcaccccttctctttaatgtggttgttgaagctctaaataggttgttgaagaaagctgtggagaaaaacttgttcagaggttttccagtgggttcaaacaatgcaagaataagcatactccaatacgcggacgacacaattttctttggtgaggcaacaatggagaatgtcaaggttatgatgcaatcctaccccgcaaaggcattggatagaagactccaagtagattgggctagagatccaagggaaggccctagggttctcataagccttagggtagatttcgaacccatgggctaa

SEQ ID NO: 48977 - DNA, 969 bp, Glycine max
  Peptide Sequence Number=SeqID_165755
atgggagagatgctcccttcaaatccccacctatgtctgatactaatgagtgccagtgttgatgctgcaagattttctcaatattttggtgtctgcccaattatctatgttccagggctcacatatccggtcaaaacttactacttggaggatgtactttctattataaaatcaggagcagataaccatgagctaagtcaggtagaaaagttgtctctagatgatgcgattaatttggcttggtctaatgatgagtggtgctcactgttagagcttgtttattcaaaagctagcccaaaggtgtttgattatcagcattcattaattggcctcaatccattaatggtttttgctagaaaaggggaaaactgtcatttaagagccaaagatggaacaactgcgttggagatttctgagaaggaaaatcaacaagtagttgttgaattgctgaagaagcacatggataatgatttttccaaccaagaagggaagaatttactagataaatatcttgcgacagtcaaccctaaagttgttgatgttgttctgatagagcaattgataaaaaaaatatacattgggcttgtgaaagaaaaaagttatgatccttatcataatgtgtttactctccaatcatcttggatttctaaagcaagtgctaagcaaagagagggatgtgctagtcgttgtcatcttggaatttgttatcgtctatattcaaaagttcaagtagcttccttgccagattttcaggttcctgaaattaagagaatgcttattgaggagctttgtctgcagggaaaattcggagatactcttaagaaggtcaagaagattgaggctgacttaaacaagatggaagaggatacaatccatagacaactatctccccaagaagtgttgacaaagaaacaactacaagaagcattatgggtagctgctcaatcgcatgagtctcttccaaggtag

SEQ ID NO: 48978 - DNA, 792 bp, Glycine max
  Peptide Sequence Number=SeqID_165756
atggcgcctcctctcacctattctcctttgtcttccactgcatctccatggtggaaaatcaccattgaagctcaaagatccagcctccatagaagccccacaagcaagcttccatcaggtctcaaaattaactttgcaaaaagcagttttggagcaataagagtgcctgatcagtggaagcaacttgcagccaattacttgaattgtaatttgttggccattccttttgtgtacttgggcatacccattggggcaaacctgaggcgatgtcagttggtccctaatagagtggtggataagctggtgagcttacaacaaagattcctttggggtggcagacctgagcataacaagattgcttggattaagtgggagaccgtgtgcctaccaaaagaaaaagaaggactaggcctcaaggacattaagactttaaatcttgcattgcttggcaaatggaaatggaatctctttcagcatcaaggacaactatgggctacggtattggagtcaaaatatggtggttggaggagcctggatacaacatctagagttaccaatgaattaatatggtggagggacttaaaaatggcttttcttcacatgcaacagggacgggctctccaaaatggaacgatgtggagggttggatgtggtgataggatcaagttctgggaggatatatgggttagttgggaggaaacattatcagcaaaataccctagattatatctcatttcttgccagcaaaatcaaatcattaggaagatgggagatcaaaaggacataggatga

SEQ ID NO: 48979 - DNA, 288 bp, Glycine max
  Peptide Sequence Number=SeqID_165757
atgacggggtctgttatgacgtggatgccgccattgttgccggcgggaaagcttgtaccgccattgacaactgcgggaacaaggatcccgccattggcaactgcggcactcagcctaaaccgccagtacgaacggcgggacaggagagagagaggctgtatcgctgatagcaacggcgggacaggagagagagaggctgtaccgctgttcctcctggcgggacatgccaacgtggcagtcccgccactgccacctgcggaacaccttcacgtttcaggcttgcagtga

SEQ ID NO: 48980 - DNA, 630 bp, Glycine max
  Peptide Sequence Number=SeqID_165758
atggccaagtctaactcttctaggttgggctttccttcccttatcacagccttatgcatagccagaggggtggtgtctgattcgttgatgttcgagtccctcagcccggccattaatttggcttatatcagaaagaactgttggaacccagaggatccttccatcacattccctgggtcccgcaaggccacgacgcaggccccttcagatgctctaactccaacactagcactagtccctccacctccagcacctatttcaactccagccggcccctccgcaccaagcagtgacaccattgtgcccatgctacagagcattcatcatggcctttgcctggtgatgcagagtatgcagaatttatctcagcagcagccgatcatgagcatggaggacttcttggaacaagtagcttggcccgaagtccaaccttcctttttggggggagactcgcttagtgagatagattggctaagcgagcctcatttgctaagcaaggcagccagctcgttgagagaatgcaaaaccctagaagatgatcagccagagagcagcgcacttagcacgcagccagcccgcccaacaaggacgttgtctccactcgtgcttagcgcgcccaagctctcttag

SEQ ID NO: 48981 - DNA, 573 bp, Glycine max
  Peptide Sequence Number=SeqID_165759
atgccagacgcatatgtttccactgtgaaaggaagggagaaatccgacaagagcaagactggagcagtgcctgtgcaaaggtgtcatgatagacgcatacccgcagataaactattgataaaacctggatggagcattacacaagccaaaggacattaccctgaattcgtagtgaccatgatgtgtgcaaaaagctgtcttacaaacgtcatcttcatgcatcagaatttggtgataaccttgaagaagatccagcttcaaaaaccaagtggcaccgccaagttcatcaaggagctcatcaatgaggacaggggaggagaaaaggctagtgctaggtcggatgagccccttctacaacatggcatcaacctgggcttcaatttcgtgtttctaaaaataagggtaacgataagggcgaactttgacaagcttagagttgggacgaaggtggatatagtgattggtgtgtcatggcagtttgggttgaagggaattcaaaggggacaatgcgaatatgaaagaaagcattggcaccatccttacgaactaggtgacgaagttgagttggagtga

SEQ ID NO: 48982 - DNA, 264 bp, Glycine max
  Peptide Sequence Number=SeqID_165760
atgcaggatgttcattgtataaacaaaaaattctgtggacaaaagtttgaggaatccagtggtagcttgtttgtgaattgtgaccaatgttatcaatggcagatggcggaacatggcagaaggccgaaattccgccatataacatgcattgtagattgcaccttatggtgccaccaaggcaaacctcttcacaaattgcctatggcggttgacaaaaaatccgccacgccattccaccatggcagtgccatggtcactatttaa

SEQ ID NO: 48983 - DNA, 1158 bp, Glycine max
  Peptide Sequence Number=SeqID_165761
atgaaacttgaagttccacgtttcgatggcgctgatcctgttggttggatttttaagatcaaccaattctttgaataccattcgactccggagcatgagtgtttgaccattgcttccttctatatggaaggtcgagccctcacctggtttcagtggatgaccagtaatggtcatctcacctcttggcctatttttcttcaggctctccagaccagttttgccccttcgcagtacgaggacccaactagagccttgttcaaattaactcagcgcaacaaagtcaatgcctacctttctgagtttgaagacctagcaaaccgtatcattggtcttccacttccatttctcttgagttgttttatctccggcttgacccccgagatttttcgcgaggttcaagccctgcaacctctaacgttggttcaggcggctgggttagcgcgtctacaggaggaaacgttccttgatagtcgttgtttatggtgcggccgcacgacctccatctcttcctccttcactatattgtcttctacgacctttgtggtgtcatcatcttctcctttgttgctcgcaccccaaaaagcaactttgtccctccctatcaagcgacttcctttagaggagctggccttgtggtgggagcatggcctttgctttaattgcgataggaagttccatcgtgaccacaagtgcacctccaaggtcttccttctaattgtggatgaagatgagggtttgcaagaagataaccttgagttgggccttttacccgacctgcctaacactcagatttcccatctggcccaaattatcctccacattctctcaggtcacctagctccagagaccttacgtctgttgggccacattgcagaccaacaagtagtgatattggttgatgagggtagcacccacaactttgtccaagagcatttggtgcacagtttgggcctaccgacccgggccacacctccagttagggtcatggtggttaatggacatcaactccattgccatctcctatgtgaagcttttttgatatgcgttcaaggtgtcaccttcttcgtcgacctccatgttctttcgttgtgtagtgcaaacttggtgttgggcatacaatggctcaaatccctcagccctattcttactaatggataa

SEQ ID NO: 48984 - DNA, 396 bp, Glycine max
  Peptide Sequence Number=SeqID_165762
atggcaaaaaagatgatgatcaaatttgataaatattgggttgtgattcatgatataatgggagttgctactgttttggatccaaggtataaaatggagttgttgcaatattattatgaaaaattgtacgaacatgattgttttgctcaagttagtaagattagacagttgtgttatgacttggtttctgattatcaattcaagatgaatggtgactccttccatagatctccaatacctgaagatggtaatgttgaaggtgatgagttgtgtgaatttgataatattttgaaatctaaaattcttgcacaaagtgatactttggttaatgagatagcttcaaatgatgaaggtgataatgcaagtgatatgatgggaagtgtccttactatctag

SEQ ID NO: 48985 - DNA, 261 bp, Glycine max
  Peptide Sequence Number=SeqID_165763
atggaacgaagaaggagaagcaggaggtggcatgacggaagaggaagatggagattgacaggtgagtctggggtgaggaatttatggattagtatgtctatcttgaggccttcctcatggacctttcccttagactgggttgtgcttgtggtttgttcttcctatcaaaatcacaaaattgcaaccccagaagtagaccttctgtcatcagggttaacagctcaatcatcatcacagaatgctctaatagagaaagcttga

SEQ ID NO: 48986 - DNA, 579 bp, Glycine max
  Peptide Sequence Number=SeqID_165764
atgacgtttgtaagacagctttttgcacacatcatggtcactacgaattcagggtcgagtatcttggtcacttggtctctgctaaaggagttgagcctgttttggcgaaagtccaagatatccagcaatggcccataccacaatcttctagggccttgcgaagctttttgggtcttaccaggttttatcaatagtttatctgcggcaaaccctttagccctaaagtacttcaagcttccacctatgtcagggagcttttcactatcaccatggcagtggagaaatggcgaagcaaacgtcgaagcaatagatgtaccttaccatactcacgggtcgcaaatgctttattgtaaaatcccagaaccactctcaagcaccttgcttttgcttttggtcccctacctaacatttctcgaagaactcaaacaacagatttctcacgaccaagcttttcttcaattacggcaaactatctctgatgagccaatgacgtatccggactattcaattgcgcaagatttgattctgaaggagggtcaaatttggttactacaagcttcacctttcatcccgacctag

SEQ ID NO: 48987 - DNA, 963 bp, Glycine max
  Peptide Sequence Number=SeqID_165765
atgaggaggcttggtggtcttgcagcttgcccaggcgagctagagctcttcacccctaagctatttgggggcccagagagaaagaaagaacaaacgaagaaaagggaagaaggagaagaagcggtgaagcgtagaacgaagaaacacgcggaaggaggaatcggcggtgctccaccggcgatcgctcatcgtcgccggcgaacttcagatcgctgctcttgcttctccggtgtgcttttcatgggaggtgtggaggatgaagcaccagctctgaaacgcatgaaattatcctctaaaggattagttggtctctcgaacggttcgtccggggagcctgttggaggctcttctagtgacttgatggctcggcccctgtcatctgaaggggacggcgaagttattggttccaaaggggttataaaacgggaggaatttgttaggataatcacgaaggcattgtattcgcttggttacaagaagagtggggtacgcctagaggaggagtctggcatacctttgcactcgtccgtggtgaatctgtttatgcagcaaatacttgatgggcattgggatgagagcatagtcacattgaataaaattggtctagcagatgaaaatgttgtccaggcagcttcgtttttgatattggagcagaagttttttgagcttctggatggggaaaaggtcatggatgcattgaagacgttgaggactgagattacaccactttgttctgatagtagtagaattcgtgaactttcttcccggatgctttctccatgtggccaggttggttcttctaagcgagatattgtactggcccttgtcttgcaacgtgaggcttgcctgtttcacaactcattggataaagagatgtcattatattcagatcatcactgtggaaaaactcagataccttctaggacatcacaggttagaaaacgttatgtctctttggtgtga

SEQ ID NO: 48988 - DNA, 213 bp, Glycine max
  Peptide Sequence Number=SeqID_165766
atgtacacggttcagttttgtgctttgaaaggtccaattgggttaagtcaagacatgactcctacacctaaatgtatgaaaacccaggagttgcaaataatgcgccttcttgaccacccaaatgttgttaatccacatactcaccaggtgcgactttggaagtgcaaaagtcttggtatgttttatgtgaaaggcgaaccaaatatatcatag

SEQ ID NO: 48989 - DNA, 846 bp, Glycine max
  Peptide Sequence Number=SeqID_165767
atgaaatggcagatcaagcaagtggacatcaagattggtcctgactatactccttcaccttttcttggtcctagctatacttctttaccttttcctggtcctagttatactccttcaccttttgttggtcatgccccttcaacaacaccaaatgaatccattccatcacccaaagcaaaaaaaacaattgataatttggagggaacaacacaaacaggaacaagtaggcttaaaagtgagatttggaagcattttcaaaaggtcaaagtaaatggacaagacaagaaccaatgcaattattgctcaaaactattgggaggaaaatcaaagaatggaataacacacctatgggggcataaacaaatttgtattcaatacaaggttgccatgagagggagtacagggcacgcatttcttgtgcctaaggtcgtccatggaaagcaagagttgggtacaagaacttatggtgcggataacacaaggatagagcttgcaaatgcaattattatgcatgagtatccactttccattgtggatcatgttggttttaggagatactcaacagctttacaacctatctttcaagattcttgtagaaacactatcaaaagagaaatattcagaatttatcaagaagagagatcaataactttgaagttattagatagtcttcaaggaagaattgacatcacatcagacatgtggactacgagcaatctgaaaaggggttatatgactatcactgctcattattgtggaagcaatatcttccaagattattttgatgatgccaaagaatcaagagtcaaacaagtttcaagaatcaagatcaagattcaagaataa

SEQ ID NO: 48990 - DNA, 680 bp, Glycine max
  Peptide Sequence Number=SeqID_165768
atgagtgttttggaggaaactaccttgactccttctaggagcaaggacttaggtcatcagaaaagtactcacaaccaagataataccaatctctatctctgtcctcactatttacaaatcgaggtggcacgggagaaaatccctattgtgcattctacttggaaagatgcccctgaatgtctaaaaaataatatatgggatgacatattgggtaaatttgacatccatgaaggaacatctgcgaagaaggtcatgtccacggttgcgaccagatggaggcaatttaagtcgtccctcaccactagatatgtatactctgagaaagacaatgaacataaccatgatccatctgggtacgatcttcttgaaaaaaaattgatggccgagaaaacaaaggcaagactgcatgaagctgagtttactgaaaatacagatagagtcgttgacccttcatcccccatttcaagacatgtcaagatgaattacaggaataaacaacacagggaacttttgtcccacatggtcattgtcgcaacctacccttcggcgggagggcgacgtgtgactcgcgggatgcgtgttccacgaaaggaatacgcgcggagtcgccaccaacgtttatttgaggaaaacgtcggaaaaaccggaaaagacgcgatctacgaacttttaagtgaaag

SEQ ID NO: 48991 - DNA, 255 bp, Glycine max
  Peptide Sequence Number=SeqID_165769
atgtatgttgtgtatatacatggggggtgcaatgaccatattggatatctctggagagggaaggagggtttaagaattataagcatccctgaagagggaaggggattgcttataatttttaactatccaaggaaaaatgcaagtacttgggggcatatcactcagtttaaaacttccttgagactcatgctgatcaccatgaggggagtggcttgtgcaggaaagggtgacctgatgcctagctttcctaagtga

SEQ ID NO: 48992 - DNA, 261 bp, Glycine max
  Peptide Sequence Number=SeqID_165770
atggaggttgatgaaccttggttggggttatggctaccattgaattatcaagtagatatgggagcaagtcagcataggacactggaatttggggtgaattctacaggctttctcactgcaaaattcatttcttggttggtgttttggtttatgctaaaggtggtgtttgtcattagaagtgcggtagtcacagcacgggtttctccttcatcctcaccctcttcatttgccctagttttctcattcgtccaagcaggatga

SEQ ID NO: 48993 - DNA, 186 bp, Glycine max
  Peptide Sequence Number=SeqID_165771
atgaatttattccttagcgctgttcatgtgtcctccaccatcgaggctggagccccgagaattgatttcctagagcccgctgttcatgtgtcctccaccatcgaggctggagccccgcgaaataattgcttagcgttgttcgcctatcctccaccttcaactcttaatcggagacccatgaattga

SEQ ID NO: 48994 - DNA, 420 bp, Glycine max
  Peptide Sequence Number=SeqID_165772
atgaagctcatgccatcttcgagatgcgtgatgcctgagtccatagcatcaaaacgatcgccgacgaaagcacaaagatccctaagttcaatgagaacatcattcaataaggaagatgaggaatcctattgtggtggtggggaaggtgttcattcatcaagaatcagaggtggaaagttgtgcttacacacccattggccatccaaatcctttcggtatccaaaggaggcaacagcaccagcaccaatagcaaaagactgtttgactttaacaaatgaaaagagagttaaggaccatggagaagaaagaaaggaattaggtgatgctggtggatcaccggatgtgccgtggcggcgttgtcctgcactggtggttgtggaggttgagccctttctcttatttgatggttctgccatttga

SEQ ID NO: 48995 - DNA, 195 bp, Glycine max
  Peptide Sequence Number=SeqID_165773
atgggtattaccaccataaaaaggggtcttcgcttctttgctagctgcaatggaaaagagaagggaatgcttaaaattagagaagaaacgggaaaagagggagagagagagagaacggtacggcgcatgataacgacgcgtataacgccacgtaaaccgcgcgaaaaagcagaagatgctgctaggtttgtctag

SEQ ID NO: 48996 - DNA, 1176 bp, Glycine max
  Peptide Sequence Number=SeqID_165774
atgacttccactttgtttgtttgtttagggctaagaatatctgactttggggtggaaagtatggttggcaaggagagtttgagaactgaggtcttgaacttgagctttgagaagcttatgatggttgaatgtggtggaaatagtgggaaaggagtgaacattaaagctggtgtgatcacggagtggaaggatattccagttgagcttttgatgcaaattttgtcacttgtggatgatcaaacggttatcatagcttctgaagtgtgtcgtgggtggagagaggcaatttgctttggccttactcggttatcactctcatggtgtagcaagaacatgaataacttggtcctatccctttctcctaaattcacaaaactgcagactttaatccttcgtcaagacaagcctcaactagaggacaatgctgttgaaactatagcaaatttctgtcatgacctccaaatcttggacctcagcaaaagtttcaagcttactgatcgctcattgtatgccgtagcccttggttgtcgggatcttacaaaactgaacatcagtggttgttcagcctttagtgacaatgctctggcttacctggccagtttttgtagaaagctgaaagttttgaatctctgtggatgtgttaaagctgcatctgacactgcgttacaggcaattgggcattactgcaatcagttacagtttttgaaccttgggtggtgtgaaaatgtcagtgatgttggagtgatgagtttagcatatggctgccctgatcttagaacacttgacttatgtggttgtgtccttataacagatgacagtgtaattgtcttggcaaacagatgtcctcatctgaggtcccttgggctgtactactgccaaagcataacagacaaggcaatgtactctttggcacaaagcaaattgaacaacaggatgtgggggtctgtgaaaggtggtggaaatgatgatgatggactaagaactctgaacattagccaatgcacagcactcaccccttctgctgtgcaggctgtgtgtgactcatgcccttccctccacacctgttctggaagacactcactcatcatgagtggttgtctgaacctgacttctgtgcattgtgtttgtgctggccaagcacaccgtgctatcactctccctcatgcagctcattga

SEQ ID NO: 48997 - DNA, 411 bp, Glycine max
  Peptide Sequence Number=SeqID_165775
atgttgaaggagaaatcaatccagcagaagcaaaatatagagaaaaatgtagagaaagccgggaagaagaaggagaagaggaaaagtggagccgaggcgctgcagagttgtgaccgtggatcacttcctttgtcatttctctttgtagtcttgggcatacaacccacagttggcacttatcaagtcgatgcccatattaacacgaacaaaaacttcaagggcaattgttctagaagtatattggacttgataggggctactattctggaggtacttcatcaagtcgatgcctatattaacacgaacattgacttcaggggcaactattttggaagtacatttggcttaacatgtggtccatggcccacagtagctactaaaccaacttttcctccatctaccactgtataa

SEQ ID NO: 48998 - DNA, 297 bp, Glycine max
  Peptide Sequence Number=SeqID_165776
atggagagtgactgtattgaggacatggacattgaagtcctttcttcaatgtggcctgaagatgttggcactgatgttggaaaaccattcaatatagaaaagtctggaacagaccatgatattttggaggaagtcacaatgatagaggagccaactaacaccaatttgcagcgtctcatggagcttacaaattacacagataaagggtcttctcagctgacatacaagcatgatatgctttcatggactaataggcctagactgagaaatgaatttgccttcaagtgtgagggttag

SEQ ID NO: 48999 - DNA, 406 bp, Glycine max
  Peptide Sequence Number=SeqID_165777
cgcgcacctcgctaaacctcacccagagtcatcatcgattttgccttcgccgctcgctttgtgtcctcagtccattcatccactcactggtcgtcgtacctgtgtcctgtgtatcgtgccggcattgcgtgtggccatcgtcaaccaggcaaagtactccaagctgctgccaattgaagttgctgatagcaaacaacctttacagaaggctatagtgaatttggatgatgttacaattatcatatctaaggatggatatgaggatatcatcatattagcagacaactttgctgcatttaatcaacgttcactggtgccagtaaaagttgcttccgggtcttggtggaagtatgctaacagagctgtatctaaccagataaagagttgtatcttggaaacatgttaa

SEQ ID NO: 49000 - DNA, 405 bp, Glycine max
  Peptide Sequence Number=SeqID_165778
atggatcaacaacagttgggaggccgttatccatggtcatcttccaaagacaggtcggatgaacgtcacatggaaagtcgtatctttgtccggggcaacaaaattgattttcacagtttcaaaaattttcatggttcttcagaattcgttctgcccatctgcaaagaagtatcgctcaccatattttcgaagtcttatcataaaatggttgattccattacaattgaagacgaaaaaagacgggtaacgcgggtaccattgtctatgcttgtaggcttaggatcttcttcatcaatgggttcctttgcttcttggaagatgaatggcagcggaatggagaaggaagagagagaggagacgccacttcaaggagaagatgagtctagaagaagctcaccaccatag

SEQ ID NO: 49001 - DNA, 408 bp, Glycine max
  Peptide Sequence Number=SeqID_165779
atgcaagaattaacacctgaagaggaacgggaatggaaagaattggcaaaaaagatacaggatactgcggctccacccgatgctattttcgtcaccattagcgctagagaccagatttttggtgaagttggtaaagtatatgctgtcaagtttaaggacgtgctgaaaggtttatggcatttggttgacagagacgatacttatcatatcgttgtctacaaccgcgatctggaccaaccagccattgtggctgggtggacaacactatgccatttttaccacctaaccgcagatcatctcggttccttgcctgccgaagtcattccccaagtggcactctttgtatcatcaagtgccatgttctatgaccttcaaggtttttcttacttagcagaaaatttcccatag

SEQ ID NO: 49002 - DNA, 153 bp, Glycine max
  Peptide Sequence Number=SeqID_165780
atggctgcgtcaatgttgcgaaataagcatgtccatgagcttgattgtatttgtcctttcaaaccatggcagcaggtcatccaaacttgcaacgagtattatgagaaggaccctccggatgagggttgggtgaccctgaatacagatggttga

SEQ ID NO: 49003 - DNA, 180 bp, Glycine max
  Peptide Sequence Number=SeqID_165781
atgtttccgtgggcgatttcgcgaaggttttccaccattcttcatcgttcttcgttcgttctacgtcgttcttcggtcttcaaccggtctgatttccttatcacaaatgaggaatacgtaggagcaagggaaacacccttgtcgaccacaaaaagatttaaaaaatacaaaaaggcgtaa

SEQ ID NO: 49004 - DNA, 1440 bp, Glycine max
  Peptide Sequence Number=SeqID_165782
atgacagaagaaaatggtgattggaagccaaaaattggtttagagttacaagatgtagaagaagcatggaaattttggagtaaatatggcgagaaagaagggattagaaagccaaataaaagagatggacaagctaccaagcacagaactgagaccagaactaatcgctctgtaagagttggtttgtcattggggaagaatggaaaatatataatccatgagtttgtaggaaagcataaacacccattacaacttccagagacaacacacatgcttgcttcacatcgtaaaataacagaagttcaagctcacgagattgagttaggtgaagactctggattatgccaaaaggcatcatttcagcttatgagcacacatgtggggcataaagctaatattggatatactcggttagatgcaaagaattatctcaaagcaaaaagacaaagaaatatggtgtacggggaagttggttgtctactacaatgttttcaacaacaattattagagaatccctcattttttcatgcataccaaatggacatcgatgaacaaatcacaaatgtattttgggcagatgcaaaaatggtgttggattacgagtattttggtgatgttgtctctttggatactacttattgtaccaatcaagcaaataggccactagctttgttttcaggttttaaccattacaggagttcaacaatctttggtgcaactttattatatgatgaaacggttgaatctttcaaatggctatttaagacattcttggaagcacatagtcataaaaagcctcagaccattttcactgatcaagaccaagcaatggccaaggcacttgttgaagtaatgcctgagacgcatcatgatttcaagaaatgcatgtatgaatttgacactaaggttgagtttgaggaggaagcattcacacttgggatgcaaagtactcaaataagtgagagcttaaattctcatttcaaagcttgcatgaagccagatgttgttcccgaaaaatacattcttaagaggtggacaagagaaggtcgtagtggcattatgcatgattttagggaaagagaggttgaaaaggatcctagactttctagcacaaagaggtatcgacatttggcatctaaattgattagggtgacatctgatgtatctccttctaaagaatattgtcaactggtagacgaaagtatagatgtcgtgttcaagaaaataaaagagcttcgcttacaagcacaaagcactaacaagaacaagaatggtgttgctgcattggtgatcaatgatgatacacaacctaaggggttcaagcaacgacctagcacaaagaggcacaaccaaaaacatctcaaaagttggcttgagttacaattaaagaaaaagacaaaaactataactagatgtcaatcacgaagtcaaacatctaag

SEQ ID NO: 49005 - DNA, 861 bp, Glycine max
  Peptide Sequence Number=SeqID_165783
atgccagcacgtgaaatgctcgtgagtgggcatgtcttcttccgcgctccttcctcgttcgtgttctttagtggtcttcctcgcagtagtcttcttctcgccggcacaagctttggttctccattttggttccatcgatcccttcgtcttcttcattggctttctgttagcgtttcttccgccatcgaggttgaagacgaagttcttctgcgagaagaagcttcttccgcgcttgtgttaggggatgaaaatggagccagcggaagaagaagcatgttaccatactccaagaggttggtcgaagtcatcttcggttggtcaaaggttggaggcagaggcagagaccttagtcaggatgtggctgaggatgttcctcggcgtcgtaggcccactgcctcagcacgtaggcaacgggttacccagagagtcgaggatgttcctcagttggctgaggatgtgcctcatgggtccgatggtagcccagagaagacagcagctgccgatgatgctgagatagatcgattggctagtgatggtacagttgatgatgatgaggggtccctcggtgggccacgcgatccatctgttttgataggatttgctgatcatgtggcacacagcatatggagtggacagcgacccgatctcaagttggtctcccatggtaggaaagtagataaatttgggagaccggctgctgagatcgaaggtatgattgcggccaccggattggattcattgatcaggtgttctgtgatcaccactgatcctggacttatatccgcctttgttgagaggtggcatagggagacgagcagcttccacctcccagtaggggagaagacgatcactctagacgac

SEQ ID NO: 49006 - DNA, 1311 bp, Glycine max
  Peptide Sequence Number=SeqID_165784
atgtctccttttgaaaaattatatggcactgtatatgacatttcttccttaaaagtctttggttgcttgtgctacactagcattctcactaataacaggaaaaagcttgatcttagagcttttgcttctgttttcttaggcttcaagcctcacactaaagggtacattacctttgatctttccactagagccacaaaggtatctagacatgtcattttctatgaaaattgcttcccttatgcctctcttagtgcctttcaatattttcccacattccttgtgcattcctatcctaccatttatgatcatggtaaggatttggatttttcttcatcatcttcacactttactatccctgataattctcagtcacctaacatttttgttgatcattcacaattgggctcctcaaacacttcttctgatccatcaaattcaccaattattattgctcctagaagatctgacatggaaagaactataccaaagaagtttcaagactttcacactacattcacatcacttgttactggtcaatcctcaatgtctcgtacataccatagttttatcatggctacatcctctaagacagaacctaagtcatttaaagaagcttcccaatcagacaaatggatcaaagcaatgaatgctgaaattaaggctttaaaggataatcgtacttggattttgactgacctccctcctaacaaattttctattggatgcaaatgggtttataaagttaaatacaaggctaatgggttactagaaagatataaggctatgttagtagcaaagaggtatactcatattgaaggtcaagactaccttgatactttttccccagtggctaagataactaatgtgagattattacttgctttagttgttgttaacaactgtcatttaaagcaattagatgtgaataatgtctttttgcatggaaaccttaatgaggaggtttacatgaatttgcctcctattatgcactcaaccaaatttaatcaagtttgcatattacatagatctttgtatggccttaaacaagccagtagattgtggtatgttcgattgtccactttcctcacctcacatggttatagacaatattcctctgatcattctttgtttcttaaacaacatcttcagtcttctactgctttactggtttatgtagatgatattgtcttgttaggcaatgatcttctagagattaaattcatcactgagcttctggatgaagtttttagaatcaaagactttgatgacttgaaaatttttcttggatttgaagtggctcacaataaataa

SEQ ID NO: 49007 - DNA, 468 bp, Glycine max
  Peptide Sequence Number=SeqID_165785
atggaggggtgtatgaaatttaactgtgatgaagcttatcttccagtaggagtagcttcatgtagtgttgtcataagaggtaataatggtagctttgttcgggcttattctaaaaggagtggcgagaggaagtgttttaaagagcttgtagctgagattagaaaaaatcaagattggtttcggacgattgatgtcgaacatcgacaaacgacttttctcctctctcgcttttttttgacatggtttaaatctggcgaggtagctcttctctctcccttttccggtgcttttggcgaggtcacattctttgcgggtttccgttcaggccttaaaggctttccaaaactccggaggaaggatacaaattataaacgagttgccatggctagcctcatttgtgcaatttacatgcttgaatttgatagacaggagaacaaaacacaagaaaatgctcttgctccaagttag

SEQ ID NO: 49008 - DNA, 939 bp, Glycine max
  Peptide Sequence Number=SeqID_165786
atgggctctgtttttggcctgattctgatggtattttcctgggtgtcgtttacatttccgggatccaatgctcaggagggtgtcaaatcagctcatgttcttgacctcatcataagagatcacacgttcaaggcattggacaagaactttaggacagcaataccacaatcagtgagcttaccagcaaatctttcaggcattggaattgatgctgtgaggttcagatgtggcagtttgagaaggtatggtgcacacctaaaggaattccatcttggtactggtgtaactgtgcatccatgtattgagagggtcatgttgataagacaaaacatggggtacaattggtcttctatatactatgctaactatgatctctctgggtaccagcttgtgtctccaattgtgggactcctagcttacaatgctgatgaagatgcaaagtcaagcaacccttttcagcttgggattgtggctggagaaacgcctatgacaattgacttcaccaatgccacaaagatgaaccaagatggggtcaagcccttgtgtgctagctttgaaggtgatgggagaatgacactagcaaaagcaccaaacccttcaacaccacttgtttgtgttgcaaagaggcatggccattttggcttggttgtggagtactcgccgccggatcagttcaggaataagcccttaagtaggtggaaagtggcggttgggagcactattggtgccgctttgggtgcttttcttttaggccttcttcttgtggcaatgcttgttagggtgaagaagagatcaagaatagtggagatggagaggagagcctatgaagaagaagcccttcaggtttcaatggttggacatgtgagagctcctactgcacccggcactcgaaccacacccgtaattgagcatgagtatatacctcatcatcctcgttga

SEQ ID NO: 49009 - DNA, 144 bp, Glycine max
  Peptide Sequence Number=SeqID_165787
atgagacagaccacctttggagagtctcacgactttcccaggagagacttcgtcccagacgatcgtgaactcaaggttgacattcatttttccaaatggaaccgtcattcacaacgagtgtggggtttattttcaaagttctag

SEQ ID NO: 49010 - DNA, 248 bp, Glycine max
  Peptide Sequence Number=SeqID_165788
atgtcaactgcggaagaaggttcttccgtggagtcccacggaagaattcttccgcccctatcaacggcagaagaactgcggaagaaccttcttccgtgggactcccacggaagaaggttcttcctcagttataatgtcaactgcggaagaaggttcttccgtggagtcccacggaagatttcttccgcccctgtcaacggcagaagaactgcggaagaaccttcttccgtggagtcccacggaagaag

SEQ ID NO: 49011 - DNA, 453 bp, Glycine max
  Peptide Sequence Number=SeqID_165789
atggtgatttttcaccatggagatgcagcggaaggcaaaggagaagaggagaggggccatccattagggaataagccattgaagaaagagcttcaccaccaagaatgtgccttggataagaagcttgaagaggatgttttaatggaggaaaagaaagagagaaggggggagcacaaaattgaaggaataaaagagggagagaagtggaactttgaagtgtgtctcataagactttcattcttcaaagttacaacaacccatgggctcgaaatctaccctaaggctcatgagaaccctaggaccttcccttggatctctggcccaatctacttggagtcttctatccaatgcccttgcgggataggatttcatcattccctccaccttggaaaggatttgacctcaaatctcgaggttcttcatactttgggatccttccctcaacacctatag

SEQ ID NO: 49012 - DNA, 2346 bp, Glycine max
  Peptide Sequence Number=SeqID_165790
atgaccattgatctcttggacaattcagtgagaaccattgaagaaggattaaatatggttgaagaagaagagaatggccaagaacaagagttaacgatcgaggaactcgagacgaggatgtggagagaccgaatgctgctgaggaagcttaaggatgagagaaaggagagagagcaagggaaaacggtggagatgatgaagaagaaggccttgactcgtgcacaagacattgtgctgaagaacatgctgaagatgatggaggtttgtgatgtaaggggttttgtttatggcatcatacctgagaaggggaagccagtgagtggagcttctgataaccttcgtggttggtggaaggaaagggtcaagtttgatcgtaatggtcctgctgcaatgctgaggtatgatgaagaaagtgggttagatgacctgcttaatgaattcagtggagacccagcatcaccgtaccgtttgagtgatctcccagacacaaccctagggtcactcttgtcgtgtctgatgcagcactgtgatccaccccagaggaggtaccctttggacaagggtgttgccccaccctggtggcccactggacttgagatttggtggcctgagctgggcttttccgaggacccgggcccaccaccctacaagaagccccatgacctcaagaaggcatggaagttaagcgtgctcactgcagtgatcaagcacatctcccctgacgtcaccaagatcaacaacatcgtgcgccactcgaggactcttcaagacaagctcactgctaaggagacttctgtttggagtgctgtgatgaaacgtgaagaaacccttgctagaagattgcaccctcatttgttcccaccccaaccaattattagaaggcccaatgagattcatggtgctaggaactttcttggtggccaaagtagtcataacccaccgccaactctcaatgttgctgctcatagtaataataatatgcttctagcaagtggaagtgctagaaatttccttggggggcaaaataacccaccaccagcatacaatgtttctaatggtggtgctagaaatttccttggggggcagaatagtccaacaccaccaagcaatgttggtaatggtgatggtagaagtttcctgggggagcaaaataatccaccaccaataactaccaatgttgttaatggtattagcgataataatagtatggttgcagtgaacaatggcaatgttgtggcactaggtcatggtgctaataagagaaaggaagttcaaggtatcacaattcctcatgacgcctattcctgccatagccctcagtgtccttatcatgagagcagctttggtttcagtgacaggaatgtgaggaacaatcatcagctgacatgcagatacaataatgggaacaaagacaacaacaacactatacaagtggttggaggtggtggagcctcaagctcttctcaggttggaagtggaaaccctagtaatgttaatgtgcctcttggtcaatctatgaacactgctgcaacagttgtgaatccgaatcagactcagaatcttactaatggtcaacctatgaacatttctgcaccagttatgactcaaaatcagtctcttactattggtcaccctaggcacaatgctgcaccaactgtgagtcaaaaccagactcttactgttatcagtgacaattctggagaaaaagggtctggtggtttgatgcacaacatgaatgttcttcagcagaagaattccactagtggtgctggcagcagcagtatgagtgttgttgttcctctaggaaaccaaaacctgcagcaggtgcaaaatgttcttcagcctcaggtggtggataacgaaaatttctttggtggtggaagggtttctttggacaagattaatttctttggcaacaacaacaacaacatgaatattaatgttcatcctcttctagaagcaagccaaaatatgcagcagctgcaaaatgctcagcctcaggtggacaagaatttctttggtgcaagggtttctgtggacaagaataataatctcgttggcaacaccaacaacatgaacaatattgttcctcctctaggaagccaaaacatgcagcaggtgcaaaatgttcagccccaggttgataagagtactttcgttggtgaaagggttgatggtggtgccagtggctacaagctgaataatgctgaagtgcacggagatttttcaacatcaacatcaatggatccttcttcctatgaatgggatgcaaataactcccaatctgattttatggactctctgttggaagcacctagccaggatttattttggctatacaattaa

SEQ ID NO: 49013 - DNA, 303 bp, Glycine max
  Peptide Sequence Number=SeqID_165791
atgttttggacaaagtggttaggagtgatgaatgtgacattgaggaggcagcgaagtatggttacctcaacacaggatcataatggcggttcttgctgtgtgacaaggttgataaggaatggtaaccttgttgtgtctaatgctagtgattttcgtgttgtgattagcaaaaagggtatggctgaagtcctaacatctgaacacaagccttctagggaagatgaaagggacaaaattgagactcgggttagcaatcaggaagcaatagatattactcatcctttctatgtggggaacaattga

SEQ ID NO: 49014 - DNA, 222 bp, Glycine max
  Peptide Sequence Number=SeqID_165792
atggggggcgctggtgggaatggtgacaccagcgccacgtggcacgtccctgacgaaagtgctaatggtggtggcgccatgcatggagtctacgtgaaaaaagagcacccctcaggaatatgttttgttacaagaccaatgtcctttaccactagtggctttgctgtggagtacacattgtcattctcaggcaaagcagtggggcactccatacataggtag

SEQ ID NO: 49015 - DNA, 150 bp, Glycine max
  Peptide Sequence Number=SeqID_165793
atgggaggtcttgatgcgacaacaactaatgcgacattgagtagctcaagcgcaaggttgacagccacagagaagcgcaatgttgtgtttaggaagctcaagatcgctgcaaaaacaaaatttggggatttatttcaagccaatgtctaa

SEQ ID NO: 49016 - DNA, 843 bp, Glycine max
  Peptide Sequence Number=SeqID_165794
gcgcgcaccggcgtcttccacgcgctgcagcaggcccggcgatcggctgttgatcaccgtgggcgtgacgaagaccaccaattcggtctcttcgttctggaatcgctgggaccggaacagggcacccagcacgggcaggtctcccaggaagggaaccttgtcgacgttgtcgccacccttgcgcgacagcaagccggccagcaccatggtctcgccgtcctggacgttgaattcggtgaaggtgcgccgagtgctcaacccgggccccgagggcgtggagaacgatgggtcgatgttgctgacctcgctgtcgatctcggccctgatgacgccgttgcggtccacgcgcggcgtgatgcgcagcttgacgccgtagggcttgaacatgaccacggggccgtagatcgtggccacggagtacggatattcgccaccggccaggaactcggccttggagccattgcgcgccgacagctggggctgggcaagaatgctggcctttccgtcgcgggccagcaggtccagctttgcggtcaggcccatgttgacggcggtgaggatgttcaggcctcggggcagcgggcctttgtcaccgctgtccggggtgattggcgggttctggacgccgatgaccagaccgggctgatggccgcgccgcgccggcgcccagatgcctcccacgctggccccgccctgggaggtccagcgcaagccgaattcgcgcagctcattgaccgggaattcgaccaccttcacgtccatgagcaccatctgctcccagccgatctggttggtgaagttgatgatctgcgggtagtgcttgcgcaggtcttcgatctctga

SEQ ID NO: 49017 - DNA, 309 bp, Glycine max
  Peptide Sequence Number=SeqID_165795
atgaatattcatcctcttgataagtacttgtggctaagcgaggctgattcgcttagcccagcccccgaggttgttcctcccaatcctataccaacaaggacagagcctgcaccagctgaatcacaacctctagtagtagacccacctgcttctccagaggttgagatactatctcttccaccagctccaccggcaccacctttgatactcattcctgatgactcagatgctgaagctccagctcctcctgactcaccatcctactacctagaggatggttcaaacttttttgactggatggactattga

SEQ ID NO: 49018 - DNA, 471 bp, Glycine max
  Peptide Sequence Number=SeqID_165796
atggctattactcaaataggaatggaaacaacaacaatagtgcaaccaggacaacaacatcaggaggaagagatgctactacaagtgcaagtttttgagatgtgtcaccatcatgtcctagctcttcggcaagaaaatacccaacatcgaagtcttaatagaacatggaaagtacaacacaagacatatgttaggaccgaagatggaagtcaactcttgtttgcaaacaccttaagaaagcaactacaacaatacaaaaatcctttcctccccaggatcatggaagctgccttcctagtggaaacgcttgactatataaaaattatgatgacactagtgatccaaatgaacatattgatgtgtatgtcacccaagttattttgtataccacaaacaacaccatcttgtgccgggtcttctccacttcaccaaaaaggcataccctcaattgctttattcaattatccctaa

SEQ ID NO: 49019 - DNA, 576 bp, Glycine max
  Peptide Sequence Number=SeqID_165797
atggaggcagtctctatggtcgtagatgatgaattcaatgaaaatcaagttttggatacaaaagtcaacattataagcagagtgcatgaggatatcgatactgagtttgataaaggaaatactgatatcaattttgaggttgataatatgaagactaatactgaggttagtcaagatattatcaaaaagatagatactcaattcaatcaaagagaaaaaggcatcaatactgaagttgataaggaaatgactaatactgagaaggaagtaagcccatctcagaagaagatattgagcaacagaagaaacttcaagactaaaaattgtatatgcaacaattctcctattggtttcgagaggccaacttcccaaactatcaaaagaatagagggcaggacccattggagacaattcaacagagaagccagatccagaataatgtgtactaacattgctaagaaaaggataaacaacttaaacacaaaaatatatcgtctaatgaattgtcaaaaatatcacttcaaaatcacttgttcgtttttctcttgtcttctcgtattgagtggcagaggttga

SEQ ID NO: 49020 - DNA, 318 bp, Glycine max
  Peptide Sequence Number=SeqID_165798
atggaggaaagggactacactgatcatatgatgcaagtatatgaacccctcaaactaaaaaggaagaaatggaaaaaggttgtacaggttgagcatattgctgcactagctaaggaagccactgcccaagtcactggagtacttgctgatctcaacactattggtgctttgcaagagaatgttgaaaatgttacttcaccagcaacatccaatgttgttaaggctaatgaagtgttacccactaaaaaatctacacctacgtccacccagcaggaacgctcaagtgaagccacatctttgcaaaaaggatgcttctaa

SEQ ID NO: 49021 - DNA, 324 bp, Glycine max
  Peptide Sequence Number=SeqID_165799
atgattgggagtgccatgagtcttatgatgaacccatcatctttttccttcatcaaagtgatacatcttgactggatgcaacactttaatggaatctttgtggtttgcaacttcttttccatcagacccaaatgtagaggctttagttatgtcaagccagatagtttaactctagtaggttttggtatcaaaacgatcaagcttgcatgtaaggttgttacctttgaagaaggtcttccaatcccagggatggttaacaagttctactttttgacctctgcaaggcatttctccgttaaagtagagcttggatccattgggtag

SEQ ID NO: 49022 - DNA, 258 bp, Glycine max
  Peptide Sequence Number=SeqID_165800
atgattgaacatgtattggcgatcagaattgccattccctggattacggggttgaaccaagctcatgcttttgcgaaactggttcatcaagtcaagttgaagtatagaagtaaccaccttgcaaaaaaattggggcaaaagatggatcgagttacatcgctgcttcatctaccgccaaacacatttaggactattgatgtccttgttacttccagtttcaccttgaccaagatgtcatggaccatgttgaaagcctaa

SEQ ID NO: 49023 - DNA, 657 bp, Glycine max
  Peptide Sequence Number=SeqID_165801
atgccactgaagggcaagcagttggtgatatacccctgcaaaacactttggagggcccacagtatcacccacaaccacacccctcacattccacagcgatttaaaaccctcatgctatggcggaaatgggaaagttgggtacacgccctatacaaccaagtttcccaccaacccaacaatgcaaaaaaaaatggggcaagtgaagagggtgagaatgagggagaaacccatgctgtgactgccattcctatacaaccaagtttcccaccaacccaacaatgtcattactcagccaataacaaaccttctccttacccaccacccagttatccacaaaggtcatccctaaatcaaccccaaagccagtctacagcacttccaatgacaaacaccacctttagcacaaaccaaaacaccaaccaagaaatgaattttgcagcgaaaaagcctatagaattcaccccaattccggtatcctatgctaacttgctcccatatctacttgataattcaatggtagccataaccccagccaaggttcatcaacctccatttctccgagaatacgactcgaatgcaacgtgtgcttgtcatggagaagcccttgggcgttccattgagcattgtaaggtgcaaggtctaattgatgcgggctag

SEQ ID NO: 49024 - DNA, 207 bp, Glycine max
  Peptide Sequence Number=SeqID_165802
atgcatgtggacaagtgcagcagtgccccaagcgtaacccccactcttcgtcaggaatataaagatcccgtcaatcatcctgtgaatgatcctctgcatgctcgttcagatcaaatgctggtgcagatggtggatcctaaggaatggatcctcaaggaatcaaccaaaacctcacagtcattgtttcactcaagctccagtgtttag

SEQ ID NO: 49025 - DNA, 546 bp, Glycine max
  Peptide Sequence Number=SeqID_165803
atgaaaaataggctagaagagctaccttggactctattcattgatgagtcatccaacaaaacacaatgtggagtaggaatcttgctagaatccccacatggggttgtgcttaggaaagcattgatgatagaattcccattaaaaaataatcagacaaagtatgaggcatgcattgcgggcttggaaatagtagtcatcatggaagtccaagtgttaaaagtatccagtgactccatgttgatgattaaccaattgagtagagaatatcaagtcaaagaaccaatattgcaaaaatacatccacaaaatcgggttaatcaaagaaaaattcaaaaagttggaattcatctacattccaaagggaaaaatgatgttatggccaacattttgggcacaaaactctaccaagaaagatattgagagccgactattactggggattgacgtactaggacctttcccaagagctttgggacaagttaaatatctcatagtaacggtcgactatttcatcaagtgggtcgaggccaaacacttgccaccataa

SEQ ID NO: 49026 - DNA, 606 bp, Glycine max
  Peptide Sequence Number=SeqID_165804
atggcttcttgtaagagaaaagccacaacttcagtgtcacaggcagccaataacatcctcggctggaacattcttccggagaggaatgtgaagctttacattactgagtttgatgaatttagaagagaattggagaggaggaactggcacagggagatcactaatttttcggagggaagcatagatgtagtagtggttaaagagttctatgcaaacctatatgaccctaaggacaaagcaccgaagcaagtaagggttcgagggcacctgattaaatttgatgttgattccctcaacaccttcttgaagacaccagtggtcgtggagaaagtggagagcttacctttttgctccatatttgctagactgaggcctaatcctcaggagcttgcagctcgactttgtataaggggatttgtacttaatgtcgagggtctaccgtggaagcttttgaggaaagatcttaccactctggcccaaacctggagtgttctatcttattctaacttggccccgacatcccatacttttgatcttaatttggataaggccagatttcactcattgcacagtccaactcctcgcggcttggatttccagccctga

SEQ ID NO: 49027 - DNA, 297 bp, Glycine max
  Peptide Sequence Number=SeqID_165805
atggcgaggcaacttgcaggatatatcactctgttacagtgttggatctacaagcattttctgtctgttgctaccgctgttcctaccgaggattacgacgaaaggagaccgcgtgcatgtcgatggacctctagcaaggcactgcccgtttccacgtatcggaggagtctggatagactgacccctgacgcggtgtgctggatttcgtacggtgaccaccgttcatctagagaatttgaggtcatctcattattttatgaccatcttagatggggccccttgacggtcattcactga

SEQ ID NO: 49028 - DNA, 822 bp, Glycine max
  Peptide Sequence Number=SeqID_165806
atgcaaaagattagggaccagttggaggattcgatcacagaaaaagtgactcgacaactaatattgtcctttagccagatgcaatcccagtttcaatcacagatgcaatcacagggactcgcactgcctcctgagccagaggttggtccttcagctgctcgtgtagcacaaaggagagttgtgttgatccctcaaggaacgaccaagacacgggtgactcagagaaacggaagactttatgaggggtccataaccgttcataacatccatttgtgtcatgatcaagtcaaggttggtgttgaggaagttagagatgcagatgcttccattcctgtactcactcaacaggttcagttagtgggacagacacttaacacctttgttacttggccgacacatcttgtgaagcgtttatcagaacagggagctatgggatcggacaaacctacagataggccggatcatgatgtcaatgatcctctatatcttatgacattgaccatcccacaactttttctaaatccattgcagaattcaaagagggatgtgtacctaggagcctacttgaatgggctagacaactacctcaagggaattatcaacatgttagttctatttttcaatacatttgcattagcattagtcgggaacatcaatattttaattgtacaatacgcattcatgtttgtattgaatgctttgaaaggacttgacgatactccacaaagtaaatccaaggttgttgctaggtggactgttgttaaatatttcaatgatgctagaccattggaactagagagattgaaggtgcttcatatctag

SEQ ID NO: 49029 - DNA, 141 bp, Glycine max
  Peptide Sequence Number=SeqID_165807
atgcagaagaagcgaaaatgcaggaaactgggtgcgagagagaagatgcagctgggcatagcgcacagaagcagcgcttggcgaattctacaggtcataaaacctgcaactctcgctaagccaggctctgggccggcttag

SEQ ID NO: 49030 - DNA, 1071 bp, Glycine max
  Peptide Sequence Number=SeqID_165808
atggcaacaccaccaccgtccctgccacaattagaaaaccctcctgaggttacttcgaaaaggacaagacaatccacgaggctcagaagtttgacatctagatgcttagatggcccacggccagttgtgaacgtgaatccgactacaggtagagggtcagagcctcataaagaaaaatttcacagttatttaggggttgtcgcaaaggaaaaagttcctattgtacacgcgaattggaatgttgtcctcgacgatctaaagagcttaatatggaaagatattttgcgcaaatttgatatccctgaaggtgaaaatgcaaaaaaaaaggtgatgtcaacagttgcagcaagatggaggcaatttaagtcttcattgacttcaaaatttgtctttgctgacaatgaaggtcagcaaatatctgatcctacagtcaagtatggccttgattcagaaacatgggcggaatttgcaaaaagccgcaaaacccctaattggcagaaacttatggaggagaagagcaagcgtggacatgaggaacattcgtgtactgaaagcccaacactcaacattgacccaccatcctcagtttcaagacacttgaagtggaagatcgcccgcacaaagcggcatgaccaaatgacgtctgaagtggcacaagaaattacagacaaaattgattcattacaggaacaagcaacacatgggagttttttttcgcatgggctacaggacatactcaacatggcctttggccgacctgagcatcaaggccatgttcgcgtcgcatggacaggtgtcacaataagccaatactttggccaagcctcacgtgcttctagcacattgtcaccatcgatcaaccaacaacaattggctaatatcatcggtggaattaaggatgacataaaaaagcagctacaagatgagataagaaatgaggtacaggatgagataagaaaggaggtacaacaagaacacaagcaacaacaagaggtttggataagggcagttgaagaaaaacagtgtcaaaatttggagatgatgaagcaagagttaaaaaaaaatcactga

SEQ ID NO: 49031 - DNA, 420 bp, Glycine max
  Peptide Sequence Number=SeqID_165809
atgatgatgatcagtatagtgtccaacaacaaatgtcgtgatcacgatgcaaacaagaagacaaataatgcctacaaattaaatatttcaatgctaaccaaacatcacattaacttggtccataagcttcacttctgtccagcaaaccgccattaccttaacacatccttaataagtgatgcaagctccattggagcttgtaggcctaggatcttcttcatcaatggattcctttgcttcttggaagataaatggcagcggaatggagaaaggaagagagagaggagacgccacttcaaggagaagatgagtctagaagaagctcaccaccataggaggccatggataagagcttggaggaagaaggagatgaatgaggggagagggagagaagagcacgaaattttgtgctctaaatga

SEQ ID NO: 49032 - DNA, 198 bp, Glycine max
  Peptide Sequence Number=SeqID_165810
atggacatgtcgattgttctaaatcatgatgatcccttattggttaaggattttataaataataaggtggaatttcaaaatcccatagttggagctgctcccctatcacaaggatctcttaggtttctctggtccccacataactccaataggatatgtaaaattgcacatgacctttggccaggcattagtaactag

SEQ ID NO: 49033 - DNA, 1158 bp, Glycine max
  Peptide Sequence Number=SeqID_165811
atggcacgtgttgctgataaaataaaattgatagttggatcaagggaagctcttaagctttctgtaaggatcactgatctttggttcattgggattcctggaaagactgaacaagctgaaatggtggttgttgattctgatggagatgaaatgcatgttgtttgcaagcaggatcagctgaagtctcgcaaggctgatttgaaagaaaatttgacttatgtgatgcataattttaaagttatcaagaatgatgggaaattcagagtttgtgatcatgaatataaattatgttttactggagttactgttgttaggcaatgtgatatggaacaattaccttttaggaaattcagatttgttgctttttccagtgtcattgctagtcattttaaaattggcctcttggttgatgttattggcgtggttgatgaagtggtattccgatatgtgtcatccaaaaatacgagggttgttttgaatttaaaggatttgaggccgatcgttattctcttgactcctgctaggattaaggaagcacagggatcatatccaacatcggtcagtaattctttcaaggcatctaaactcatgatcaatgacctggtgctggaaattcaagaatttagagagagtcttttagatttagggatcgaggttagatcaattttgacgcctattggacaagggagttcacaggtttcaggctcatctcaattatcatcaaaagatgtgtttctgtcaaagactaaagttttctttgtagaaaatctaatgtcagtttcttcaataggagtttgtttgtgttactgtcgccaagattatagccgtagtgatggacaactattcatggtgctatccgccttgtggtatcgggttgaggtgatggttagtcacaagggtgaacaaaccaaatttttgatctgggatcatgaatgtgcacagttaattggtcagtcagcggatgaagtcaacaggctcaaaatagaagatggggatgttgatttaaatgcctctcctcaagcattagataggctattgggttgtttccttgcattcaaagtgaaggtgcaaccaaggttcaggaattctgttgttcttaaatattcagatgaattagagttgatcaatgttgtgctagatttgattcccgatagtgag

SEQ ID NO: 49034 - DNA, 272 bp, Glycine max
  Peptide Sequence Number=SeqID_165812
ttgagcttagctcatcagtgggctaagtgcgcatccactgctaagtggagcttcaacgcacttagcgcaacagaagaatctggcagagcatcaatatcaaggtcgcgcgctaagtgcgagatcagtgcgctaagcgtagtagttgtcttcagccatgctcagtgcatgactggcgctaagctcaaatccacttactcagcacaccacagtgcctatttggggaaaagagctctggaggcagcaagaggagcagcttttgcagagatacctag

SEQ ID NO: 49035 - DNA, 357 bp, Glycine max
  Peptide Sequence Number=SeqID_165813
atgtacaagaaagaaagaaagaaagaatgcctaaatcatatccatgcatcatatgttattgtggaagcaatgccttccaagattcaaaggactaaccgcctaagaatcctttatcttaacacattagagggtacatcctttgtggtacaagtagagggtacatctacttgggttgttgtaactgagaacaagaaatggtacatctcttgtggatcagttcaagtgaagggtacatccacttggttgtttaaagggaacaagggagggtacatcccttgtggatctttgcttgtaaaggttttttacaaggttgaaagaaatctcaaggactgcaggttgcttagggactggatgtag

SEQ ID NO: 49036 - DNA, 258 bp, Glycine max
  Peptide Sequence Number=SeqID_165814
atggaaaacgttgccgtgtttgacgagtgtctacgaaggggttggggctccaattgtgacgacaacggtaataatgtcggtgctggtaatggtcacagtgcccgtgatactgacagtagtggatgtgacattgatggtgattgtagcagtgtcaatataatggtggtggcaacaatggtggtagtggtgttgacgttggtggtggtggtgacaatagaaagtgtcattttcaaatgtaggaatagtttgtttttctaa

SEQ ID NO: 49037 - DNA, 663 bp, Glycine max
  Peptide Sequence Number=SeqID_165815
aacaacaataataggttggaggaagctattgttaaactcactgacttgtccattgcctccatggccaaccaaaagaacataaatgtgttcatcaagaacgtagagatacaagtatgtcaattggcaaagcagcttcataacagttatgttgggtttttagcaactacaaaagaaaacccaaaagtgaattgcaatgctatcatgactaggagtgggctggtggctcattacccaccaaagacaaaaggccagcttgctagagaagggaagtttattcccaaaacctttctctcaaaagagaagctctatcctcacatgtcaacaaaaaaggacaaagagaggcattgtgaatgcttcttggaaattttcaaacagctcaacatcaccatttcaatctcatatgcattggagctaatgtcgaaaattggaaacatggaagtgaaagagatctacatgattattcaattggcggaccattccaccaaactacctcatggagtggtggagaacatgctagttgatgtgggaaaattcactctacccgttgagttcattattatggacatagaggaaggctcagacattcacttaattttgggaagaccattcatgaacatggccaatgtcattattagtgttgcggaagggaaattcacaatttga

SEQ ID NO: 49038 - DNA, 492 bp, Glycine max
  Peptide Sequence Number=SeqID_165816
atgggtcaattcatgagatcatggtcatctcaagagggtcgtggtcaaatcatgagggtcgtggtcaaccacgagggtcatagtcaatccataatcacccaaggttttatcatcacttccgaccatagccatggtggattcaccacaactgtaaaggttcttgctaatacacctcactcaagcattaaattctgggcacttgagagagttgtcctcgtagttaagacctcgggcttaggcaaggacatgagcgaggtcacctccatgcttaagcgcggtgttctgggatggcccgtactaagacaaccgctcaaaagaaagcccttccccaaaagaaatagaggctccaaggcagtgggtctcaaaatgcacctaacccagaggaaaatgaaaatctccaacccaacaaacaatttccctcacttcactataaaaagttattcgaagaattggggaggaagcaggggatcaaagagcggcagatggaactag

SEQ ID NO: 49039 - DNA, 207 bp, Glycine max
  Peptide Sequence Number=SeqID_165817
atgtcagtgagcaaccttgaatttactggaggcccttgcttaagactaagcttcattgtgcttcatcgagacaagcaaagcaaaggtaggtctcaaagaccttgcttaagcatggcattctatgtgcttaagcaacgggagtcagaaactgaaatttttaggatcgaaaggcctcgctcaagcgagatgttactcacacttaagtga

SEQ ID NO: 49040 - DNA, 297 bp, Glycine max
  Peptide Sequence Number=SeqID_165818
atgaggctgcataggagggaagtagggatagcagcagtggaaaccagattaaggcagactcttcctcagatgaggaggagctctaagggagattcattacagccaacaaccatgccattacacatggctatggattcattgaaagggttcacaccctccatatcaatacggttatggattcattcaaaagggttcaccctccacaccactactggagttggaggagtatgtagcctatgtggcatggccagccaaatttggggactagccaaccgttgcctaaggaagggggcatga

SEQ ID NO: 49041 - DNA, 843 bp, Glycine max
  Peptide Sequence Number=SeqID_165819
atgtcctttggcctgaaaaatgcaagcgttacataccaaagattaatggaccaaattttcaaacagcagatcgaacaaaatgtcaagatctatgtcgaagacaaggttgtcaaatcctatagcatagtccaacatgtggcagacctagaagaggtattcggagaaatttacaaatacaacatgtgccttaactcgaaaaaatgcactttcagggtcggcggaggcagattcctcttcatgatcacacatctgggaataaaagtcaaccttgacaaatgcataggcatactggcgatgcatagtcctaccaacatcctagaagctcaaatgctgaatggtagactagcatctttcttgttaggaatagccctcctcctatatcttttaatagctgatgaagctattagctttgccctcgtacaagaggaaaggaagcaccggattcccatctacttaacaagttgtatgcttcatgacgctgagaaatgctaccaaatgatagagaaggtggcactagcattcattacctcagcacaatgcctcaagccatactttcagagtcaccaagtggtagtcaacacgaactaccgcatcaaacaggttttgcgaaagcctaaaatggtagggagaatagtagcatggtctatagaaatttcagagtttgatctccagtacaaaccctgtggccccatgaagacacagttcatggcatactttctggctgaatttgctggaaacaaccaaaccaccccaaactggtggaacctctatgttgacgatgtgtccaaccttgaaggccctagcaatgtcactctaatacaagccctcaagcaatcaggctga

SEQ ID NO: 49042 - DNA, 1242 bp, Glycine max
  Peptide Sequence Number=SeqID_165820
atggacaagagttgtatggtgtcgagagtggtaacctcgacaagtgcaggagttgcaagtatgcaaaatccgatgtgtcaggtgagaggagcctctgcctttgacaattctacccttctgatcgttggagagtgcattgaagacaaacatttcatttgtgtttttgccacaggcgagtacagtgcacacgtcatttccatcggcggttcctcctcggaggagacttgccattgggcttctgatagcgagtcctcttcctcggagaggttgacggtctcgtattgtactatggaaggaatttcttgcctccataggagagcgcatcctctcgcttcttctctagatggggaacccgtcctagtcaccatgattcttccctcttttgtttctcggggagtgagaaagagtggcggcggggacatttgggcttccccttatgtgcgacatagccacaatgttgggtccaagtctttagatgaggatctgttgacccttatggagagggtcgacaaggctatcttggagcaactgccagcctcggtggatgcatgggccaatttgtctcttcccttggcgggtgatccctttgctgccttggatattaagcaggttagacctgatagaggggttgtgccactgtttgctactattccttctgctagagaaggggttgctaaggtctcccataatatgccttcctctgttttggctaagaggaagcgtgacgatgacgctagggtattaagctgcaagaagtcggggaccccttctagccttcgagctgtgaggcaagttgcagggttgatgcctgattcaggtcacccctcgagtttgttgggtctgccttcggctccatcaattgtccaagctcctgctcttattattgctactattgctgctcctccacctcctcctgttgtgtctatccaagagatttttgcttttcctgctgctcaagttagtgccctggcttctttagccggtcttatcatggcttcttcctccactgtcgctgtacccttgctgagtgccgctcaactggttcccccctcgtctgtgttggcatcaacgtctccttcatccttttttcaccctagtgtttcattagatcacatttacacttctcatgatgctgattcgttgtggggccaaggtcttcctctagagaagtttagcgatcctggaagagaatgggcaaagacactaagatacgctaagcaaggtggcatccttaaaggttga

SEQ ID NO: 49043 - DNA, 621 bp, Glycine max
  Peptide Sequence Number=SeqID_165821
atgctcgttgttgttgtgattgatcccccaacctttgtagtccttttggccttcttgggtttcaatctttttcctgctacgtcccttgtcaaaaaaaatcccactcccaagaatcaacaaaaaccttcccccaaccatgcttatatgattcctcttagtcggcttcctataccctgtctaaagggagattccatcttagtcactattttggaggaggagtttcttgttgggttggataaatgtaagaattacctccatggatgccttctcttgctgaagacactggttctctatttgaaactattgaagccccggaagccctttgtcatttggaagcttattgccattggaggatcagagaaaggctatttttgtagggtcttgtggagtttctcctggattcttgcgattgtattcatgaagctttatggaccttttaagaataatcccaagaagccggataacaatggctctcaggttgatgcaaggtctcttggccctgtccttacccaaccacaaaagtcaaatgagtctcccctagataatggatctcttaacaatgaggaggatgctttggccattgtgattccccttgatgattgtgtcttcaaagatctttag

SEQ ID NO: 49044 - DNA, 165 bp, Glycine max
  Peptide Sequence Number=SeqID_165822
atggaggtcatagatcccttcatgaagcagttgagcaagggtgttatcaacccccttttgaatagctcaccattaagcatgacatggtggttgaccatccatttcaggcgtcaggcttcattctggtctggtggagacaccccccgaattaggaaattcttgtag

SEQ ID NO: 49045 - DNA, 253 bp, Glycine max
  Peptide Sequence Number=SeqID_165823
atgctttttctaacccacacctctagtgccagattacccacccagtttggtgagtttgatattcacgtattcactgatagccgcaacggcgtggagcatgtggccctggcttatggagatgttcaaggtgccagcgacccgctggtgagagtgcactcagaatgcctgactggtgacgtattcggctctacccgttgtgattgcggcgaacaactacaccacgcccagcgcctgattaaagaaaccggccaag

SEQ ID NO: 49046 - DNA, 591 bp, Glycine max
  Peptide Sequence Number=SeqID_165824
atgtctgccgttttcaggagcttgatatacatgttttggacgcaacgtcgtgcatggatgggctggtttgctttgctggttttactggccacactgttatttttaccgcgtgctgattcaggtgaaagtgcggccaacgctggccgtttatctgccaagggtgaaattttaagcctggaaaaaatctcgcaaaaggccaaatcctataaaccaggtgaaattctcgaggttgagctggagaagaagcatgggcgttatgtgtatgaggtcgacatactggatgctggtagccagacacagcaagcgctcaagaccgcgggttacgcgtgtgattggctgcaagagggcgttgaagcgggtattcaaggtgagctagaaccctatgatctggtcattctcgatttaggcctgccgggtcggcccggtttggaagttttggccgagtggcggaataaaagccttggcatgccggtaattgtattgacggcgcgcagcagttggcaggaaaaggtggaggcttttaacctgggcgcagatgattatgtgaccaagccttttcacatggaggagttgctggcgcgtatcagtgcg

SEQ ID NO: 49047 - DNA, 246 bp, Glycine max
  Peptide Sequence Number=SeqID_165825
atggctaatgcacaggcagacaagtctgcagatgacgaggctaccattaaccagatgcatcaacacaactttttaggtaaacggccttacgccaaaacaccggtagccaagcagaacccagatgaaaaatgggtgggcgcgggcatcgtgacggacaagccggaacctagctttgataagcatcagcaaatgcgtttgaactttataggcagacgtccctataacgcagggaacggcaccgattaa

SEQ ID NO: 49048 - DNA, 417 bp, Glycine max
  Peptide Sequence Number=SeqID_165826
gatcttcagtgcaccggcatgttgctggctaatcaggccatgtgctgcaccgaattgcatgcatatttcatccagcaaccattgcaacaggtcatcggaccagccgagcatgaacaatttttgcccaaggcgttcaaacagtctgtcatgagcaagctgtacctggttaccggcaaaatgcaaaccatcgtgaatgcatcaagattcacctcaccaacacaagcggctgaatctaaagcaggtgaaactgttcagaatacacatcatgtgcaatttttgggcaagcgtgcttaccagcaaccgctggtagccaaatctgatgccgagcaggcttgggtgggcgccacattgagagtggaccagaccaaccagcaacaagtgttgaaaatgcagtcactgggcaagcgagcttactag

SEQ ID NO: 49049 - DNA, 348 bp, Glycine max
  Peptide Sequence Number=SeqID_165827
atgtcaacctctgtgcaagggtctgcgacaacagacctgtttaagcacatcaatcgcgacttgccagcctcgattgttgtgttctttgtggctttgcccctttgtttggggattgcgctggcttccggtgcgccgctattttccggtgtgattgccgggattattggcggtatcgtagttgggctggccagtggctcgcagttaggggtcagtggcccggcggccggtttggctgtcattgtgctggcggccatcagtaaccttggttcttacgaagcttttctggcagctgtagtgctggccggtgtcttccagtttttgctagattccacatgcctttggctatga

SEQ ID NO: 49050 - DNA, 169 bp, Glycine max
  Peptide Sequence Number=SeqID_165828
atggggcaattgaggaaaccgctacatgggcaaaatcgtcttaggccacggtcagaggtcgagacaaagttaaaggcagaaaccaatcaagaggctagggtcacgattgacaaatcgtcgtcccttcccagctctggacaagcggaaaacgccgctacaaggcagccta

SEQ ID NO: 49051 - DNA, 219 bp, Glycine max
  Peptide Sequence Number=SeqID_165829
atgcatcattttagcaaagccgatagagagcccgacttagtgagagttacagtattttgggaacattgcatgtctgatatgccttttagaggcttgaaaagtgcaagaaaacgaattgcgttttctggaaaacgcggtgaactcgctaagcgagaatgctgcgctaagcgggttcatcagtattcattgaatatacgcgttcttggaagaactcgctaa

SEQ ID NO: 49052 - DNA, 159 bp, Glycine max
  Peptide Sequence Number=SeqID_165830
atggcgccaaaaacttgttcgacgatcggcagcctaatcctaatcaagcatcatcctcagatccctcttgttggactaaacttgactagaagtgcattaagacaaacataccaacaaggttaccgtaccctgatccctcgtgaaaatatgataaaatag

SEQ ID NO: 49053 - DNA, 246 bp, Glycine max
  Peptide Sequence Number=SeqID_165831
atggctcaattacaactagctgtggagaactttacagggaccactatgagcaatgaaaggacagtgagccttctgctatggatgttaatgccatcaacaagcagcaggaaacagccttggctttggcagataaactgccgtatgcagaatatggtgctaagcatgccaggcatgtgggcaaagtatctagcctggatcctaacagtggatctaacatcctacctagccataatcttgtattcttag

SEQ ID NO: 49054 - DNA, 1737 bp, Glycine max
  Peptide Sequence Number=SeqID_165832
atgttggcgtgtcattggcaccatttgggtgtccatgatgcccgtggcttctttgacagcatgcctttgaaggatgttgcatcgtggaacaccatgatttccgcattggctcaggttggactcatgggtgaggctcggaggttgttctcggcaatgccggagaaaaactgtgtgtcgtggagtgccatggtgtctggatatgtagcttgtggggacttggatgctgctgtggagtgtttttatgctgcgcctatgaggagtgtgatcacgtggactgccatgatcactgggtacatgaagtttgggagggttgaattagcagaaagattgtttcaggaaatgtcaatgaggacattggtgacatggaatgctatgattgctgggtatgttgagaatgggagggcagaggatgggttaaggctattcaggacaatgttagaaactggggttaagcctaatgctttgagcttgactagtgtcttgttgggttgtagtaatttgtcagcattgcagttgggtaagcaggttcatcagttagtttgtaaatgtcctttgagtagtgatacgacagctgggacttcattggttagcatgtattccaagtgtggggatctaaaggatgcctgggagttattcatccagattccacggaaagatgtagtgtgctggaatgcaatgatttctggatatgctcaacatggggctggcaaaaaagctcttcgtttgtttgatgagatgaaaaaggaaggcttgaagccagattggattacttttgttgcagtattgttagcttgtaaccacgcaggattggtggatcttggtgtccaatattttaacacaatgagaagggattttggaattgaaactaagccagaacactatgcatgcatggttgaccttcttggtcgagctggaaagttatctgaggctgtggatttgataaaaagtatgccatttaagccccatcctgccatttatggaacacttctgggtgcttgtaggatccataaaaacttaaacctggccgaatttgctgccaagaatctgcttgagcttgatccaactattgcaactggatatgttcaattggctaatgtttatgcagcacaaaacagatgggaccatgttgctagtatccgaagatcaatgaaagacaataatgtagtgaagatacctggatatagttggattgaaataaacagtgtggtgcatgggtttagatcaagtgatagattgcaccctgaattggcttctatacatgagaaactaaaagacttggagaagaaaatgaagttggctggttatgtgcctgatcttgaatttgtgttgcatgatgtgggagaggagctgaaagaacagcttcttttatggcatagtgagaagctggcaattgcatttggccttttaaaggtaccattaggggttccaatccgggtgttcaaaaacttgagagtctgtggagattgccactctgcaaccaagtacatctcaactatagaaggaagagaaatcatagttagagatacaactaggtttcatcatttcaaggatgggttctgctcctgcagagattactgcctcaagaaaggaaaacgactcattaacttccgaaactcaagctacatgggttttgtagtggagttcaacaatagttatttggaaactgattcatacgtggcctgcattagcaaggaatgctggaaacaaccaacctatgatcttctcgttgaacattga

SEQ ID NO: 49055 - DNA, 198 bp, Glycine max
  Peptide Sequence Number=SeqID_165833
atggctagacatgtaaataacgctttcttatgtaacattgattgggatctttgctgggagagccatcatctctgggttgaagtggttagagagaaatataattgtggtcatgatattcttcctttgattaaaatgaagcaaggtgatcttgttagttgggtgaatcataatcaaacatttggaatgattctggactag

SEQ ID NO: 49056 - DNA, 120 bp, Glycine max
  Peptide Sequence Number=SeqID_165834
atggaccaacgacggtcacgaaccctgacggcgatcacgaaccctagcaacaacgatggtgtggaggagaccacaatggcaggtcttcacgaaaataacaagaccgttattgtagtgtga

SEQ ID NO: 49057 - DNA, 495 bp, Glycine max
  Peptide Sequence Number=SeqID_165835
atgatgacaacagaagctgagactgagagggtggtggtgatccaggatgcatcaagagatgttaattcaaatgcaatcctaggggccctggaatggttttctgttaaagctggagatcagcttataattgttgctatccttgattggatgagcagtcctatgggttacatggtcagagttgattccagttcaatgatttcaacaaacaagaaaataattgaaaaaaggcttaccaaaaaaaaggaagaatatcttatgaaccagaacatccaggagatctccaactactgtaaattgaatgagattggattccaattagaagtgcttgtaggctctactgcagaggttgcttctaatgctgccaaggaatttcaggcgacaaggttgatactagttagaacttggaattatgcagatgaactggtagaatcaaatccaggtgataatgatacaactaacactcccaatcttagaacatttcagatcataatttga

SEQ ID NO: 49058 - DNA, 279 bp, Glycine max
  Peptide Sequence Number=SeqID_165836
atggatgctatggatgatgtgaaggttaaaattccaaagttccaaggttatgctcttgtgtggtggaaccaacttcaagttgatgtggattggttgagaagacctagagtgacaactagaagagagttgcacaacaagttgcaaaagttttatcaaggaaatataagtgtggatgagtattacaaagagacgaagatttctttgataagagatgaaattgaagaaactcaagaaactaccacggctagattattacatggtttgaatagagacatctaa

SEQ ID NO: 49059 - DNA, 186 bp, Glycine max
  Peptide Sequence Number=SeqID_165837
atgtcaccaagatgttcaggggaagatatgggtacctattgggttcaggataaggttctccaggatattgggcagctgtggttacactctgggacaatacttgatgaaatgggtgggatcagaaaacatagcaagaaaggctatcttacattatcttcacacacaaagtgcataagagatacctaa

SEQ ID NO: 49060 - DNA, 276 bp, Glycine max
  Peptide Sequence Number=SeqID_165838
atggatgtgtactttggtgatatcttgatctatagtttgacatttgatgaccccttggaacatattaggagtgttttggaagtgcttagaaaagagagctcatatgcaaatagggaaaaatgcacattttgtactaatcaagtagtgttcctaggatttcttgtgggctctaagggtgtgcaaatcaatgaggagaaagtgaaaggtattagagattggcctacccctaagaatgtgagtggggtgaggagttttcatgagttaactagtttctag

SEQ ID NO: 49061 - DNA, 225 bp, Glycine max
  Peptide Sequence Number=SeqID_165839
atgggaggaaaaggtacaattgattcaaatctgaggatgaattcttttcaaggagggaatgatgaaggactacaaagggatgaggaacttagcttgggaggagttgttactaggtcaagattgaagaaacttaaaaagaatattaatatgaaaatgaactcacttatggagaaggaagaaaaaggagacagaaagataataaattgtagtgaactctttgattaa

SEQ ID NO: 49062 - DNA, 117 bp, Glycine max
  Peptide Sequence Number=SeqID_165840
atggctcctatgaccgaaatgaggctctacaaagagagcgtgattgacggtgatgaccaaagagtgagactgggaaggctccaccacgagatactagtggcggcgaccaaagagtaa

SEQ ID NO: 49063 - DNA, 2541 bp, Glycine max
  Peptide Sequence Number=SeqID_165841
atggatatagatcttcggttaccttctggtgaacatgataaggaggatgaagaaacaactacaattgataacatgttggacagtgaagaaaaattgcataatggaggtatagatggcagaaatatagttgatactggaattgaggtacatgctctaaatggtggagatttgaattcacccacagttgatattgtaatgtttaaggaagatacaaatcttgagccactttctggcatggaatttgagtctcacggggaagcttattctttttaccaagaatatgctcggtcgatgggattcaacactgcaatacaaaatagtcgtcgttcaaaaacatcaagagaatttatagatgcgaagtttgcttgttctcgatatggaacaaaacgagagtatgacaaatcatttaatcgaccacgtgcacgacagaacaagcaagattctgaaaattcaacaggtcgaagatcttgttcaaagactgattgtaaagcaagcatgcatgtaaaaagaaggtcagatggaaaatgggttatacatagctttgtgaaggagcataatcatgagcttttaccagcccaagcagttagtgaacaaacaagacgaatgtatgctgcgatggctaggcagtttgccgaatacaaaaccgtggttggtctcaagaatgagaagaatccatttgataaaggtcggaatttgggcctggagtcaggggaggctagactcatgcttgattttttcatacagatgcaaaatatgaattctaacttcttttatgcagtagatcttggtgaagatcaacgtctgaaaaatcttttatggattgacgctaaaagtaggaatgactatatcaacttttgtgatgtagtgtcgtttgataccgcctatgttagaaacaaatataagatgccgcttgcactttttgttggagtgaaccagcactaccaatttacattacttggatgtgccctgatatcagatgaaagtgctgccactttttcttggctatttcggacgtggctgaaaggagttggtggtcaagttccaaaagtgatcattactgaccatgacaagacattgaagtcagttatttcagatatctttcctaattccagtcattgtgtttgcctatggcatatattagggaaggtatctgaaaatttatctcctgtaattaaaaagcatgagaattttatggcaaaatttgaaaaatgcatttataggtccttgaccagtgatgattttgagaagagatggtggaaaattgttgataagtttgaacttcgagaggatgaatgcatgcagtcattgtatgaagatcgtaagttatgggcaccaacattcatgaaagatgttttcttaggtggtatgtctactgtccagcgatctgaaagtgtaaattccttctttgacaaatatgttcataagaagacctctgtccaagattttgtcaaacagtatgaagcaatcttgcaagacaggtatgaagaggaagcaaaagcagattctgatacatggaataaagtggcaaccttaaaaactccttctccattggagaagagtgttgcagggattttctcgcatgctgtattcaagaagattcaaactgaggttgtaggtgcagttgcttgccatcctaaagctgacaggcaggatgatacaaccattgttcacagggttcatgatatggaaacaaataaagacttctttgttgtggtgaatcaagttaaatctgagttgtcctgtatatgtcggttatttgaatacagaggctatctttgtagacatgcgttgtttgttcttcaatattctggccagtcagtgttcccatctcaatatattttgaaacggtggacaaaagatgcaaaggtcaggaatataatgggagaagaatcggaacacatgctaactagggtgcaacgttacaatgatttatgtcagcgagcactaaaacttagtgaagagggatcattgtctcaagagagttatggtattgcattccatgcgctacatgaagctcacaaaagttgtgtgagtgttaacaattctagtaagagtagtcctacagaagctggcacaccaggggctcatggtcagctttccactgaagaagatacccaaagtagaaatatgggcaagtcaaacaaaaagaagcatccaactaaaaagaaaaaggtgaactctgaagcagaagtgataacagttggggcattagacaacttgcaacaaatggacaaattcagcacaagagcagtaacccttgaaggttattatggcacacagcagagcgtgcaagggatgttgaacttgatgggaccaacacgtgatgattactacgggaatcaacagacacttcaggggctgggaccaataagttcaataccaaccagtcacgatggttattatggtacacatcagggcatgccgggtctggcacaactagattttttgcgaactggtttcacatatggcattcgggttagtatggatgatcctaacgtgagagcaacacagttgcatgaggatccatctagacatgcatga

SEQ ID NO: 49064 - DNA, 225 bp, Glycine max
  Peptide Sequence Number=SeqID_165842
atgaaatgtggtggttcatcatcgtctcgtcgcggtatggtggtttgtagggaatggggtcacccaccggaatgggtcaaggtggcgttggcatgcgcaaacgccgtattatattacaaatactggattttggaggttttccattgtaacctcaaacgggcacgaggtattccattctcaacgccagataatcagcttatagctctcgtttccccagccctataa

SEQ ID NO: 49065 - DNA, 374 bp, Glycine max
  Peptide Sequence Number=SeqID_165843
cctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 49066 - DNA, 294 bp, Glycine max
  Peptide Sequence Number=SeqID_165844
atgactaacatcattttaggacagaagactagtggacgatatttcgttggtggacttgattgtacagtgcatagaaatttctttggtagccagattcaaagctttgaggcagagctttcaatgccagagcttgtctccaaggaaggagatcctgaaacattttgtggaatttttattcgtgcccctgcaattcttggagcaaggccaaaagttcaagtgctggttgattgtcctgtaccttctagcatattgttgagttctgattcctctattgaagaccaaatggttaattaa

SEQ ID NO: 49067 - DNA, 3894 bp, Glycine max
  Peptide Sequence Number=SeqID_165845
atgccagaccataacacctgtcaatccacactagaacgcctcaaggaggccatcgccaaactcacccaagctcaggccaccctcacccaagatcacacgacccttgcccaaacccaaacctccatgaatacaaaaatggacgccatgctcgaacacctcgctgcactcaccatccaaccatcttccccgcaactctccccacaccacaaccccatcccttctccacacacttacaaaccacacatgaagctcgatgtacctagattcaacggccaagatccagagcgtatcaccgtggcttcattctacatggacggtccagcgctatcctggtaccaatggatgactcgcaatgggttcatctcctcctggcctgcgctactccaagcttcggagtccagattcgctctgacattttacgatgatccccaaggggcgctattcaagcttcaacagcaaggttcggtgaacgattaccgcactaagtttgaacgtttagcgaattggatcgttggtctgtctcccatggcgctactaagttattttatttcgggcctttacccggacctctgccgtgaagtccaggctctacaacctatgttcataccgcaagccgtggcacttgccaagttgcaggaagaaaagattcaggaccgccgtcgtcattcctgcacatcctataccccttctggtctgccaccatcaccgccaccacccactgcggttcctttcaccgttctcgccctggtacgcccttcagttaagcgcctttcagcagaagaacttgatgtccgttgtgacaaggggttatgttatcattgtgacgagaagtggattctcggccaccgttgtcgtcctcgcctccacttactcattacaaacgatgatgatgacgactacacagatccctccccaaccatcccatactcacgcatcgatgaccatggcgatcctttgtcctcacttcagggccctcagatcagcctaaacactttggcgggaatgtcggcaccggagacaattcgtctttatggcaccatctcacaccatcaggtaatcattctcgtggatggcggcagcacccacaattttatccagtctcacctcgcctccttccttcacctgactcaggttcccaccgcggccatgcgagtcatgataggcaatggcagcaccactgattgtgacaccaagtgtcctgaggtacctatcctagtccagggccacacttttcttgttgatttgtttcaattgcctataggtggtgcagacatagtgctcggagttcagtggttgaaacaactaggtctggtcaccacagactattcattgttgacgaagagcttcacgtattttccaggaacccacccatctgccctcgccatgcaccatcacccaccacatccatttacaacaaacaccaatcccattaatgtacgaccttaccggtacccctattcccagaaaaatgaactcgagaggcaagtcgctaccatgttggacacggacatgatccgccatagccatagcccattttcttctcctatgctattggtgaagaagaaagatggaagctggagatgttgtgttgactattgcgctctaaatgcaattactatcaaagatagatttccaatgcctacgatagatgagctacttgatgagatcggaacgacatcgtggttctcgaagttggacctccgtcaagggttccatcaaattcgaatgaatgaagaggacatccccaaaactgtgttccgcacccaccatggtcactttgaattcaaggtgatgccatttggtctgacaaacgctccctcgacatttcaggccaccatgaacaacattctccggccgtttctacgaaagttcgctgttgtcttctttgatgaaatcctcgtatacagtccttcatttcatgcgcaccttcaacacttgcaggccatcttggatacgctctcacaaggctctttctatctccgccgttccaagtgtattttcgctgaacaacaactgacttatctcggccacatagtatcctcacaaggtgttgctccagaccctaagaagattcacgcaatgaccgcttggcccatacccacaactccttcagacctcaggagctttctgggtctcatggggttttatcgtaagttcattcgaaattacgctaccactgctgcccagttgacggccttactctgtaaagatagcttcatatggacgcctgaagctcacactgcattccaacatctgaaaactctaatgactcaggctcctactcttgcttcacctgacttcacggtgcccttcattttggaaaccgatacttccggcaccgctatcggggcagcttcgacttacgttcgtgaattgcatgtcatcacctctatggtgcgaaaatggcgtcactatttgctagggcacaacttcattatcatgacagaccatcgaagcttaaaagagctgatgtcacaggttattcagacacccgaacagcagtgttacttggccaagcttcttgggtatgattataccatacaatacaaacctggcgctacaaacgtggttgcggatgctttatcgagggatacgacataccaagagttgcttctgaaggtccaacaaaatcctgcagaccaccccagcttcactgttaaacaaaatgggttactgttccggggaaagatatggctccctgctggtcatgatctctccaaggtgctccttgtcgaatatcacagcactccgttaggcggtcacatgggtgtttcaaaaacgctccatcgtattcaacaacatttttggtggcccaacatgcaccaagacattcgtcagtatattgctgtgtgcgttacttgccagcaaatcaagatggagacacgcaagcctgcaggccttctacaaccattaccacttccttcatcactatggagtgatctatccatggactttatcacgggtctcccagcttcacaagggtacaccatcatcatggtcgttgtcgaccgatactccaaaggtacacactttggaccattgccagcacactacactgcgcataaggttgccttattgttcatggatactatctgcaagcaccatggtttcccacgtagcatcattttggacagggaccccatattcattagtggtttttggcgcgagctattttgtatcagtggaaccaagctgcatttcagtacaatgtaccacccgcaaacagacagccaaacaaaagttctaaaccatgtgctcgaacaatatttacatgcatttgtccatgatcatcctcaacaatggttcaagtttttatcgctagcggaatggtgctataatacttccgtccacagtggtactggattttcaccttttgagattatgtacggtacaccaacacctgctccgcctctctactctgttggaacttcaactgtcgaagcagtagacgctatatgcacttcgcaggatgtcatttaccaaaccttcacacgcaggctacaaaagcagcaagcctctatgaaacgcttagctgattcacacaagcgagatctcacatttagcattggtgattgggtttacgttcatttatgtccttatcgtcagacctcgctccaaccagcctatactaagctctccaaaaggtattatggaccttacaggattcaggcacaggtgggcaatgtcgcataccgcctacagttgccacccactttgaagatccacccagtctttcatgtctccctcctgaaagcccaccatggtcccattccactggatgtacctactttgccaccatttagcactgctaatcacctaatagtgctagcacttgaagataccacctgggagtattggccacagcttaaagacatttatgaccttgaggacaag

SEQ ID NO: 49068 - DNA, 213 bp, Glycine max
  Peptide Sequence Number=SeqID_165846
atgggtcacccatcattcattgttcacgtaccaaaaagcccaaaaagtagtaagggcgtgaggtggtgtatgtcaccacccacagttcacgcaccaagcgtggaggaaatttttgctttggcagtaacatatgatgaaccttggtttactgatacaaggtacttttgggtggggccagggaatcagatatggccagatcaaaagattaagtaa

SEQ ID NO: 49069 - DNA, 297 bp, Glycine max
  Peptide Sequence Number=SeqID_165847
atggattttatacccgttcaccccaatcttgggctacgttcaaacctcacccaaactgatgaaatttccactaacacaaccaacaacatgctggatttttataactgccaaccgcttgttggacttcacaacatctccctcactataggcactacacttgtttttgacttggagataacccgtctcaatcacaacaccatgggagagacaatccaagtattcttcacctcttcaggtaggcttaatccacagaatgattctcctcactattggaaagaaaaacccattgaaccatga

SEQ ID NO: 49070 - DNA, 537 bp, Glycine max
  Peptide Sequence Number=SeqID_165848
atggatatgtgtagggtatcttcttgtgtttggtatagatgtgctacatggtgtgaagtactagtagcgacccctttaggggctgtggagtctttatggcaattctcagattgggtgcgaggcaaggaggcgaaggagcggtggggagttgtgtggctagaagttatttggatgatttggatgaagtgtaacaacatcatcttcaatgaagcccatctggacttgaaaaatgtcttaaacctagtgaagattcgagcttgttttgggagaggcaagacttatggttgttatcttggagggcttgtggtgccaaaggttggcatgcaggacatacatatggaaagggacattgacaagcgcacctccctaatgaccacgacacctccatacgtagagaaaaaatcacttgagagacaaagagcaagatctaatcaaaaccaagggtactcaaagccgaataccctaaccggtcatacgagaaaccaacaacgagcaaagaacccttatatctttggcatccctaaatacattagatag

SEQ ID NO: 49071 - DNA, 495 bp, Glycine max
  Peptide Sequence Number=SeqID_165849
atgtggggaatgaacttactaagaccattgttaaaagccctaggagctatcaaattcttaatagtcttcattgactacttcaccaagtggatagaagtaagaccacttcggggcattacggctagcgaggtggaaaaattcacttggaaacacctcatttgcagggacagccttccatacgccattgttgccgacaacaacacccaatttaaagctcaaacttacgaagacttcctaagaaggctaggcaccaagcacctagtcacctttgtcaagcatcctcaaactaacagacaggcagaggcagttaacagagttatcctcaaggcccttggaactagactcgacaagtctaagggcctatggaaagaagaactctacaacatactctgggtgaagccaggaaagacccatgagtgggaaagcttggtcccaactgggaaggtccctttcgggtcaaagcaaacctcgacagtggagtatatctactactag

SEQ ID NO: 49072 - DNA, 717 bp, Glycine max
  Peptide Sequence Number=SeqID_165850
atgatcgaggacgcgctagtgttaccgagtagtagcagtcacagctacagcgtcatcaaagttggttccgttcaatctccatcggttttggtgtctccactaaaccatcaccatcgtgttcttctgaacgtgccattttcatctccgataatcgctctcagaagaaagggagttggtgagaagcttgtgcccaaaatggctaattatgaaggacaagcagttaccagtcgtgatagcgaagtcagatcagggagtatgatttttgagcctattttagaagatggagtgtttcgttttgattgttctgcaaatgatagagatgcagcatatcccagtatttcttttgtaaatagcaaggatagagacacgcctatcactactcagaaggttcccctgtatacccctacgtttgagtgtcttctagagcagcagattgtcaaacttgagcttcctgtaggtacctccctttatggaactggagaagctagcggagagctagagaggacgggcaaaagggttttcacatggaacacagatgcatggggttatggccctggaactacatccttgtaccaatcacatccatgggtgttagcagttcttcctaatggcgaggcactaggaatccttgctgacacgacaaggcgctgtgaggtgctggaaaattggctttttctcatctataaccttgtagagatgtctatgctgttatattaa

SEQ ID NO: 49073 - DNA, 2766 bp, Glycine max
  Peptide Sequence Number=SeqID_165851
atggaagaaaatcttaacacaagttgcaaaaatcaagaagggaatgaaatgatccataataatgagcataaggtggggataagaaacaaaggaccatgtaagaaacaacagcctggggttgatgtggttgagtggggtcccggacttcacacgttggcgttgagggtgcttttgataggaggggggacttgcaaaacaaaggactctgatgctcaagagcttaaagatgatgttagagataaagggctaggcatctgcgctcctatggcaaggtggacatgtgtctctgagtgccacataggatttgtgggtcctggacatctgtttgatgccggggatggtagtcttgataatcagagggtgacaagtttatcaagccccccaagtgtggttgagtgttgttcgatgtcgggtgtggtagccttgacaaatgtgagagttacacgtcaatgttgcttatcaatcccccgagcttggacatgcgttgtccgagctgcttctattagcaacccattagacatcgggagctcatctcgattggcggttcctcgtgtgaggatactcactaaggtgcctctaatagggagtcattctcttcatagagggagcgttggtggtagtggagacgtgacattgtctccctgtgttcaacctagtgtgaatgttgggtcaccattgtatgccccggtcgttgttggctatgagtggttaagggatgatgtgttgaagtgtaggtcatccttgacctcagtggcaagcatcatcgtgcttcagcaccaggtaaagttggcgaatgttgaggactcctataaactggccgttcaggcttgcgggaatgatgacttcccatttttgagggcagcgcttggttgtctgcccttcttttttgtgtacagatgcttgttcgagatcttgggtgttattctgcccttgaccgtgtttcagtgtgctctactggaacacttgaatgtggccctgtcccagcttcacccgaatagttgggcgatggtgagggcgtttgagatcttggtgtccaagaatttgttcaagtttgactcaaacgcctttttctgttttaaggaccattttttcaaggtcctggctattgatgtcatggctaatggaatgccaacgatggtcgacaaagcaatcttggagcagctgctagcttcgcttgatgcacaagccattttgtgtcttctgtcagcaagcaatcctctcgttgccttgaatggtaaatgcctaactttgtcctcatttgttgtcagacctgcaagtgggaccgtgccaacgtctgttgctgctccatctgctggaaaagggggttaccccaacattccttcctcttttttggctaagaagaaaaaggaagatgtggctgggtcatctggctgtaaaaagtcaaaggcccctaatggcctccacgccatgaggcaggctgtgggaatgatgcctactgcgggtcgcctttcaatagagcaagggttgcctcaggctgcaccgactgtcgagactcttactattgctgctgtcgaagttgctactcttgctatccttgctccttcacttcctcccgctgttgtgcaggatgttgctcctactactgctgaagttgttgttctatccactcaagttggtcctttattatgtgtcagtgtggcaaacattggtgcttccacgatatcgcctacttcatctactttgttggctctccctgctgttgtcttggcggccatggcgtcgccttcttcatcctggtgccctcgtgtctcccttgatcatctgtacacttcttgtgatattgactcattatggggtgtgacttataagtcgaaacagaagaccctagatggctttatgtcagccttcgacagaaaccttattaggtcggctggggtgtggaaccccaatggttctgccaaggagaatgaattgcgagaccaagaggtggtgaaaaaggtggcgtccttagaggcggaggtcgccaagtggaagcaccctaaggtggtcaatgtcactattgcttttgctgaggttgtaaaggtgaaccgtcaacaatttttcaaggttggcggttccttggccaaactgttgcacacctggttggatggtgataacctgatcaggcgctgcaagggcctgcagtcagagtccaagttggtggagtccgagttgcaggtggccaaggagagggaggccatgaggcaggctggtttgtttgcgaaggacctcgacttgggtctctttgatcccttcaaggatgtgaaggatgacgccctgcttgataaggaggagattgttgcgaaagaggaggaggttgcggatgaaaggcgagatgatgcagagcaaggcgatgatggtcatctcaatttggatttcaacttgattaaaggtcttgtcacccatctggtagggcttccttctattacgtggagcttctcccctgatggttatgaggagttgtgtcagtgttgcccctggtttaaggtggcggtcgtcttgacctgtgaaagtactcctctgatggtggaacttacacctttaacggtgatcgtcgtagctgctgcatgtgagcggaccaatttgggtttagtagaagcagtgttgtgctcttgcatacatggcactcatcgtgggtggcatgtattggagatcatcgggcttgctcttgcatacatgcctcttacaaagtggaaattgtccatcttgggttttgagcaccgtgctattgcatacatgccactcgtcgtgggtggcacacactag

SEQ ID NO: 49074 - DNA, 399 bp, Glycine max
  Peptide Sequence Number=SeqID_165852
atggcttctgcattagtagagtgtccaccatttgaattttctagcaagtactatcatgtgtctgaaaatggaggtgtgtgtgtgaggcagaccagtttctttgaaggcaaaccagtgcttaatcagggtgttggttactctgtcattcttggttttggtgctttctttgccgtcttcacctctttcttggtgtggctggagaagcgttatgttgggtcacgtcacacatctgaatggttcaatacagcaggaagaaatgttaagacggggcttattgcaagtgtcattgtgtctcagtggacatgggctgctacaatcctgcaaagctctaatgttgcatgggagtatggagttagtggacctttctggtatgctagtggggccaccatccaggcatga

SEQ ID NO: 49075 - DNA, 2073 bp, Glycine max
  Peptide Sequence Number=SeqID_165853
atgatgtttcgggtgatgttcaacacggcgtttattcggtccaacattttgatgctgaatgctgagaacttagacattctttgggattcgaaggagcggtatccgaagggcttccgggctgaggttttgtttggggaggttgaaagcataagtcctccaagggctcagacgagtattttagatggtgaggtgaaaggtggattgcctattgaggcattttcaagggttcaggaactttttagtggtgtagaatgggttgaaagtggggatgctgctgctgtctggctgctcaaacagcttacagtcttaaatgatgccaaagagctttcaaggtttcaaggtagaggaagttggtattcatcacccgctgactctgactctgaaaataatgaatcgagcactgctgatagttcagatgaggcctttgatgttattcccaagtcttatgctgatccttcaaaattattgatatctgacaaccctgatttggtccatttagcttttgagaacaatggtggagattatgtaaatctcacttcaagaacacctgatcagtcgttgactgataatgtttcatcacctcatcatgctccaagaaaggaatattctccttgttcctctccaccatcaccttcaccagttcccgctactcaaccttttccaataccggcaccaccacctcctacatcaaatatacagccagatttagctcctcccccacctccacatcagatagatcagaatgtgaacaatgcttctacatttccttcacctcctcctcctcctcctcctttggtttccaatactcctagtcaacctccacctcctctaggacctgtacgaacaagttcagccccaccgccaccacctcctcctccaggtcattatacgaacaggttcagctccaccacctcctcctcctcctccaagtgtacgaacaggttctgctccaccaccaccaccaccaccattggcaccaaaacctccaggtgctcctcctcctccacctggccgtggtacatctccaatgccacctccaccacctgcagcaaagcttcaacaacaaatgttggaagaggtcgtggtactggtggtactgttaatgctcctaagaaaactttgctaaaacccctacattgggtgaaagttgctcgagcagccaagggaagtctatgggctgattcacagaaacaggatagtggaacaagggcccctgagattgatatatcagaacttgagagcctgttttcagcagcatctacttctgatgggagcagtactaagggtggaggacgacgtggtcctaatattaacaaacctgagaaagtacaattggttgatttgcgtagagcatataattgtgaaataatgctctctaaaatcaaaattcctttgccagatatgcttatagcagtcctggcattggattctgcagttctggatattgatcaggttgagaatctcatcaagttctgtcctacaaaggaagagatggagatgttaaagaattatacaggaaacaaggaaatgcttggaaagtgtgaacagttttttatggagctcatgaaggttccacgtgtggaatccaaattaagggtttttgcttttaaaatcaacttttcttctcaggtgaatgatttgaagttaaatttgaacacaatcaacaatgcagccagagaggtgaaagaatctgggaaattgcgtcaaataatgcagaccattcttacactgggcaatgccttgaatcaaggaacagcacggggatcagctgttggattcaaattggatagccttcttaaattatctgatactcgtgcaagaaataacaaaatgactttaatgcattatttgtgtaagtgtaaatataaaaacttcgtaccccattacccagaggctcttcgctatgcgaaggtatgggggagggaatattgtacgcagccttacccttgcatatgcgaagaggctgtttccggattcgaacccatgaccaacaagtcaccaaggcacaactttaccgctgcaccagggctcgccctcacccagtgtaaatatactcagataaaaactatgtga

SEQ ID NO: 49076 - DNA, 1314 bp, Glycine max
  Peptide Sequence Number=SeqID_165854
atgaagggaggaggggctgtgtttttagaaaacatgatgttgagaagtgggaatgggatctggaaccaggtgtttaaggagaaaaaaccatcaagggaaacttttgtttgtggagcatgtggtaaggctgggcacatgagaacgaataagaactgtccaaaatatggtgaagatctagaaactcaacttgaatctacagacatggaaaaatcatctggaaaatccagctttgtggatccctctagtctttcccagcataaagctccctccaaaaagtcaatgtctaaaggcacaacaaaaattgctcctgttgacaattcatcaaaaattccattgaaattcaaatgcagctccacagagaaatcttctgataaacctgcaatagaaagcctgcagagttctgacaagccagtcacttctgactcagaaactgcaaagtctgctaaggttaataagataattattcccaagaaagtgaaaccagatgatacacaggctgaatctggtaagcatgctattgttatacggcctcctactgattcaggtagaggacaggttgattctcataagttccctattaaaatacgcccgccaacagaaatagatagggagcaaaaccacaaaaagattgttataaaacgtacaaaggaagttattgatctggaactggacagtcctggtggaaacactggacttcaacacagaaaaactaaaagaattgttgaattgtcgaatttcgagaaacaaaagaaacaggagaccgtgtatggaactgaaggttttaaaaaatggaacagtaaagaggacagaagatggcaggaagagcaagagaaatggagaaatgatgcaaggcttcgagaagaagacagagcaagaaggcatcgcaaagaagaaatcaggatgctcaaagagcaagaaaggttagatgagataaaaagatttgaagaagatattagaagagaaagggaggaggaagaacaacaaaaagctaagaagaagaagaagaagaagcctgagttaagagacgagtatttagatgacctcagagcaagaagacacgataagagaatgccagaaagagaccggagtggaaaaaggagatctattactgagttaggaaagattggtgcagattatatgccgccaacaaaacgccgaagagggggagggggagagaagcaaattaccaatagctacttggtcatttatgacgtgaaagtgctaatatctgtccagcagttgaggaaagctgacgaaaatattgaggactgggaagaaaacagtcctggagccaaattcatgccattgccatga

SEQ ID NO: 49077 - DNA, 1734 bp, Glycine max
  Peptide Sequence Number=SeqID_165855
atggctatagagattaaaagaaaggctcctcatgctcatactgtgtgtgaaattgtcaaggcccgttgggggacttctgcgcacattgttttcctcattttctgcttcttgacgaatataattgtgacggctatgttgctcctcggtggttctgcggttgtaaatgcattaactggagtgaacctttatgctgctagctttctaataccacttggagtaattgtctatacactagcgggtggactgaaggccacattcttagcaagctatatccattctgtcatagtgcacattgttttggtgatttttgtctaccttgtctacacggctagcagcgagcttggtagcccttctgttgtttacaatcgcctgctagaggttgcaagcaaatcaagaacatgtcaggatcctatatcacaccaaggacaatcttgtggtccagttagtggtaatcacaaaggttcttacctaacaatgctaagttccggtggcttagtttttgggattataaacattgttggaaattttggcactgtgtttgttgacaatggatattgggtgagtgccattgctgcaagaccttcatctactcataaggggtacttgttgggaggcttggtctggtttgctgtgccattttctttggctacatcattaggtctaggagccctggcccttgatttaccaataaatgaaaatgaagcaggccgtggacttgttccccctgctacggctgtagctttgatggggaaaggaggatctattcttcttcttaccatgctttttatggcagtaacttctgctggttcatcagaactcattgcggtgtcctcattatgcacatatgatatctaccgaacttacataaatcctaatgcaagtggaaagcaaatcctcaaagtgtcaaggggtgtcgtcctaggattcgggtgtttcatggggttgttagcagttatactgaacaaggctgaagtttctttaggatggatgtaccttgcaatgggagttctgattggctcagcagttcttcccattgcttttatgcttctatggagaaaagcaaatgcaattggagccattcttggaacagtgttaggttgtgttttaggaattatcacttggctgtctgttacaaaaatacaatatggccgggtaaacctcaatacaactggcagaaatgcaccaatgcttgctggaaaccttgtctctatactaactggaggagttgctcatgctgtctgcagcatgttgagacctcagaactatgactggagtaccaccaagcaaatcacagtggttgaaaaggaaaaatctaatcttccagcagaagagtttaaagaagaaaaactaatcagagctaaatcatgggtggtgaagtggggtgttggtttcactcttttgattgtcattctatggcctattctctccctcccagcaggggagtttagtaagggctacttctatttctgggcagtgattgctataggatggggtactgttggttctgctgtgataattgttttaccactaatagagagctgggaaaccattcagacagttattatgggcatgtttacaaatgacaggctcatggaaaaggtagaggagttaaatttcaagttgcagaccatcatgcaggcaatgccagaagctgagagactttacttgcttgagaaggggaaggccaaaaagttagactcctcggaacagcaggctagttctcttcctgcataa

SEQ ID NO: 49078 - DNA, 1830 bp, Glycine max
  Peptide Sequence Number=SeqID_165856
atggttgcaaaaacattccggaaaaagagcataccttgtgatgtggtgtggatggatatcgattacatggatggttttcgttgtttcacctttgacaaggcagctatccagcctgcactggagcgttttcgagatcccatgtctttagtgaaagatctccattatagtggttttaaagctatttggatgcttgatcctggaatcaagcaggaagagggttattttgtatacgatagtggttctaaaaatgatgtttgggtccaaaaggcagatggaactccttacgttggggaggtgtggcctgggccatgtgtcttccctgactatacgcagtctaaagttcgtgcatggtgggcaaatttagttaaagacttcattcccaatggtgttgatggtatatggaatgatatgaacgaaccagctatctttaaggttctaacaaaaacaatgcctgagagcaatgttcatagaggagatactgaacttggaggttgtcagaatcattttttctatcataatgtctatggtctactgatggcaagatcaacttatgaaggcatgaaactagctaatgaaaagaagcgtccttttgttcttacgagagctggattttctggcagccaaaggtatgctgcaacatggactggagataatctttctacatgggagcatcttcacatgagtatctccatggtacttcagctggttccttgtttcctttttgccgagggcattctgaagctggcaccactgaccatgaaccctggtcttttggggaagagcaccttacgtagacaggggttggataagttggagattactttgcctaaggggatatggttgaattttgatttcaacgatgcacatccggatttgccagctttatacttaaaaggtggctcgattattcccgtgggcctccctcatcagcatgttggagaggctaatccttcagatgacttgactctttttgtggctttagatgaacatgggaaagctgaaggtgttctatttgaggatgatggtgatggatatgaattcactaaaggcagttatttattaacacattatgtggctgaacttaaatcatcagttgttacagtgagtgtccacaaaactgatggatcatgggaaagacctaaacgccgcttgcatattcaattattgctgggtgggggtgcaatgcttgatacatggggaactgatggagaagttctgcaactaattttgccttcggaagatgaggtgttgaagctagtatctactagtgagaagaattacaaggaccgtttggaaaatgcaactccaattcctgatgtagaagaggtttctggacccaagggaacagagctttcaagaactcccattgaactgaaaaatggtgagtggaatcttaaagttgttccctggattgggggtagaatcatgtccatgacacacattccttcaggaacacaatggctccatagtaggattgagataaatgggtatgaggagtatagtggtatggagtatcgttctgctgggtgttctgaggaatattctgtcattgatcgagaaccagggcttgtggtgttagagggtgatattggtgggggattggttcttaaacgtcatatctatgttccaaagaatgttcccaatgccatccagatagactctagtataatagcacgaagtgttggagctggttctggagggttctcaagcctgcagtgttggatcatgggggttaagggtgtttggttactgagtgcctctatacacttccacttagaaatgtatccttggacacattttgaaatgtttggctggcaagtccaaaattag

SEQ ID NO: 49079 - DNA, 258 bp, Glycine max
  Peptide Sequence Number=SeqID_165857
atgccatggaaggaggagcttcaccaccaagagagtgccttggataagaagcttagagaggaagcttcaatggaggaaaaaatgagagagggggggggggggggggggcacaaaattgaaggagaaaaagaggaagagaagttaaacttggaaatgtgtctcacaagtttcacattcatcaaagttgtgacaagaatatttcaaggatatgccaaagacatcttagcatattccaagaatataccaaaggcatcttaa

SEQ ID NO: 49080 - DNA, 1166 bp, Glycine max
  Peptide Sequence Number=SeqID_165858
aagcaagttcaataggtgaaaatgtgatagaacaaccattgatagatcatactgacaacaaggaaattgttatagaacaaccacctatagataatactaacaacggtgtagaacaaccacctagagatgatactgacaatggtgaaaacgtgatagaacaaccacctataaataatactgacaacataaatagtcataatttcaatcaagaactagaagacaatattttagaaataggagtagaagggaatgttgagcataataacacttgtagtgaagtacctacaaatatttatgacctaggactatggaaaaatattgatggaaaatttagagatttaatgatagaaaatggtcctatcagacatgacaattttcaatatccaaaagatgaaaataatagatatttctattcatcatgttatcaacgaacactgtcaaatggagaaaaacatgatagaagatggctagtttattctaaagatttagacaaagtgtattgtttttgctgtaagttatttggttcaacaaatgttagtcaactagcaaatgaagggactaaagattggaagaatcctggttccaaacttaagagtcatgaaacaaatcatgaacatataattaatatgaccaagtggattgaactagaaaagagattgacaacaaaacaaacaattgataagaatatacaagaacaaattaacaaagaaaaggaacattgggaaaaggttctacttaggattatagctatagtcaaatatctttctaaaaataatcttgcttttcatggaacaaatgaaaagatatatgaaaaaggtaatggtaattttttgagtttgattgagatgcttgcggaatttgatccaattatgcaagaacatgttaggcgcataaaaagtaatgaaactcgtaatcatttcttgagtaataccatacaaaacgagcttatagaaatgatagccttccaagttaaaaagtcaatcatagagaaagttaaagatgcaaaatatttttctgttattcttgattgtactcctgatgaaagtagaatagaaagtgtcaaagctattaagtttcatgctccaaagggaaaacgggtttgcattggctttagaatccacggaaaaaatggtcatcgaaatggatatagagccaaaattttgtga

SEQ ID NO: 49081 - DNA, 1380 bp, Glycine max
  Peptide Sequence Number=SeqID_165859
atggacgcgctcatcgcttcaccctatacccacacattttggaatgagtacatgctcaatccacactcctgcgagtacaacctggtgctggatcagacgattgagggagaattggacgtcggccgactgcgcgcggcgatcgacggggtttgccgtgactatattctgtttcaccacgttctggatgacagcgcctcgcaattacgctgggtaaggtcggcgaaaaaaattgcgctggaaacgctcgatgccgattgcgatgtcggtaagttaatcaatgcgccgttcgatctccgggaagggccgctgtgccgcttctacctgattgagctggctccgcagcgctataacctgatcattgtcgttcatcacatcctgatcgacggcctgtccggacaggagttctacagcgccgtttctgcctattacaatcgcggcacggcggtgacgccgccgcaggcggatgaaacggacatcagcacattgtaccggcgctatgaggcagatatcgcggcgttgaaacacgagttcggttccgcgtcattctggggcgacatgctggccgaatgcgccccgcgcgtggcgttgccttatctccccggcgcagcggccgaagcgcccggcgccggcgaagtgcgctttgcgttgccgttcgctgagtggcaagcgctgaaatccggcgtcaggtatgccaatcctttcgtgatcttcaaaacgctgtgggcgctgctgatcgcccgacaatctgcgcaggaaacggtgcatatcggttatcccatcgcgccggagggtggcgaggcgctgttcttcggcgcacaggtcaacactgcggtgtttcccttgaccctcgccccgggagccacgttcaatcagttgtaccgcgcgacgctggcatacagcaaagcgctcaaggtggctggcaagctgcggcacagccaattaccggtttatgacatgctgagcctcagtccggtgcgtcagctgaacgtcaactttacccaggcttacatgaaagatgcgccgctggcgctcgaggggtgtcgcattggcgtcaatcaccggttcaatgtcgatctggccggttcggaactgctgctggagtatcagcccaccgagcaggcctttgagtttcgcctgcgctaccgccccgatctgttcgacgcgacccagatggcggagatggcggagcagtatctctggctattgcagcgcgcattaaccgaaccggatgcgccgattgccgcttggccgcagctgacggcgcaacaggttttgcgctgccgcgacgcctgggagagcgggcctgcaacggccgacgcggaagcgacgctgctcgacggcctggcccgccaggcgcgccgtcacccggaacgcatcgtc

SEQ ID NO: 49082 - DNA, 1387 bp, Glycine max
  Peptide Sequence Number=SeqID_165860
atgccagtttccttccccttgaatgccggtacagggagtcaaaaatggctattttcgcccccttgcgggcaactctttcagcattattggcagaattatctgatgaataaaaaacgtcccgccttgaccccggcaaccctgttattgctacagccgatctatatcggctcggccctggcggcggagcaaaaagacagcgacaccctggtggtgatggcgcaacccaccggattgacggagctggggtcgccggtctccgtcagcgtgatcgacggcgaagacctgcgcaacgccgcgccgcagattaacctgtcggaaaacctcggcagcgtgccgggcctgcagatccaaaaccggcaaaattatgcgcaggatctgcagctgtcgatacgcgggttcggtagccgctcgatgttcggcgtgcgcggggtgcgcatgtacgtcgacggcattcccgccaccatgcccgacggccaagggcaaacctccaatatcgacatcaattccgtcgaacgcatcgaggtgctgcgcggcccctattccgcgctgtacggcaacgcctcgggcggggtcatcaatgttgacaccattaccggcacccagccgccgacgctggaggccggcggctatttcggcagtgacaacacctggcgctacggggtgaaagcgaccggcgccaccggcgacggcacccaggccggcgacgtcaactacgccatctccggcacccgctttactacccagggctaccgcgatcacagcgccgcgcggaaaaacctcggcaacggcaagctcggcgtgcggctggacgacgtcagcaccctgacgctgatgttcaacagcgtctcaatcgatgccggcgatccgggcggcctgaccgaggcggaatggaaggaaaacccgcgccaggcgccgcgcgcggatcaatacaacacccgcaaatcgctcgaccagacccaggccggcttgcgctatcagcgccagatgagtgaacgcgacgaactgaccctgaccgcctaccacggcgagcgccacaccacgcagtaccaatcgatcccgatggggccgcagctcaaccccacccacgccggcggggtgatcgtgctggaaagaaaatatcagggcattgacactcgctggaagcatgaggatactctcgcatcgttaccggtaacactgatcggcggtctggattatgaaaccatgaccgaacgccggcaggggttcgaaaactttattctgcgagacggcacagtggactacggcgagaaaggcgaccagcggcgcaacgagaagaaccgcatctggaacctggatccttacctgcaaacctcctggcaactgacgccgcactgggacgctggatgccggcctgcgctacagcacg

SEQ ID NO: 49083 - DNA, 273 bp, Glycine max
  Peptide Sequence Number=SeqID_165861
atgtatgctaagctcagcagggttgcgcttagcgacaccatgaaattcagaaaatttactaagtatggcggcttatcgagacatgctcgcttagcccaatggttgcccgtagaatgctcgcttagcaagtgtcgcaacctacccttcggcaggagggcgatgcgtgactcgcgggtgcgtgttccaagaaaggaatacgcgcggagtcgccaccaacgtttatttgaggaaaacgtcgaaaaaatcggaaaagacgtgatctacgaactttaa

SEQ ID NO: 49084 - DNA, 886 bp, Glycine max
  Peptide Sequence Number=SeqID_165862
cacttcttctcatcatccttttcttatcagaactactcacacattgatgaaggacatgcccttctttttcctcaagaactccttaggagccaagatgaagaaaggcatcaaaaccttctgcaacaacaacggttcaacctccactctcaaccaacaaaatagccacaacaacaacaactacagtgatttcacaagcaaggtaagctcatcaaactcaccaaccctagaggatctaatactacaactagagttggaggaagaaatggctagaaaatccaaacttaatagtgagtatagtggaataatgaggggtaggatgtcatgtgtgaacaactctgacatactgagatctgcaaggaatgcattgaatcagtatccacggttttcgctcgatggaagggacgccatgtaccggtcttcttttgggaacatagagggaataagaagaagatcagtttgtagtgagacaagttttgatttagataataatcataagggtgtgtgttgtttgcctccaacactggctggggagagtgtggtgtggcgaaaacccggtgttgtggcgaagttgatgggtttagaagccatgccggtgcccataggtagcagcagaagatcctgtgacaataataaagagaagttaagtgctgttgttagaaggcagaatctaataaggaggagatttgagaggcatgacttggagagaaagctactaacaatggagatgcaacatcagagttatggttatcatactaataataataataataacattagaagacacaacaagaataacggttgttgctctaaaaatgggaattgtgttatgaaaccggttgctctagaggctctggctgggggacctggaaggagatcatatgcttaa

SEQ ID NO: 49085 - DNA, 297 bp, Glycine max
  Peptide Sequence Number=SeqID_165863
acattgggggagttggggacaggcttcaaggacgttctacgacagaacttgatgaatgaggattcgtatgtggttaggaaattcaatggaccttgttccaaggttttgaagcgaccgaggtttctcaacgacttgctccccgatgattgtgataccgttgtcttcttcattttcattctcgcactcgcaagaggagacaaaaagaacttaggggaagtggttgccaagacctttctcactaggaaagaagagaccaaacttgcaaagaaaagtaatgatgcaatgctgaaggattga

SEQ ID NO: 49086 - DNA, 1269 bp, Glycine max
  Peptide Sequence Number=SeqID_165864
atggtgaatcggagtttcaagcttgcacatactacagaggattgtgattttcaaacgttgtacccatttgctatgcacataagctgcggggctcgtcaaaatgttcaaacaaaaccaaccaacaccctttggcgtgaagattttgggtttacaggagggatagctgccaatgcaactcgtccaagtttcattaccccaccactcaacactcttcgctatttccccttgtctgaaggtccacaaaattgctacaacattaacaaagtgccaaagggtcactactcaatcaggatcttctttggacttgttggtcggtctaaagataccagtgagcctctatttgacatttctattgaaggcacgcaaatatattctctgaaaccgggttggaacaagcagaatgatcaagtatttgttgaggcgctagtgtttcttacaaatgattcagtatcaatctgtttccacagcactggtcatggggatccagcaatcctttctattgagattcagcaaattgatgacaaggcttattattttggcccctggtggagtcaagggataatacttagaacagttaaaagactgagttgtggttttgggcagtcaaagtttgatgtagattatggaggggattccaggggaggggaccgattttggcaacggattaaaacttttggcgatgaatctgatcaacctagatcagttgaaacaagaatcaaacaagcttcacatccaccaaacttctatccagaaaccctttatcagtccgcgcttgttagtactaataatgaacctgatttaacttacgcattggaggtggatcccaacagaaactattcggtttggttacattttgcagagattgataattcagtgactgctgcggggcaaagagtcttcaatattataataaatgatgatcatgctttcaaagatgttgacattgtagaattaagtggggatatctatactgcccttgtgcttaataccactgttactgttaatgggaggattctaacaataacgttgaaaccaaaggaaggtaatctcgccataatcaatgccattgagatatttgaggttataatggtcgagtcaaaaactatatcagaggaagttagtgctttacaaacattgaagaaggcattggggcttccacccaggtttgggtggaatggtgatccttgtgttcctcaacaacatccatggtttggagtggattgccaattaaacaaaagtagtggcagctggatcattgatggactgtaa

SEQ ID NO: 49087 - DNA, 168 bp, Glycine max
  Peptide Sequence Number=SeqID_165865
atgatcaccatcactatcatgatcgtttctgttataactgtcataactgttatcacaacaacgaacatgaccgttaacccttgtcaccaccatggtcatgacgacaatcatggtgatagtggttgcaatgatggtggtggttgtggtgacaatcttgatgtaaattaa

SEQ ID NO: 49088 - DNA, 198 bp, Glycine max
  Peptide Sequence Number=SeqID_165866
atgcaggggcttcttttacatttctccttcttattacctgttcattttgttggtggaaaaggcgccagaatatcctccgagctcagcaaatggcagaattgccctactaatatcgtagatgaatggcactgtaatctgatcgatcttctaatggtgcttgtcctccataatatcgggtttactacaacaaaatactga

SEQ ID NO: 49089 - DNA, 456 bp, Glycine max
  Peptide Sequence Number=SeqID_165867
atgaggatcctagttactgctaattctttcacatttgtgttaacttcaactgcagtcaagggagagcataccttttcagcaaagtgttattattgtactttcacatcaatcttctatatttttcagtattttgttatggatgattttggtggtcctccccaccttcagggtccttcccccaccctcagggtgaacgtaacgcttgggcctcaggtggacagaatgatgatatctggactgcacaccgttgaagacatattttgttgcagctgtggacaacctcttggatggaaatatgttctgacacatgaaaagaatgaaatatacaaagaagggaagtttgtgcttgagaggtggacgatagttgacaatgaagaggaggaattgaattctgatgcacaagctggctctctaactggctctcaatctggctcaagtgacacagaaaacgcctag

SEQ ID NO: 49090 - DNA, 689 bp, Glycine max
  Peptide Sequence Number=SeqID_165868
gactacatgtcctcgccttcaaagggctacacaccctcgtcgtcagaggactacagctacagacccttagaggactacacgtcctaaccttgagaaggccatacgccctcgccttaaaaggactacgcatcctcaccttcagaggactacacttcctcgcctttagaaagctacacctcctcaccttcagaggactacacgttctcgccttcaaaggactacacatcctcgctgtcagaggactacacgtccttgccttcaatggagtacatgtcctcgccttcagaggactacatgtcctcggcatcagagggctacacgtcctcaccttcagagggctacacgtcctcgcattcagaggactagacgcccttagctcagaggactacacagggctacacatcctcgccttgagagggctacacgccctcgccttcaaaggactacacgtcctcacgttcagaggactacacgtcctcgccttaaaaggactacacgtcctcaccatcagagggctacacgtccttgccttcaaattgctacacgtcctcaccttcagaggactacaagtcctcgccttcagaggactacacgtcctcaccttcagaggactacaaatcctcgccttcacaggagtacacgtcttcgccattaaagggctacacatcctcgcctttagagggctacac

SEQ ID NO: 49091 - DNA, 682 bp, Glycine max
  Peptide Sequence Number=SeqID_165869
caaaaaaggggaggtggttgccgcccagctcgcccaggcgagctcagctcgcccaggcgagcagggttgcttcctccagaagcaaccgccttctggaggatcttctggagggcccaaatgggcctgggtgctatttgcacccccatttttactaagtacaccccctctgctgtttttttgcacctcacgaggaccaaagaatggtcgcacgtcatcgagcaaaggtccccggacgaaattagggtatgacacaaagaattacagcttaatggtaaataagtttggtaaatttctcaaaaagtccaaagacaaaaaattctctaaatctacaaagaagattgaaagcaacaacaacaccttcacatgctctgaatgtggtaagcaaggtcatatcaaatgtgaatgtcctatctaccttagaaaacaagtcagtgaaaagaaaggaaagaatgatagaaaacagaaaaaggcatacatagcttgggaagataatgcatctacatcctccaactcttctagtgatgaagaagttgcaaatgtatgcttgatggcaaagtcaatgaatgactcatcaaccatggaagaaactaaggtaaattctgaatttgaagaagttttggaagcatttaatgaaatgcatgaagaagctcaaaggcttgtgttggacaagtggcctcaataa

SEQ ID NO: 49092 - DNA, 288 bp, Glycine max
  Peptide Sequence Number=SeqID_165870
atgggtacaacaagatgcaaacctaccaagggaatgcttcttcacccaacaaggaatttgaggaatcacctaggtgtaggtggtcttacagcagaagacaaaattctcgttgtcgatgtatctaatgagatagtggattttaccaaagcatctagtgagatcaccgaaaggcatctcaagaagcttgggatgaggttttttgaacatgagtggattatggttggagagccaccagtagcagggaacatggatcagatggatgaagaagctgaagctgaagcttcataa

SEQ ID NO: 49093 - DNA, 228 bp, Glycine max
  Peptide Sequence Number=SeqID_165871
atggaggaagaactgagtcagttcataaagaacagggtctggaaccttgtacctcctactaagaatcagttagtgattggaacctgtcgcaacctaccattttgcgggtcgacaaaagcggggctcttgctcctacgtaccctccatcgaagaggaaatcagacctgcgtagttctttcaaaaggggcgaatcaagcgattctttttacttggaaggtggtcatttaa

SEQ ID NO: 49094 - DNA, 360 bp, Glycine max
  Peptide Sequence Number=SeqID_165872
atgtgtgtggaagttagagagatggttaagttgggagttgggggtgtggtgccgtactcagtgagaaatcatcttctaatgtctattcatctgtaccacgcaacagccgtacaaagattggtgtttctcatcaagaaggatgaaaaaagttatcaggttttgcgcttgaacaaaaatagaaatcagatttgtgcaaggcaaggcaatcttggacggtgtgagatcctcatcatcactgaaatctcccaaatcctcgtaaacttcaacggtcatgtcctagcgaaaggtagatctggtaggcctcctgttgacatcgtgcccgaagacctactgagaggtacactcgaaaagggtgattag

SEQ ID NO: 49095 - DNA, 366 bp, Glycine max
  Peptide Sequence Number=SeqID_165873
atgaagggggatgacttagaatctttaattatccacagtttgtgcattgatggtacccatgtttcatacttcatgttgcatggaaatagtataaactttgcgagtaagtacttgaagtttctcataaggggaaatacttgtacttgggggtatgtcactcggttttggaactcccttaagactcagggtgatcaccatgggggggagttacctgtgcatgacaatgtgaccttgacacttactaatgtagctccatgtgaagcttcagaatggagaaggaagaaagatgattggagacgccacttcaaggagaagatgagtcaagaacaagctcaccaccataggaagccatggataagagcttaa

SEQ ID NO: 49096 - DNA, 585 bp, Glycine max
  Peptide Sequence Number=SeqID_165874
atgggtcgtcgtaagattcaaattgcagtggtgaaagaccctaatacaaggcaagtaacattttccaagcgtcgaacaggtttgttcaaaaaggcgaatgaattgtccatcttgtgtggagtagaaattgctatcgttgtgttctctattggaaacaaaccttactcttttgggcacccaagtgttgatgttgttgtgactaaatttcttcaacatgcgaccaattcaaatgatgcccttggaagcaacaattcttcaaatgaagttgttggtgacatggaaaggctgaatcaacaattatctgatcttcagacccaaatactcgaggaggaaattaagggtacaaagcatgatgagagactaaaacaacatgaagtgacacaagtctttcaatataaagaattgcaaggtttgtgtttagagctccaacgtaaggtgaaggactatgttgatgaaattgaggtgtcggagtgtatgttgcttcttgcacaagaacctgtagtaggaccttgggttgctctcatctctgctagatatagtgagatgggagagaaaggaacaataacggtgaataagtgtttttaa

SEQ ID NO: 49097 - DNA, 261 bp, Glycine max
  Peptide Sequence Number=SeqID_165875
atgtttcatgctccatttcattcccactatccacgaatatccacccttgctaatggtgagaaaaatgtcaccttggagaatgtgatgctgttggagggttttgcaactattggtgatccaatcttgatccgatttcaaagcttggaaatgatgaaggtggagaagaaattgatacatagacaggacaacaacaatctccaaggagtaaaaagggtaggggcaacaaatctccaaggagtaaaaagagtggggtttatataa

SEQ ID NO: 49098 - DNA, 1032 bp, Glycine max
  Peptide Sequence Number=SeqID_165876
atggcgatgaacccgcaggctaacgtcggggtcttcgtggtgttgacccgttccgcgttgacccgtttcagcgccatgagcgacggcgtcaacgacctcgtcagcgccttaagcggcgtgcagccgaatatggaaaccgccagccagcaaaccatgacagatttaatcactcgcccacgccgcctgcgtcaatccgcctcgctgcgcgccatgtttgaagagacaacactgagtttgaacgacctggtgttgccgatctttgttgaagaagaaattgacgattacaaagccatcgaagcgatgcctggcgtcatgcgtattccggaaaaacatctggcgcgcgaaattgagcgcatcgccaacgccgggattcgttcagtgatgacctttggtatttcccaccataccgacgcgaccggtagcgatacctggaatgaaaacggtctggtggcgcgcatgacccgtatcgccaaacaggcggtgccggaaatgatcgtcatgtccgatacctgcttctgcgaatacacctcgcacggccactgcggcgtgttgtgcgagcacggcgtcgataacgatgcgactctggaaaacctcggtaagcaggcggtagtcgccgcggccgccggcgctgatttcatcgcgccatccgccgcgatggatggacaggtacaggcgatccgccgttcgctggatgccgcaggctttaccaataccgcgattatgtcttactcaaccaaattcgcctcatcgttctacggcccgttccgcgaagccgccggtaccgcgctgaagggcgatcgtaaaacttaccagatgagcccgatgaaccgtcgcgaggcaattcgcgagtcattgcttgatgaagcccagggcgcggactgcctgatggtgaaaccggccggcgcctatctggatatcctgcgtgatatccgcgagcgcagcaacctgccgctcggcgcttatcaggtcagcggcgagtacgcgatgatcaaatttgccgcgcaggctggcgctatcgacgaagagaaagtg

SEQ ID NO: 49099 - DNA, 1235 bp, Glycine max
  Peptide Sequence Number=SeqID_165877
atgactcttgaagagctcattgtgatttttaaagtccatgagcaagagcttgctcaagataaaggaacaaacaaagggaagtcactagcccttacaattccaaagaaatatgatgatgatgactttgatgaacaagatgacgagctaagtttgatcactaaaaagatcagaaagatccaacttgtggattctcagcctaatgacactgtcaactctgacggtgaagaggatttcaagaaaacttatcaacctcatttaattgattttatcttggaaaccacttcacttggtgatgtacaagacacctctgtttgtgaggaggtcaaggcattacttgacgaaaaggtatctagtggacgaaagattcttcttaagtattttcaagacttggaagaaagggtgaaatccttaaccacaactcttaaagattcaaaagaagaacacaaggaaatgcttaaacaaaagctcttactactaaaagaatgcatcagtcatggtacctggatagtggcatatagagtgtacaactccagaaccttgactttggaagaagccattcatgtgaggtttaatgacaacaagcctaacactaccatgtcaaaactggatgagtcctttgcagagatgaaaattgaagatatcgtcaagtctattgttgcatctagtcagaaccaacttgtgtccaactcaccaatggatgatcaacctaaagaaaagcttgtagaactccccaaaggcaaatctgttgttggagcaaagtgggtgtttagaaacaagctagatgaaacatgtaaagttgtgaggaatcaggctaggcttgtagccaaaggttactcacaacaagaaggtatagattatactaaaaattttggtcctattactcgtctaaaggcaatatgcattttactatcctttgttgctcaccatggtatgatgttgtatcaaatggacataaaaatcacattactcaatggactaatcaaggaagatgtctatgtcaaacaacccctcgagttcaagagttctatctaccatcaccatgttttcaaacttaattacagctttgtatggtttaaagcaagctcctcgagcttggcagagtttgagatgagtatgattagacaattaaagttcttccttggacttcaaatcaagcaaacagatgaaggcatatacatacgtcaaaccaagtatgtgaaggaacttctgaagaagttcaagatggacgatgcaaa

SEQ ID NO: 49100 - DNA, 636 bp, Glycine max
  Peptide Sequence Number=SeqID_165878
atggcccatgtgtccaaaaggcttgcacccaagaagcaaacacaaaagccttcacccactattgaatgcgtaaagacactcagtgagattgaaagtgtggatgatatgcctcttgtgcttagaaaaagaaaagttgcaccaccttcagatgagacttctgtgcctcaagtgagtgaagaaggtctgcctgtcatagaccccaacctcattgtcgaagacatcgcatggccgggttttctccttgcctttctctctaagaatgcttacaacattcaaagaagactagacgtgaaattccaacctcaggcagattggatgaagcttccacgtgatattgaagaaaaagaagaagtcacctgccctccatcgatgcacaaagattctcaagttgtatccaccactactgagctggatcgactaatagggattgaagttcttcctccaccaaagtggaagagacttcgtcccaaggtatcaaagtattcatctatcacgagtcaatgcaaaaatgtctacaaggttccttttggggcctgtagagaaaaggtgagctatgacaaggacatcattggatggttttgcaagattgatgcccaacagattgatccatcctctgatgatttcctaccaaactga

SEQ ID NO: 49101 - DNA, 213 bp, Glycine max
  Peptide Sequence Number=SeqID_165879
atggccttgttgactatccattcaaagagtttggccttgctcaacagtgttccatatcgccttgaggtcttagcccagttgggtccccacaaggagtgcccaatgtgggttcatcctaaacaattcatattcatatgtaagggtattgactctagatcttttcacatcagtggtgccttcatgttacttacacctactacggtgggtatgtaa

SEQ ID NO: 49102 - DNA, 159 bp, Glycine max
  Peptide Sequence Number=SeqID_165880
atgcattaccaaaagaggaaaactctagatgaggcttcactattatcaagcgagttggagacccagcatgaccacagatcaacctccactccctatggctctaaaggtagatacaacaagcacatcacatgttgtctaccccaggattcaatggcataa

SEQ ID NO: 49103 - DNA, 339 bp, Glycine max
  Peptide Sequence Number=SeqID_165881
atgcaacaaggagaaacaattagagatgttcaaaaaaggttcacatatagtgaatcatctcaagggcctttgaaagtgtttaaggaagaagagctgaatataaagatactaaagtccctcaatagaacatggcaattgaaggtcatgacaatctccgagtccaaagattttgcctccaccacacatgctgagatatttggaaagttaaaagaatatgaaatggacatgactaggattatcaaagaggaggctaaggagaagaaacatagagacttagcactacaatcttccatactatctagtgatgagagtgatgaagaatgtgtaaaaggttcctag

SEQ ID NO: 49104 - DNA, 336 bp, Glycine max
  Peptide Sequence Number=SeqID_165882
atggcggaaaccaagaacaagaggataaaaagcattggacatagaccaattgcccccaaaacaaaatcaaagaaggataataagtctacaaagggaggcttttcaaacaaagggtttgtctttcctgaacttcttgagtaccatggattgaataagctagtggagatgaagggcatgttctaccctgaactagtaagagttgtctacactactacccacattgatggtgagactggttatttgtgtgctgaagtgaaggggaagcagattgtcatgaccactgagatttgggaagacattgttggtttgttttcaaaaggaatagtggtcaattag

SEQ ID NO: 49105 - DNA, 150 bp, Glycine max
  Peptide Sequence Number=SeqID_165883
atgtcggcatttgaggcagactctacggaggagagcggtcctggagggatagcgactagcagagagcaacatattttagaggttatgcgtgatcagaaagaaatgactccgaatagagttgtgaactggccattcaggactctacagtga

SEQ ID NO: 49106 - DNA, 549 bp, Glycine max
  Peptide Sequence Number=SeqID_165884
atgttggattattcattggaatatacaaagatttgcatttggtgtgacagcatgagggctatcaatctgacaaagaatcttatccaacattcaaggtccaagcacattgacatcaaacaacacttcatcagagatcatgctgagaaagggaatattgaactaaagttccttgaaactaagcttcaacttgctaatattctcactaaacctttgactgagaatagtttaaaatttagtaaatccctaatagataaagggaaaggaaaggcaataaaagtgttctctaggtttgatttagagccaaccatgataatcacacacctctcctcccattccaagggtgttgtgataaggtcaccaaagaagaaaaattatgtgaaaaacaactcatctcttttgggaatgcctgttgacatcaaaagtctctatgatgagtggtttgacatcatgggcctcaaaaaggctaaaatcatgaagaagttcttggaagaaaaagattatgatttcaagtccaagtctctcaaatactttggaagaactatccattag

SEQ ID NO: 49107 - DNA, 684 bp, Glycine max
  Peptide Sequence Number=SeqID_165885
atgggtactttactcagtgatatagctccatgtagagcttgtaggccttggatcttcttcactaatggagtcctttgcttcttgaagatcaatggaaacaaaatggagaaggagaaaagcttgaaggtaggagaagatgagtggagggagagggagagaaggggcatgaaatttatgcctcaaatgaggcgaaaaatctaccctaaggcttatgagaaccctagggccttctcctgcatctctagctcaatcttcttggagtcttctatccaatgcccttgggagaatggagtagctggaagaatgaacaacaccttgttggaaagggccaaatgcatgttatccaattcaagactgaataggagtttttgggctaaggcggtcagcagagcatgttatatcgtgaatcgcccaccatccactaccataaacttcaagacccctattgtggtatggtctaataaaccagttaaatactcaatgttgaaggtgtttggatgtctgccatactatcacgtaagtgaaggcaagtttgaggatgtcactaagcaggtggagtttaagtgttccacaatcagaaacattagtgatcagaagtactttgaagcacctgataagactaatcatgatcttcaaatgcaccctcaacatcagaattctacaccagttgagggaactaactag

SEQ ID NO: 49108 - DNA, 354 bp, Glycine max
  Peptide Sequence Number=SeqID_165886
atgtgcaaagaggtttatgagctgatgaaagaagaatttgaaatgagcatgatgggagacctaaagttctttataggacttcaaatcattcaaaaatatcatgacatttttatccatcaagagaaattcaccaaggaccattcaaagaggttcagaatggatgaagctaaaccaatagctacccctatgcatccatctactgtcatttacaaggatgagaaagttggaactactaatcgttgcccttggtttgagaaagggcctaagtttgatcttgtaagctattatgatgttgactttgttggtgataaagtagaaagaaatagcatcagtggtgctattccattcctttga

SEQ ID NO: 49109 - DNA, 408 bp, Glycine max
  Peptide Sequence Number=SeqID_165887
atggtcaacacaatcaagattgagaaattcactgtgaagaataacttcaacctttggcatgaaaaggcacattcattaattctcttagctctgtttgatgaggttctttatgaagtttctaaagaactgattgttgttggactttggttcaaattggagaaactcttaatgacaaaatcaatctactacaagtcgtttctgaaacgacgtttgtttggcctccaaatgaagcctcttcctccctcctatgagaactttgtgagttctcatagtgtaggcaaggattccattacacctgaagaagtcatgtccaatctctattctaaagagctacgactaaaggcatctatgaatggtgatgaagtctctatgttcggattttcagtgactgattctactaaagggtag

SEQ ID NO: 49110 - DNA, 225 bp, Glycine max
  Peptide Sequence Number=SeqID_165888
atgaaaaatgaggttacattaagcaaaaagggcaacagaaatgaagagaaagaaagagttctgaagcaggcccagcccaacactcgcgctaagcgcgcgtcaggcgctaagcgagcaaagaaggcaggcgctaagcgaggcgttaagctcgaagaagcagaaaccgttacgtgcgctaagcccagctacgcgctaagtgcacgatccaacagaagcacaggctaa

SEQ ID NO: 49111 - DNA, 309 bp, Glycine max
  Peptide Sequence Number=SeqID_165889
atgcatactttgttagggtcattcaacagtggaaactggtctgattctaaagtccttgatagtacagggctaggttgtcgtactatcacaaggaatcgggcacacgatcaagggtgggaacaggagttaagtccttacaatcaatatgaagaagaaagaactcctaatcttgaaagtgtgttcgaagaattcatggcataccatgctagctcaaaagccaatcaaaattcaatgaaaaatcatgaaattcattttggcaagagctactcaatagaaaactttcaagggggaccagagttacagccttaa

SEQ ID NO: 49112 - DNA, 440 bp, Glycine max
  Peptide Sequence Number=SeqID_165890
atgtgccctcctccgtcaaaggtcaacactaaaggtgcaccgaagaaaccgatgaaaagaagtcaaagatccacaaagcctgatccgtcttacttggagtatgttgatgcttttcattctgttcaaagcagcaactcttcagtgaaacatagtgcatcatcttctgaaccgccgaagccaacaaggatcatcccgatgttggatcaatttgcgccatttagacaggatttcattcacaacattgtggatgtaaaagcggacggtaactggatatcggtccattaccggtttattagatggtcgcatgactacaacaacctcttcggtggcacaaagagatttgaacaattaagactgtccctacttgttgatgggttttccaaggttagtgtggacaagtggatggatataacggagatgggatatgtcattgcatcacg

SEQ ID NO: 49113 - DNA, 228 bp, Glycine max
  Peptide Sequence Number=SeqID_165891
atggctgaaggagtgggagtgtacggttcccttggcggcaacgttgttgtcgtcaagcaacatggtagtgacgagggcggagagcgccctcttggcgcagtggacctggccgtcaccgacaggggatccttgacggcgtcgcagcgaagggtgtcagcattgcagacctcgacgacgcggttgacagagaagttcaaagatggagtgaggggagtccacgaaggctaa

SEQ ID NO: 49114 - DNA, 576 bp, Glycine max
  Peptide Sequence Number=SeqID_165892
atgactgccttgaagcgaatcattcgatacatcaaaggcaccatcactcacggtttacatctctctccctcctcagttgacaaactcaccacatatactgatgctgactgggggggatgtccggacacccgcaggtccacgtccggttattgtgtttatcttggagataatttagtttcatggtctgccaaacgtcaaccaactctttctcgttctagtgcagaggcagagtatcgtggtgttgctaacgttgtctctgaatcctgttggcttcgaaatttactcttagaacttcagtgtcctattgcgaaagccacactagtatattgtgacaatgttagtgctgtctacttatcaggaaatcccattcaacaccaacgcactaaacacattgaaatggatattcattttgtgcgtgaaaaggttgctcgtggccagatacgcgttctacatgttccttcacgctaccaaatagctgacattttcacaaagggccttccgctgcagctattcagcgacttcagagatagtctcaacattcgtcctcctcccgtttcgactacgggggtgtattag

SEQ ID NO: 49115 - DNA, 846 bp, Glycine max
  Peptide Sequence Number=SeqID_165893
atggtggatttcttgcaatatgcggacgatacaattttctttggtgaggcaactacatctaatgtgttggtgggaaaggacatgggatcccatcattacaaatttttcaaggaagctctcggtttggaagcacaagcgtttatcatttgcgggaagagtttgcctcataaacttgtttgttgtccaaaggagcttagggttaaaaatattaaattgttcgatgagacacttttagggaaatggagatgggatgtgagtggtggaactttgttttggtggcaagatttgatgagggtgtgtgggagtaaaagtggtacaaaatggtttgataactcttttgagtggaagctttttctgctatctgaccaaaaagaatatgagattgttaacatggatcattgggagaatgggcattggcattggcactggaatcttatttggcgtagggacaaatcccaatctgagcaagaaatggtggagcaattgttggttataagcggatatggatggggtggtatagaaacgaggggtggctattgtgctactgtacttgtcgaaaatccatatgtggtagcatccgttttcaagttggcgaaatcatacctctttactgcacgatcgtggctacgagcacttatgaagatgatgaatgtatcttttgttcaatggtctttctgccctataacatatctagcagaggttggcaacatcacatgtatggcccttgacaataatggcaaggtctatgcaaaagacgaaaaagaaaaaggaaagggaggtggatttctgatgtgtcatcattttctcctatttcttaaccctttttgtcaccattttaattactga

SEQ ID NO: 49116 - DNA, 342 bp, Glycine max
  Peptide Sequence Number=SeqID_165894
atgcatgcatccgaagagtcttcctccttcttcttgttgttgatgttatcattatcccaccctgggaaaatcaccttgtcctcaaggaatgagtggctgaagattttttcggagacagagccatttgacagcgacgagaatgacgaagacgatgaggaagaagacgtggttgagctctttgtagcggctgaagtgttccttgcgggctcgatgaatggtaatcctgcggcggtcggaggacacgtgggggttgctgttaacaaggagggaaacaaccacaatgggaagcggacccaacaaggttgtggggggcgactatatgggtgcgaaaagtggaggtag

SEQ ID NO: 49117 - DNA, 301 bp, Glycine max
  Peptide Sequence Number=SeqID_165895
tcctgagcttaaggttggtccttctgctacccgtgtcagcacaaagggaagttgtgttgatccctcagggcaggacctaagcacacgtgaatcagacaaatgtgggttgtatgttgatgacaatcctttccgcctggttgcccttggaagagtttatgaagggtcgacaaacatccacaacatccctttgggcaatgatcaagtgaaggataaacaaggagctgagggacccacaaaacctgtagatagaccggaacccaatgacgatcctccatataagatgacattgccaatctcgtag

SEQ ID NO: 49118 - DNA, 417 bp, Glycine max
  Peptide Sequence Number=SeqID_165896
atggctattgaagaacccataataagagataatgttagcgacttcagtgatgacgagcaacaacgtgattttcatgaacatggtgaaccaagcaatcaaagtgagtcatctttatattttgaaactattagtagccaacttttagaaaatcaagagtactcaaatccttatcaaaggagagggagagctagtacaaatgatctttacgaagggttgacatttgaatcaaaacaagtagatgtgaatgccattaaacaatttcattttatgcattcatttaattttgatgtggtcaagaacaagagtggcaaggtgagagtatcgttcagcaaaatacgcaagaggtgggagttgaagaaattaaacggtattcacacctgcacaaattctttcatatcacaaatcatgttaggttag

SEQ ID NO: 49119 - DNA, 159 bp, Glycine max
  Peptide Sequence Number=SeqID_165897
atggcgagttcgctgcgcaacgcccacgtagcagggaaaccgccattcgtcggttttgctttgcaggacgtgcagacttgctttgcagtgcagagaaaggggagttgcaattgccattggcgagttaagggcaagttgcaactgccattagcgatttag

SEQ ID NO: 49120 - DNA, 306 bp, Glycine max
  Peptide Sequence Number=SeqID_165898
atgtgggaaaaagagagggttttgggagaggaagaatggaggacgaatttgggagaaagagagagcgtagaaacatatcgtaaatataccattaaggtcactcaaggtgaaaaccctcatttaaggaagattgtggaggagacacaagcaggaaaagtttctgattttgtagttgattctgaaggcgtgttgcactttggcacttgcctatgtgttccaaattcaggaggcttaagggagaagattatggaggaagttcatcattcctcttacactattcatccagggttctacttaaatatatga

SEQ ID NO: 49121 - DNA, 1426 bp, Glycine max
  Peptide Sequence Number=SeqID_165899
caccccaacggtgcctggaaagctcccgctgaacgtgaacaacatggtcaccggtgtcgcactcgttgggaccctcagtggccagctcgtctttggctggctcggagacaagctcggccggaaaaaagtttacggtatcaccctgatcctcatggtgttctgcgccatttgctctggactatcgttcggggcaacagcgaagtctgtcatggggacgctctgcttcttccgcttctggctcggcttcggcatcggcggagactacccgctctccgccaccatcatgtcggagtacgccaacaagcggacacgcggcgcatttatagcagccgtgttcgccatgcaaggtgtggggatcattttcgcgggtttagtctccatggccctctcaggaatctttaaatactactaccctgccccagcgtacatcgataatcctgtcttgtccacacaacccgagggtgaccttttgtggcggcttgttctcatgattggatctgtccctgcgatgttgacttactattggcgaatgaaaatgccggagacggggcgttacaccgccatcatcgaaggaaacgtgaagcaagccgccgccgacatggcgaaagtcttggacatagagatccaggctgagcaagataagttggcggaattcaatgctaacaataactacccactctggtcaaacgagttcttcaagcgacatggacgccacttgataggaacaatgagttcatggtttttgttagatattgcgttctacagccaaaacttaacgcagaaggatattttccctgcggttgggctcatacacaaagactttgaaatggacgctattagggaagtgttcgagacgtcacgtgccatgttcgtgatcgcgttgctgggaacattcccagggtattggttcactgttttcttcattgagaagattggaaggtacaagatccaacttattgggttcttcatgatgtcgttcttcatgttcatcattggggtgaagtacgattatctcaagaacgagggcaaaggctactttgcgctcttatacggattaacgttcttttttgctaactttggacccaatagcacgacgttcgtgctgcccgccgagcttttcccgacgcgcgtgagaagcacgtgtcacgcccttagcgctgcggcgggaaaagccggggccctcgtggggacattcggaatacaaagtttgactgtgggtggtcaatcatacaagattaaaaaggtgatgattattctggcggtgacaaacttgttagggttcttctcttcgtttttggttactgaaacgaagggacggtccttggaagagatttctggggaggatgggagagagagtgaactcacgccaacgcccaataataggattcagggtaggattcagggttcaaggactgagacaatgtga

SEQ ID NO: 49122 - DNA, 303 bp, Glycine max
  Peptide Sequence Number=SeqID_165900
atggctgatcgaaagagtgcaatgggtgggtcgtcatccacgtcttcggatacgaagtctcgccgattttctaagtggattccaaactctgttgagaagatcctttctgatgataggaacaatgtttctgcagagggaagtgatttggtcaggtacattgaggagaatgaagagctaaagcagaaagttgcttcattacttgaggaaacaaaagcaaatgtagaagaaatagcatatttgagcaaaaaattggcaaaagaagaagaagaatgtcgtggatatcgtgaagaagctttgaagtag

SEQ ID NO: 49123 - DNA, 270 bp, Glycine max
  Peptide Sequence Number=SeqID_165901
aaggtacatctacttgggttgttgactgagaacaagagagggtacatctcttgtggatcagttctagtggagggtacatccactaggttgttcaaagagaacaagggagggccacttgatccaactggtggggcctccacagcccaagagcctgtgactgaggagcccacaacaccagcaccatcaccagcagtagcaaaggaggagaccactccagctcagacccctcaaccatctccaccatctgtacctgctcctgaggagacttag

SEQ ID NO: 49124 - DNA, 897 bp, Glycine max
  Peptide Sequence Number=SeqID_165902
gtggcaaagctgtgggcgcagatcgctgactacaccaactgttcgatcgacattgtgcaccatctgcgcaaggtggcggaccgggaggcaaccgttgaagatgcccgcggcgccgtgtcgctaatcggcgcggcgcgttcagtccgggtgctcaaccgcatgtcggaagagcaggcaggcgaggccggcatcgataaggcggatcggttcggctacttctacaccacctacggcaagtcgaacctgacgccgctttctcacaaggcggagtggcgtcatctcgtgtcgacgccgcttggaaacgggaccggccttgctcagccgcaagactttgcgcctgttgtaaccgagtggcagtggccgagcgccgaggaagtggcgggagaccttacagaagaccagcgcgcgtccattctggcggctgtgagcgcgtcagattacaagaagtcaccgaaggccaagaactgggtcggaggcgctgtagcgtacgctgtggggctggatttggacgacaacgtgcagcgcaagcgagcagccagccttgtgactgcccttatgcgtgaaggcgcacttgtcgagcgcgaggagagggatccggtgcggcgcgagttggcggtgccgcctcctaggctcgtctgtatgcgggccgctgagaacgtgcgcatccttttggaatcccacgcgttgttctcgttcaatgtgagcgaggagaatttcatgtccaagagagagctaatcgataccggcagtgacaagcgctacgtgcgtcgcgacgaaaaaggccagttcaaagaaagcgtcgacgtcggccggtcgctgtctgccgataagcgccatcaggcgaagcatgacgcaaagcccggcgagggtgatcgcggcgaccacaagaagcactga

SEQ ID NO: 49125 - DNA, 1359 bp, Glycine max
  Peptide Sequence Number=SeqID_165903
atggctggcaataccgagattgcccttctccatcttcatgtcgccgacttggccctcgccaaagtaatcgaacctaccatctggggaccacgtgtcattgtagccatgttcgtgaccttcttcgcctgtgacgatgatcaccagattatgtttcttaggggtgatgataccaccctgctgctgaccgccgaaccgcgcgtgaatgctcgcgcgtctgttccgcttgctcgccttatcaagccaaggagacccactttgcaaacgccgcttgaactagcgcaacactacgtcgcccaaggctggccggtatttccctgtcgctcacacgctgaggagcatgtcgaccaggcaacgggcgagatcgtcacgctcggcgaaaagacgcctttgactccaaatggctttaaggcagcaacgcgctttccgcgcatcatcgagagatggtggtcggactggccggatgctgccgttggtttgccgacaggcgaaaagaccggcttcttcgcgctggacatcgataataagccgggcggcgccaatggcttcgactggctggctgagatggaagcagagcacggccctctgcccgacacggcacgcgtgacgagcccgaacggcggactgcatatctacttcaagtacgtagtcggcacccgcaaccgcggcgcgcttggtgctggcgtggatatccggtccgaaggtggttacgtgctggccgctggcagcacgatggccaacggccgctcctacaagtgggagacggacacgcgtgagatcgcggacgcacccgcatggctgctcgatctgctgctgccgaagtccgcgcccgctcacacgcaatacagcctgtcggctgcgaccaacaacgcttacgtggatgcggccgtcgatcgcgagcttgctgaccttgccggtgcgccgatgggcacgcgcaacaatgcgctcaacgacgccgcgttctcgatcggtactatcgtcggcgccggcgcactcagcgaggcagaggcgcgtgcgctgctacagggcgtggcgcgcggctggggcagggactggtcacgctgctgcaagacaatcgagaacggcctgaaggctggcattcagaacccacgccatatcccggagccagacttcccggcgcacaacaacacgcgcctagtggatatcacacgcatgattcagcgcggacttgagaaaggcaggttgcgcgagcaggcggctgcgaccaacaacgaccttaccgtgcgggaagacgtggcgcgagaggacacaaatattcctgaacaggaatccgcttcaccagtcagtgacattgagcccgccaacggacacattcctttgtcacccatcaccgcgaccgcg

SEQ ID NO: 49126 - DNA, 137 bp, Glycine max
  Peptide Sequence Number=SeqID_165904
atggctccgaaaaagctttccgcgaagagatctaggagggacgccgcgactgaagggacaagtgccgcccccgagtttgatagccaccgtttcaggagcgctgagcaccagcagtgcttcaaagccatcaaaggatg

SEQ ID NO: 49127 - DNA, 108 bp, Glycine max
  Peptide Sequence Number=SeqID_165905
gaaatgttcgatgtgggtcaccaggtgattctttttcagacctctctatctgttaactttcctggccgatgtcggctagcatttttgtcgatcagtatcggtgaataa

SEQ ID NO: 49128 - DNA, 330 bp, Glycine max
  Peptide Sequence Number=SeqID_165906
atggagcatatgactggggctgagctgataacttcgtcaattactgagagatacaagagcaagggtgctcttggccttgatcgactcaaagatggtagtgtggttatggtcttcttgaaagctagaaaggcttggatgctagcctacgttgagcttctgaacttcttgtatgttggttgggctatgcatcacccgtatgacagtgcatttgtcggggttagcttcaatcccctgttccccgaagacttcttccttgtccgccacatgttgggatatgctttgagacttgaaaactatgtcgtccacatatacctcgacattttcatatga

SEQ ID NO: 49129 - DNA, 742 bp, Glycine max
  Peptide Sequence Number=SeqID_165907
ggatgagaaggttgcagaatattgtaggaaatcatcatttgttgaggtgcataagctagaaaaacctttaactgaagaagaatctttgaaattgttctgtaagaaggcatttcagtatagttccgatggagattgtccagaagaacttaaagatatatctcttgaaattgttagaaagtgtaaaggtttacctctagcaatagtggccattggtggtcttttgcctcaaaaagatgaaagtgcacctgaatggggacaattttgtcgagatctaagtttagacttggagaggaattctgagttaaatagtataacaaaaattttaggtttaagttatgatgatttgccattcaatctcagatcatgtttattgtatttcggaatgtatccggaggactatgaagttcaatctgatagactgattagacagtggatagctgaagggtttgtcaaacatgaaaccggaaaaacattggaagaagttgggcaacaatatttatcaaggttggtccgtagaagtttggtgcaagtatcctcatttagaattgatggcaaagttaaaaggtgtcgtgttcatgacttaatacacgacatgatccttagaaaagtcaaggatacaaggttttgtcagtatattgacgggcgtgatcaatttgtatcaagctcaagtcaccaacctctcaatggtggtgaatgtttctacattactttaggtctttctagagttttcatgatagattag

SEQ ID NO: 49130 - DNA, 636 bp, Glycine max
  Peptide Sequence Number=SeqID_165908
atgtctgcccctaagccatcgcttgtgtgtcaaaaagagaagagtagattgggaccaacacttggctgggataggaggggttgtattaactacaatcccgcacttgctataagacagttagggtaccccatgaagggagcatcgacggaagagagcctctctcttttccttgtgagagatttcggcgcgcaaagtttcaagattatacaaagagtccataaggcgtgggaaagcctgttaaggaaagatgaagaacataggggcattcgtaatggcatcatcggtggttatcatgaatggttgaaagttcgtacacgagggttagattggctctccaagttgaaaattatcaacgaggagaacttcgaagctccggaaaaggatgaagaagtccgagctctaaaaaatggactaggaaaagcaagacttgccaaagaaaaattcaagttagtcgctacaaacgtccggaaagagtgtaccgagttacgagaagaaaatgcagctaccgcaagagcccttgaacaagaaaccaagagggctcgcaaggaagagcatggccgagacaaattccgtggagctttgtggggcagcaacagtgagctcaagcttcgaagggaagagagagaccattcatga

SEQ ID NO: 49131 - DNA, 399 bp, Glycine max
  Peptide Sequence Number=SeqID_165909
atgtgtatacggataacccttgggtgtctccgcatgtcactcgatgcatgggccaggattaacagatgttgtgtttgtacggataatcactcggggtatttccgcctaccacctgacgcatgggttaggattaacagatgttgtgtttgtatggataaccacttggggtatttctacctacaactgacgcatgggtcaggattaacagatgttgtgtttataaccactcggggtatttccgcctgccacctgacgcatgggtcaggattaacagatgttgtatttgtacggataatcacttgggtatatccgcctgccacctggcacatgggtcaggatcaacagatgttgtgtgtgcggataaccatcgggtgtctccgcatgccaccagactcttga

SEQ ID NO: 49132 - DNA, 336 bp, Glycine max
  Peptide Sequence Number=SeqID_165910
atggccccgaggaagcttgcctcaaagaggtccaggaaggacaaggcggccgaaggaactagtaccgctccggagtacgacagtcaccgctttaggagtgctgtacaccagcagcgcttcgaggccatcaagggatggtcgtttcttcgggagcgacgcgtccagctcagggacgacgagtatactgatttccaggaggaaattgggcgccggcggtggacatcactggcgcttccgaaacgtttccgtaacgttttccgtgaagaatttcgcaaaggtttcaaccgttcttcgacgttcttcattcgttcttcatcgttcttcgatcttcaacgg

SEQ ID NO: 49133 - DNA, 324 bp, Glycine max
  Peptide Sequence Number=SeqID_165911
atgggggagacatatgaaataccccaccacaatctagccaacttcgagccttgcctcggatgtgccactgaagggcaagcagttcgtgcccctcctgctatggctgaaaatggaaagttggatcggatagaggaaaggctaaaggtcattgaaggaagcagagattatgcctttcctaacctagaagagttgttcctagtacccaatgttgtcacccatcccaagttcaaggtgtcggactttgagaagtacaaggagactacttgccccaagaaccatctaaaagatgtattgtcggaagatggggacatacgcaaaagatga

SEQ ID NO: 49134 - DNA, 348 bp, Glycine max
  Peptide Sequence Number=SeqID_165912
atggtggaatctgaaaaacttagctatatcagaaacaaccaaaagaagcttagagttgataagtattctagcttacaaacttcattggatactggaacagctaaaggcttaaccaagggaaaaagagtcatcttaccctcaacgtttgttgggagccacgttatatggatcaactttactttgatggtatggcaatatgcagtcatattactttcacctttgaatctcaaaccgacagacaggccagatattgtatcacgaattttcagattaaaatatgaacacatgctgtcagacttaacaaagggtcaattactgggaaaagtggttacatatattaatggctaa

SEQ ID NO: 49135 - DNA, 812 bp, Glycine max
  Peptide Sequence Number=SeqID_165913
atggaccatggggttctagtacctacaccatcagagggctacacgtcctcaccttcagagggctacacaccctcgccttcaggggataacacatcctcacctccaaaggactacctatcctcgccttcagaggactacacatcctcgccatcaaagggtcacatacactcacctttagaggactacatgtcctcgcattcagaggactgcatgtccacgccttcaaaggactacacgttctcgccatcggagggctgcatgccttcaccttcagaggactacacatcctcacctttagaggactatacgtcctcgccttcagagggctacacgccctcgctttcaaaggactacacgtcctcgtcatcagagggctgcacgtcttacccttcagaggacaacacatcctcgccttcagagggtcgtgtaccgtcaccttcagaggactacatgtcctcgccttcagaggactacacgtcctcgcgttcagagggccacacgccgtcgcctttagaggactacacgtcctcaccttcagagagctacacgccctcgccatcagaggactacacgtgctcaccaacagagggctacatgtcctcaccttctgagggctacgctccgtcgccttcagagggctacacactcttgcctttagaggactacatgtcctcaccttcagagggctacacgccctcgccttcagaggactatacgtcctcaccttcagaggactacacgtcctcacctttagagggctgcacaccctcgccttcagaggactatacgtcctcaccttcagaggactacac

SEQ ID NO: 49136 - DNA, 861 bp, Glycine max
  Peptide Sequence Number=SeqID_165914
atgtcggttaacccaggctttggcggccagtcctttattccgcacacccttgaaaaactgcgtcaggtgcgtcagcttatcgatcaatccggctacgacattcgccttgaagtcgatggcggcgtgaaagccagcaatattggtgaaattgccgccgccggtgcggatatgtttgtcgcgggttcggcgatcttcggccagccggactacaaaaaagttattgatcaaatgcgtagtgaattagcgaaggccatccgcggcgtggcattcgacctggacggtacgctggtcgatagcgcgccgggtttaaccgccgccgttgatagcgcgctttacgcgctggaactgccggtggcaggtgaagaacgcgtcgtgacctggattggcaacggcgcagacgtcctgatggagcgggcgctgacctgggctcgccaggagcgcgccacgttacgtgcggcgatggggaaaccttccgtcgacgatcatgatataccgcaagacgaacagctacgcgttttgcgtaaactgttcgaccgctattacgccgaagcggcggaagaaggcagtttcttgttcccggcggtggccgatacgctcggcgcgctgcatgccaaaggcctgccgctggcgctggtcaccaacaaaccaacgccgttcgtggcgcccttgctcgaggcgctggatatcgcgaaatactttagcgtggtgatcggcggcgacgatgtgcagaacaaaaagccgcatccggatccgctgctgctggtggcgcaaaagctctctctgacgcctgccgaactcttgttcgtcggggattcgcgcaatgatattcaggcggcgaaagcggcagttgccgctctatcg

SEQ ID NO: 49137 - DNA, 131 bp, Glycine max
  Peptide Sequence Number=SeqID_165915
atggcggaaccatcaaagaagcgaaatggcacttcaagtcggagtcaacggcattccgggtcacaggaaacaccaattccttcatccattccttctggatcattgttttcatctgaggaacagcggatacg

SEQ ID NO: 49138 - DNA, 670 bp, Glycine max
  Peptide Sequence Number=SeqID_165916
atggccgtgcagcatcagcaaaggcgtgcccttgccgccgctggccacgcgcagcgtaacgccattatccagcgtcacatcctgcagggtaaaaccggcgataaacggcgacgggccgcgatcgataatcttactcatggttgctccctgcgtccagtccaccgcgctgccgccaccgatcagcatttcgcgcttcagggcactgaccgtaaagtgaatcacttcatccgcgaactgaatggtttgctgctccagcgacacgctgatggtgttgcgctgcgcatcggcggccaccgcgctcagacgctgataatccgcctcgctcagactcagcgtcagcacgccgttacgctggcagttatcgtcaaaaatgccggcgaagctggtgccgataatcgcgcggatgcccagctgattcagcccccacaccgcatgttcgcggctggagccgcagccaaaattggcaccgaccagcaaaaacgtcgcgttctgccagcccggctgattaaggatgaaatcagggtttggtgccccgtcggccagaaagcgcaggtcaaagaacaccccgcgatccagcccctgccggtcaatgcctttgagaaactgcttgggcataatcacatcggtatcgatgttagcagccggcagcggtgccagcttgccggtgatg

SEQ ID NO: 49139 - DNA, 893 bp, Glycine max
  Peptide Sequence Number=SeqID_165917
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatccaaacaagactcggcattgatgtacgaacaacgtcgtttgattcgtaaagaacgtattcagaaactgtcgcataatcttgttgccaagctttcgctttacactgatacgtttccatttcctgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49140 - DNA, 636 bp, Glycine max
  Peptide Sequence Number=SeqID_165918
atggtggcttttcaccaggccggtgccatgacgccggccggttctgcttcaggatgggataaaactatgggttcaccggtcaccgcagcggaagattcgctgctgcgacacaggtcgttcgtcgccttctggctggcgcgtacctgttcatcgtttggttttcagatgttctccgtggccgtcagctggcaaatctatgcgcttacccacagtgctatggcgctgggcatgatcggtctgatgcaatttttaccttcagtattgctggcgctgccggcgggtcaccttgcggatcagtatgaccgtcgccgcatcgtgctgctggggcagctgattgagtggctggcgctgctcgggctggtggcgctgacgctgctgcactgggcgggccggattgaaatctggggactggtattcctgatttcgctggccaaagcgctggagtggccggcaatcacctcaatgctgccagcgttggtaccgccgcccatccttgcgcgcgccatggcggccagctcggtgggcggtcaggcggcggtgattgtcggtccgacgctgggcggcttactgtacgtggccgggccggaggtggtgtacggtgtttcggcgctgttctatctgttgtcgattgtgctg

SEQ ID NO: 49141 - DNA, 627 bp, Glycine max
  Peptide Sequence Number=SeqID_165919
atggaaaacaattcataccatccttatgtcactgagcgtgtctgtcgcttcgacggcacacctatcggcgcgtgttattcagcgtccttaatgcattgcgtgccggaacgtgatgcattacttcatgaaggcgagataattacccaacattatcagtcagcggatgctgcgggattaataattattccactggcgggaaatagtgtgatgtcctttttgcatgacgtggataattattccagcctgcaacatgagaatgtaaggctggcgatcaactatgccactttacgtcaggcaggatccgccttacgcgctgtggcgtctcgtttttccttctggctttacgatctcgcgccgccgggaaccgagtggaaaaatatcaccgattttcccttcagcggtattgttctgagcgatgacttcttccgcgaaaattatctcaagttcagctttccttttctgctcgcttcgctgcgggaaacacaagcagaggtaatattacctaagcggctggcaaacgcagcggagctgtcatccgctcttcccggggtaaacgtttacacaaaattctgcgcgtcggcgttatcacccgattacgccggacaggatggcgcaatatcctcataa

SEQ ID NO: 49142 - DNA, 1328 bp, Glycine max
  Peptide Sequence Number=SeqID_165920
atgatgaaatgatcggcgccaacctgcagcaggcgctggaggccgccggctggtcggtggactgggtgcgtgacggcgtatttgccagcaacgcctggcaggaaggcggttacacctgcgtcctgctcgatctcggtttaccgcgtgaagatggcatcaatgtgctgcgccgtgcacgcacgcgcggtgacatgacgccggtgctggtgctgaccgcacgtgataccgtgcagcagcgcatccaggggctggacagtggcgccgatgactacttactcaaaccctttgatctgcaagaggttctggcgcgtatgcgagccatcacccgacgccgccacggtgcggcggactccctgctgggcaacggcgacgtgcagctcgatatgatgacgcgtgaagtgctgtacaaaggccagcgcgagcagctaaccgcacgtgaatacgccctgctctatgcgctgctggaacgcccaggggcgatcctgtcgcgtgagcagttagaaaaccgcatctacggctggggcgaagaggtcaccagcaacgccgtggacgtgctgattcacggcatgcggcgcaaactcgataacgaaatcctttacgtttatgcggtcgctgcgcaacaaactgctggccacgctggtgctgctgcatctggcgatgatcggcggtgtcacctggacgaccagctcgccaaaattgccgatgcctggtcaagcagccagcgcatgccggcactgatgccgatggtgatgcagcaggagaagctgaaaattggcgactgcggcgatgactgccagtggcgcgtttacacccgacccggcgagctgggcagcgagatcggcaatattcaggtgctgcacaacgtcggctacatgaagagcctgatggtgaaacgcgtactctccgccatcattccgctcatcctgatgatgccgctgtcgctgctggtgatctggctggtggtgcgggccattacgcgcgatctgcgcgtggcctcgcgccagattgcggcgcaggaaaccctgcatccgcacagcgtgtcgccggacggtctgccggacgaagtgctgccgctggtcgatgcttataactcgctactggataaactacgcgcggcctggtcgtcacaacgccagttccttgaggatgccgcgcatgaactgcgcacgccggtcaccgccgtcacgttacagctggagaacctgcgtcagcacatcctgccgggcgaagccagccgccagtttgatcagctggaagcgggcgtcacgcgcacgcgccatctggtgacgcagttgctgaatatctcacgacaggaggatcagtccgtg

SEQ ID NO: 49143 - DNA, 515 bp, Glycine max
  Peptide Sequence Number=SeqID_165921
tgtacgccatcctgacacggatgagcattcacgtggctcagctaatcattgatgccatctatatatttgcagtccttgtcgcacctagcaaggtgattcggccgcccatcacccgagcttttattgagaagtattgcacgcagagacaggtccagggggatgctccgcaggccgcagacgcgccgccacctaatcaggccggtccagccgaattgtttgatacgaagcagtatttgcggcatttggttcgccagcaggtggccaaccaccgggcacatgtacagacccatgattgtctttaccagatgagcctcagcctgcagagcaagggttttacttcttttccgtgccctactccggaccagttcagggcagaggtcgcatggcctggagattggcctgaggcccgggcaggagaggcatcaacagaggctcccgacgaggcagatgaggcccgcgaggacgaggagatgaccgatttacttgatttcttaggaggaagcggggccacatga

SEQ ID NO: 49144 - DNA, 186 bp, Glycine max
  Peptide Sequence Number=SeqID_165922
atggaagctagggttggtatggcggtggatggtggtggtgtacggaagttggtgcagccgccgccgaagcagattggaactgtttctcagcttctcgccggaggagtcgccggcgcgttcagcaaaacctattcagggaatgcattccaatgttgcagctttgagaaaagtcagtatatggaatga

SEQ ID NO: 49145 - DNA, 207 bp, Glycine max
  Peptide Sequence Number=SeqID_165923
atgtcattgcctagcgctgttcatgtgttctcccttatcaagtgcgaagcttctggtgactgggaagcacgttattctgttgttttccagatcggttccttcgccaaaagaaaaaaaagaagaagtagagatgagagtcgtcattgcgaaaagggcaggacggacgaaatcagtgtcctatctttgctttcctcttatctccgatga

SEQ ID NO: 49146 - DNA, 627 bp, Glycine max
  Peptide Sequence Number=SeqID_165924
atggttccacgacttcaaagccatagggataatgttagtgcagatctttgcgtacattttgttggtggtggcatggcaggaatcactgctgctacatctacttatccattggatcttgtaagaacacggctggctgcacagccctttcccctttggccctacgcattttacctccatctctgccctagctttgatgagtattatcaatcaatgatatgtgcccaagttgtcatccagacaaattttacctactacagaggtatctggcatgctttacacacaattagcaaggaagagggaatatttggcctttacaagggacttggaactacactcttgactgtagggccaagtatagctatcagcttctctgtgtatgaaaccttgagatcttattggcagtcaaatagatccgatgattcacctgtcgtgattagtctggcttgcggcagtctttcaggcattgcatcatcaactgttaagaatcctttagtcaaactattgaatttgctcaaccgaagaacatcaaagaagttaatgtctgtagtggtttactatgcttttgatgcagagaaagagagtttggtgcaggaactgcaccaagtatctaaccagactgacccatag

SEQ ID NO: 49147 - DNA, 144 bp, Glycine max
  Peptide Sequence Number=SeqID_165925
atgacgaaggaagtgatccacagtcacaactctgcagcgcctcagctccaattttccttttctctttcttcttcttctacattttctctgaaaacatgcaaggagtgcagggaaattctctcaggcgagctgcaactcgcctag

SEQ ID NO: 49148 - DNA, 1209 bp, Glycine max
  Peptide Sequence Number=SeqID_165926
atggcactttcttcagccgaagatttaaagagaccaaacgctcatcaaggatataattggggagaagacactggtgatgattactcgaaggcacctcgtgatacccttaactcatctgcacaccctccctttgcccctacaccattttatccccacgaatatagaagaatatgtggtggctgcaaccaagagataatgtatggaaattgtttgggctgcatggatacttattttcacccaaattgttttcgctgtcactcttgtggttaccccattacagagcgtgagattcctataaatgctgctggtttgattgagtataggtgccaccccttttggtcccaaaagtattgtccatctcatgaatatgataatacagctcgctgctgtagttgtgaaagattggagcctttgaacataaaatactatagactagaagatggacggagtttgtgtttagagtgcatggaatctgctataatggataccggtgattgccagcccctttaccattctatcagagattactatgaaggaatgcagatgagaatagatcaacaaattcccatgcttctagttgagagagaagcacttaatgaagctattgtaggggagaaaaatggttttcatcacttaccagaaacaagaggcttatgcctttcagaagagcagactgtcaccagtatacatagaagaccaagaattggaggccatcgactaatcgggatgcgaactcaacctcaaaaactgactagaaaatgtgaagttacagcaattcttgttctatatggtcttcctaggttactcacaggtgctatacttgcccatgagttgatgcatgcatggctacgccttaatggtagtatatttttatattttgatccttatggttatcgcaaccttaatcctgaagtagaggaaggcatttgtcaggttctttcgtatatgtggcttgagtcagaagtaatgcctagctttcaaaacatgccatcaacatccacaagtgctgcctcttcctactcctcctcaaagaagggtgcaaagtctcatgttgaaaataaattgggtgaatttttcaagaatcagattgccaatgattcttccccagcttatggtggtggctttagagctgctaatgaagctgttaatagatatggtttgcgtagaacacttgaccatattcattggactggttttttcccagtgtaa

SEQ ID NO: 49149 - DNA, 234 bp, Glycine max
  Peptide Sequence Number=SeqID_165927
atgcctcgtattcatgacgcgatcttgtattacaacaggaaatggaatatgccaccgcagaacaaatttgttggatgcgcgttcacaggaaaaaatcctaagaaatttcaaattccttcaagatgtaccatcgatgaactgaagaatttaatcaagcaagttgcacctaaagggattccccctcttggaattcacgaatcacaaacggtcagtgggacgtcgctaaacaactga

SEQ ID NO: 49150 - DNA, 738 bp, Glycine max
  Peptide Sequence Number=SeqID_165928
atgaaggtcaaagttatatcacgctccgtggatgagttcacccgagaacgaagtcaagaccttcagagggtgttccggaattacgatcccagccttcgtcctcaagagaaagcggtggagtatgtgcgtgctgttaatgcagtgaagttggacaagatttttgcaagaccatttattggagcattggatgggcatatagacgctgtttcgtgtatgacgagaaaccctagccagttgaaagggatattctccagttcgatggatggagatggagaaggttggaagagaagaggaggaaatttgttttgctatgttgtggatttccaaaatatgtttcctggtcaccgtggtgctgtacgaggcttgacagcatcaacagatggacacattcttgtgtcatgtggaactgattgcacgggtgctgatcaccagtgggatggcgagcattttgccacagctggtgctcaagtagatatatggaatcacaataggtctcagccaataaacagttttgaatgggggacagatacagtaatttctgtccggtttaatcccggagaaccaaatctcttggccacctcagctaggtatgtgagattgccttggccacttgccgcaacgatgacctctgctgtggggtggattgaaggagcggctgttgcgttcgttatagcactggtgtggtatggcgctattgcggtctgtgttgcggtttcacaactgcaacttagattttga

SEQ ID NO: 49151 - DNA, 1077 bp, Glycine max
  Peptide Sequence Number=SeqID_165929
atggcgttgttggcggccagtggcggcgacaccgtcaaactcttcgacgcctccgcggtcaagcccggcgtatacactcctgccggcgatccctgcgccctcagcttcaccccttctcccggttcccaagtcaattcagtcaagtggaaccacaccaatttggttgtggccagtgctggagatgataagaagatctcgctttggcggaagaacgggaacagcatggggaccattcctgtcgccggcactgatagtggagacaacattgaggaatctatattggccatcagctttagcaacaaggcatccagatatgtatgttcaggaggaactggtcaagttgtaaggatatgggatttgcaaaggaaacgctgtattaaatggctaaagggtcatactaatactgtcacaggtgtaatgtacaattgtaaggatgaacatttggcatctatcagccttagtggagacctaatgcttcataaccttgcttctgggcaaaaggctgcggagctcaaagatcccaatcaacagatgttgagagttcttgattattctcgagttagtcgtcaccttcttgtgactgctggtgatgatgggactgtacatttgtgggatacaactggtcgcagccctaaggtttcatggataaagccgcattccgcaccaactgctggtattagcttctctccatccaatgacaagatcattgctagtgttggccttgataaaaaaatgtacatttatgattctggatctagaagaccatcatcttacatttcttatgaagcacctttctcttcgttggcatttagagatgatggttggatgctggctgctggaactagtaatggccgtgtggcattctatgatgttcgtggaaaaccacaacctgttgctgttcttcacgcttatggtagttctgaggggaaagtaggcactataatctatagtatacaagcatgcaacaggctgttacaagcttatgctggcaaaggtctaaaccagttgttgtcgatgaaagaaattgctctgcagagactgctcttgtgggagatacagttgaagattcaatactaa

SEQ ID NO: 49152 - DNA, 1134 bp, Glycine max
  Peptide Sequence Number=SeqID_165930
atgagcacacaaggacaagtgattgatgaggcggttctggatgacataatccggcgcctaacggaggtccgattggcccgacccggaaagcaggttcagctctccgagtctgagatcaagcaactttgcgtcgcttccagagacatcttcattaaccagcccaatttgcttgaactcgaagcccccatcaagatttgtggtaccccttttgctttcttctccttgtctcccctcaatttgctcccttttgtgtttaggggtttaactcaacctcttcctttacctgggcttgaaaccataagggtggctttgtctttaaccgaacacaatggcattgagctattgcgagaatttgggtttgggtttaactcaatcctgaaagctagtgacattcatgggcagtacagtgatttgttaaggctatttgaatatgggggtttgcctcctactgccaattatctctttttgggggactatgtggaccgtgggaagcagagcttagaaaccatatgtcttttgcttgcgtataaaatcaaatatccagaaaactttttcctgttgagggggaatcatgagtgtgcttccattaataggatttatgggttttatgatgaatgtaagcgaaggtttaatgtgaggctttggaaagcctttaccgactgttttaactgccttcctgtggcagcccttatagatgaaaaaatattgtgcatgcatggtggtctttcccctgaactcacaaacttggatgaaatcaggaatctacctcgtcctactgcaattcccgacactggcttgctttgtgatttgctttggtctgatcctggtagggatgtgaagggttggggtatgaatgacagaggagtgtcctacacctttggccctgatatggtcgctgaattcttgacaaagcatgacttggaccttgtttgtcgtgctcaccaggttgtagaggatgggtatgaattctttgctgataggaaacttgttacgatattttcagctccaaactattgtggtgaatttgacaatgctggtgcgatgatgagtgtggatgaaaacttgatgtgctcatttcagattcttaagcctgcagagaaaaaatcaaagtttgtgatgtcaaacaagatgtga

SEQ ID NO: 49153 - DNA, 1191 bp, Glycine max
  Peptide Sequence Number=SeqID_165931
atgtctgaccaagaaggtggcaaagggtctccaaagtcttcgtctttgggtccatatgaagaagccatggaggccttgtcgtctttgatcactagacgcactcgtgctgatgatagcaacgtgggggatcagtttagcctgttatatgattacctgaagatgctagatttggaggagccaattgcaaatatgaagattatccatgtggctgggaccaaagggaagggatctacctgcaccttcacagaatctatattgcgtaactgtggttttcgcactggtctcttcacatctcctcacctcattgatatccgagagagatttcgtttagatggtatggaaatttgtgaagagaaatttttagcctacttctggtggtgttatgatagactaaaggaaaaaactgatgacaatattccaatgcctacctattttcgtttccttgctttagttgccttcaagatatttgcagcagagcaggtcgatgttgctataatggaggtaggattaggtggaaaatacgatgcaacaaatgtggttcagtcacctattgtatgtggaataacttctcttgggtatgaccacatggagattcttgggaatactctgggagaaattgctggtgagaaggctggcatcttcaagaatcggattccagcttttacagtgcctcaacctgatgaagcaatgcatgtacttgaagagaaggcttctctattaaatgtacctcttcaagtggtaactccattagatgccaaattgctaaatggtttgagacttggtcttgaaggtgagcaccaatatttaaatgctggtcttgccatcgcactgtgctttacatggctgaaaaggactggacatgttggagatatctatatggaacaaactgacactttgccagagcagttcgtaaaagggttaacaagtgcaagtttgcaaggaagggctcagattgttccagaccaacacatcaagagtgaaaggtcaaatgaacttgttttttttttagatggggctcatagtcctgaaagcatggaagtgtgtgcgaggtggttttctctagccattaaagaatacaacccggaccaaaccttgtttcatcagcaacttaataattctaaattgtcacatgaagtagtgaagagtacataccacggcgaaagagatcccagagaaaatccactccggtag

SEQ ID NO: 49154 - DNA, 735 bp, Glycine max
  Peptide Sequence Number=SeqID_165932
atgatattgctgttcaattgtttgactgtacgagatccacagttgcttcttcctcggctgatgaaaacgtgtgctgatcatggtgtctacttcaagaaggcgctctttgtaccaagtttatctgtttttaataaagttggaccccaggcttttacaccgactgattccaaagttgatctgtcatggcagtttagtcttcaaagagtttgggaaaatctcatgcaaggcagcaaagttagaaccatagatgttgatggcaactaccaggtgcagattctagtctgtgtctttcaatggggttggctaaatgatcaatcaatggcactggggtttatcaaaaactcatacaactatcaagccttttccactagatgggattggttacatggatcaaatgacataataatgtttatagttttaactgaaccaaatttcaataaaccgtttgttgtctggcattcagtcccaactcccaatcttatcttcttttgtgagttcattgagatttactacatgatgggagaattgccatgtctgttttctacccgtctttttccttgtattccttcactggttgtgtcttgtagaagtactgacattgtttctgaagaactaaaagatgatatggaaatgagtgccagtaattgtgaacatagcacagtgttttcgtcattgccattggcaatcaaatggctcagggacagagtgcaacaaaatcaatcagttcgttttcag

SEQ ID NO: 49155 - DNA, 1242 bp, Glycine max
  Peptide Sequence Number=SeqID_165933
atggcatccggcagtggttttacatccagcatactaaatgcatctactgccgaagaaactcctcaacgaaaccatttatggccaggtggaaccctgtctaggttgcatgctccccgtgctagttataacttcaaggatgacatggaggtcttctcccctcttgtggatgttcaaccattaacaccctcactatgggatgaaaatgggataaagaaggataatttattttccgacaggaaacctttgttgtttccgtcatctagtcgaagattttcaaattctgaggatggaaccagtgatcatccaatatctgattggaaatctggctcaacaaccaagcaggatattacacagtcttcctttccacttgtggggtcaactcctccccctccatcttcaaagaatgaagattcttctatcactcctccagaagcttggggtggtgagcggttaagtgataaatatgcttatacacgtcagcctgtcaatgcaccatctcgttttggggtgttggcttctgctggtcagacagcaggatcaatgttatctggattgcaggatacatcctcatccgtgggtgttagttcctataccagttcaagcctaagttttgcaaatttacgggccaaggatgcttcttcaagccaggaaacttccttggggtttactgatcacatgttctctgctcctatgtccatcaatacaaaaaccagccttggacaagcaattgattccccaaaaatccttgattccccaagaatgtcatcttttaatcgaagattttctacttatgcagaaagaataagcactacatctaccttaagcgatggagtgtccctttcagttggttcacctaagattaagaaatcaggagcagaaaccagagaagaacttctaaatagcttgctgttgaagtctgatatatctgctccaatagaatctggctcattaccactgacaagtggaataatctcacagccgaaagcatctcagccagatgcacaaggatcttcatttacacttcagctttttcaacggaccctggaagaaactctggattcctttcagaaatccatacacgaagatatgagaaaccttcatattgaaattttgagacagtttcatatgcaagagacggaaatgtcagctgtaatgaactctattcttgaaaaccaagctgagttgatgaaagaagttaagtctcttcgtcaggaaaaccagcagctcagacaaatgctttga

SEQ ID NO: 49156 - DNA, 342 bp, Glycine max
  Peptide Sequence Number=SeqID_165934
atggcgcatgtagccaccagtgcgaatatgcaaatattccctcccaacaatggaggagacagaggaccgggatataatactcttggcagtcctactgaagcctttgaacaacagccagcaaacaactggaggggagtctttagcatctcatcttattcagagtatttcaatgtagacacggatgttgtcctaatcagattgataagttccttgaatccagttgctggagactttttcagcaagatagatgctaaccctgatttgtgcgttatttttttgtgcccttgtgcttttatactttcaattatcaaaatggagatactgatttggattacatattga

SEQ ID NO: 49157 - DNA, 525 bp, Glycine max
  Peptide Sequence Number=SeqID_165935
atggttcagaatttaaaagtgttcatgtacaagccaaacaagccccaactcaaatgcgcgaccacggtggagtctctgttctattcttcactgcagaacagcacctacctcacccaagatcccgaggaagcgcaccttttcttcttccctttcttcctaaatctctccacgcgcttcctcgcgcgtgtcctaacacgcatccgcaaagattttattttaggagtttggcgtggtggagtatgggaacgacgtgtcgtgcatagggaagcactacgtgtggggtgcgtgccggtggtggttacgagggactcgtctacgacatgcgtttatggatgtgttgagttggaaagaaaagacagtgtttgtgagaagtgcgcaaggagtgatgtttttgttgggcaacacgtggaaggaacaacaaaagcgaatgagaagattgggtgtggaggtgagtatgcacctcaagtggaaccagcctcctttgcccttcgatgtgttcaacactatatgtatcagatgccatag

SEQ ID NO: 49158 - DNA, 1422 bp, Glycine max
  Peptide Sequence Number=SeqID_165936
atggggcagaagcagcgttcgagttccgatgccgacaacgaagtcaagaaacgacgccgtgttggtttctcaggcgttgattctggagttgaggccaaagactgcatcacaatctatctagtttcaagcaaggaagaattcgatgctccagagagttttgtcattcatcctgtggatctgaatagcttttttgatgatgatgggaaaatttatggctatgagggtttgaagattaccatctgggttagcagcatatcattttatgcatatgctgatattacattccagagttcatctgatcgaggcaaaggggtcacagatttgaaatctgctcttcagacaatttttgctgagactcttgttgatagcaaggatgaattccttcagaaatatttggtggataacgactttgttagaacaaacatctcaaatggagaagctttgaagcacaaagctttccaggggaacatttctgattataatccacatacagattcatctacttctactgttgaggttgtccgtttggtggcaggcaacatgactactggacaactttacagtcatctaatacccctcacactacttctcgttgatggtagcagtcctattgatgttactgattcacagtgggagctgtatgttttgtgtcagaagaaaactgatccgcagggagagatccaatgtaggttgattggttttactgctgtttatcgattttatcactatcctgatgattcccgattacgactaagccagatactggtattacctccttaccagcacaagggttatggtcgattccttctagaggtgctatatgatgttgctatatctgaaaatgtttttgacttcacggtagaagagccattagatcacttccaacatgttcgtacttgtgttgactcacttcgcctgcttcagttttacccaattcagaatatagttactaaagctgtttcacttctgaagcaaggaaagttatcaaagaaagcaaattgtcctcgacttttgccacctcccagcgcaattgaggatgttaggaaaagtctgaaaattaacaagcagcagtttctccagtgttgggaggttttgatctacattggccttaatcctgttgacaagaacacggagaactttgttagtattattttgaaccgtgttaagtatgatatcttagggaaagattctgggacgtctgggaagcagcttattgaagtaccaagtgatgttgatcaggagatgtcatttgtcatgttcagatcagaagccaacgaagctagtagtgtgcaaatggatgacaatcaggctaatcaagaagagcaactccagaggttagttcaggaaagggtgaaagaaattcagttgattgcggaaaaggtaaccctgcatcttgggagctcaggggtggtggttaattag

SEQ ID NO: 49159 - DNA, 999 bp, Glycine max
  Peptide Sequence Number=SeqID_165937
atggaagatccaattggtcaagtattaaaacgaactgagctttcagatgggctaattttagagaagacatcatctcctttgggagtgctccttattgtttttgagtcacgccctgatgctcttgtacagatagcttcgctggcaatccgaagtgggaatgggcttctcttgaaaggtggcaaagaagctaagcggtcaaatgcaattttgcacaaagtaattactgaggccataccagatactgttggtggaaaacttataggacttgtgacctcaagggaagaaatccctgagctacttaagctggatgacgtaattgatctggtgattccaagaggcagcaacaaacttgtttctcaaatcaagagttccactaaaattcctgttttaggtcacgctgtctgcgctattactaatccagatggagtttgccatgtctatgttgataagtctgctaatgtggagatggcgagggggattgtacttgatgcaaaattagattatccagcagcctgcaatgccatggaaacacttcttatccacaaggatttgatagagaaaggttggctaaatgatattgttgttgacctacgaactgaaggtgttaaattatatggaggaccaagggcaagttctctgttaaatattccacaagcacattcatttcatcatgagtacagttcgctggcttgcactgttgaaattgtggatgacgttgcacacactgattccatcattgcagaagataaagaagttgctaatgtgtttctacgccaagtagacagtgctgctgtttttcacaatgcaagcaccagatttagtgatggggcacgatttggactgggcgcagaggttggaattagtacgagcaggattcatgctcgaggtccagtaggtgttgagggattgttaacaacaagatggatactaaaaggaagtggacaagtagtagatggtgataaagggattgtctatacccacaaagaccttgcagcttaa

SEQ ID NO: 49160 - DNA, 762 bp, Glycine max
  Peptide Sequence Number=SeqID_165938
atggcgtttaactcaattcttcgcaagtcgggttcttttgcgagggctcttgctgtcgcgggtcaattgacgaagaatagcaacctgggtcatcgctctctacacttcaccgccatcaaccagcaccagcacaaggattcgtttgttccaaggttccacttttcttctgtagcttccaagaagaaaccaacctccgatgagaaccttctccgggtcatcgaatccgaaatcgaatgcgcccaggagaccgatgatcacaacgcagctgaagaggttccgggtaattttccgtttaagataattgatagtcccggacaacagactataatgctcgagagaacgtaccaagacgaggaaattaaggtggaggttcacatgccggatttggtcactggggaagaaaatgacgatgataatgataatcagagtgaaagaactgctcagtcaagtattccactttcaatcagtgttcataagaaggatggaccctatctagagtttaattgcgtgggttaccctgatgagattgttattgacggcttgtcggttaagaatcctgatctcactgaggatcaagttgcttatgagggaccaggcttccagaccttggatgagaatctgcagaagtccttccataagtatttagaaatcagaggaatcaagcctagcacaaccaatttcttgcatgagtacatgatcaacaaggacagtaaagagtacttggtatggttgaacaagctcaagagcttcgtgcaagcatga

SEQ ID NO: 49161 - DNA, 315 bp, Glycine max
  Peptide Sequence Number=SeqID_165939
atgaccaaattttgtctctgcttgtcatcgggcccgccgcctctggatgacaaaagggtgcggataaccgtaaggtatctccgcgtgtcatcgggcccgccgcctctggatgacacaagggtgcggataaccgtaagaatgaccaaattttgtctcggcgtgtcatcgggcccgccgcctctggatgacaaaagggtgcggataaccgtaaggtatttccgcgtctcatcgggcccgtcgcctctggatgactcaagggtgcagaatgaccgtaaggtatctccgcgtgtcatcgagcccgccgcctctggatga

SEQ ID NO: 49162 - DNA, 537 bp, Glycine max
  Peptide Sequence Number=SeqID_165940
atgacctatcgggatgccgagacttatcgttcgattgtgcgtaaagggccgctcttcccgcttaactcactgatgtatcatggtattgtcagtgctgaaaatgcctattacgggctggaaaaaccgcaaaccgatagcgattttgccgatcaggagctgtacatcacgccgtcgctacttaacaaagtgaagtgggacaccctggcgcaggcggcaaaatggtcgagagcaaatgccgacgtgctggtggatacccattgggtcggcggcgatcctaccgcactggaagtttacggctgggcctcatggaataaagataaggcgatattaggcctgcgtaacccatcagataaaccacagcaattttatctcgatctcgctaaagccttcgagataccgcagggagagacgtctcgctttacgttaaaaagcgtttacggcagtaacgcgacattccctgctgactatcagcaagcggctattgttacgctacaacccttacaaacgctggttttcgaagcgacgccggtaaaatag

SEQ ID NO: 49163 - DNA, 792 bp, Glycine max
  Peptide Sequence Number=SeqID_165941
atgttcaattacttgtcaaagggctgtgatgcttctgtgcttcttgatgatacaccatatttcacgggcgaaaagaatgctcttcctaatcacaattcacttagggggtttgaagtcattgatgacataaaagaacatcttgaaaggatatgtccatcaacagtttcctgtgctgatatattggccttagcagctagggaagcaatcgatcagattggagggccttcttggcctgttcaattaggccgaagagatgcaacaacaaccagtaaggaagcagctgagcaacaaattccctcaccaattgagcctctagaaaacatcactgcaaaatttttctccaagggtcttgacatgaaggatgttgtagccctttcaggagcacatacaattggttttgcccgatgcttcaccttcaaaaggagactttttgactttcaaggctctggcagacctgatcccgtgcttgaattttcacttctatcaaaattgcaaaacatgtgtccaaatgaagacgcctcaaacagcaatctagcacctcttgatgctacaagtaccatgatgtttgacaatgagtattatagaaatattgtatacaacacaggacttctagaatctgaccaagcactaattaaggatcgaaggactgctcctacggtttattattacagcaacaaccaattttccttctacaatgattttgccgaatccatggtgaagcttagtaatgtaggagtacttacaggaacagaagggcaaattagatataaatgtggctctgtaaactattaa

SEQ ID NO: 49164 - DNA, 291 bp, Glycine max
  Peptide Sequence Number=SeqID_165942
atgcagaattcacataaagatgtgtacctagaagtctgcttgaatggtatacattggcaaatggtcatcattttgcctaaggacaatgatgtcatctggttttgttccttgcacaataggcccgacaactacttgaaaggaattattaacagtcaaggaagtaaattcaagactgctactagatggattatagttaaagttttgataatgccaagatgtaagcaacacaagagtacttcaagtcaaaattcaagatcaagaaaacaagatcaagaaaaagataagacttag

SEQ ID NO: 49165 - DNA, 539 bp, Glycine max
  Peptide Sequence Number=SeqID_165943
caaccgctgtgcgtatccacccgctcaacgtcagctggcagggctggctctggcagcgcgacgcaagcccgcctgatgcgctgcgctactgggcgcgaacaccctatgagggcgtgcaacgctttagcgtggctggagacggttcaccagaacagtggctcatggcaacgatcccgctggccgggctgcaactgcaaaccgctcatgcggcggaaccgcattaccgcctgctggcctggcgcgcgtctttacccgagatcaaccatgactgggttgcgcaggcttttcgccaggcacctgtgaatgcggcggaccggcatgctctgctggcgggacaatcggcacaacgtgccgtggctggccggacgatctgtagctgctttggcgttggggaaaacaccatcttacaggcgattaaacagggctgtcacagcactcaggcactgggtaacgcactcaactgtggtaccaactgcggctcctgcctgccggagctaaaacaccttttgctttccgttgctgtaccggaggaagaatga

SEQ ID NO: 49166 - DNA, 237 bp, Glycine max
  Peptide Sequence Number=SeqID_165944
atggccttagcaaatttcttattcccagaaggaaattccatcaataggcctcctatctttaacggagagggttaccactattggaaaacctgtatgcaaatcttcattgaagcaatagatttaaacatttgggaagccatagaaataagaccttatgcacccaccatagtagatgcaagcacgacaacagaaaaacctagaaatcaatggtctgaagaagatagaagaagattttaa

SEQ ID NO: 49167 - DNA, 399 bp, Glycine max
  Peptide Sequence Number=SeqID_165945
atgtccacaccatttgtacaacagccaccaccactagaagtgacccagcaatcctacacgacccatttgggtcacgggtcggtgggacccgtcatcgcggtcctcgccgtcatcactgttctcggcgtcatcgccggcatgatcggaaggctctgttcgggtcgtcgggtcatgggtcacggcgagtacgacgtcgaaacctgggtcgagaccaaatgctcctcctgcgtcgacggcagaatcgcccctccaacgccacgaccacgtcctccgccgccgccggaacccaactctggcggggacttgccgccggaggaaccccctcaagagatcaaagaagaagaacaacaacaagagcaacaccgaaggcaacactcacattcccattgtgatagctaa

SEQ ID NO: 49168 - DNA, 450 bp, Glycine max
  Peptide Sequence Number=SeqID_165946
atggccaccaattttgctcagtgcctcatcttactggctataacagcttcaatatttgaagtgagtatggccaacaaggactgggaaatcatagttggtggttctgagcattggcactttggctataactacaccaattgggccatcaataatggccctttctatttcaacgataccctagttttcaagtatgatgctccaaatgcgactagttttccacacagtgtgtacttgttagcgaatttttggagcttcttgaattgtgatgttaagaaggcaaagatgctggcgaaccctaagcaaggtgctgaagagggcttcaagttcgtgttgaagaagtggcagccatactactttgcttgtggtgagagaaatggatttcattgcaacaatggacagatgaagttcgctgttattccaatgcttcgtcccttctggccatggccatga

SEQ ID NO: 49169 - DNA, 360 bp, Glycine max
  Peptide Sequence Number=SeqID_165947
atggatttttctcaaaacctgtttaccaaaggggcgtattacctaaccggcccaagacaaccaagaaatgacattgatgtttatcttagtcccttgattgaagagttgacaaagctatgggacgaaggggttgccgtgtttgacgggtatcgaaatgagacattcaagttgcgtgcaatgttattttgtaccattaatgactttccaacatatgagaatttgagtggatacaatgttaagggccattgtgcatgccctatttgtgaagaagacacaagctatgtacaactgaaacatggaagaaaaatagtgtacacttggcatcgacattttctgaaaccttatcacccttaccgctga

SEQ ID NO: 49170 - DNA, 552 bp, Glycine max
  Peptide Sequence Number=SeqID_165948
atgcgtcagccgctggccgaacgagcgggaacagatgatctgttctttcgccgccgcctcatcttcccattgcaggcacgactcgccgcgcagctcgcgtatcgtgcgctccagcaccacgctgaaggttttacgcgccagccggctggcgagtcaggcggcgccccacgccccatacctcttccaccgggatcagcgccagcagcttgcgctggcgcgccggatcggataaatccaccacgccgccggtaccgcgccatttcttggcggcgaagttggccagtttggccagcgttttgctcggcgcaatgccgaccccgaccgttaaatgcagctcgcgccggatgcgatcgcgcacccgccggccgaactgctccagcgcttcgcagtgcgccacgccgtccagccgcagaaaggcttcgtccagcgagtagatctccaccgacggcgccatctcttccagcgtatccatcacccggcgggacatatcggcgtacagcgcgtagttggaggagaacaccgcgacgttacggcggcgcatctcctctttaa

SEQ ID NO: 49171 - DNA, 411 bp, Glycine max
  Peptide Sequence Number=SeqID_165949
atgtcgcctaacattgtcggagaagaagaagctgatgatgttcatgctaatcgtaatgatcatgatgaaggagaattaattaacatcgttaatgcaaatggctacaccgcccagctctcctcctcctccttctactggtgcaacatcgcattcgctgtctaccttgaagcggacaagaaaggtggatgtgacatacgagaattggaagtaagtccctgctgcaaagaaggatatgatatgggaggatattcagtttgtcaggctgaatttaatatccctgaagcatctgatgtaaggataaaaaagaaaatacttcagactgtggaggagcggtggagacaatttaagtttgatttgacgtcgaaatgggtacttgcaactgacaaggatagtgtcgacgatactatatga

SEQ ID NO: 49172 - DNA, 186 bp, Glycine max
  Peptide Sequence Number=SeqID_165950
atggaacatggtcggttcccagattctcgcggtcgtgaaatcagtctcagaatgtcatttttcctcactgctaattggttactagaggacctcagagtgaagaaggcaggttgcaacatgaaaatgcgaaaaggagatgaagaagacaaagcatataatttctcagcagagaagattctaaagtga

SEQ ID NO: 49173 - DNA, 1637 bp, Glycine max
  Peptide Sequence Number=SeqID_165951
tccccgccgccgccgacacccctcgccggaaagatgacgccatcaccggaaaacggtctccgttctacccgttctacagcccgagcccggctcgcttcctgaagaagtctccggcaccggcgggagggagccggagcgcgagctccacaccgaggaggtttttccggcggccgttcccacctccgtcgccggcgaagcacataagggcggtgctggctcggcggcagggcaagaaggcgtcggctacggcggcgataccggaggagggggaggagggtgcggcggatttggataagagatttgggttctccaaggagttcactagtaggttggaggttggtgaagaagtgggtcgagggcattttgggtatacgtgttctgctaagttcaagaagggtgagctcaagggtcaacaagtagctgttaaggtcataccaaaagcaaagatgacaacagcaattgctattgaagatgtgagaagggaggtgaaaatactgcgagctttgaatggacacagcaatctgatacagttctatgatgcatttgaagaccaagataatgtctacattgttatggagttatgtgaagggggggagctcttagatatgatattatcaagaggagggaaatactcagaagatgatgcaaaggctgtcatgggtgtggtacaccgagatcttaagccggagggacttggtgctgactttagagttggattaagactaagtattaggtcacttttatttttacttttttggctggcaaagaattttttgtatgctaaaaaggatgaaagttctgagttgaaagctatagactttgggttatcagattttgtcagaccagatgaaaggcttaatgatattgttggaagtgcatattatgtggcccctgaagttctccatagatcttatagcacagaggctgatgtgtggagtataggtgtgatagcatatattctattatgtggcagtcgtccattttgggctcgaacagagtctggtatttttagggcagttttgaaagctgatccaagctttgatgaaacaccgtggccatctttatctttagaagctaaagattttgtcaaacgcttattgaataaggatccacggaagcgaatatctgctgctcaggctctaactaacaatgaggaggccttgtcaaaaacattgactgcagatgaactctattatctgagggagcaatttgcactgctagaaccaagcaaaaatggcagcatatctttagagaatgttaacaaggccttgatgaaatatgcaacagatgccatgaaagagtctcgcatccttgacttcctttcatcgctgaactcgttacaatatagaaggatggattttgaagaattttgtgcagctgcattgagtgtgcatcaacttgaagctcttgatcgttgggaacaacatgcccgctgtgcatatgaactttttgataaagacggaaacagggctattgtcattgaagagcttgtttcagaacttggacttggtccctctattcctgttcatgttgttcttcatgattggatacgccacacggatgggaagttaagctttcttgggtttgtcaaattattacacggtgtatctagccgaagccttgcaaaggttcaatga

SEQ ID NO: 49174 - DNA, 292 bp, Glycine max
  Peptide Sequence Number=SeqID_165952
atggatgggtctattaccgtccaacctttggattttgctcttcataagaggattgtggaagggccactcaagcccagtctatggtctcgctctagtttagctctagggagtttctacgtgcaaccagcattattgctggggcacccagcaaacaaccttcttccggaagaagaatttgtgatttccggaagtgctcaggaactacttccgggagaacgtcatccggaatgttttcagaagaagcttcttccgaaagatttccattttcttccggaagaaggttcttccggaa

SEQ ID NO: 49175 - DNA, 276 bp, Glycine max
  Peptide Sequence Number=SeqID_165953
atggatgaagaaagcattgattccattgaagaagattatgaggaaaagtctacatccacgagcattcgtgtggagactaagatactttcagaagaggagggaactatcatattcatagacaatgagaaggacgatgatgggaatcttgattgtgatggcaagatgcttgaccatcttgaatctacgtttctatcaaggctagtggatgaatacaagtttgaccacaagccaagagtggtgacatcactacaaaaggttacacctttagcctcatga

SEQ ID NO: 49176 - DNA, 252 bp, Glycine max
  Peptide Sequence Number=SeqID_165954
atggaaatgcaacaccatgtgaatgctggcgttggacccaagaattggatcaaaatatttctagtttcaagaacgaacatcacatatcctattctggctagactagcttttgtggtgttaatagtcggggcttcaaattttggcataggcaatggtgttaagttctttatgcttctagcatctttagtttgtatcctttcgttttccgtgaccatggttcttcctaagctagttggtaattggataagctaa

SEQ ID NO: 49177 - DNA, 405 bp, Glycine max
  Peptide Sequence Number=SeqID_165955
atggatcatacccgattgatttatgggcttgttatgaagatgtacatggacccgggtagcatgatctcctcccaaatcactcagatcgcccaatccaactcttctaggttgggcttccctgctttgatcacgaccctctgcgacgctaaaaggggctcgggccactctagatgctccaccagtcattcctccgccaacagttcctcttccggtctctgccccgccttctcttctctctactcaccaagccagtatcttctcatacagagtcttcatcatctctccctccatcggttggttatgtcgccaaaggctttcttggagagtgtagcttggcctggggaccaagcttcctctgtcgggggaggtgacacctctggagctggtgatcatgatatgctgtag

SEQ ID NO: 49178 - DNA, 1149 bp, Glycine max
  Peptide Sequence Number=SeqID_165956
atggctcaacccagttccaacggggatctgaataataaccagcagggtcaggttcagcaacagcagcagcagtgggcggcggcgcagccgcatcagtatcagcagcaatggatggccatgcagtacccggccacagccatggccatgatgcagcagcagatgatgatgtacccgcagcattacatgccgtacgctcacccccattacccgccgccgccgccgcctcctcagtcgtctcaccatcaccaccacaaacaggccgcagccgcggcggcggctgcggcctcctccgacgagatcaggaccgtctggctcggcgacctccaccattggatggacgagaactacctccacaactgctttgctcacaccggcgaggttgtgtcggccaaggtcattcgaaataagcaaactggtcagtctgagggatatggattcgtggagttctattcacgagcgacggctgagaaagtcttgcagaactataatggcacgatgatgcccaatacagatcaggcattccgtctgaattgggccacattcagtgcgggggaaaggcgttcttccgatgctacttctgatctctctatatttgtgggggacttggccattgatgttactgatgctatgctgcaagagacttttgctggccgatattcgtctattaagggagcaaaagttgtcattgattctaataccggccgctcaaaaggctatggttttgttaggtttggtgatgaaaatgagagaacgagggcaatgactgaaatgaatggtgtttattgttctagtaggcccatgcgaataggtgttgcaactcccaagaaaacttatggctaccaacaacaatattcttctcaagctgtgctattggccggtggacacgcagctaatggtgctgtggcccaaggttcccattctgaaggggatttaaacaacaccactatatttgttggagggcttgattctgacaccagtgatgaggatctcagacaaccatttttgcaatttggtgaggttgtctctgtgaaaattccagtgggtaaagggtgtggatttgttcaatttgcagacagtgaaacccctgcccctctgctgtgtagtgggtggtttcctgtgaaatgggaattggcatatgtattcttgtga

SEQ ID NO: 49179 - DNA, 156 bp, Glycine max
  Peptide Sequence Number=SeqID_165957
atggcggaatcatccactagttctgctgtttcagttgattccatttccagagacaacaagttctggaaaggggcatttgctgtcgctggaatcatgcttaccctcgtcacctatggtgtcttgcagaaatgcagattctggggggcactgtggtag

SEQ ID NO: 49180 - DNA, 714 bp, Glycine max
  Peptide Sequence Number=SeqID_165958
atgggtcacccacatttgtgcacactccagatattcagtcctaggcacgttgtggacttgtgttgtggtaattcgttgcatttgagaattactgccaaggatgcacttgatgctgagtatttctggacggatccattaccatgtgatcctaagagtttacccaaatacgagtcatcgcatgagtttcagaccaagaaaaaacgtcagcagcaacgacaaaatgaagaaaatgccaagcgtcttaaaatgcagcatcctcagcagcatacacgtttgccccccattcagcaggctgggcaacaacacccccaaatgcggcaaggtcctaaccaccctattcatgggtctcaaccagcagttgctgcaggacctagccatcattatggaaagcctcgaggtccttctggtgggccaggaagatatccttctggtgggaactctggtgggggatacaatcacccgaatcgtgcaggtcaaggaggaggaagtggttatggaagtgggccatatcctcctcaagggcggggtgcaccttatgggtcaagtggtatgcccggtgggcccagtggtggtcctcgtggtgggggtggaagcggctatggagttggagctccaaattatcctcaaggtgctccttatggtggatcggcagctgggcgtggatcaaacatgatgggtggtaaccgcaaccaacagtatggttggcagcagtaa

SEQ ID NO: 49181 - DNA, 300 bp, Glycine max
  Peptide Sequence Number=SeqID_165959
atggagtggtctgtcggtcgtgatggtggtagggaagtgggtggttggaataatgaagaatatttggtgattaaggaggtgatttctggtgctgagtggccagacaaggcatgcaagctgagatgtgccggaggaggttcaaggagtaaatccaaagttggaggtggagatcatggtgtggccgcctctgatgtgagttcttcatcctctcctaccaaaagaaataacaagggcaacaatggtggtgtggggttgactgaggttgatcacgtggccgtggttgtaacggtggccgattga

SEQ ID NO: 49182 - DNA, 399 bp, Glycine max
  Peptide Sequence Number=SeqID_165960
atgtcggagaacggtggtgggaaaatcggaattggagtgaaaaatctaagtgtgccgacaaaggctgcaaatgccgttcaggtggttatcagtttgagtttgtccgtctcctctgttcatgtcggtgctctttctccctcttttgtgttgctgctttgtcctccgttcacacccataccaccatcgcaccaccatcaatctctccatattcgctcacaaaaaccaccaccgcactcacgaaaaccatcattgtgccaccccttcacatacccaaatagcgcgaaagtgggtggcgatcatggaattgtagaggaaggtctcacgggtgcgggtgagattgaagatgcgacacgcctagcactgtacgggatcgaaaccacattattatgcacttgttga

SEQ ID NO: 49183 - DNA, 798 bp, Glycine max
  Peptide Sequence Number=SeqID_165961
atgaagttcattgcagggggtaagctagtcgagttgcatggtgaccgtgagaaagacatggaacttgtttccccatcccaattacgttgtctgcttcatacgaatccctccagcactttctttcatattcacatggaaacttgccctcaatcgtctcccacgacacaagtattaccagaaatcacctccttaatcaccaaatattcttcattattccaaccacccacttccctaccaccatcacgaccgacagaccactccattacccttctaccaaacacaaccccagtgaatgtaaaaccttataggtatccctactatcagaaacaagagatcgaagatcaggtgactgccatgcttgtgaaaggtttcattcaaccaagttcaaacctgctttcttcgccggttttgttagtaaaaaagaaggatggagcatggagattctgtgtagattatcgggcttttaatgcaatcacagtgcgagaccgctttccgattcccacgatggttgagctgctagatgaatttggaggggcacgttggttctctaagctagatttgatgcagggataccatcaaatattgatgcgcggggttgatattagtcatgttatggcgggtgagggagtacgaccagtaccagaaaaggttcaggctattcagacgtggccaactctgcgttcgcctcgggctctaagaggttttctcggcctcgccgggttttaccggcagtttatcagagggtatgcagatctagcaccacctcttaccaagctcttatgcaatgctcagttttag

SEQ ID NO: 49184 - DNA, 375 bp, Glycine max
  Peptide Sequence Number=SeqID_165962
atggcggacgtgactcgttccaaggtgtccgcagatcgcctcgaagacgcaatcgcgaaacttacagcgtctcaactcgccatgaatatgaaaattgacgatcttcttcagcgtatgtcgcaacttgaagcaaaccaacaaccactgcaaacgccaccatcttcttcggtaggacagacgccgccggtgtacaatccaatgcatcgtatgaaactcgatgttccaaggaataccagctcagtttatgatgagttgctttatcttggggttgagtcccgccattcgccaggaggtgcaagttctacaaccagtcttcttggctcaagcagtggcgtatgcacgcttataggaggagaaactcctcgatgcacgtag

SEQ ID NO: 49185 - DNA, 684 bp, Glycine max
  Peptide Sequence Number=SeqID_165963
atggcgagggcgtgcagccctttgatggcgatgacatgtaggcctctaaaggttaggacgtgcatccctctgaaactgaggacgtgtagtcctctgaaggtgagggcgtgcagccctctgaaggtgaggacgtgtaatcatctggaggtgagggtgtggagccctctgattgataggacgtgtagtcctctgatggcgaggatgtgtagtcctattaaggtgagggggtgcagccctttgatggcgacgacgtgtaggcctctaaaggttcggacgtgtatccctctgaaggcgaggacgtgtagtcatctaaaggtaagggcgtgcagccctctgaaggtgaggacgtgtaatcctctagaggtgaaggcgtgcagccatctgatggctaggacgtgcagtcttctgatggcggggatgtgtagtcctattaaggtgagggcatgcccttttatggcgaggacgtcgagtcctctgatggcgagggcatgcagccctgtgatggtgaggacgtgcagccctgtgatgccaaggacgtgtagtcctccaaaggtgaaggtgtgcagccctctgatggcgaggacgtgtagtcctctgatggcgaggatgtgtagccctctgacggtgaaggcgtgcacccctttgatggcgaggacgtgtagtcctctgatggcgagggcatga

SEQ ID NO: 49186 - DNA, 897 bp, Glycine max
  Peptide Sequence Number=SeqID_165964
atggatttcatcgtaggactccctgcgtatcagggtaacatatgcatcctgattatcgtggatcgtttttccaagggtgtgcatctgggcatgcttcccccgcaccacacgttgcagaccgtagctcagttgttcatggagatggtgggcaagttacatggcatgcctcgaagcataacgtctgatcgcgatccgcttttcatgagcaaattctggcaatcgttgttctccctgagtggtacaaaactcagaataagttctgcgtatcatcctcaaacggatgggcagactgaagtcgcgaatcgagttgtggagcaatacttgcgagcgttcgtgcatcgaagacctagtacatgggggcacttcctgttgtgggctgagtggtcgtataatacgtcgacccactcggccacgagactgacacccttcaaggttacgtttggccgcaaacctccaaactttccacatggacgaattgctcagtcagagggaggacatgttcacctacttcgacgaaaactgcagaaagctcggactcgcatgaaagaaatcgcagatgggcattgcagagaccatgagtttcaggtgaacaagtgggttctggtcaagctgagaccatatcggcaaaccacggtggcaggtgcgggtcaatcaaagcttttgaggtgtttctatggaccctttagaatcatcgagaggatgggtcccgtagcttacaagcttgaactcgcggagcatttgcgcattcatcccgtgtttcattgttccctcctaaaacctttcgtgggctcgcccaatccaatagcagttgagaaccttccttccggggctatggataatcagcctatcaccacaccattagctattctgggtcagaagacagttccgacggactag

SEQ ID NO: 49187 - DNA, 2097 bp, Glycine max
  Peptide Sequence Number=SeqID_165965
atgacttcgaagttcgatgaacttctcagtcgcatgaaccagttagaaacctctcacgccaactcccacgctcctccgtcatttgttgctgcttcaacggcggccacctccaacgcagcctatagatcgaagctggaggttccacgatttgatggaacagatcctgaaggatggatattcaagggcccggctttggcatggttccaatggatgtatcgaagtggtcagctctcctcgtggtcagcctttcttcatgccatccacgccaggttctcatcttcagcttatgaagatcctacaggagtcttgtgcaagctaacacagagatccacggtatcggcatacctctcggaatttgaagctctcgctaacagagttatcggacttcctgcgccgtttgtcttgagttgcttgatatctggacttagccctgcgattcggagggacgtacaagtgatgcaaccgcacttagtgacccaggcagtttcgtttgcacgtctccatgaagaaaagcttctcgacagtcaccgtcaggggagtaaaccttcgccctcgacaactccagggacgagtaccacgcgcccttcaccttccttgaatggacctctacaagaatcaccactactgccctctgcgagcagacctcacgccgccaccatccctttcaaaagattaacaccatctgagctcgccctccgtcgtgaacaagaagaagatgatgataaccgtgatatggatcccggaccatctctgttacctccttccccgcaggaaacatctccggcacagattagtttacatgctttatcagtacacaccacttcttacaacaggagttggtgtcttctcttcaattacggccacatgagacctccacgctatgagtcacagttggtaatgaagcatgagtttcaggtagacttccatgtcctgccaattcgaggggccgatgttgtactgggagtccaatggctcaaggcgttaggaccagtcctcacggactacactgcgcttacaatgaagttcatctacaatgggcagttgattgaactcatggaacctctcgcggagacgccactacctattacccacccgataccagcaatacaaagactcctcaccaaacattcctttctcttccaaccattatcaaccttacccccgtcgagaccaacaaaccacgctattacccttcttcctcactcagctccggttaatgtgaaaccctatcattacccacattttcaaaagcaagaaatagaaacccaagtcgcagctatgctcagacaaggccatatacaacacagttcgagcccgttttcatccccagtactattggttaagaaacatgatggaacttggtgtttctgtgtggattacaaggcgcttaatgcgatcacagtccgtgatcgtttccccatcccgacggtggatgagcttctagacgagctaggcggcgctgtttggttttcgaagctcgacctgatgcaaggatatcatcagatccttatgagagagtccgatataagcaaaacggcgttttgcacacatcatgggcattacgaattccgcataatgctcttcggcctttgtaatgcaccatcatcattccaagcaacaatgaacaggatccgcagcttggatgagcatctaaaccacttggaaatcgcgtttcaggtattgaagaaaggcaagtttactcttaaattcaccaagtgttcatttgcgcagaaacaaatagactacttgggtcacgtcgtgtccggcgatggcgttcaacctgtgcctgagaagatacaagggtacgcgacgatagctagcccactctctcaactattaaccaaggcggagctggtatggtctccggaagtagaaaacgcgtttcagatgctcaagaatgcagtcacgacggcgctggtgcttgctctcccagacttcactaagccctttacgatggaaacagatgcttcaggcttaggaatgagcgatgtgctctcgcaggaagggcacccaatttccttcttcagcaaacaattctgcccaaagttgctgagatcttccacctacgtctgggaactagccgccatcaccactgca

SEQ ID NO: 49188 - DNA, 378 bp, Glycine max
  Peptide Sequence Number=SeqID_165966
atggttgaacatttgcatgagggcttcattgtgatgcaagatgctcaagcagaaatacttgcaaaatacaagcccacaatcaattcaactttgctgattgcacaacttaaacaagtgaacgaaaccaccaccaaagctttggaatatttcaagagcaccaggcacattatcctgtactatgaagacatcgtcaaaaaccgcactaaattaagggacgttcaggattttctaaaggttcctcaaatggatttaaagagtcgtcaggtgaagatacataaagggtccttatctagccaagttgaaaactggaatgatataagcaaggcactaacaggaacaccatacgagagtttcatccacgaagattatcgtaggtag

SEQ ID NO: 49189 - DNA, 564 bp, Glycine max
  Peptide Sequence Number=SeqID_165967
atggcagatgatctctcttccttcgccaaggatgctttgcttgtgaagggtttgaagagttccactttggtgtggaggcttattgttttgacccttgcaatggtctctggcgtgtatatatgttcaatttgtctgaagcagataggcactagcagcaagattggttttttagacatcaaggttgttcaaaagccatgcccggaacctaacattgaaccttgggagattccttttgtgcattaccctcaccccaaaacttacagcagggcggaatgtgcttgccaccctgtgcgctatttcgctattctgtcaatgcagagatccgggagtggatggtttgagacgtttttaaacagtcatgctaacataagctcaaatggggaaatcttttcggttaaggtgagaaggagtaacatgtcaacaataacagagactctggatacaatttataatctagactggttaagtagtgcttcaaaaaatgagtgcaccactgctgttggtttgaagtggatgcttaatcagatgcatttgcaaattttcattaaggctatggttgcctag

SEQ ID NO: 49190 - DNA, 299 bp, Glycine max
  Peptide Sequence Number=SeqID_165968
cctaaggatcacgatagacagtggcttaggaaacaagacttaccacatgggcgtactccgtcatctccgccacagcaagatgcttcctctgctctcatgaatgaagtcctttctgaactctgtgggcttcaagcattcgttggtgattgttttgatgccatggatggtcacatggatgccatggatgcacgtttcgcaggaatggacactcgcatcactcagcttggggacgatatggaacttgtaaagggtttttacaagatagtggaactctcaaacgggttgcttggggactggat

SEQ ID NO: 49191 - DNA, 915 bp, Glycine max
  Peptide Sequence Number=SeqID_165969
atggaccaaacaaccgccgctgccaacgaggttgtccgcgagttccccggcctcctccgcgtctacaaagacggccgcgtcgagcgcctcctcggcaccgaaaccacccctcccggcaccgaccccggcaccgccgtccaatccaaagacgtcaccatcaacgccgaaaccggtgccggcgtccgcctctacctccctcccaccgccgccgcccaaaaactcccccttttgatctacatccacggcggcgccttctgcgtctgcaccccctacaaccccgcctaccaccaccacctcaacgccctctccgccgccgccaacgtcgtcgtcgcctccgtccactaccgcctcgccccagagcaccccctccccgccgcatacgacgacgcctgggaggtcctccagtgggtcgccgcctccgacccggagccctggctcaactgccacgccgatctaagcaccgtcttcctcgccggcgacagcgctggagccaacatcgcccacaacaccgccatgcgaggcaccacacaaggcttcggaaatttaaccctcaaaggcatggtcttgcttcacccatacttcgggaacgataaaaaagacgagcttctggagtatctataccctacctacggagggttcgaagactttaagatacattctcagcaggatccgaaactgtcggaactgggatgtccgaggatgctgatcttcgtgtcggagaaggattttctgcgtgacagagggtgcagttattacgaggcgctgaggaagagtgggtggatggggaaggtggagatggtggagttcgagggcgaggaccacgtgtttcatttgctcgaccccactaaggataaatctgtggacctcgttaagcagttcgtcgctttcatcaagcaaatccccgcgcactgttga

SEQ ID NO: 49192 - DNA, 537 bp, Glycine max
  Peptide Sequence Number=SeqID_165970
atgaactcccttctccaaccattcttgcgcaaattcactgcgatgttcttcgacgacattcttatgtatagcgataccttgccgtcccacctcgaacacttggaaatggtgattcagaccccagagcaacaatactacctctcgatattgcttggctacgagtacaagattcagtatcggtctggatcttctaatgtcgtcatagatgcgttatctcaaattgagatgccccgagatatccaaatgttcctcctatccataccgaatttcgtattcatggaccaactccatcaggctctttccgacaaccctgtcttccaagagaagttacagtcaacaatggctaacctttcttcctactcggacttcaagatgcacaatgggttgattatgtataaaggtagcatatggttggattctgctaatccttttatccaagctctattaatggaattccataatgccccattggaggtcacctgggcgttaccaaaactctccaccgacttcagtccaatttcatttgggatcatatga

SEQ ID NO: 49193 - DNA, 615 bp, Glycine max
  Peptide Sequence Number=SeqID_165971
atgtcgtcgaagaacatcgcagtgaatttgcgcaagaatggttggagaagggagttcattgttccctggaagggtggtggtaattgggtagggtggttgaagatggaagcaaatttgttgaggatagattggatggtggggaaacctattgagttgaaatgtaaatgggcccacatgcaacgtccacttgaagttccactggaagtcccagatgggaagcacgtggagggccaccgtgaatgtgtgaccttgaagatacaggatggtggcggggaaaaactagcggtagtcgaacacaaagccgttgccaaccataacgcgcaaaggagatgtctcttgagtggggaggctggagagggcattaaggctgatgtgggaaaggtaggggttggtttgagttcaaatttggggcttaagggttctggtggagaggaaataggcgagggatctgggtcaagctatttcatcaggggtacagtgaacaaacgagggtttggaagtagagggagaagggaaagtggtggtgtgtggtgtggttggccgggaaggatggaggacgttggccgcatcgtcggtccaataacttatcttcctggagtttcgcaagcgcagtga

SEQ ID NO: 49194 - DNA, 576 bp, Glycine max
  Peptide Sequence Number=SeqID_165972
atgaaccaagtgattgaacaacacctttgttcttttgttcatccacgacccacttattggcacaagttcttggcctttgcggagtggtcctgtaacactttgttccattccaacacaagaaagacacaatatgaagccacctatggcaaaccccctccctctatacctcactatatcgtggggtcatccacgaatgaggttgttgattccctgctcgccacaagagaggtcattcatgaattgcttaagtgtcgcctcctcacagcccatgagaaaatgaagaaacactcagatatcaagcgcaaggacgaagaatttggtattggacattgggtctatgttaaactccgcccttatcgccaaatatcgcttattgtctccggttgcaactcaaagatccaccctgtgtttcactgttcgatgctcttcccacaccatgacccacttgttcgtgattcaaaccctttgcctccttatgctatcgataaccacccggtgttggaatcattgtctatcttatcttccaaaatgggtgagacctcaaatcccccgacccgcttggtattagttcaatga

SEQ ID NO: 49195 - DNA, 454 bp, Glycine max
  Peptide Sequence Number=SeqID_165973
atggtcatctgcctctttttgaagacttcaatgtctttcgaccgagactattacagtctcatttgccttccagagacaatcaagtccgttggcacgcagagacaaacatggtcatctgcctcttttcgaagacttcaatgtcttttgaccgtgactattatagtctcatttgccttccagagacaatcaagtccgttggcacacaaagacaaacatgagacaaacaaggtcatctgccccttgttgaagacttcaatgtctttcgatgaagactatttcagtctcctttgccttctagagacaattgagttcgttggcatacagagacaaacaaggtcatctgccctttgtcgaagacttcaatgtcttttgatgaagactattacaattttctttgccttccagagacattcaagttttgctgattgggctttcgctagtggtcgatcggatg

SEQ ID NO: 49196 - DNA, 378 bp, Glycine max
  Peptide Sequence Number=SeqID_165974
atgggggaaaagatgaatcgagtcacatcactgcttcgtctactgccaaacatatttaggattgttgatgtccttgttacttccagtttcaccttgacaaagatgtcatggaccataaaaggacacgctttacggtgcccttaccgaactcgtactagagctagagtaatgggtgaagcagaggaggtgcaagagaagatgaaggccgacatggaggccatgaaagagcaaatggccacaatgatggagaccatgatgagcatgaagaagataatggaagccaatgcggttatagttgccgctactagcgctgtcgctaaggtgaacccgatgctcccatctggcctcaagcaaatgaatcatccaacctcaaatatg

SEQ ID NO: 49197 - DNA, 294 bp, Glycine max
  Peptide Sequence Number=SeqID_165975
atggaggccatgaaagagaaaatgacaataatgatggaagccatgatgaatataagaaaaatgatggaggtcaacatgactatagtcattgccgcaagtaccgccactgaggtagacccgactcatccacctggcctcaatcaagaccctcaacccacgggggagacacatgaagtaccccaagaccacactctagccaatttcgagtttcaccttggatatgccactgaggggcaggcattttgtggcatacctcttccaaacactttagggggccctcagtattgcccataa

SEQ ID NO: 49198 - DNA, 237 bp, Glycine max
  Peptide Sequence Number=SeqID_165976
atggaaagggaaatgataataatgatagtagacacattacctgtgttctactatgagaagatggtgggttacatgccttcaagctttgcagatttagtgtttgttggcgagaggatcaaagtgggtctgagaaaagtcaaatttgattatgttgctttgatgaataggaagcctaaggcaaatggaaagaataagaaggagggagaaacccatgttgtgactgtcgttcttacatga

SEQ ID NO: 49199 - DNA, 575 bp, Glycine max
  Peptide Sequence Number=SeqID_165977
gactgcacgttgtcccctttagaggactacatgtcctcgccatcagagggttgcacgccctcaccttcagaggactgcacatcctcgccgtcgtagggctacacaccctcacctttagagggctacacgccctcaccttcagcggactacacgtcctccccatcagagaactacacgccctcgccaatagagggctgcatgccctcaccttcagaggactacacgcccttgccttcagagggctgcatggcctcgcctacaaaggactacacgtcctcttcatcagagggttgcacaccctaacctttagaagactacgcgtcctcgccttcaaagggctacgcgccctcgccttcgtagggctacttgccctcaccttcagaggactacatgtccttgcctatagagggctacacgccctcgccatcagaggactccacgtcgtcatcgtcagagggctacgcgccctcgccttcatagggctacacgccctcgcctttgtagggctacacgccctcaccatcagaggactacacatcctcgcctttagtgcactacacgtcccttgcctttag

SEQ ID NO: 49200 - DNA, 396 bp, Glycine max
  Peptide Sequence Number=SeqID_165978
atggcaacgctccaagaccctgctccggtggctgctatgtttccccctcgggacacatccctctggtaccactttgggatatcactcgtggtgtgtggcgcatgcttgccactcgtgcttaactactgcattgtgctactcaagtgcaacttggttctccccatggcggtgctcttgttgcattttctaataggagggtgtaatggaattggtgttgagggcgaggaggacaacttagatccccacaagggacggttgctccggggagtggtagaggcggataatgagggggacgaaagaaataactaccaggtggaggtaggggttagaggagaggaaggtttcgtagagccagtggtggaagtggttagggttttcaagcatagtcgtaattga

SEQ ID NO: 49201 - DNA, 102 bp, Glycine max
  Peptide Sequence Number=SeqID_165979
atggtggtggagatgacggacatcgagaggtcgtggagcatgggaatgggtcccaatggaacaggcatatcatcactgagaatatatctggttagaggctaa

SEQ ID NO: 49202 - DNA, 372 bp, Glycine max
  Peptide Sequence Number=SeqID_165980
atggaccaattaaagcgcctaagcatcccctcagaaatgcttagattctctaaccacgctaattacccacgtctgggccatccgacaagaaaaatcagcatgcaacaaggacagacagatatcctcatagctaggttccctgatcctagctatggtgttaaaacgccaagttggaagattccgcttcggtcgaagggttcctctcagtgtggggttgcaacggagaacaacggcggtttgtggtggctaatggtggctgtgggtgatggagaaagtgcttgggacgttagaaatggctttggaagaaagaaaaaagaagaaatggtgtttttcctaagctacacgaaagcaaaggctgaaatgcttaaatga

SEQ ID NO: 49203 - DNA, 276 bp, Glycine max
  Peptide Sequence Number=SeqID_165981
atgggtgaagagagatgtcgaatagtgagtgaagaagtggcaatgttgacagtcgtcgtgttcatccaagaaattgactactccacttggctttctaacgtgatcatgagtcatgccatttgggttaaagaacatcagaaccacatatcaatgcttgatggcaaaatcttcccagggcaacttggccaaatcttggaagtctatgtggatgacatgatggtcaagttcgacaatgtgacaactcatttggtagatctagaagaagtcttcggctag

SEQ ID NO: 49204 - DNA, 389 bp, Glycine max
  Peptide Sequence Number=SeqID_165982
atggacattctcaggccctttcccacggccccagggcaaaggaaattcctgctagtggtcattgattatttcaccttgtgggttgaggtcgaaccactagcaagcatcactactcaattcatagaccaaaaattcaatgaattcttgggtgatcatgacatcaagcgcagggtgatgtctgtaaagaaccctcaaaccaatgggcaagccgaggccacaaacaaggtgattttgagtgaattgaagaagcaactaggtggagataaggaaagacactacttcgctaaagatgagaataacgaagtgttgcaaatagatttgaacctgataaaccaagtacgtgaagatgtggtaatcatgatcaaagcttgtaagcgacgtaagaccag

SEQ ID NO: 49205 - DNA, 334 bp, Glycine max
  Peptide Sequence Number=SeqID_165983
agggtacatctacttgggttgttatactgagaacaagagtgggtacatctcttgtggatcagttcaagtggagggtacatcccttgtggatctttggcttgtaaaggattttacaaggttgaaagaaatctcaagaatcgttggttgcttggggactggatgtaggcacgggcacgagagcgaagttggggtcattctggaaggacccactggcatggtcgagtacaaagcactcctggaaggtcgtaggctcactaaagaggtcgacgctcaaagggtctattgccgaagcgactccaagatctctgctgggcagatcaacaatgtgttttaa

SEQ ID NO: 49206 - DNA, 228 bp, Glycine max
  Peptide Sequence Number=SeqID_165984
atgtatcaagttgtcatgcctcttgtacgagatgcacttctttacaaagttcgagcagtttgtcctaaggttttgccaatagtagccagccctgagaactctagtagtcatggttctttctctggaatgcaaaccacaaatacccttatgcatttctcaaaggacatactcagcctagtcttggtcaaggcacttgagcaaaggtggggagaaacccctcctatataa

SEQ ID NO: 49207 - DNA, 276 bp, Glycine max
  Peptide Sequence Number=SeqID_165985
atgacaaagagagcagcatcttcaagatccccaaccagagcttccaactgtacagcagtttctgagacaataaggagaagatgcaatgaaaatatcagtgttatcaatggcagatggtggaaggccaaaattctgccatataaacatgccatggtgggcctcccttcacaaatcgcctatggaagctggcaaaaatttgccacgccattccactatggcaactatggtgccacccgttgttgtcaaatagcagatattgcggcgctatcacactaa

SEQ ID NO: 49208 - DNA, 2655 bp, Glycine max
  Peptide Sequence Number=SeqID_165986
atggcgtggcaaatttttgccagcttccataggcgatttgtgaagggaggcccaccatggcattctgcttatgcctctgattttgtcgtgtatcttgacctagcttgctgtaaagtttaccttattgtctcagaaactgctgtacagttggaagctctggttggggatcttgaagatgctgctctctttgtcattgctcgccacacagggaatatgttttcattgaagctctcgatttcatcaaactctgaagatgctgcatcaaaacatgacaatttgcttcaggccataaaagccatgagtgatattgaagaagtattggttggtgttgtgaagttccatcctcagtggcattgtctcctgaagtctgttgacactagagtagataaaattttatctgttctcaggccacaagcttttgcagatcatcgggcttttctcgtttctcttgggtggccaccaaaactgcttccatcaaaaaatggaagcgatcatatcacaaacctacctaatccattagttcttatgcaagaagataagagaagaaattactctcaaagttttatagctctttgtgctttgcagcatctgcaaaatagaagggaagaaagacagcttaatagtagtcttataaaaagagacacgcagaatatacagctttgggccattgatgaattagtgtctcctattgcgtcaaggatggaataccatttcaccaaatggtctgagcagccagaatatatgtttgctttggcatataaagttatcagagattttattacaggaatagatgatgtcttgcagccacttattgacaaggccaggcttatcggttgtagtgcaaaggaggcatgggtctctgcaatggtccaaatgctttctgtctttctggaaaagaaagtttttttgttgctcactgaaagatacaaagtaaagcatttgaagcctgatgtatcatcttcatggcttcaccttgtggaccttatcattgcatttgacaaaaagatgcaatcccttctcaatctggatacttgttttttggcagtgtctggaagttttgaagggctctcaagaggcatgtcagttctatcaatgttttgtaataggcctgattggctgaagatctgggcaaaaatagagttcaaaaatgcctggaagaaacttaaatccgaactgatagaggagaaagcatggatgacttctaagaaatgcatatctgggattgacactgagcaagagtatctgctattgactgtcgaagatcacaaagctccacctattgcagagttttttcttaaaattatctgggagatgattgagcgctgccaaactatgccatccagtttattacgtgcacaatttattagatttactgcaggaagattcctctggtatttctttaagcaattactttttcggttcaaggcaactgaattatgtccggatagttctgatgatgttgccatagttagagtgtgtgggttaataaatgctgccagatatatttggattaaattgcaagaatggagtgatgccgtggattttttggagatgaaaattgctgaaaatgattctagcaagcccatacaagatgattcaatggataatgactgcttttttgaggaagaaataagaagcttgtctgaaatggaaaccaactggcttatggaaattattgcagttgttcttcgacagtttgaagtgctttcttggaaatatgttcaaaacaatgatagttttggggatgaacaagtttatacaaatccagtagaggatgctgatttaatagtctccaatgattttgttgaagctttagattctttaaaacgttggcttcacactatgaagataagtctcaataaaaaggattttttggatttgtggaggagcattgctgaggggctagatcattacatttcatggagcattgtcagaagtgagaattggttctttaagatgggcgtcactcaatttgaagctgacatgcaagcactaatatttatttttcagccttattgtgctcgcccacaagcattttttccttgtattaatgagattcttaagcttttgaaactgaaaaaagaagaggaaaagctaatgcaagcatttttgtccaggaatgaaaatggatcagagtgtttgcatctttatggaatttctcatctatcagttaatcaaattcttcaagttcttagatacaaaatttgggctgggatttttgagttcaagaactccattaaagatgctttaaggttattgtggctttgggagttggagtcatccttgattaattcctttttggctaggaaagtgcagtttggtgcatttcctttggcttttctggtgttctctttgaaggaacgtcctgagttgaagttgtcctcctacagaagaaagatagaaaaaattggaaggtctattccagagattgaagacatagtgactgccacaggattaagtcctctgattaaatgttccttggacattgatgtgactatcactctcaatgatgtggcatcgttgctacatctgcccattataggcaccttccattgctttgaggctcttcatgtagaccaagcagtggacttgttagttgacttgcttgaagtcagttcacaagaagcaagagaagagacatttcaatgccatggg

SEQ ID NO: 49209 - DNA, 328 bp, Glycine max
  Peptide Sequence Number=SeqID_165987
gattcacaatcgattctcctcatgtttcaaccagcccgcatcaattagactttgcaccttacgcttcgaagtcatacagtgctcaatggaatttcccgaaactcctccatgatatgcacatgttgcgttcgagtcgtatcctcagaaaaatggaggttgaggaaaccaagcaggggttatggctaccattgcattatcaagtaggtatgggagcaagctttgtgattgatttagggatgacctttgtggatgactgggtggtgggtaatgagaagagcttatattggttaagtaataacattgttgggctggtgggaagtttggccat

SEQ ID NO: 49210 - DNA, 672 bp, Glycine max
  Peptide Sequence Number=SeqID_165988
ggtgtggaaggcgcgtccgtcgtacaggatgtgctcgtagatatcgtcgaccaggatgaagaaatcccggtggggactttggcggatgacctgcgcgaattcggccagttgggcgcggtcgtaggcggtgccgctgggattgctgggcgaattcaggaccagccatttggtccgggggccgatcgccgccgccagatcggccgccgccagcgcataaccgcgctgcggcgacgtcatgatcgggcgcaacacgccgccattcatgacgacgatatcgctgtaggaggcccagtaaggcgccggcatgatgacctcatcgcccgggctcagggtcgccaggaacgcctggtagatgacctgcttgccgccacagcccacgctgatctcggcgatggagcagtcgatgccgttgtcgcgcctgaacttggcgacgatggcctcgcgcagccgcgtgctgccgttgatgggggtgtagcgggtttcaccatcgcggatggcgcggatcgccgcctcgccgatgtgctgcggcgtggggaaatccggctcgccgagcgtcatgtcgatgacgctgtggccttgctggatggcctggcgggttcgttccgccatgacctggatgggggaaaggcgcagagcggagatgatgggagcgaacatgggcggaatccctga

SEQ ID NO: 49211 - DNA, 1443 bp, Glycine max
  Peptide Sequence Number=SeqID_165989
atggcaaagccagggaatgttgcagcttgtgccaattgtcccatagaagttacagaagaactatggggatattttaaggataagaagaagcaagagtgtgaaacatttaaagggatgtgtcaacattttcttgaagactatggtgatagcgatgaagaaagagctcttgatgaaggcccactgcatagatttgatgttggaagacattggcattcaagtactttgagattgttgaggttcttcaccaacaaaagagaattggtgaggcacgcaattactaggtttgctacatccttcctcacattagaaaggctccataaggagaaaggcaatcttagaaagatttttgtatcagatgattggacaaaaaataaattgtccaaggaagccaaagggaaggaagcaacaaaaactgtacttatgccagctttttggaataatgtgctctatatacttaaggtgatggctccacttgtcaaggtgctgcaccttgttgacagtgagaaaaaaccagccatgggttatatttatgaggcaatggagaaggctaaagaagctataatgaagtcatttgaaaataatgaaagcaagtataagcaagtgtttgaaattactgacagtaggtggacttgccaacttcatcgccccttgcatgcagctgatcactttctaaacccagatttgttcttcagcaatccttctatggaatttgattttgaggtggtaaatagattgtatgtatgcattgaaaaattggtgcctgatcaagcagtgagacagaagattcttacagagctacccatttataaaatgggtggtagtatgttggggcaaaatttgcaattcaacaaaggagcattgtctcaccagcataacatttctttggattcgacttttgtagcaccatggtggcaatcatgtggattgccaactccaaatttgcaacagttggaaataaagattttgagtttgacatgtagtgcgtcaggatgtgaacgcaattggagtatctttgaacaaattcattctaagaaaaggaataagcttcaacacaaaagactaaacaacttggtgtatgccaaatataatcaagcattggttaaaagatacaattatagaaacgaaattgatccaatttcactcaatgacattgatgaatgcaacgagtggcttatggggcaaatggatggtggttatgatgatgatgatgatgctgggaatgagagggcttcgggaattggacagccaatgacatatactacgcaaaggactaaaaagagaaaggaaccccttggtgttgaagatgctatacctaacacaaaaagaggccaagagttacaaggcattgattttggggactcaaaagaagttgaacggcatgccccattacaagacaatgaggattatgattatattggggaaggggcagagcagaatgaatag

SEQ ID NO: 49212 - DNA, 432 bp, Glycine max
  Peptide Sequence Number=SeqID_165990
atggagccacctcctccttctcctcctcttccccgtttgccaaacaccgccgatctcacgccccaacacttagcgtttctggatcaacacttccgaaccaaacgcgacctatctcgcgaatcttttaatctccctctctcctcctcgctctctcaactgtgctccgaactcgagtcccggctcctccaacacctcacgaaacgcaccgtttcgtggatctctcgctccttcagcgccaaatcctcgctccagcgtctctccctcgcacttcaaaatctctccctccgcacttctccacgtataaaaaaggggattggttcgaagaggtttcagtgggtgttgagtgaggggattcctcgattggcgagcgaaatgaaccgaattgagtctcttcggtgttatcttggtgagtttgttttggaatctctgtaa

SEQ ID NO: 49213 - DNA, 231 bp, Glycine max
  Peptide Sequence Number=SeqID_165991
atgctctcctccaaaggttcaaggttcaatcaaacaattcagattttcagctcaatcatgggtgcaaaggatatgtcattcattcacaaggtgtcgcaacatgcccttttgggggcgagcgagggcgaggctcacgggtgcgctttccaaaggaggaaagatgcgcagagtcgccaccaacgtttatttgtggaaaacgtcggaaaaaccgaaggaaactggtcaaaatga

SEQ ID NO: 49214 - DNA, 597 bp, Glycine max
  Peptide Sequence Number=SeqID_165992
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggcgaattggagctccaccgcggtggcggccgctctagaactagtggatcccccgggctgcaggaattcgatgtggccatcgacccgcagcgtggcctcgaccacggcgcgtgggtgccgctgcgcttgctgcgcccgcaggccgatgtcccggtggtgccgctgtcgatccagccgctgcttggccccgagcatcagttcgcgctgggccgtgcattggcgccgctgcgcgagcagggcgtgctgttggtcggctcgggcagcaatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 49215 - DNA, 312 bp, Glycine max
  Peptide Sequence Number=SeqID_165993
atgaaaggtcgggtgatcggcggtcgaatcaccttactaggtgtgacgggaaccccgaacgactggcagagacccgtgatcaatgctggaaaacccaaggccttgttagacttatctaggtctagagggtgcctggatggcatacaccagctgacacttcggcagagggcggtcgaaattatgatcgctgggcaggatgttgctgagcagcaacgtcatccatgtctgggtcaaggtagtcatgttggtgtgcatgatctgcacccgtctcccggcagcggtccgggcaaaatcctgacctggtatgcatag

SEQ ID NO: 49216 - DNA, 450 bp, Glycine max
  Peptide Sequence Number=SeqID_165994
atggaaacatgttcagtggtaagagatctattacaacaaatgatagaccatggtcgggttgaggtcaacaatgaggggaagggggaacaacatatatgcatgcagtcggcatataaggaaggtcctaaaaagcctcaacccttggtaatacacttcaccagggacacggttccccaaaggccccgacagcactcggcagtatcgggcgttagacctattccttttccttacaagaatagtcgcgcagttccgtggaggtacgccccttcgggcggcaagaaggaagaagctaccaacatcggctcactatcggccaaagtaaccaacatcacttggttgaatagcataacccgcagcggtcacgtgttcgcaccccccagcctgccaacgcagcccacaaacgctaaagggaaatcaaagatgaccgaaggacaaaccatcaaggtgtag

SEQ ID NO: 49217 - DNA, 582 bp, Glycine max
  Peptide Sequence Number=SeqID_165995
atgatcggccctctcaatgagtcaatctcttgcattcacatatgggtggacccttgggtacacgccctcaccttcagaggactacacgtcctcgccttaagagggctgcacgccctcaccttcagagggctacacgccctcgccttcagaggactggacatcctcaccttgagaggactacacgtcctcgccttcaaagggctacatgcccttaccttcagaggaatacacgtcctcccttttagagggctacacgccctcgccttcagagggctacacgccctcaccttcaaaggactacacgtcctcgccttaagagtgctgcacgccctcgccttcagaggactggacgtcctcaccttcagagggctgcacgccctcaccttcaaagggcgacacgtcctgaacttcagagggctgcacgctctcgcctttagagggctgcacactctcgccttcaaagggagacacgtcctaaactttagagggctgcacgccctcgcctttaaagggctacgtgtcctcgcctttagtgagctccacattcgcaccttaagagaatttaaggtcctttgcccttaa

SEQ ID NO: 49218 - DNA, 261 bp, Glycine max
  Peptide Sequence Number=SeqID_165996
atggagaattcttccctaacagtcaaccacttaatccaaccctatttcaatttactaagcgaaaatcaacttagggttttcaataggcaccacatacaccagttagcccttcgtccattaagcatgaacgcaaggagaactgccaggaaaccacattacaagcgaaacctcaaagagagttgggcttcgtcctcaaaaggaaacaacaccagaaaatctagccttccatggattcaaacagaaaacgcaattgaaacatga

SEQ ID NO: 49219 - DNA, 213 bp, Glycine max
  Peptide Sequence Number=SeqID_165997
atggtcttacgactttgcggagacctgtgtttttggtacccatttgttgaaggtcgttcgagcttttcctgggagtatggcatggattacttcagcgctgtagcgcctggtactcgaactttggctcgaggcattttctctaccccttattaccctgaaaaagcaggggcaccttgcgtccttgaaccgataaccatctttcggctaacctag

SEQ ID NO: 49220 - DNA, 321 bp, Glycine max
  Peptide Sequence Number=SeqID_165998
atgaaattaggatttttccaattcccaattcttcttcttcttcttctttttctttgccttgttcttacttcgaaatgtcacagtttgaaggttttttcatatggtggcattaggaactcgcctggtggccatggtgcaagcggtggcagtgcgaacaatgatagtgttagtgatggagctccactgccgcctatttgtgattgcgagcaattggtggtggtgcaaacaacattaacgatgaatcatttcgggaggagattttggggttgtcctaactacaagaaacaacatgggagtgagagtggctacaacttcttttaa

SEQ ID NO: 49221 - DNA, 276 bp, Glycine max
  Peptide Sequence Number=SeqID_165999
atggaactagaaggacttgctagagggaagaaggatagtccatggagggcaagaagaaaggaaacgtgcagtttcaaggagatgacgattcttcctctctgctatgccattttgttgtggtatatgaggacatatttgggtgacccagacgatcatgcaaaagcttgggttttgaagttgcaaaacagaacacaggaaagctggattctaagtagtaaagtcctcatgattcacgtccttctccaatcaaacgacccgtaccgtgttcctgaataa

SEQ ID NO: 49222 - DNA, 600 bp, Glycine max
  Peptide Sequence Number=SeqID_166000
atgcctggatcaatgtgttctggcatcaaaatagtaaattcaagcattcatggcaaatttacttcaaaaataatactgtgtataattttccaaattggttcctccaatggtggaactacttcggaccaattccacatatattcccagaagaagtccaacagggattccaacaattcaacaagctctataatagcaaggaatcactacagatacggaaaaactgaaaacagcaagcaatatccaccattacagagacacgcctttgtaaaatggtggtcacaattcgatacttcaaagactgctccagatcaagtcaagaactggttccagagcaatcctgagttccttaaacctgctgatccaaagacatctctattcctgaatcaaaagtcgcaactggcagcattcttagcaagctcaaaatctaaagagagtcttgctcagaatctcaaagaagttctccaactacttcaacaggaagtggaagaagaaccttccaagaaggaagctgaatcatcagagactaatgatgaccaagaagacgatccattctaccagaatgaagatgactgtttcggtatatcattagacgaagattaa

SEQ ID NO: 49223 - DNA, 192 bp, Glycine max
  Peptide Sequence Number=SeqID_166001
atgttgatgacggttgtggtggtgataacaatgacgatgatattgatgataatggtgatggttgcaatgctggtggtagtgatgatgtcggtgacaatggtgatgacaatgatgatggtggtggtgatagcgatgctagtggcaacgagaggtaacaacgatggtggtggtagtgttggtgatgcggcttag

SEQ ID NO: 49224 - DNA, 1433 bp, Glycine max
  Peptide Sequence Number=SeqID_166002
atgtcaacagaaaaaggaggcaaagatgaatcatcaacgtggattcttgagggcattgatattgatcccattgtggagaggcctaaaagggatgatgaagcaccccctaatggaatcatggtgcttaaatctcccaatgatgctgatgtgaacaacaacaacaatagcaatgtgaggagcagggttggcattcaggggaataatggggggaggaaaatgatgagggctgaatcaggagcagctagagggattaagagtttacggtttcttgatagaacggtcacagggaaggaagctgatgcatggaagtccattgagaagcgctttactcaaaatgcagttgatggaaagctcacaaaagacaaatttggaacctgcatgggcatgggggcagaatcaaaggattttgctggggagctgtatgaggccttggcaaggaggaggaatgtctgtgcagaaaatgggataactttggatgaagttaaagtattctgggaggacatgactaacagagatcttgaatcaaggcttcaagtgttctttgacatgtgtgacaagaatggggatggtaggctatcagaagaggaggttaaggaggttatagtgttgagtgcctcagcaaataagctaggaaatctcaaagtgcatgctgatgcgtatgcatctttgataatggaagagcttgaccctgatcataatggatatatagagatgtggcagctagaaactcttctgaaggaaatggctagtgcggaagatggcaccaaaaaacttgataattgtagagccatgactttgagtagagctatgataccgagcaagtatagaactcctgtgagcaaatttctatctacaactgcagaatttgctttggataaatggaaaaaaatatgggttgtcgcgctttggttggccataaacttggtgctttttatttggaagtttaagcaatacagggaaagggaagcctttaaggtcatgggttactgtctatgctttgcaaagggtgctgctgagactctcaagttcaacatggctcttattgtcctaaccatgtgcagaagaacacttacaaaactaagaggatcatttctaaatcgaatcataccttttgatgacaatataaacttccacaagacaattgcagtagctgtggttatagggacttttattcatgtaatgatgcatatcacttgtgattttccaagattaatatcatgcccagaaaataagttcatgtcgatacttgggcaagattttaactatgagcagcctactttctacacccttcttaaaagtattcttggtgtaactggaattctgatggtcttgcttatggcctttatcttcactctagcgacacattatttcagaaaaagtgttgtcaagttacctttgtcgttgcatcgattggctggtttcaatgccttttg

SEQ ID NO: 49225 - DNA, 558 bp, Glycine max
  Peptide Sequence Number=SeqID_166003
attggcgcatttgcagttgttattcgacaaacaaatattatatgggtgctttttgttgcatgcactgggatcataaatatttctgtggctcatgcaaagcacagtacaaaaactgatgagccggatgtatctatcaagcatgggttggcatatgctactggtacaaatacggagggtttcaatctgagaaagcgaaaaattgttaaatctattggaaactcgtcgtctagtttacttgcttcttctccttccttttcttcaggttttgctgatgaaatatggtccatccttttaacattatggggccccaaagaccttctttctcacacatatcctactgacactgcaggtgcaaaagaagcacacgcagttaccccacattttgcgcagatgctttattttagtttggtttctgtattggctcaggctcctatgcacttcactatcactaaagctgtggacctgtttcagatgtttcgcaagagtagggcccttcttttctttcagatgtttctggcccttgttgttggcctgctctcagtacactttttcaggtga

SEQ ID NO: 49226 - DNA, 321 bp, Glycine max
  Peptide Sequence Number=SeqID_166004
atgggagcatcgactgcggtgtgggcgcaggatcaagagcaacgcaccgccaaggtggggcagtgtgccggtctgcagccggcggatatcgccgcccaggtcaagcgtgatttcttgcagaatcgcattacgcgctgggaggcggacaaaaaactgctgggcacagctaccccgatcgcctgggtcagcccggatgccatcaccggcaaggagcaggtatggcaggtgccgctgacggtgcgtggcaccaaagtggataaaacctacaacgtgacgctcaactgcaacaccggcgagatcgcctacagcgcgccgcagtaa

SEQ ID NO: 49227 - DNA, 317 bp, Glycine max
  Peptide Sequence Number=SeqID_166005
atggccaacaaggcgatagccaaacccgtttttttcatatgtcctcccgttgtgattagcgctatccgggcgcccatccctggctcacaacagggtttcggcaaagggttaccgtttgacgaactcgatgacaaacagcgcatccagacccggatagatttccttgatcacctgcttcagttcgccgagcgacatgttctcctgctgtgcatggcgttcggtcagcgcatccaggcgcaccggcgttaccgacagcacttcgataaagcagaaaaatacgccgtcttcattgcggcttacgcgcaatacctcgcccg

SEQ ID NO: 49228 - DNA, 207 bp, Glycine max
  Peptide Sequence Number=SeqID_166006
atgactcctccgcagcttccacatagaggaagggcaacttaccaagacctcttcctcacccgatactatgaccaaatgccccttcactacgaacttcagcttttggtggagtgtatgaggccctatctgtacggggaggtcgatctctcccctcacctctcggcggatgccgttgaaggcacagaccaccatggaaattggccttag

SEQ ID NO: 49229 - DNA, 492 bp, Glycine max
  Peptide Sequence Number=SeqID_166007
atgataaaacattgcacactgatcgaatggcctaactctctagcagtccccagtggagccaccaaatgttgcaacctacccttcggcgggagggcgacgcgagactcgaaggcgaatcttccaacaaaggaaaatgcacgaagttgccaccaacgtttatttgaggaaaacgctagaaaaaccaaaaaagacgaaggtctgcggattttgaaaataagggttcgggagttgtttaagcacggggaaattgtctctagaatatttccgttggatttaatgatgaaatctatgcaatttcagtgggctaagcgcgcatccatcgctaagcgcaacttcagtgcgcttagagcgatagaagaatctggaagggcatcaatatcaaggtcgtgcgctaagcacaagatcagtgtgctaagcacagcagttgtcttcagccagcctcagcgcacgattggcgctaagctcaacgtcacgaattcagagcctatttaa

SEQ ID NO: 49230 - DNA, 309 bp, Glycine max
  Peptide Sequence Number=SeqID_166008
atgcagaaaaagctatcaaattgtgcaacaaaactgccaattatgcaggaaaaaaaatggttgtgcagtgctagtttctgctgtcacgggaaaggcagtttcatgacaaatggaattgaattgtttggatgttgtgaaagtttggcggggttgatggggacccgggctgagaggaacgaggagaaggctacgtacatgcacagtggtacctggagatatgtcgcgggggtcaggagaccttggggacgtcaggtgggatgctattgcccaaaaccaagcttggccaatcccgaaccaacccgggcatag

SEQ ID NO: 49231 - DNA, 300 bp, Glycine max
  Peptide Sequence Number=SeqID_166009
atagcttaccccgctttcacgggaagggtcgcttcgctcgtgggagtggaggggaaggagaggacaggttcagccgtcagagggatgcggaagcaaattaccccgatcaaggaagcgaaaacaagaactcttaatcagaaccagcgttttctgctttctttcaaaggggtagtgaaaaaggcgaaggatgaggcctcacgttcagacactgcctttggttcattacccgttgagaaggcagtagaagaggtagcattcgcagaccaaagcaaagacggctggggattcttcatagcatag

SEQ ID NO: 49232 - DNA, 1137 bp, Glycine max
  Peptide Sequence Number=SeqID_166010
gatcctttacatgtaagacctatagctcatgcaatttgggatcctcattttggtcaaccggctgtagaagcttttactcgaggaggtgctctaggcccagttaatatagcctattctgggcatttagtccatgtcgctattccgggatccaggggggaatacgttcgatggaataatttattaagtatattgcctcaccccgaaggattaggtccatttttcacaggtcagtggaatctttatgctcaaaaccccgattccaatagtcatatatttggtacccctcaaggagcaggaactgctattctaacacttctcgggggatttcatccgcaaactcaaattgctggccatatgtatagaaccaacttcgggattggtcacagtataaaagatcttttagaagcacatactcctccggggggtagattggggcgtggacataagggtctttatgacacaatcaataattcaattcattttcaattaggtcttgctctagcctctttaggggttattacttccttggtagctcaacacatgtactctttacccgcttatgcatttatagcgcaagactttactactcaagctgcattatatactcatcatcaatatatagcgggcttcattatgacaggggcttttgctcatggagctatattttttattagagattataatccagaacagaatgaagataatgtcttagcaagaatgttagaccataaagaagctatcatatcccacttaagttgggctagcctctttctggggttccatactctgggactttatgtccataatgatgtcatgcttgcttttggtactccggagaaacaaatcttgattgaacctatatttgcccaatggatacaatctgctcatggtaaaacttcctatgggttcgatatacttttatcttcaacgaacagtccggcgttcaatgcaggacgaagcatatggttgcctggttggttaaacgctgttaatgagaatagtaattctctattcttaacaatagggcctggagacttcttggttcatcatgctattgctcttggtttacatacaactacattgatcttagtaaagggtgctttggatgcgcgtggttctaagattaatgccagataa

SEQ ID NO: 49233 - DNA, 1066 bp, Glycine max
  Peptide Sequence Number=SeqID_166011
atggataggttgacgaccatgatgaatgcactcctgtcagcccagaactctcaagctgccgccgctactgtagagcagcccttggtgagcacaaccccgttatctacagtgacttctccacccctctttttgcctccaggttgtacatggggaatgccacctccagtctgcggaagcccccagcccgctgtatctgaagttccacctccttttgctcagcagtcagcaccgattccgcaacccaatacctctttccctcaagctgcgatgacttattctgctccactgattcacactattcaacaggaggttgaaccaattttccaagctgaaaatgttgtagccttcgacaagatggaagaactccaagaaagatttgatggtatgcaaagggaagtcgaagccctccgaggaagagatctgttcgggaaggacgcctgtgaattatgcttggtcccaaatgttactatccctcacaagttcaaggtgccagacttcgagaagtataaaggaaactcttgtccccgcagtcacttggtgatgtacgcgcggaaaatgtccatgtatactgacaatcataagctgcttattcatttctttcaggacagcctaactggggccgctctgaagtggtatatgaatttggacagtgcgagcattcgtactttcaatgacctgggtgaagcgttcatccggcagtataagtacaatttggacatggccccagatcgtgatcagctccgtgcgatgacacaaaaagagaaggaaacgttcaaggagtatgcccagcgttggagggaagtggctgcccagattgtcccgccgttggaagaaagggaaatgaccaaaatatttctgaagaccctgagccagttttattacgagaaaatggttgcaagtgcaccaacagacttcactgaaatggtcaacatgggtgtgcgattagaggaaggtgtccgagagggacgtttgactggggaaagtgcccctgccgcaagtaatgccaagaagtttggaggccactttgcgaagaagaaagatcaagaggtgggaatggtagctcatg

SEQ ID NO: 49234 - DNA, 210 bp, Glycine max
  Peptide Sequence Number=SeqID_166012
atggcgccttcagcaggagtttggcacgtggctatggaaacgccattcccagcagcgcttccacttttgcatgaaaacgccagcagtgttggcgagttggtcaaggctagccctaggcttgcagtgttgcagtgcagactgactgcagcaggaaagcgtcagttgctcttgcgagtttggaagcgttattggtaccagcgatttgcctga

SEQ ID NO: 49235 - DNA, 234 bp, Glycine max
  Peptide Sequence Number=SeqID_166013
atggagttttgccccagttgtggtaacatgctacagtatgaattgccttatatgggtcgcccttcaagatttttttgttctgcttgcccatatgtttgccacattgagaatagggttgagatcaaaagaaagcaaaggttggtgagaaaagagatagagcctatattctccgaggatgacatgacaaatgcaccatcaactgaagaaggggacagggatagagctaggttgtag

SEQ ID NO: 49236 - DNA, 1032 bp, Glycine max
  Peptide Sequence Number=SeqID_166014
atggacagtaacaacctcttctccaattacttttccgacgacctcgattcctcccctaccgtccccaccgtcgtgaccacgaccacgaccaccactgcgacctggtggctcgaagaagctgatcatcgaggagaggccgtgctttatatggtttcgtgcaattccgattttgaagccgagattttgcttcatctgaggaaggaagagaacccacacaacaacaatattgaggtttctacgcgtcagtatgcctttttcctcacttcaatgttggcaccgcagaggtttctctacactctctcacacgcccgttcatgcagcagcagcaggatacctgccagtgccagatttgcaagttccgttgccacacaacaatcctcttctggtttgggtggtttatttggatggctcactggagaccgatccagttctttaccatctctggatttcccgcttctgggcgttatacttcccccttcattgcctaattttgttgcgcccggaaaaactattattactacactcccaaatggactcaaagtggcctctgaaacatcaccggttaacgagcagcttctgaaagtgaaggctgagattggtgaagcttccaaaaatccccaagacttgcttttggaagcaattcattctgctggtttttctggtgccttggcaaatcctcttttagcttcagagtcagttctaaatagactaaatggtacaattctggaggagtttgttactgagaactatatggcacctcggatagtacttgtagcatctggtgttgaacatgaggaattgttatttgttgcagaacctctcttttctgatctacccagtgttccacgtctagaggagccaaaatcaatgtatactggtggtgattatagatgtcaaagtgaatcagggaggacccattttgctctagcagttgaacttcctggtggctggcataagttgaaggatgctatggttttgactattcttcaggttttgataatgtcttacattttcttgcttttctgcacttga

SEQ ID NO: 49237 - DNA, 165 bp, Glycine max
  Peptide Sequence Number=SeqID_166015
atgacgtatacaatcagaacaattgagggttactctgatataattgtgatgcggcaacatccaactcagttaggtaaccctgaaacatctaatgctgaggactggatgggtctggttgattatgcttggagtcattctgatgaacacttgaacactttaaggtga

SEQ ID NO: 49238 - DNA, 201 bp, Glycine max
  Peptide Sequence Number=SeqID_166016
atgaattctaggtcacaaagaagcaaagagtgcccaatctgttggcaatcacttgctttgaaagatcctgctagccaagagcttgtagctgcagtggaagatgagaaatgcatgagatcaagaaacattgctaattctcgtgcccccttggaattattcttttgtagccaagagcttgtagctgcaatgaaagccacttaa

SEQ ID NO: 49239 - DNA, 474 bp, Glycine max
  Peptide Sequence Number=SeqID_166017
atgagagatagtgaacaagccatgtacagtttaaaggacagcctgaacagggacagggagaagttgcttggcacgcctgagaaaaagcacttgtgtgagctttttgatgtgccgtcaactggtctgtgtagatcggaggatggcaatcctaaccacagggttggctactggaaaggtcaccagaggaaaatcgtcaaaattttgtcaaaagggaaagtggatcctccggacagatcacggttttcaagatgtctctatatgttgagagaaacctactcatctaggaagaagcctgcatcagcaagacacttgacagttgcttcctttggaagtacttgtcggaaactatcacagtgtataagagttgccaaccctccagcagagcatcctgaaagcaaagcctacaaaagtagccttatctatcatcacatgctaacaagttttacatcaatgctaacacatcataatacataa

SEQ ID NO: 49240 - DNA, 309 bp, Glycine max
  Peptide Sequence Number=SeqID_166018
atgaacaaccaattcttggaaatgttgcttcatcaatcggttcagcgttggtcaagcttacagactacaaagggtggaataagtagagctatgaggcacttaatgggggtgaagggggatgttggtgcttgccagaaagttccacttgaaatcaaggaagcttctgagaaaaataaggttgtaaatgatgtagcagttgggcaggagaaagatgatgatgaggtagaagcattggaagaaatttacaacataagggttggaaaaagacttgcagcaacaggttctactcctgctgccaagggaaatact

SEQ ID NO: 49241 - DNA, 414 bp, Glycine max
  Peptide Sequence Number=SeqID_166019
atgagatctttctatcatgatgttgcccagcttcagtgtctctttccatcagaaattgctaaaaacataaagactccactgttccttgttcatccagcttatgatttctggcagatacgcaatattttggtgcctcaaggatcagatcctgatggtcactggcaaaggtgcagactggacattcgcagttgtaatgctaatatgattgataaacttgacagttaccgtggctctttgctgaaggctgtgaatgaattccaacaacgaaaggagattggaatgtttatagattcatgcttcgtccattgccagactgagatggaagtgacgtggcattcacccaactctcctaaaataaatgataagcctcaagggtatagtcctacatcagctacagttaaaggctttaaatag

SEQ ID NO: 49242 - DNA, 411 bp, Glycine max
  Peptide Sequence Number=SeqID_166020
atgtttaatgagaccttgttggctaaatggaagtggggttcattccgcaatgaccaatccctatggggtcaagtgattgaatctaggtatggtgggtggagggggcttgaggagagaggaggagggagaaattcatcaatttggtggagggatttgaggagggtatgcggtgaggaaagtgaggacaaatggtttgataaaatgagtgtggaagttaggggatggaagatttatccattgtggaagaaattttttcagtggctgaattgtagctcggttttaccagtggagcataaatccaagtgcattcttcctcaattatccagaatcagtggtggttttgtaacctcagatcatgtttgttctctggccatatgtgatgctatcaacagggtatttgagtctgaatga

SEQ ID NO: 49243 - DNA, 129 bp, Glycine max
  Peptide Sequence Number=SeqID_166021
atgaacactgcgggatactttacaaatattctactgctacaaaaacttcccacgatagacatagacagatctgtgaaagaaacgctattgacaaatgatagagacagtttatgtatgaatatcaaataa

SEQ ID NO: 49244 - DNA, 174 bp, Glycine max
  Peptide Sequence Number=SeqID_166022
atgggggtgcaaatagcacccagacccacttgggccctctggaatattcctccagaaggcgccaaggcgcttccgaaacgtttccgtaacgttttccgtgaggaatctcgcaaaggtttgaaccgttcttcgacgttcttcattcgttcttcatcgttcttcgatcttcaacgg

SEQ ID NO: 49245 - DNA, 1059 bp, Glycine max
  Peptide Sequence Number=SeqID_166023
atgcagacttggatgtaccttgtagttccgctagtactctatgcttttgagagaattcacccattttttaggggtaaagatcaccgagtaagcatcattaaggcaataatatacacaggaaatgttctggcactatacatgaccaaacctcaaggattcaagtataaaagtggaatgtatatttttgtcaagtgcccagatatatctagttttgaatggcatcctttctccatcacctctgcacctggagatgactacttaagtgttcatatacgaaccttgggagattggactacagagcttaaaaacaaatttacacaggtttgtgagcctcacagtgctcaaccaagaaagggaaaccttatgaggatggaaactagagcaccaagttcaaactataaccattcttcaaactcaagcattcgatatccaaagatcctcattaaaggaccatacggagccccagcacaaagctataagaactatgatgtcctcatgctcataggtcttggaatcggtgccacaccaatgatcagcattctaaaagatatgttgaacaacatgaagtcagaaagccctaaagagggaacctatatgcaggactcagaccatagctatcacttagacgatcaaattaagaaaggtcctgaaagagcatatttttattgggtaacaagagagcagtcatcatttgaatggttcaaaggtgtcatggatgatattgcagattatgaccacgataatatcatagaaatgcacaactatttgactagtgtctacgaggaaggtgatgcacggtccgctcttattgccatgattcagaagctgcaacatgctaaaaatggagttgatgtagtttcagaaagccggatacgaacacattttgcaagaccaaactggaaaaaagtcttcactcaattagcaaacgcacatcaaagctctcggataggtgtattctactgtggaagccctactcttacaaaaacattgaaggaactttgtctcgagttcagcctaaactcatctacccgttttcagtttcacaaggagaacttctaa

SEQ ID NO: 49246 - DNA, 633 bp, Glycine max
  Peptide Sequence Number=SeqID_166024
atgtctccagcaggttcatcaagatggagccctaccacagaacagctcatgatcttggaggaactgtacaggagtggtattagaactcccagtgcctctcaaattcagcaaattactacacacctttctttctatggcaggatagaaggaaagaacgtgttctactggtttcagaaccacaaggctagggatagacagaagctaagaaggaaactcaccaagcaactgcagctacagcagcagcagcaacaacaacaattccaactccatcatcattgccaacaactcaatcaagatcatatcactaaccattttgttggtagctttggttatagcactgctcgttctactacccatgatttttccttttttaactcacctagcttgatttttcagggaggagctgcaaacacaccagaacaagcattgagttgcaaatggaatgtgcataaccctcaaagtaatttggtggagaataaagagatggcattctgcaactatggttggacacttgtggatgttgataatcaagcatcttcatgttgcactactcgacctctcaagactcttgatctctttcctctcacaactaccagaatcaatgaagactgcaccgccacaccacccaagtag

SEQ ID NO: 49247 - DNA, 453 bp, Glycine max
  Peptide Sequence Number=SeqID_166025
atggcgtctttgaaggggtctaacaacttctcgacttttttgagccagttgtcgaccaatacggctgagaaggtgggtgagacaatagtggctctagtgatggccactattgtcaaggtggggacttccgagagtatgataacgaacccgaagacgtgctttgtcactcttcgcaccgcccgatccagtgccacactgcccgtagagttcatgtttatgagccgaaaggggatgaacaaggatctcttctacatgtatgattgcttgtttcacaatctacatgacaaggtttggtggatatcattgatccagataccgaatcatcctctttttcgtcctttcacttcttgtaaaaacttcaaaactggttactttaacgtagcaataaggccagttgtcgagaaggactatttctacaactcgatgaggaactcattgtttcccttctactag

SEQ ID NO: 49248 - DNA, 827 bp, Glycine max
  Peptide Sequence Number=SeqID_166026
atgtcaaatctgcatttcttaatggccctttagatgaagaagtttatattcagcaaccccctggatatgaagtcataggcagtggagacaaggatggaatagtgatgcaccagaagaattatattaaagaagtattgaagaggttcgacatggatcaatgttataaggtagatattccagtggaaggaaatctgaaactggatacaggtgatcatgaagcttcagtagatgccacattgttcaagcagctagtgggatgcttgagattcgtctaccacaatagaccaaaaatctcatatggagttggtcttgtcaacatattcatgagtaatccaaaacagtctcatttggcaatagcaaaaagaatcttgaggtatctcaaaggaacacttaattatggcatattctttcctcatcagaaagaaaaagatgagttatacctcgtagcttattctgactcagactggtttcgggataaagtggagagaagatctacttctactgagtacatttcagcttgtagtgctgcatgtcaagcactgtggattctatcccttatttctaaattaaatatgaagactgatgactttgtggagctgcaagtggacaataagtctactattgacttagcaaggaatcctatgtcccatggtcgtagcaagcacattgaaactaagtttcatttcttaagggatcaagttaacaaagggaggataaggttgaaacattgtgggacagatttgcaacttgcttatattatgacaaaggagttgaaggctgatagattcaagttgctgagaaatatgttgggtgtggtgcatatttga

SEQ ID NO: 49249 - DNA, 666 bp, Glycine max
  Peptide Sequence Number=SeqID_166027
atggcagccacagtcaagatttcttggctttggaatgtgctggactctacctccctcagtttgatgactccaagagtaaatccaaaaattaatacttatgcagtagcttatgctatagatggtttgtcgccttcattgatgatcatacaagagtcacgtgtatttttcatgaaagaaacatcagaagtgggaagaatatttgaaaactttcacaacatggtgcaaacacaatttcagactagcattcagcctcactgcagcaaattggatcccaaatccataaaatgcatcttcctagggtattcaccacaccaaaaagaatgctattcaccttcaaccagaaaattctatcacacaatggatgtgatattctttgaaacccagccctattatcccaaagttgcaattcaggggaagaaaacaatagcacaagaagaatcccaacttttggaaattggagagatggagacaatcaagactaactcagaacctaccactgaacaagtagcaccacctaccaatgctccagtagcccctactgctctagttgaaatccaaatggctgaaccaagtgaaccagattcagattctcctggtgcacaagaaatcaaaaaacctcatgtttactcaaagagacaaaaaaactcggaaggggttagaatttga

SEQ ID NO: 49250 - DNA, 360 bp, Glycine max
  Peptide Sequence Number=SeqID_166028
atgaaaaaaccttcatgtcagaaaggtttcattcttgatggttttccaagaaccgtggtccaagcacagaagcttgatgagatgctgcaaaaccaaggagttaaagttaataaggttactggtgaaccacttatccagtgcaaggatgacactgcagctgttcttaagtcaagactggaggcatttcacaagcaaactgaatcgcagctccgttctttagcgacctcttcttcctctacggcacgtctgttggtgtcttcttcttcttcttcttcttcttcttcttcttctgctcgtcgacattgtcaagatgctccgcaatttgtaggattgattgaagctgaatacggatcaagttga

SEQ ID NO: 49251 - DNA, 474 bp, Glycine max
  Peptide Sequence Number=SeqID_166029
atggatgctcactcagatttgtttgctgctattggacttgtagatatgcattctaagtgtgaaatgatggatgatgcgagaagagcttatgattcgatgtgtattctaagtgtgaaggcaattaaggtgtgtaagcagattcatataatttccatcaaagttggaatttattcagatttctatgtaatatacagtcttgttgacaagtttggaaaatgtaaccatatagatgaagcttcgaaaacatttgaagattgcacttgggaagatttggtggcttacacatccatgataagaacatattctcaatatggggatggggaggaggctttaaagctatatttagaaatgcaagatgcagatatcaatcccgatccatttatctgcagttcccttttaaatgcttgtgcaaatttgtctacctatgagcaagggaaacaattacatgtccatgccatcacctttggaaattaa

SEQ ID NO: 49252 - DNA, 440 bp, Glycine max
  Peptide Sequence Number=SeqID_166030
gtggagttaatattgaggaggaggaactaacagatttgaggtcaaatcctcttcaaggggaaggggatgatgcaatcctccctaggaagggaccagtcactagaaccatgagcaagaggctccaagaagattgggctagagctgttgaaggaggccctagggttttcatgaacctcaggaggaatgcatgtcctcgccttcagaggactacacgtcctcgacatttgagggctgcacgtcctcgccttcatagggctgtcctcgccttcaaagggctgcatgcgctggccttcagaggactgcacatcctcgccttaagcggactgcacatactcgccttcggagggctgcacgctagtggacagcacgtccgcgctttcagagggctacacacccttgccttcagaggattacacgtcctcgccttcacaggactgtga

SEQ ID NO: 49253 - DNA, 480 bp, Glycine max
  Peptide Sequence Number=SeqID_166031
atgatatgtccattacgatgccatgaaaagatgcatgatgcgatcaaggaacaagccaaagtgagtttgctatgtgtaggtttcattccagaatcccaacttaaaagcaaaattagtcattccttaatccacatgggctttattgggcttgtagcgtggtcagggaggaaaatgcaaggatcatgcatgagtgcacataacatgcgaatgatgaaaatagaatgtttcattccagaatcccaacttaaaagcaaaattagtcattccttaatccacatgggctttattgggcttgtagcgtggtcagggaggaaaatgcaaggatcatgcatgagtgcacataacatgcgaatgatgaaaatagaatgtttcattccagaatcccaacttaaaagcaaaattagtcattccttaatccacatgggctttattgggcttgtagcgtggtcaggggtaagaggccatgaaagaaaggattag

SEQ ID NO: 49254 - DNA, 222 bp, Glycine max
  Peptide Sequence Number=SeqID_166032
atggtttattcggataaccactcgggtatttccgctcgtcagcgtaactcaaaaatagcaaaaaagaatgtttatacggataagcactcgggtatttccgcctgtcagcatgactcaaaactcagtatgacagatcttgtaagcgcggaagattatgaaaatctccgcgtgtcaacgggcttgtcggccgcgattgacgaagttcgcaggagacgacgttag

SEQ ID NO: 49255 - DNA, 599 bp, Glycine max
  Peptide Sequence Number=SeqID_166033
ctcatgataaggtcgatgtgacatatgagacctggaaggaagtctttgctgctcagaaggatttgatatgggaggatattcaggcgaaatttgaaatccctgaagcttctgacagtaggacaaagaagaaagttcttcaaacggtgggcgagcggtggaggaaatgggcacttgcagctgataaggacggtgtggatgacattgtctgtgaaaaatatggcattagtaaggagaaatgggcccaattttgccagacccgccgagatccctcgtgggaggatgtgcgcaaaaaagcacaggccatccagaagcaaaacaccgccccccatggcgtcattaaccctcaatctcccatcagacgacatgtgaagtggaagatggtccgcaccaagaaaactgggcagatgacgtctgaggccgcaaaggaaatcgctgagaagattgattctttggaggagcaagcgtcacagggttcgtttgtcccccatggatgtcaggatgtcctaactattgccattgggcgactagaacaccttggccatgtgcgtgctactggagccagtgtcaccatcaagcaatacttcagctcggctccatga

SEQ ID NO: 49256 - DNA, 195 bp, Glycine max
  Peptide Sequence Number=SeqID_166034
atggataaggtaaatgaagagtctgaactgatggttgtgtcaattgactcgaccgatgagtctgaactgatggttgtgtcggttgagttggacaatgggtttgaactcatggtggcagccgtttcagtgtttttccccagaggaatggggtgtggatgtgtgcagaagaaatgttttttggagaagtatgggtga

SEQ ID NO: 49257 - DNA, 531 bp, Glycine max
  Peptide Sequence Number=SeqID_166035
atgcagttcacagcatcattccacaatgatatggacaccatagaagtgccttctttttaccaccaacagtgtccagtataccctcgctttgtccgcttcagatatgatggaacaacgttctatatcagactaagacagcatcggcagaaagtctactttgccgatggattaaaccacttcagaaaagatttagaaatttttgaatctgtgaccattaaattcttgacatgcaaaaacaactccacttttgacctttatttcatcccctcactacaacaccagagttgtggaaggccatgcctattctcaagagagcatatttggacacttcaaattacacagtcaatgcttgctgcaccggaaccgctgagacttccaaattgtgccatggcacatgttaatgtctgtggtaaacacatgaccatcctgagaagaattagaactccattacagtggaatgatgtggtccttgacattggaatgagccagagatatgttgtacaacccatggtatcaattcctcacggctag

SEQ ID NO: 49258 - DNA, 267 bp, Glycine max
  Peptide Sequence Number=SeqID_166036
atggaaaggagttcgtcattatacacctccgaggctcgcagtcgcgtgttttgtctctgtaacatagaggctccactagtgacattgtggactgaggaaaatccagggaggcgtttttatggttgtggtctatacaaggatacaggtaggaaagggtgtaatttttttcagtggcatgatccagttggcaacaatcatcaaaagaagatcattgtagccttgatgaaggagtttgatgaattgaagttgagggaaaaggatttgtaa

SEQ ID NO: 49259 - DNA, 1158 bp, Glycine max
  Peptide Sequence Number=SeqID_166037
atggcatatgacaaagaaatgttaccaaaacaatacaacacgacataccaattgctcacagatgagcaaaaaactattgtcgataccattatgtctgtggttaacactcaatcagctgcagtttactttctctatggatatggtggaactagcaaaacatttgtttggacaaccttatcatctggtatacgctccaatggtggaattgtttgtacaattgcttcgagtggaattgcttcattactattgcctggtggtcggaccgcacattccaaatttgctataccagtccctgcaacagaaaattcaacatgcaatattcatcaaggcagtgagttagctgaattattaaaggttacaaaactaatagtttgggatgaagttccaatgtgtcacaaatttccatttgaggcactagataaaagtcttaaagacatcatgcaaaacaatctgccttttggagggagaattatggtttttggtggagatttccgacagatcttgccaattgttccaaaaggtaatcgctcagacatcgtccatgcaactataaatgcatcatacatttgggaccattgccaaattcttaaacttacaaaaaacatgagattgctatcaaatgctccccaacagcccaacaatgaagaactcaaacaattttcacattggctacttgacataggagatggaaaaattggacaatataatgacggattttcagaaatcactattccagatgagtttcttataaaaaattatgatgatcctatccatgctattgttgaagctacctatcccagcttgatagataactacagtgacacagattacttgcaaaaaagagttgttcttgcctctaaaaaagaaattgttgacaaaataaatgattatgtcctatcacttatacccaatcacgaaaaagagtattgcagcgcagatagtattgataaatcagatgaattgctcaatcctgcttttgcattattgccacctgaattcctgtattcattgcaaacatcaggtatacctaatcataaattaaaacttaaggttggaactccaatcatgctaatacgaaatctcgaccaaattgatggcctgtgcaatggaactaggctcattatcaccaaactcggatctaatgtgattgaggctgaa

SEQ ID NO: 49260 - DNA, 390 bp, Glycine max
  Peptide Sequence Number=SeqID_166038
atgaatgggccgtccgacaaggtcaatgcacccccccatgaacatacacaacatgcacatgccaatgcatttccaacatcaatcaacattccatgttcacatcattctaaacatagacatcatctcgtctcaatgacgttatcaacaacaacaacaaccttatttcatattcagataatcatcaccaacggcaagcaacggcggctcacgacagccaccggtggtcttgggtggtggaaaataagcgggcctttcgcgctaagccgaagtccacttcttgcgcttagtcccaacggtcagactgtagaaacatatcttagagagatccagacaaaatttgaatacgatccaacggttaacgaatccggtatcgagattttactgaagtag

SEQ ID NO: 49261 - DNA, 354 bp, Glycine max
  Peptide Sequence Number=SeqID_166039
atgaattttgatgcatcagttagaaatgatggtacgggcttgggtttgatattgagggatgatgaaggaatggccttggaagctgctacttattttttacaatccactaatacatcgttggaagctgaagccatttgttttcgttggggtggggaaggatctctgaagcaagaccgaaactatgttcaggggataattgatgattcttatgttttgtgtgatgagtttcattctatctcactcactttcactacaagcaggatgggtaatagagttgcccatgaattagttggattagctgttctttttcatggaagttattggattgaagaagttcctcagtttgttgtatag

SEQ ID NO: 49262 - DNA, 549 bp, Glycine max
  Peptide Sequence Number=SeqID_166040
atggatattagattacctttctaccctgcggaggtttccaaagtctgcatgattcagtttggaatacccagtcctgacgagattgcaaatgtctgtggtgcaaatcgagcatggctagacaacggagagagggaagatgaagtccatcaatacccgggtacaatcccacttcacctggctagaaccctacctctccaacttataatcttggttctacaggatatagtcctacaagtccagcttatttgcctaccagttcatcctactctcctgcattgttgggttacaagtgaggttaaagtgtggtgtcaaatttccttatgtggtggttcgtggtccattggtgtaaatctccccagcgtttaccctcctcgaatttctccaacatcacccagctatagccccacctcacctgcatatagttcaacttcgtcttcctacagccctacatccccctcttacagcccaacgtctccatcatatagtcctacctcacttggatatagccaacatcacaccatcatattgcccaaaatcaccatcgtatag

SEQ ID NO: 49263 - DNA, 231 bp, Glycine max
  Peptide Sequence Number=SeqID_166041
atggaagaggaaaaatcaatggcggctaagatttgtgttggggtggatttggatgaagcttgcgtgggacaaagagggtggacggttaggattgggggacgaaagaggcgtgtggcgacctcgtgctgtgtccagtgtgagggtgtgaacgaagagataaaggaaatattctttccacgtaagaatcatggcatcattcggaaaggtagggacaagtgtctcccactttaa

SEQ ID NO: 49264 - DNA, 270 bp, Glycine max
  Peptide Sequence Number=SeqID_166042
atgggaaactggaagggttggaggtacttcaataggctgtctatctacccaattaagagtatccttcgtaaagtgacttcaaacttcaggttcaaaactgaaggtcacagaaatggacttcttagtctttataaggacatggagtcttgtggggaatatgcagatatcaaagtcatgtggaaaatgattgaatcttcctctcctcaatatgcctgccacaagaaaaggatcaataggtcttcatattgggtggtctgcaggctaacttga

SEQ ID NO: 49265 - DNA, 298 bp, Glycine max
  Peptide Sequence Number=SeqID_166043
gaccaaatggttcccgcatgtcatccggcctgtcgcctctggatgacaaaaggcgcagaagacgacgttagtctctgcgtgccatcggacatgactgtgtctgaatggcgaaaaggtgtagaagacgacgttagtctctgcgtgccatcggacatggttgtgtctgaatggcgtaaaggcgcagaagacgacgttagtctttgcgtgccatcggacatgactgtgtctgaatggcgtaaagaagacgacgttagtctctgcgtgccatcggacacggctgtgtctgaatggcgtaaag

SEQ ID NO: 49266 - DNA, 231 bp, Glycine max
  Peptide Sequence Number=SeqID_166044
atggatgaattcattgaactgatgaaagaacataacttggaaacgttgggatgctggagtgcccacctggctgtagccatgactaattttgcacgttgttttcaaatcatcattgtcatgcgtgccttatggagtggtaggggagttcggcctgagaccgacaccttgacacctaaatttgttttgccccagatatcaagattgggttcccacgataaaagaccccattga

SEQ ID NO: 49267 - DNA, 411 bp, Glycine max
  Peptide Sequence Number=SeqID_166045
atgcccaaaaccctaacaccttatcttccaccacccacgactagcaatggcaaccacgagtcaccgttgcttgctgttggaccaccgcacagagaggaatgctttaattggagcagaatcttcagaatccatctcaaggattcgatagagaatgaagctcccaaccttttctttcgtggtttctttgaggactctatgtttggaccaatgaacttgaacgcgagagacctccgaacgacgctgagaggagtcgaaggagagataacgatagatgatgatgttgagatgatgatgcaatcctaccccgcaagggcattggatagaagactccaagtagattgggccagagatgcaagagaaggcccaagggttctcatgagccttaggacagatttcgggcccatgggctaa

SEQ ID NO: 49268 - DNA, 1164 bp, Glycine max
  Peptide Sequence Number=SeqID_166046
atgtctgagggctattataattctaagaagactgatgatatctgcgatgatgtttgtggacagaatggaactcctgcagcactgagcatgtcaagactcaagtgtattctaaagggattggacttcaaaacctatatatttctgtttgtgattgttcctgttggcatcttcggtctctatttgcacgggcagaaaatctcctactttctaagaccactgtgggaatctcctccaaagcctttccatgaaatccctcactattatcacgagaacgtgtcaatggagtctctctgcaagcttcatggctgggggattcgtgagtcaccgagacgagtttttgacgctgttttgttcagcaatgaagtcgacatcctcactatccgttggaaagaaatgcagccttacgtgacgcagtatgtactccttgaatcaaactcaacatttaccggatttgtcaaaccattgctattttcgggcaatagggacaagttcaagtttcttgagtcgcgcctaacatacggggtgattggagggagattcaagaaaaaagaaaatccttttattgaggaggcttatcaaagagttgccctggatcagcttctgaggatagcaggcatagaagacgacgatctcttgataatgtccgatgttgatgagattccaagcgcgcacacaattaacctcttgaggtggtgtgatgggatccctccagttcttcatcttcaactaaagaactatttatactctttcgagttctttttggacaacaaaagttggagggcgtcaatccatagataccagaccggcaagacttggtatgcacactatcgacaggctgatgtgctgctggccgatgctggctggcattgtagcttctgttttcgtcatatcaacgaattcatatttaagatgaaagcttacagccattacgatcgcgtgcggttccctcactacttgaaccctgacaggattcaggatgttatatgcaagggggctgacttattcgacatgcttccagaagagtatacattcaaggagatcattgggaaattgggacctattcctcattcttactcagcagtgcatcttccagcatatttattgaataatgcagagagattcaggtttttgttaccgggtaactgcagaagagaaaggggctga

SEQ ID NO: 49269 - DNA, 459 bp, Glycine max
  Peptide Sequence Number=SeqID_166047
atggataacatcaacaatctgaatactttatttgcccagttgctcacatcggatttcaacatagaagaaaatgagcgagcaaagcttctacttcatagtctaccaaattcatatgatcaattcatcatcaacattattgtcagtcgtctaacctttgatgatgttgccagaactattcctaaagaagaatccaaacaaaagaataagaaagataggcaggaaaattccaagcatgcaaaggctttaatgatgacgaagatccatacggaatgtgggatcttgaaggcaatgaagggcaatcttgtattgattaaagctgagaaaatcatagctaatctatgcatgcttttgggagatatgttgcaagaagtatatgcattagttgcaacaacaagtcaagaagaagcaatgatgatatggcatcaaagactaggtcacatgtcagagagcaaggcctga

SEQ ID NO: 49270 - DNA, 246 bp, Glycine max
  Peptide Sequence Number=SeqID_166048
atgacactgtttactttcaaattgtctcacaattgggtatctgagaaaatgcatagccagctaactaggatggtgcatttgaaagaaacaaagagtgaaaaagaagatgaaattggaaaagagggtggactcacaggtgaaaaatggagatggaagattcagcatttggaggaaaagatcctaaaccctaatagaacagactcagagagagggagtagagatcttgctctgttatttgattggtag

SEQ ID NO: 49271 - DNA, 672 bp, Glycine max
  Peptide Sequence Number=SeqID_166049
atgcagagaaagtttcactttcttgtcaaaaacaaagccactgctagtgctgatgggggtacaaggtttacgtgtggaactcaattctcaaggaaatcagtagggtcggccttctcttgtgtcattggaaacaagacaacaccgcgtggcaagcatgcttccaaactgaagaaaaaaaaggagcctattggcgactcagggaacggaaaagctgcattgtctcagcttcttgcactggaggagactgatcatgcaggagatgcaaagcagaacagaaaggataggcaacgtgtgaaaatgaatcttcctttgatgagctttctgaaaaagaagagaggatggaacaatttcatgagggctagatttagtagtggtgtgcatggtgatggcagtaatgttgttaccaagttcggacaagtgaagaggaaggcaagtttacgccgcttggttagggttccctctaaaatactggtccttcgcctcaagttgaagatgataaagtgcctgattataaagaaagcgccaaagcagtttgaacagagagctgaagatgaagacagagaactatgcaaaaagaggattctcttgggagagagatgcaggccattgagttctccaagtccaggttacgatacaagtaattttttctatccaagaaatagttacacttga

SEQ ID NO: 49272 - DNA, 621 bp, Glycine max
  Peptide Sequence Number=SeqID_166050
atgcagtttctcaccggattcaaccttgttggaaaccgacgacgcaaaagccgcgacgcaatgaggttccgtgacgccagtctttctaagcaggcaattatttgtggaaaagttggccaagcccctgttcaaaagatactgaggaatggtagaaatataaccatctttacagttgggacagggggcatgtttgaccagagaattcaaggaccaaaggatttgccaaaacctgctcaatggcataggattgctgtgcataatgatatactagggacctatgccgtacagcaactctttaaaaactcttcagtttatgttgagggtgacattgagactagagtttataatgatagcatcaacggtaacgttaaaagcattccagagatatgtgttcgccgtgatgggtctgctgcaaagcttgagggagaattcgcctcatcaagaatggggagagcattgataaaacttccttggatgaattgcatcaaagtttgtttattgattggtattatgcctgactataatgctggcaggagaagggttgttttagggaaagttgaccatctaacggaagcatatacttctgaaagaaacttcgccttgttgctgcagcatttgtaa

SEQ ID NO: 49273 - DNA, 417 bp, Glycine max
  Peptide Sequence Number=SeqID_166051
atgaattctatggcggtgagacttgcgaagcatctccgactctctgcactgacctcattttcactcggtggtgtgccgagaagcggagcttcatggtactcgacctccctatctggaggtgaaaatgatcaccctttacctgataatgatgcacctaagaaggaagcattggatgaagagtttgatgattttcttggcgaaaagcctgagttacagctgcaaggtgtggatcccaagaagggttggggatttcgtggcgtgcacaaggttttgcatttttgttatgctatgaccaaatacaagtttttgcaatacaagattttgaaaatagaattgattctagacaatggtcatgctggagccaatgttgtcaataacggatcttggaaaattgcaaaagctgaaaatccactatag

SEQ ID NO: 49274 - DNA, 2977 bp, Glycine max
  Peptide Sequence Number=SeqID_166052
atgagaatccaccaaatcttctttactttctttatacccttatgtttgataaacatcgacgtagcaacattccattgtcttgaccatcagcaattcttattactccacttgaaggacaaccttgtattcaaccctgacacatccaaaaaattggttcactggaaccatagtggcgattgctgtcaatggaatggagtaacatgcagcatgggccaagtaattggtcttgatttgtgtgaggaatttatttctggaggactgaataattcaagtctcttcaagctgcaatatttgcagaatttgaatcttgcttacaatgatttcaattcttccattcctttggagtttgacaagctcaagaatttgaggtgtttaaatttgtcaaatgctggatttcatgggcagattcctgctcagatttctcacctgacaaatttgacaacacttgacttgtctacatcacttgcctcacaacattttctcaaactccagaatccaaacattgagatgattttacagaaccttacaaaactcacagaactatatcttgatggtgtgagggtatctgctgagggaaaggagtggtgtcatgctttatcttctcttcaaaagctaaaagtgctgagcatggcatcatgcaatatctcagggccaattgattcttcactagaagcacttgaggaactctcagtagttcgactgaatctgaataatatctcaagccctgtgcctgaattccttgttaatttctccaatttgaatgtcttggagcttagcagttgctggctgaggggtaattttccaaagggtatctttcaaatgcaaacattaagtgttcttgatatctcaaacaaccaggatcttcatggtgctttgccaaatttcctacaacaagaagttcttcacaccatgaatcttagtaacacaaatttctctgggaaattgccaggttctatttcaaatttaaagcagttgtccaaattagatctatctaactgccaattcattgaaacactcccaatttcaatgtcagaaatcactcaacttgttcatgtggacttgtcttttaacaagtttactggtccccttccctctttgaagatggcaaaaaatctcagatatttatctctcttacacaataatttgacaggagccattcctacaactcattttgagggacttgaaaatctactcactgtcaatttaggagataattccctcaacggaaaaattcctttgactctttttacacttccttctttgcaagaactaacactttctcataatggatttgatggcctattagatgaatttccaaatgtttctgcctctaaactacagttgattgacttgagcagcaacaaattgcagggtcctattccggagtctatctttcatattaatggactccgtttcctacaactttctgcaaatgaattcaatggaacaataaaacttgttatgattcagaggcttcacaatttgcatacattaggtctttcacacaacaaattgtcagttgatataattgtcaatgatgatcatgacctatcatcctttcccagcatgaaatatatattgttggcttcttgcaagttgagagaatttccagggttcttgagaaaccaatcccaactaaatgctttagacctatccaacaatcagattcaaggaatagttcctaactggatctggagatttgactctctggtttatctcaatctttccaacaattttctcacaaatatggaaggaccctttgatgatctgaattccaatctatacatccttgatcttcattccaatcaactttctggatcaattcctactttcacaaaatatgctgttcatttggactactcaagcaataaattcaacactgccccacttgacttggataagtatatcccttttgtatactttctctccctttcaaataacacctttcaagggaaaatccatgaagccttttgtaatctttcttctctgcggttgcttgatctttcctataatcgcttcaatgacctcattcccaagtgtttgatgagaaggaataataccctcagagtactaaatcttgctggaaacaaactcaagggttatctttctgataccatttcaagttcatgcaatttaagattccttaatctcaatggaaatctcttgggtggtgttatcccagactctctagccaattgccagagtctacaagtcttaaatcttggaagcaatcagtttagtgatagatttccatgcttcttaagtaatatttcctccctgagagtgctaattttgaggtcaaacaaactcaatggtccaattgcatgccctcataacactagcaattgggagatgctacatattgttgatctagcctacaataatttctctggtatactacctggaccattttttagaagctggacaaaaatgatgggtaatgaggctgaatcccatgaaaaatacgggtctttattttttgacgtgtttgacaatcatgccactgtgcgttacaataatctgttcacagttatcagcaaatttcttgtaatgaaattatacaaactgttggcaactgaaccttattttgtggctgaccacatatttgcctattatgtcacttctaacgaattcggtggtcgctacttggattcagttacaattgtgaacaaggctttgcaaatgaagttgatcaaaattcccactatcttcacttccttagatctctcctcgaaccattttgaaggtccaatacctgaagaacttgtgagtttgaaagcactcaatgttcttaatttgtcacacaatgctttctcaagtcacatccccttgtcaattggaagtttggtgcatcttgaatccttggacttgtcaaataacaatttgagcggaaaaatccctcttgagcttgctagtttaaattttctagcatacttgaatctctcatttaatcaattgagggggcaaatcccaacag

SEQ ID NO: 49275 - DNA, 684 bp, Glycine max
  Peptide Sequence Number=SeqID_166053
atggtttttccaaaactaggtatcatcatcactgctgcactagcattagtccctttgcttttcatcaatgaatctgatggtgcttcttattacccttctggtttacatgctgatattgctgagattgcaccctttgcttctcagaaagttaacctttcagtgtactatgcaagcctaagccaaccttgtgcaactttcattgttaagaatcttgaggaaattttccacagcgatctcatcaacattgtcaacctccagctagttccttgggccaatgcttatgttgataagactaaccattccataaatggccctgatgaatgcgagctaaattcattggaagcatgtgctctcaatgttttgaatgatgtgaacaaacattatgctttgatttactgctttgagtttctggcaattgagggaagacacaagaattggcaggactgtttcagccaattggacttgcccgaggaacctattctgagctgctataacagaggaaatggaacagagcttggacaaaaatctattaatgaaacagctctcctttacgcaccccacgaatttctgccttgggtgatggtaaacaatcaatctattggaaaggaatatgaaaacttttcacgttatgtttgtgaggcttataaaggcattacggctccagcagcatgcaaccttcattag

SEQ ID NO: 49276 - DNA, 438 bp, Glycine max
  Peptide Sequence Number=SeqID_166054
atgacaatgatgatggtggtagcagtaatggatggtgatggtggtggaggtaacattgatgatagtagcagtgacaatgtgatagtggtaataatctcggtggcaatgattgtagcagtggcagtggtggtggggggtgttggtggtggttgcaatgaggtggtggttgtggtggcggtgatgaaggtggtattgttggtagtgatgacaatgatagtgatagtgacattaatggtggtggtaacaatgttgacgatgatggtgatggtgatgttggctgtgatgctagtagcggtgtcggtggttgtggtgataataactagttatggcaacgataacaatgatagtggtagcgatgacggaggtggtaatggtattggtgacgatgataatgataatggtgatggtcgttgtaatattccgtttttcgtaaaataa

SEQ ID NO: 49277 - DNA, 990 bp, Glycine max
  Peptide Sequence Number=SeqID_166055
atggggtcgactggacatcagggttcggagatcgaaattaacggtgcggttttggatttgagtgtccgatatgacttctctgagcagagaattggtgtttctcatactccagtttctggaggaagagaaattcaaagaatctgtacacaatttttccccttttctctgcaagttgtagatgtatctgattctggtgtggttgggacttgggatgaatttgaaatgaggcttgagaaagaatctgggttctttttcaacatgaagtactttgaggaaaaagtgcaggctggcgagtgggaagaggttgagaagtacttatcaggatttaccaaagttgatgataatagatactcaatgaaaatattttttgaaatcaggaaacagaaatatctggaagcacttgatcagcaagacaaggcaaaggctgtggagatattagtgggtgatttaaagatgttttccaccttcaatgaggagctgtacaaagaaataacccagttattaactcttactaatttcagggagaatgagcagctgtccaagtatggtgacaccaaaactgctcgaagcattatgctgatagaactgaaaaaactcatagaggcaaatcctcttttccgtgataagcttatcttccctacccttaagtcatcaagactgcgaactttgatcaatcaaagtctaaactggcagcatcagctctgcaaaaacccaaggccaaatccagatattaagactttattcacagatcacacatgtgcacctcctaatggtcctctggcgcccacacccatcaatcttccaattgctgcagttgcaaagcctgctacttatactccacttggagctcatggtcccttcccacctgctgctgcaactgccaatgctaatgctttggctggttggatggccaatgcctcagcttcatcatctgtccaagcagctgtagtcacagcatcaactatacctgtcccacagaatcaaggttaa

SEQ ID NO: 49278 - DNA, 141 bp, Glycine max
  Peptide Sequence Number=SeqID_166056
atgaatactcgtgcaaaacctgccaaggctctttgttcaatccaccaagaaaatgctctgaagctatccccaatcattccaatttcaatttcccaatgtgaaccaggttttgcacccgatgaaacgatgatgccgaaagaa

SEQ ID NO: 49279 - DNA, 1632 bp, Glycine max
  Peptide Sequence Number=SeqID_166057
atgatgcaatcagaggatctgcaattccaatggccattctttgaagacatgaactcaacttttgatcaaggtgttgagtcctatggcttcaccaccatgtatggccacgttggtgattgtggaccttatgacttcactatgaatgaccatgttggtgattgtggactcaatactctattgagcacaccagaggattctacttctgaaatttgttccatcccctttccttcctcccccattttctccattgatcatattcatatccaatacccaatcaatgaagaaaccatgcaccttccatcactcatggaattggatgattttgattccatcttggatactcaaattattagtattcaaggtcatggagaaagtgaagggagcttcttcccttcacagaatttctcgagtgaggtggaaaatgcatggagtccaaccccatctgtgaggtcagagttgtccacaaatcaaacatcaccattgactttaccactagaaaacatggaagtcgaaaaccaagtgagtcttccacacttgttgaaggcctatggagaagccttggagcaaggacaaaaagcactagaagaagtgattttgaggtgcataagccagaaagctagcccacttggtgagtctctagagcgccttgcattctacttgtctcaaggcatgacaaatcatggagactatctaaaaggggaggccttaaagaactttgaggctgctttgagggcattatatcaaggattcccaattgggaaaattgctcactttgcagctgtttcagcaattctcgaagccttgccacaagattgtgatgtgcacatagtggacttttatattggacatggtgttcaatggcctccaatgattgaggctattgcacacatgaacaaaacattgacattgacatcaatcaaatggggtggtgaggttcctgaatgtgtttctagtccatgcaattttgaggaaactagaaggcagctctatgagcatgccaaatcctgtgggttgaagttgaaggttgaggagaaaggagtggaggaattggttagtgatattaagaaaatgaacaaaaagggtgagaagggagagtttttggccttcaattgcacgattgatctgcctcatatgggaaaagtaaggagcagaaaacatgccttacagtttctaagggtagctgatgaattgataagcacctctgacaacaggggaattatcacttttgcggatggggatgcttttgagaaagtgaaaaataacttgaatttcaggtcattttttgatgggcacttggtgcattaccaagccttgttagaatcaatggaatcacatttcccaaccagtttctcagaagcaagaattgccatggagaaattatttttgcaaccttgcatctcttctcttgattggttacaaacatgggaggagatgaaaaggggaggccatcttgaggaagaaactagcttagagggttgccaattgagcaaaaatatcttaatggaaattagagaagtgttgagaggaagtgatggttcctatcaggccaggattgaaggacaacatgacaatgaactagttttggagtacaaaggaactcaactattaagattttcaacttggaaaaactaa

SEQ ID NO: 49280 - DNA, 375 bp, Glycine max
  Peptide Sequence Number=SeqID_166058
atgttgaaggtaagttggagcctagaaccaagatggaattctttatgggtgatagagatggaatcaaaggatttcgagtctagtcccccatctgaaagaaaggccattctgaatagaattgtcatctttgatgaattctctatgttgtattctaaatctgatgaagttttgggcaaggatgaggatatcactaagcagtttgaatcacctagtgagactgttcatggtcttcaaatgcaccctcaagatcagacttcagcaccagttgaggagactgattggacgatccaaaacaatctgaagcagcccaaaaccacaacaccaagaaagtcacaaaggaaaatcaaagctcctaaaagatatgacttgatataa

SEQ ID NO: 49281 - DNA, 453 bp, Glycine max
  Peptide Sequence Number=SeqID_166059
atgcctcctttctcccactccaagtttgccttcacattaacctctctagatctctcccaaaatgccctatttggctccctcaacaacatgtcatttctcccctcccactccaacctccaatccctcaacctctccaccaacctccttgaatgcgatctcttacaacaaccaacgacatcgaagacgtcggagaacgagaaagaagacagagggagagtgcaagttgtcattggtcttctccgtgtcgatccagacgccgacagtggcagtgcgggcatcgccgcattagaagttcaaccacctccgtgtcaccgacttctcttacaacaaccaacgacatcgaaaacgtcggagaacgagaaagaagatagagggagagtgcaggttgtcattggtcttctccgtgtcgatccagacgccgacagtggtagtgcgagttggtgttggtattga

SEQ ID NO: 49282 - DNA, 264 bp, Glycine max
  Peptide Sequence Number=SeqID_166060
atggacaagttggtccacgtactacctgccactgtcagtcgctgtaaattctttataaaaggggaaaaagtttacaatggtgtgaagaataattattttgtggatgatatgccatgtcagaaaccatatgcttatacagaaagggtaatcagaagtgtcagccagtggtctgctggaacaagtcagcctgaagaaagcattcacactgcatattgttctcttattgaagaagcaaagcattttatctacattgaggtaaattaa

SEQ ID NO: 49283 - DNA, 471 bp, Glycine max
  Peptide Sequence Number=SeqID_166061
atgacatgtagaagctcaataggtggaccttttggagcaacatgtgaaagtggccctaaggagacgtcattgttgacctcatacgctgatcatgtggtgtgggaagtatggggtgatatgatacatgatgtggtcaaagggtctagtttattctcattgactgcatgcagctatcagacaatagacaagggactcttgcttgcttttgctgagagatggcataaagagaaaaacaccttccatctgctcatgggagaaatgacgataacacttgatgatgtggcatcgttacttgacattaccattactagcgtgttttacaactgtgaacatatggataaggaagcacctatttccgtgcttgtggaactacttcgatttgaatataaggattcctttgatgatggtcttgtgaacattagtagggcacgaggtggcaccagaggtgggtgtcacagaggaggacattga

SEQ ID NO: 49284 - DNA, 102 bp, Glycine max
  Peptide Sequence Number=SeqID_166062
atgtgggattgtgatatctcaagcttggagaggttgagggcatcgagcaaagatgtggagactcaaaggtgggtgacaaatgagagtgcgaggctgctatga

SEQ ID NO: 49285 - DNA, 477 bp, Glycine max
  Peptide Sequence Number=SeqID_166063
atggatgatacggttaaaaatgaagattgcaacaatttttttaaaactacgaaggtttttgatactcgagatgaattattgaaaagggtttgggaggttgcatttgagttggatgttgttgttgtcattttgaggtatattcattggcatgtaatgaatgatgaagttgtgtgtaacatattttggacacaacctgatgtggtaaagttgttgaatgcatttaacatagtgttctacatggataatacgtacaaaaccaataggtataggctacctttgcttgagattattggtgttacttgtactgtgctgacattttctgcttcttttgcttacatgaaagttgaacgtgaaaaaaaaattaggtgggcacttgaaaggtttagaggcctttttcgcaaacatgatgaatccaaaagtgattgtaacaaacaaagacctaactttgatgaatgtagtaaaaattgtgtttcttga

SEQ ID NO: 49286 - DNA, 690 bp, Glycine max
  Peptide Sequence Number=SeqID_166064
atggcggtgtcggcgatgaccatccgccgcgatattaaattcctgcaggacgccggcctggtggttggcatacacggcggtgtcaggttgcctgcagtggtccatcaggcattgccgtatgtggagaaggcacagctgaacgtgcacgccaaacaaagccttggccgttatgctgcgtcactggtagaggatggccaggttgtctacctcgatgccggtaccaccagctatgaaattgcgcgtgcgttaggcgatcaggcaagtctcaccgtgctgactaacgactttacgattgccgcctggctgatgcgtcacagccacatcacgctatttcatacaggtggcaaagtcgataaacggcatattgccagcgtgggtgccatggcggcgaccgcccttgccgcgttcaatattgatctggccttcctcagcgccagcgcgtgggatgtcacgcacggcctctcgacacccgacgaagacaccttgctggtgaatcaggcggtgctggccgcctcagcgcagcgttatctggtggctgacagcagcaaatatggtcgttacagcgtgtattccgtgtgtaagttgcagcagctggacggcgtgatcactgatgacgattgcccctgtgctgccgttgaggagatgaaacagcgtggtattcgtctgcaccgggtaaatcgccgcggctga

SEQ ID NO: 49287 - DNA, 3663 bp, Glycine max
  Peptide Sequence Number=SeqID_166065
atgtcggagaatctcgacgcttccgaaatctcgccgagcacttcgtccgcaagtctcggcgagacgccggaaattgccgccataccactcggaatcgatctcgtgtcggcggccaggcgaaatatctgcttcttgaggaccgtggcggattctttgtggcttcaccacacgcccattatggtcgaagccgtaagaaggtaccatgatttctggatgccgttgattgctgatctcacgctgcaaaactcttcccctcccatgattcttcctccccttgacatccactgggtttggttctgtcacactttaaaccccgtgagttacagggaatactgtgaaacgagattctcgaagctgattggcaaagcgggaatctttgacgaagagaacagagagtacgcgttgatgcggtgcatggagatttggagcagtagatacccgttggagtcgtttgagaacgaggcgagttgggattcgcaggattcggatactgtggctgttgttggggggagtttgaaggagagagtgtttaaggaagttgaaaagcagaggaggttcacacgtgagttctcttcgcgcttggttcctacttcggacattctcttaatgtggctgacccatcagagctacccaacagtgtattgtgaagatttgaaagcattagctatagaaggtgatctgcagaaggtggcaactctgtctgaaacggtgaaggaaaaggagtctgaagaaaccaagaagttgtgggatagggcgtttaatcaaccttatgagaaagctggtggagaggtgccttttatgttggacgttgttacctcaatcaaatcccctgtctattgggaggaatcaggcacagatgtcaatacaaaatacaggtccatgcttccaagatttttattggaggcctgtgtgtttgtgaggcttaagcaaagaataacaacattgcagaaggatataaaccatgatttcctacacctccgaatagtaaggtgtcatagtgaactaaagctagataaagccttgtccaagttcaccaatgattcatggaaaaaagcttggcacttttactgtgagtttgggactaagggagttatgtttgagtatcgtcgtcatggtggtaactgcctaagaggaagtagcctgctagatactgtttcgttccgctggaatgatttattgagagcagattctttaactttggaaaaggaagttagtcaacaggtgaatgttgttacgtcaataaccccaccagttcaggcaccatacttgttgaaatgtgtacctgatcgagtcactgatgattctggggctatgatatctgatgtgattctgaagatgaatagttatcgtccacaagaagggcgatggttgtctcgcacagttcttgatcatgcagggagagtgtgttttgttattagaattagggtaggaggaggattttggagaagagggggtgaagctccttcagctgtaaaatgggaagataggattatagagatacgggaaggatcttggtcttatgttgctggttacattggtagagcacctgagaaggtggtggccactgcaacaccaaaggaacctactgaacaatgtaaagctgcatggtgcttttcaacaggagatgaacttacaatacaatgggagtcatcacaatcagtgtcagggaggcagatgcaatatcaagtaaagaaaacaaagtcaaagagaaaaggcgaagacatgaaaatcgagttagaggagaaagagatcgagggagaagaagacgaggagagttttataacagtagtccgtttcacagaagataacccagatggaaaagcaactgctcttctaaattggaggctattggttgttgaagtattgccagaagaagatgcagtactgatgcttctcctttgcctttcaatactcaaaagtgtatcagaaatgaagaaacaagacgtgggaggcttgttggtgaggagaagattaaaagaagcaaggcttggaagtagggattggggttctgtgatacttcatccatcttcatggtcatcatccattgattcaacttatcttcaaccctggcattggaatgctgtggttgtcatgaaatctgatgctgtagatcagctgaaaaggtatccaacattaagtccatcaccagtggaagctttctcctccactccaaatggctcatgcgacaccacaccctacccagcattctgcaaaactactctgccagcttctcaatatttatccatacaagaccaatgccgtttcttccctcagcaatccttatcaatcacaaaaaccattttcaatttggtctcttcttatctcagagacccctacaccattcctcattcaacagtgcacgcccttgaagattgtcttaatctttcagaacttaactctgatttcttgtccaatgtcctccaagccattgaaaacaccctggctagctatgaggtctatgacttacaaaccttgcttagtgcaattttaactaaccaacaaacgtgcttggatggttttaaagaggtaacaccctatcctatagttaccaatgccttatcaagtcctctttctgatgcaatcaaactatatagcacatctttagcccttttcacccgtggttgggttagtgcagccaccaccaccacaggaagttcaaccacggttgagactattattaatagaaagttgctgcaaacaagcgttgacgacaatgtggtggtgaacccagatgggtctggggatttcgccaccataaatgatgcaatacatgctgcacctaacaataccggtaccaacaacgggtaccatgtaatttatgttgtcgctgggatttacaatgagtacgtgtctgttcctaagagcaagcagaacctaatgctcgttggagatggcatcaaccgcactgtgctcactggcaatcgcagcgtggtcgatggctggaccactttccaatctgccactttcgttggaaaagggtttgttgcagtgaacataacatttcgcaacactgcgggatccagcaagcatcaagcagtggctgtgagaaacggggcagacatgtccacgttctacaattgtagttttgaaggttaccaagatacactgtatgtacattccctaaggcaattctacaaaagctgtgacatttatggaacagtggacttcatatttggcaacgcagcagcactactccaggattgtaacatgtatccaagacttcctatgcaaaaccagttcaatgcaatcacagcacaaggcagaacagatccaaaccaaaacactggcatctccatacaaaactgttgcataatagcagccagtgacttgggtgatgctaccaacaattataatgggataaagacatatttgggtcggccttggaaggagtattcgaggactgtttacatgcaatctttcattgatggcctaattgatccaaaggggtggaacgaatggtcaggggattttgctttgagcacgctgtattatgcagagtttgctaactggggacctggttctaacactagcaatagggtcacatgggaaggttaccatctcattgatgaaaaggatgcagatgatttcacggtgcacaagtttattcaaggtgagaaatggctgcctcagacaggagtgcctttcaaagctgggttacagtga

SEQ ID NO: 49288 - DNA, 2052 bp, Glycine max
  Peptide Sequence Number=SeqID_166066
atgcctatacctcttatggcttctccaactcttcttgtcttcctcctatttctctctctcttacaccaagttgcctccaaggctgtgatctttgaaggattcgatgaaaacagtgaactcaatcttcaaggatcttccatcatcaaaaccagccgtttgcttaaactcaccaacagatcaaccaatattgtaggccatgcattctatgccacacccttccaaatgcttaacaaaaacaacacaaaccctccactccaaccctatgcttattccttcagcaccaattttgttttttcaattgtgtccccaatttctggctctggtggctttggccttgccttcaccatagcaccctcaacacagtttcctggggctgaggctggccattatcttggtcttgtcaactccgccaatgatgggaatgactcaaaccacatttttgcagttgaatttgacacagtaaatggttacaaagatgactcagacactgaaggaaaccatgttggggtcaacatcaatggcatggactcaatcattactgaaccagctgcatacattgaagagggcactgataatgtaaaggaagatttcagaatggctaaggttgatgctgtccaagtttggatagaatatgatggtgaaaagaaaactctgaatgtaacaatagctcctttgccattaccaaggccaagcaaaccaattataatgaatcataacattgatctctacaatgttatggaagaaagcatgtatgttggtttctcagcatcaacaggccaagaaacaagctctcactatcttctaggatggagttttgtagtgaatggtgttgcccctctactgaacatttccaaccttccaaagccaccaccaaaggagaaagaaccaacctcatttccttgggtcaatgttgcaattggcatcttgtctggtttgactttttgccttttgtgtattctgttttgcctaacatgttataggagatacatggattttgaggttcttgaggactgggagatggattgtcctcacaggtttaggtacaaagatcttcacatagccacaaaggggttcatagagagccagctcattggagttggaggctttggtgctgtgtacaaaggtgtgttgccttccacaggagctgaggttgctgtcaagaggattgtgagaagcccttttcatggaatgagggaatttgcagctgagattgaaagcttgggaaagttaaggcacaagaatttggtgaaccttcaaggttggtgcaagaaaaagaatgatctactcttagtctatgatttcattccaaacggaagccttgattatgtcctatataaacccaacaacaacaataactttgttttgaattgggggcaaagattcaacattctcaaagacatcagtgctggactattgtacctgcatgaagagtgggagcaagtggtgatccatagagatgtgaaaactagcaacattttgattgatgcacacttgaatgcacgtttaggtgattttggacttgcaaggctctataaccatggtcaagtgtcacacacaacaagtgtggttgggactattggttacattgcaccagagttaactcgcactggaaaggcttgtgcaaacacagatgtgtattcatttggggttgtgctccttgaagtggccacaggtaagaggcctcttgattcggatcagtttttcttggtggagtgggttattgagaattaccatttgggtcaaattcttgaggtggttgatcctaagcttgattcactttatgatgaggaagaagttgagttggttctgaaattgggtctactttgcactcaacatagagcagattatagaccttccatgaaacaagtcacaaggtacttgaactttgatgaccctcttcctgatattgctgattggggacatgatgtttctggcagcagtagattgagtgaaggtttcttagaagtcacgtcttctatgggaactgttgaagcattagggtatttgtcttccattagcatgagtactaagtccatagatgctggtagatag

SEQ ID NO: 49289 - DNA, 681 bp, Glycine max
  Peptide Sequence Number=SeqID_166067
atggtttgcgtgggtgctatcagtaccgatgccgtactgcatctggctgaagatgcgcagttcgcaggcgctgatgcgctgctgctgccggcgatgagttaccagccactgcgtaatgaagaggtgtatgccctctttgagacggttacccgccatgcttcagtaccggtttgtgtttatgacaaccccggaaccacgcatttccgctttaccgacgaactgctcgggcagctgtcgtcactgaaagggattcgctcaattaaaattccgggagtaccggatacccccatcgctgcagctgaacgcgtcgctgcactgcgacaacatcttcgtcctggcgtgaccctgggtattagtggtgatgccagtgccgggctggggctgaacgccggttgcgaagtctggtattccgtttgtggcggtatcttcccggaaaccgccaaacaaattacgcaggccgcagccattaacgatgctgaacgcgttactgccttaactcaccgcctgcaacctttatgggatctgttccgtaagcatggcggaagtctccgcgtgatcgcagcggcagcaggcttactggggctgaccgatgccgactgtctgcctcgtcccctgttacccttatcggtcgcagaggtggcagaagtagcagcagtgatggccgcactggaccttaagtaa

SEQ ID NO: 49290 - DNA, 294 bp, Glycine max
  Peptide Sequence Number=SeqID_166068
atgacccacacccgaaacatcatttcttctccgatcgcaaatacaaacccagaacatctaacttcctcggaactccacttggatttcctcaaaagggaatcgaaaatggcagaaaaaatagaggaacttacagagtcatcgttcgatgtggaggggttggtggtgaagaggattgaaagggtggcaatgaaaagaagagaaaatatggcagagatgaagatccgaaccgagaacaagctacaaaaactagaaccacctctgcctcctctcgcgacaaccgccattggatattga

SEQ ID NO: 49291 - DNA, 243 bp, Glycine max
  Peptide Sequence Number=SeqID_166069
atgaaagaagaggtgcgaaaggaagtacttaaattgctggaagcaggactcatttatcccatctcagatagtgcatgggttagccctgtgcaggttgttcccaagaagggaggcctaggatcttcttcatcaatggattcctttgcttcttggaagatgaatggcagcggaatggagaaggaagagagagaggagacaccacttcaaggagaagatgagtctagaagaagctcaccaccatag

SEQ ID NO: 49292 - DNA, 306 bp, Glycine max
  Peptide Sequence Number=SeqID_166070
atggcagcgcaattaatccatgatcacgtgtggactgtggagtggatactacctacacctactcaacatcgactagtggagccaatccaagtgatagaggtgtcatcctctgaagaggatcctgaggaggacccagaggagttacctcctgagcctgctgtggatgctcttgacctttcagaggatgatgaagacccacttcctgttgtggattctccagaggatatcttgtcagcatctgaggcagactctacagaggagagcggccctggagggacagcgaacagtgaagactcttcatcatag

SEQ ID NO: 49293 - DNA, 795 bp, Glycine max
  Peptide Sequence Number=SeqID_166071
gttctcaacaacttcttaaggactagaaacctgacttacatgtgcaagatgattcatagcgtgttcttcatcatagtcatgccaagagtaggatcaagggactatgcgtttaaaggcaatttgaaccccaaggtgaagaagaactttattccttatggaatgctctttattcgaatcaggagactagctggagtggatgtctcttcaaaggagccatcatctggagccacttcgctgaagagggaaactttagctctgtcatcttatgttgatcatactattggaactcaagctaatcctttggatcttgagtctggagcttctcctcaacagatacaacgttctctcatagacgctaaggagaaggcaagagttgaaaaggtcttgttgaggaagaagaagagacgtagagctccaactagctatagagcaagaaaagatagttgcggaagaaagggaggctctagatgctgcaatgctcaatttgtaattaaagtatcattgcaagggtttgatgtttctactaaaaatgattccattgaaacaaaccttggggttgcacctcttcaacctcgtccaatcacaactgaagatgaagttgatgttgaacctctacttgctcatcctatgatgaagagagagaggagacgccacttcaaggagaagatgagtctagaagaagctcaccaccataggaggccatggataagagcttggaggaagaaggaaatgaacgaaggaagaggaagagaagagcacgaaattttgtgctctaaaagagctctgaaatctgaa

SEQ ID NO: 49294 - DNA, 537 bp, Glycine max
  Peptide Sequence Number=SeqID_166072
cttcattgcctaacaggccatcttacaaaagcaatccccaagagactcaacgtacggatgcacatgccaaagttgagtatgtgaaaagattgtatgaccaagtgaaggtgcaaattgcaaagaaaaatgaaaactatgccaagcaagccaacaagaaaaggaaggaagtggtacttgaacccggtgatgatcctggacatttgaggacaaatgttatccaagaaggagggaatgatgagaatcatgaaactggccaaatacaggctaaaggccgaagtggagaaggacgaaggcccaagtggagaaggacaaagcccccgaagtttctctctgggttccttgttgaaccaattatcagacttatcaaggtaatccttgtggcgtcttcccagacttatcttccttcattggaagtggcatctaccgtgacttatcttccttcaccggaagtggcgtctaccctgacttatcttccttcatcggaagtggcgtcttccaaactctataaactgtatcaagcaatccgctcctactcag

SEQ ID NO: 49295 - DNA, 255 bp, Glycine max
  Peptide Sequence Number=SeqID_166073
atggtgaagaagttgggaaaatttctcaaaagatccaaagatagaagattctctaaaccttcaaagaagacagaaggcaacaacaacacctttcacatgcttcaaatgtgggaagcaagtgaagaagacgttgcaaatgtgtgcttgatgatagattcaatggatgactcttcaaccattgaagaaactgaggtgtgcctacaagcaagagactcactatggtacttggatagtggctgcttgttcgaactctag

SEQ ID NO: 49296 - DNA, 247 bp, Glycine max
  Peptide Sequence Number=SeqID_166074
ggtgcccgttccccccggcaaggtcacgtcatcatagctctaattacgggtctctgtcagttctacggagtgcttgtcacctccggcaagggcatcaggccccctactaatcgagctttcatcaagaagtactgcatccccaggcaggcgcagggcgaaacaccacagcagcctggggatggccggcagcgggcaacagacgcatcgccatcacctctagagttcacctcagctcatccacaaaaag

SEQ ID NO: 49297 - DNA, 336 bp, Glycine max
  Peptide Sequence Number=SeqID_166075
atgcatgttcctgagtcttttgaaaccagagctgaggtgttggagctgatgatggatgcagaaaaatcaccgagacactttcatcacaaagattttgaagggaaagttcctactcctgcaatattgaagtctgaaccattgtggacagggaaacaagttttcaatctcatcattcctaaacaattaaatttaattagatatttctggctggaagaggttgaccctgattcagctcagaaatttcttggtcatactaagtggcttgtaaactactggcttttgcagaatgcttttagcattggaattggagacgcaattgctgatgcttttacttag

SEQ ID NO: 49298 - DNA, 987 bp, Glycine max
  Peptide Sequence Number=SeqID_166076
atggaagaagagagacatggctcatcggaatgttcaaagacaagcccttctaacgaagaagattgtgaagaaagtgagggctatgaagatgaaagcaagcaaaacaacaataatggaggaagctcaagcaacagcactgtggaagagaacgagaagaagacaacagtgaggccctatgttagatccaagatgccaaggctacgttggacacctgatcttcatcttcgctttgttcatgctgttcaaagacttggaggacaagagagagcaaccccaaagttagttcttcagttgatgaatatcaaaggtttaagtattgctcatgtcaagagccatctacaggagcaagaaggtagacacaaatcaagatatggatatggggatgcttctctcgctatctatgaaaacatggtgcacaggcctttcatgaatagaagttcattagatgaatctggagctgaattttgtggcagcagattaactgagagaatccatgggaccaatagtaacatcaattggactcgtaacatgttccaagttgattcttcttctagtttcaatgaaccatcaacaagcaaagtccaagaaccaaaacataagttcttctcatttggtggtaatgaatcctcatgcacacaaatcaaaatgagccaggttgatctacatcaatcaactcagctgcaaccaggtgcacaagagctcatgcctaataataagtttgcaacaaatgaggtggaactgaagaccttgaaaagaaaggcttcagatattgaccttgatttgaatctgtcacttaagttaaattcaagggtcaatgctgagaaccaaggaagcatggtggaccatgaagttgttgatagcaatctatcactttctttgtgttcacaatcctcctcctttagcagcaacaggttgaaaaactcacaagatcactctaaggagcaaggggaaattattagagccagtgctctggatctaactatatga

SEQ ID NO: 49299 - DNA, 258 bp, Glycine max
  Peptide Sequence Number=SeqID_166077
atgactccattgatgaaaaagatccaaggcctacaagctctacatggagctacatcatgtactgtccagggttcacaaagtacatgtgtcatgctatatggaactctgagacacacttcaaccctccatgtcagccctagcgccggagtcccccttcttgtcctcctaacaaaggccactctcagtccaacgtgcaaagtccaagagcctaccttagctaggtccactctgatgagtgccagctctgaattttggtaa

SEQ ID NO: 49300 - DNA, 228 bp, Glycine max
  Peptide Sequence Number=SeqID_166078
atgatgatttggttggtgttgttgctgttaaaaggtggttggccatggaagaaggcatcatgtaggaaggtggttgtcagaggccacatcgtcgacaatagagacatcgaggatggtggttgtcgtgtgcaagggtgttgcatgcgatgctgcgggggtaatgcatgggtgctacgagctagggtggtgttgagaacgaatgaggggtttcttttggggttttattaa

SEQ ID NO: 49301 - DNA, 402 bp, Glycine max
  Peptide Sequence Number=SeqID_166079
atggcacatcaacacgtcattagtcatttcttcaaaggctcgtcaaacccaaggtctgcccttggctcatcaaacccaaggttcgcccttggtgagtctcacatcgtcaaaggctcacaaaacccaaggtctgcccttagtgagtatcgtttctccaaaggctcacaaaacccaaggtctgcccttggtgagtatcatttctccaaagactcgtcaaacccaaggtcttcccttggtgaggcttgcatctccaaaggctcgcaaaacctaaggtcctcccttggtgagtctcttttctccaaagacttgtcaaacccaaggtcttcccttggtaagcctcatcacaactctacaggcttgtcaaacccaaggtcaacccttggtgagcccctccattgctaa

SEQ ID NO: 49302 - DNA, 1599 bp, Glycine max
  Peptide Sequence Number=SeqID_166080
gtgtcgagggaagaagccccagagtatcaagaacctctggatttgaggtcaaatcctttccatgggggaggggatgatgcaatcctacccctcaagggtctcgttctccccttgaccatgttccagtgtgctttgcttgagcacttgaatgtggcccttcccaactccaccccaatagttgggccatggatgggttgggtctccttgaactgtgtgtccaagaagctatttaagttcgactcaaatgtctttctccatttcaaggaccatttcttcaagttcctaacttctgatgtggtggcttatggtttgccactgatgttcaatcaagaagaagagcctcgattcatgttctattggcagtttgacctcaccagcttcaagtctttaaacgaggatctgttgacccttttggagagggttgacaaggctatcttggagcagctgtcaactttgctggacgtgcggatcattctatcgactgaactaacacttgcttgtgctattgttgctagttttgcaagaattatggttgatttcccttggaggtcacttctaaagcaggttggacctgatgggggtcaacctgctgttgaggttggccttgttactcatgttgccgagaccgccctcggtgctccttcctttgttttggcaaagaggaattctggttgcccttcgagtttgcgagatcttcctccgactcaactgaacgtcgaggctcatactcctattgttgctattgtttctgctcctccacctcctcttgtcgtgcctattcaagagattgctctagctgctaaagttgatgcaccagccacttcaactggtcttgtcatggtccaccatcattgtacccttgctgagtgcgagtgtggcaaccatgagtgctcccaagatgtcgtgtcctccttcttcagctccccgggttcctcccttggctgtgatgggtataagcccgaacagaagaccccgaagtttggctattatggaggagaatggacagcggcaccaggaggctctgagcaaggtggcgtccttggatgcaaagtggagcgccttaaggtagccaatgccatcgtcgccttcactaaagctatgaagttgaaccaccaactgccttccaaggttggaagtgttctagccaatttgctgcataccaggttggatagtgatgaactattcgaatgctgcaaggacttgcagggagagaaaaaagacttggctggcaagatgaagggcattgtgatggagaaggatgagtttgccaaggagagggaggccgataaggagcttgaagaggagctgcttatgtacaagaaggaggttatggagcagcatgaaaagggctttaacaaggctattaggaaagctaggttctttgataaggaccttgacttgggtctttttgacccattcaaggacgtgcaagatggtgttctacttgacgacaagaccttggtgatgtggagtcaagacattggtggtctttatgacttccacctgattgaaggtcttgttgaccagttgggtggcaacttgtttagtcttgtggaatctgaacctttgactatggttgtcatagttcccaaggagtga

SEQ ID NO: 49303 - DNA, 561 bp, Glycine max
  Peptide Sequence Number=SeqID_166081
atgggagaaaatgcactagctccaagagggagataccaactcgaaatactttcatgcaatggcttcaacaagaaaaagaatcaattgtatcaacgagctgcaaaatgcatagggggagatgctgttgtttctgatgaattaaatcatatgctcactgcttcgtttgaaaaagatgaactcaaggaagctttatttcatatgaaccctgaaaacacttcagggcttgatggtcttaatgcagcgttttatagaagattctggaatttatgtggtaatgagttttcaaagcttgatgttctggaccaaattggtgaagagcagtcaacctttgttgagggcaggaccattatggataattataaggtcaaagttaatcatgatctgataggacccattaacccaagactagggttaagttttggtgcaggaagtgaagcatttgctttgttgcaagcgatgaagatgttggctcaactaccctattacatggtgatattcgagaccaacagcaagcaatttgtggatcacttacagagagcggaatcatcattcaacaaataa

SEQ ID NO: 49304 - DNA, 444 bp, Glycine max
  Peptide Sequence Number=SeqID_166082
atggctggaaatcgtgagaacgcagctgcaggagcgaatcccattcgtgtaaggaggacacacatccgttggactgaagaggaacacaggaggtttcttcgcgggatcgaactatatggcgcgtcaaacgtgagagatattgccaagaatgttgtattgaccaaaactccagcccaagttagtagccatgcacagaagtatttccaacgccaaaagagtggcaagaaggcaagacctagcatatttgacattgaaccagtagtggcacagccacagaacatacatgacagtgagccagtagtggaacagccacagaacatacatcacagggaaccagtagtggaacagccacacaacgcagagctgccggagcaaccaatccaacaagggctaaaccaaccaaacaatataataaccaatgattttctagcaaattttaaatga

SEQ ID NO: 49305 - DNA, 294 bp, Glycine max
  Peptide Sequence Number=SeqID_166083
atgtgtccactcaggttcattctcatattcctgtcggcaactcttgctggcttcttggtcctcagaaacctgggatggcaacctgaccacatcactgacactgagttggaggacgcaaacaatgaagatgatcacaccaccctaacctcagatgctgcttctccttccttaaacaatgcaacttccatggttcagggtgcattgctatctgggttctggaacctccttgacatggctagcggtcgctatctttggaagcaattggtctcatcctcttccccaaagcctgaatga

SEQ ID NO: 49306 - DNA, 420 bp, Glycine max
  Peptide Sequence Number=SeqID_166084
atgccttcgatatcatctccctttctcctggttttaatctttgtgagttccttggagacagttttcagaaaagggaattttacttcaagactggcttcgttcatcatctacaggctggaagaaattgtgaagcagatgaagctgaaaataaagaaaagggctgcaggattgttgaaattagagggcattcatgaaggtaggaaggggattttatccattgatgctgagatctttgaggttactgcacttttgcatttggtggagatgaataaattaaacggggatacattggaatatgagaaaatattgaaagagataaggcgggctcttaaagatattgtttgggtttggctagttgatcgtcaagaacaatcacaacagttggagcaacagcagcagcaacaacgatcgcagtcttaa

SEQ ID NO: 49307 - DNA, 216 bp, Glycine max
  Peptide Sequence Number=SeqID_166085
atgttggcatatctggaggccatcaaccacatctttgttttcccagaggagctggtgctcccctttttcaaatcatgggcaacatgtgtatattataaagatatgggaaagaggtggtatattcttgtgctcgtggttgacaagttaggtgcttgtgggagtatgcttcagattcagaaacttgcttgcaaagcgtggaacacattcctcagctga

SEQ ID NO: 49308 - DNA, 108 bp, Glycine max
  Peptide Sequence Number=SeqID_166086
atggtgagaactgagaaatccgagacctacaactcaaactttctcatggcaatagacaataacctgtcctatagagataagcttgaagggaaaggtcgagaaggttaa

SEQ ID NO: 49309 - DNA, 441 bp, Glycine max
  Peptide Sequence Number=SeqID_166087
atgggttgtggaagtaatttggatgtgaataatttgttgtcacaaatagaggagctaaagctaaaggttgcaacaaatgaagaaagagtttttctgtatgaggaacaaatcatggatttgaagaagatgttggttaaagaagaaaatcaatctcaaccaaattctgaagttgttgttgaactaaggaaaaaaattgcaaagcaacatactaagactaacactgaacaaaagatggtcaagccaacttcggctagagttatttttaggtcaaagttgggtaaggctattttcaggccgacatcggccaagactattttttggccaacatcaactcaatttttccagcaaacgtcagttaatgatgttttctggccaacatcagcaggggctatttttttgtggatatcgagcataactatttttgctcaacatggatcgtga

SEQ ID NO: 49310 - DNA, 303 bp, Glycine max
  Peptide Sequence Number=SeqID_166088
atgggcccaaaatctaccctaaggctcatgagagccctagggctttctcttgcatctctgacccaatcttcttggagtcttctatccaatgcccttgtggggtccttgaaacttcaaaagtgttgtgggagatctttgccattagtctccatccaaaatgtgatcacgtgtccgttagttagacaagtcaatgatacacacacgaagccatatcgactatctgagatgatgacaatgaggatagcaaaagctaggtggttagcgatagcaaatctaaattggtggtggctcatggttgtttga

SEQ ID NO: 49311 - DNA, 276 bp, Glycine max
  Peptide Sequence Number=SeqID_166089
atggcgaaaaatttaaaattcgatgatagagagaagagactaacagaaagtggagttggtagggaggtacaggtggtgatgggaagaatggtgggcgacagtgaccatcaccgtcgtcatgttgtcgtttccggcggcgctgccgttatccgccgcagccgccgcttcgcgtctctgcacgaacattccgccgggactcattccgactccatgaagagatctcaattctcgggtgatgtagtgctaaataggtggaaattggaatcacaaatttag

SEQ ID NO: 49312 - DNA, 1249 bp, Glycine max
  Peptide Sequence Number=SeqID_166090
gatgatgttatttggtgacactcacaatccagagtctactcctttcccaaactatctagagattaattgcatattcctaagaacattaaacactttttattgctcatcctccatgggagcccttcccactaacgcttttcttgtaacaggtctatatccaacattaacaagtctacaagcattatctttgaacccttggaacatttacagcaaaatccggacccttcatgtggatattatggcttactatcaacactcaaaaagtcacagaccaggtcgtttaatctcttgggagactactccaactctgccttttgtgaagtttaacacagatggaagttcctttggaaatctgggaatagctggttttggtgtgaagagcaacggcgaacctatttccgttaagtcgcgaacgttcgttccgaaagccgcttccatgagcgcgagcaacaaatggagagcaatgtcgcaccaccagcatcagcctctgtgcacgcgcacgcaccagatcggcgccctcctcctcgtggcgaccaccttcttcttcacgagaatgctttccacctccacgctctccaccagcgtcgtccacgtgtcgcaaccccggttccagtgggggcagtcccagctatccctcaagatctacgtctaccaagaagacgaaatcgacggtttgaaggagctcttgcgcggaagggacgctaagatcacagacgaagcttgcctcaaaggccagtggggcagtcaggtgaaaatacacaagttacttctgcaatcgaaacaacggacatggaagaaggaggaagcggatttgtttttcgtcccatcttatgtgaaatgtgcgcgaatgatgggtggccttaacgacaaagaaattaacagcacctatgtcaaagtcataagtcaaatgccgtattttcgattatctggaggccgcaaccatatatttgttttccccagtggagctggtgctcatttgttcaagtcatgggcaacgtatataaaccgttccattattcttacgccagagggggatcggactgacaagagagatacaagtgcctttaatacatggaaagatataatcattccaggtaatattgatgatggtatgactaaaactggggataccacggtccagcctttgcctctgtcaaagcggaagtacttagctaattatttagggcgtgcacaaggaaaagcaggtcgtcttaagcttatagagctttcaaagcagtttcctgagaag

SEQ ID NO: 49313 - DNA, 401 bp, Glycine max
  Peptide Sequence Number=SeqID_166091
atgggccctatgctctctcctagagaactgctaggcatgacggagtcagcatcagagggactattgctgggactcagagaaaccgtggataagttgctctatggaatgcctcatctagacagaggtgacaaaaaggttctcaacaccttcgtgaggacatccaacttgatctacatgtgtaggatgatccacagtgtgttattcaacatactcatgcctaaggccttcaaggacaagttcaaccctaaggtgaagaagaaccccaatctttatggaatgctcttcacccaaatcttgaggctagatggagtggaggtttctttgatggatccatcatctggagccactcagctgaatggggctaccttcgtgaagatgggaattgctaaaaatttcccaga

SEQ ID NO: 49314 - DNA, 378 bp, Glycine max
  Peptide Sequence Number=SeqID_166092
atggcaagtggtaaggacaagtccaagaaggaaggatcttctccacctaagcaacaaggttcaaagtctccaagtggtaaacatgttcctaaccctagcacttcttctacttctaggagtagttcaattaaatgctttaaatgcttgggtagagggggtagttgcattaatgtgtcgagctcaaggttggttagcatacttaacatcaaaaccaccccacaccctaatccttattgcttgaaatttccatgtgaaaaaggtgaattggttgtaggccagcaagtgttgatgagctttacctatggaaaatataaagatgttatgttgtgtgatgtagctcccattgaagcatgtcatatcttgttgggtaaaccatag

SEQ ID NO: 49315 - DNA, 423 bp, Glycine max
  Peptide Sequence Number=SeqID_166093
atggcagatatcttcgatgggtctggggctatgcccgccgcggaaaccatcacgaaggtagaaggagctctatgtgagggtgttgaagactgcttccaggtgttgaatgtggtctgcccaagaattattgtagaccaatatatcgtcgaagaagactgcaatgaatttgcacaggaatggtctgagcaattcgttcatcgtggcctggaaggtggccggcgcgttgcagagcccaaagggcatcacgcagtactcataatggccggtgtgggtgcgaaaggctattttggggatgtcttcttcggccatcctgatttgatggaatcactggccattgagcgtgcgataatccacgcagcagcgccagctaccgtccttcttcttcacaaggagcacaggagaggaataagggttgtgacttaa

SEQ ID NO: 49316 - DNA, 1014 bp, Glycine max
  Peptide Sequence Number=SeqID_166094
atgcataagcatgagtcccctgttggctatgtgtcagacatgaaaatcctgtttatagtcaagggttcttctcttatcagccttgcttatggtaggagttggtcttccacttcttcaagtggtatttggtcatctgagtggcttgttcctagggtagtgtctaatcctatcaaaacaagagctgatctttctgctgctgaaacccaggttcggaaattattggagcagttaaagtgcgattctgttcattgtaagagagaggcaacagcagaactccaccttcttgctaaggaaaatatggataaccgaattgtgatctcgaattgtggagccattagcttaatagtcgatttactgcaatcaacggatactacaatccaggaacattctgttacaacacttcttaacttatcaatcaatgataacaacaaagctgctattgctaatgctggtgcaattgaacctttgattcacgtccttcagatagggagtccagaagccaaggagaattcagctgccactcttttcagcctatcagttactgaggaaaacaagatcaggataggcagggctggggcaattagaccactggttgatttattagggaatgggacccctagagggaagaaagatgctgccactgctttgtttaatttgtcattatttcatgaaaacaaggatcggattgtgcaagctggtgctgtgaaaaaccttgtagatttaatggacctggcagccggaatggttgataaggtagtggctgttttagcaaatcttgctacgataccagaagggaaaacagcaattggtcagcaaggtggcattcctgttttggttgaagttatcgagtcgggttctgcgagaggaaaagagaatgcagcagcagctcttctacatctatgctcagacaatcatagatacttaaccatggtgctccaagaaggagctgtgccccctttagtagcattgtcacaatcaggcaagggccaaagaaaaggccttggctctccttaa

SEQ ID NO: 49317 - DNA, 531 bp, Glycine max
  Peptide Sequence Number=SeqID_166095
atggagtgcatcagtaaccctaccccttgtgaagggtcatcatcatcttccaagcactccaacaagagcaataaggagaaaaagggtgtgaggaaaagcaacaaaggtggaggaggaggaggagtgaggctttccactgatccacaaagcgtggcagcaagggaaagaaggcacagaatcagtgacaggttcaagatccttcagagcatggtccctggtgggagcaagatggacacggtttccatgttggagggtgccattcactacgtcaaattcctcaagacacagattttgctccaccaagcgttgatagactttgtagatgttgatcatcatgagtctccactgttcctcccctcagagtataataatttccctgatgaacactccatttcccttcaacaaaacccttcttcatcagtttcggtgcattctcatcataatcagcagagtttaccacagttaccactggcacagtgctacttccaaggtgaagaagatttcaacacctttgatgccatgccactatga

SEQ ID NO: 49318 - DNA, 378 bp, Glycine max
  Peptide Sequence Number=SeqID_166096
atggtgtcggcatccaccaccattggaacatggtcatcacgaactctttcaaaaacttcatttcctaaaggacgttcatttaggttgtgtttggttgctgctatttacatggagtgggcatggacgaatatcaacctaggtgcttatggaaatgagtggtatttgcggagagggttcctttttacaaagggtgtcgccatcactaatgatgagacaccagtctcgccaatggaaggggcgagacaggatgaggtggaggcagtctcgccaatgggaggggtgagacagactgatgtggatggtgctgtgagtgcttgtggcaatacatggagaaggaagaaaatattatcagcctgtatagcaaaacaacggacttag

SEQ ID NO: 49319 - DNA, 1473 bp, Glycine max
  Peptide Sequence Number=SeqID_166097
atggcctccatttatgctccaacaagatcacttctcttcacccatacaaccaaatgcttcttccgtcccttcaaaccctcttcttctcccttccctctccactgcgccacaaaaaccacctgcagcaccctccaacaacaacaacaacaacctcgccgcaacaacagcaataacaacgtcatcggaatcctcgaagagcgtggtctggtcgagtccatcaccagcgacgcgctccgcagcgcgtgcctcacaccaccacccctcaaggtctactgcggcttcgaccccaccgcggagtccctccacctcggcaacctcctcggcctcatcgtgctctcctggttccgtcgctgcggccaccgcgccgtcgcgctcattggcggagccaccgcgcgagtcggtgacccctccgggaaatccctcgaaagacccgaacttgatgccgaaaccttggagaggaaccaaatgggtatctcgaacaccattcatgagattctgggtcgcgctcaaaattcgaacttggtgggtcccgattctgattcttctgttgtgattctgaacaactataattggtggaaggagtttagtttgttggattttttgaaaagggtgggtaggtttgctagggtggggtcaatgatggctaaggagagtgttagaaagaggttggaatctgaacaagggatgagttacactgagtttacttatcagttgttgcagggttatgatttcttgcacttgtttcagaatgagggtgttagtgttcagattggggggagtgaccaatggggtaatataactgctgggactgagttgattaggaagattttgcaagtggaaggtgcttatggtttgacattccctcttcttttgaagagtgacggcacaaagtttggaaagtccgaggatggcgccatttggttgtctccaacgtttttgtctccatacaagttttaccagtatttttttagtgtgcctgatgatgatgttattaggtttttgaagattcttacctttttggacattgaggagatagtttccttggagggggagatggggaagccaggctatgtccctaacactgctcagcggaggcttgcagaggaagttacacggtttgttcatggagaggatggtttggctgaggctcttaaagccactgaagcattgaggccggggtctgagacaaagttggactggaaaactatagaggggattgctgaggatgtgccatcttgttctttggcctatgatgcagttttgaatctgtcgttggtggatctttcagtctcttctggtttgtttgagagtaaatctgctgcaaggcggttgttgaagcaaggagggctttacttgaataataacagagtggatagtgaaagtaagaggattgaagctgcggatatagtggatgggaaagttctcctgttatcagctggcaaaaagaataaggtgctggtgagaatagcttga

SEQ ID NO: 49320 - DNA, 384 bp, Glycine max
  Peptide Sequence Number=SeqID_166098
atggctctaacaatatctgattttagttctgggaaggggggaaagagtccctgttcgcatgagtttcacacagcagcaacaacgttgaaactggatggggacgcgagcttcacacaacaacagcatcacggcctccatagagaagcagcaataatgcgacctacacaaatagcaacaacgttaatggcaacaaacacaaacaacacagccatcaacaatgtcatttctcacagggatgtaaagtatttgcggagggggtccctttttacaaagggtgtcgccatcaccaatggcgagacatcattgacagctgacgtggagacaatgggaggggcgagacagactgatgtggatagtgccgccaatgcttgtggcgatacatga

SEQ ID NO: 49321 - DNA, 1674 bp, Glycine max
  Peptide Sequence Number=SeqID_166099
atgacgacagccccggtacttactccgctggattttgatattcccttttgcttagaaactgatgcttctggtgccgccatgggagctgtcctatcccaatgttctcaccccatagcattcttcagtaagattttctgcccccgcctccagcattcgtcgacatacgtgagggagctccatgcaatcacagcagccgtggtacaaacaccagaacaacagcattacttggcgaagttattgggatacgactacactatcaaatatcggtccggcgcgagcaacaccgcggctaatgccctttcacgtatccccactcccggtcaatgccttgtcctctcgattccttccccggagtgtctcaatgatatcaagaatttcttatcccagtcatctgtttaccacaatctccggcaacaaatccaatcataccctgaggctcaccctgaattttcgttgaccaccgactggatccgttatcgtggtaagctgtggttgccacctaataacccattcattccaatgttattggtagagttccactccacccctctaggtggacatatgggcgagactaagacactccgccggctgcaagacaatttctattgggacaatatgcgccacgacgtccaccttcacatttcggaatgcagcgtctgccaacacataaaacatatcaaccgcaaatcggtcggacttctccaacctctacccatcccatcaagtttatgggaggagttgtcactggattttgtcaccgggctacccctttcccacggttacacggccatccttgttatggttgaccgctactccaaggacacccatctcggagccctgccacccaaattcactgcgcacaagtatgcaagctccatggcttcccctgtagtctggttttcggtcgcgatcccatcttcctcagtgcattctggcgcgaactcttccgccttagtgccaccaagctctgatacagtaccgcttatcacccaggaaccgatggccagaccgagttacaacacttctgtccattctggtaccggtctctctccatacgaagtcacatatggcaaacctcccccagcattgccacactacgtcgccggaacctctcccgtggaggcagcggactccatgttggttacccgccaggaccttcatcgcaaactacaacgacgtctactgaaagcccagacagccatgaaatcatttgctgatcgtcatcgccgggacgtgcaatttcaagttggcgatggggtttacgtgcgcctccgcccttaccgccaaatctcccttcgaccccgttactcgaagcttgctaaacgttactacgggccctaccaagtcacagagaagattggccttgtcgcttactgcctcaagcttcctgatggttcaaaaatacaccccgtgtttcatgtgtcgcttctgaaacttcaccatggagttcccccgactacggcaaacacccttcctccagaaaaacttgacaaccaccccatcgtcgagcctctctccttcctcgactggaaatggaacaccgaaactgaccccccatctcgcatggacgaggttgattttccaggggagggtgttgatagcagcaggatacaggacaatactaggcccaagagaactattaagaaaccagcccaatacaaggatttcatttga

SEQ ID NO: 49322 - DNA, 552 bp, Glycine max
  Peptide Sequence Number=SeqID_166100
atgtctgcccctgaaacatttcgagtctacggcacagtgtgtggccaccgcctcaccatccttgtcgatggcggcagcacgcacaacttcgtgcaactgtgggtggctaaatttctcggccttccctccaccatgatttcccccctaacggtgatggtcggcgacggaggcattatccaatgcacccgccgctaccccagcgtttccattaccatccagggtcatgctttcaacattgacctcttcgggttggcactaagtggcgtggatatagtgctaagggtccaatggttaaggggtttgggcccagacattactgactacacctccctttccatggacttcacccacttgggcctccccgttcacttggtggcggacgtgcctctcacacccccctctgcatcagcccagcagctaaagcgtatgctgcaaacccaagccatctccgttctcttccacattggcccgatacgcaccccttcttactcccccaccctcatcgttgatgatcaaccaccaccccctgactgtagatgcaattggctttga

SEQ ID NO: 49323 - DNA, 1485 bp, Glycine max
  Peptide Sequence Number=SeqID_166101
atgaagacattgttttacgtgtacaagagtccagtggaagtgccatgggaggcgacgcaatttggacttcctgatgttggggcaaaatttttcatcacacatgctgatctagcggaaataatatcaggtgacaagtgtttgaacatatctatcctgcagctgtggaccatttttatgaataactgtggtagaagcaaagttgatcagtcactgtatggtttgttggagcctcaatctatacacaatgctaaggacagacgtgaacaatgccaagaatacattcaaacatgggtcaaggaatcacaaaggcagttgtacttaggggcttacttgcatcaggcacattggcaactatttgttttgtgtccaagggaaaacacggttgttcggttttgttctctgaggaagaagccagatattaacatcaaagccacaattaacagtgcaatgaagacaataaccagttctttccaaggcatgtctaatcaagctgcaccttggtgggttgaaccaaagagtcatgtccaaactggagcgtacgagtgcggatattatgtcatgcattggatgtggtgcataatgactggtggattgaaggatgactggaacaagtggttttctgatggatcaccgttagacgtggaggccatcaccacacttcgccaaaaatgggcaacattctttttaactaacaacgtagacttggatgggctcgtcgttattggtggtgatgacttaaacactaatgtgtgccttcttgccgagaatttcaggtttatttgccatagtcaatggacttcgtttgccctattggctttcactgtgccactgaaatctctgctcttcttactcttccttcacctcttcaagttcagtggttatggtaacgtagggttctcaacgggatacagctgcgctaggcaattgaaaattgatgcaacgtgcaaagattcatgggttggattctcgggtaggtggagtagcaaaggcaagttcatccttatcttggtcatgttctttgggaggctcaagaaattcaacatgaaaggtggcaaagcatggaagctctcctggccagttgactgtgatgagcacaagagtttgtgcagcaaatatggagtctctgggtacccaacaattcaatggtttccaaaaggatctcttgaacccaaaaagtatgaagggccacgcactgctgattcacttgctgagtttgtaaatacggaaggagatttgctcgcgggaacaaatgtgaagattgctacagctccttccaatgtagtggtgcttacatctaaaaattttaatgaggttgtcttagatgaaaccaaagatgtcttggttgagttttatgcaccttggtgtggacattgcaaaagtcttgctcctacttacgagaaagttgccacaacatttaaattggaggaagatgtagtaattgcaaatttggatgctgataaatataaggatctggctgaaaagtga

SEQ ID NO: 49324 - DNA, 947 bp, Glycine max
  Peptide Sequence Number=SeqID_166102
catacattgacgggattggctgtgggaagcagggtaatgcggtgagcaacttgtcatggaggtggaagggtagtgggttctggaaaagagtgtggtatttggttagcagagcttcaatggctagaaaaggggcgcttgacctagggcatagaaactggagtaggcccaatatcaatatcagcatggagttcaatatggtcaggagtgtggcgggacatatgtgggttcaatcgaggatagacccattgcaaaccaaaacacataatggggaagtcatggcggtggccaaagagatgaaaggtatcgggggtgaaggaggaaaacaaggttttggtgaaggttcggaagggttgttgtctgcgataaagagaaggatgtgtcccttgcaacgatgggtccaagagaaggtgagggtaatggagatgaaaatggggaagtttgaggcagatggcaacggtcacgttgaagatgaagtagctgataaggcaatatggtggaagcctgatgacacggttcaccagacattcaaactcggccaaatagtcattgaccaacccggggagaagctagagccaagggcttgtaagaacctagaccaggaagtgatgaatccattacggaacatccactggtaccagcttaaggcaggatcgtccaggagtacgttggacggggccagaactggaagtggaaggcgaggtgtgaaaggtaagatgattgaggcggtcgaggatggaatcgactttatccacaaggtcggagtgtttgttagtgagggaggtctagttgacagaaagatgggaaatagcctccttgaggcgatcggtagtggttttgcgcgtggcgtgttcggccatggcaggcaatctgttttggaagaggttcaacatagtgaggttcttcatctctgcaaacctcgtcagaggctcgagagtgtggtgaggaag

SEQ ID NO: 49325 - DNA, 366 bp, Glycine max
  Peptide Sequence Number=SeqID_166103
atggggagagatgcatcaaagtttattcatatttctcccaaagatagtgaatatgtgatctatggagacaacaaacaaaggccacttaatcaacaagcccaacaagtgatatcaaatgataccaacaggaaatgtcttctaactatgagacaactttgtggaatcaatgacttccaagattattttgatgatgccaaagaatcaagagttaagcaagttctaaagaatcaggagtcaaaaagcttcaagaatcaagtttcacagaatcaagattcaagaacaatcaagtttcaagattcaatcaagtttcaagaatcaagattcaagaacaatcaagatcaagattcaagactcaagattcaataa

SEQ ID NO: 49326 - DNA, 588 bp, Glycine max
  Peptide Sequence Number=SeqID_166104
atggtgcagtggcccaatccgaaaacccctaaggatttatgtgcatttttgggactcacggacttttaccgtaaatttattaaggggtatgcagccattgccaacccactcacttctctcctttgtaaggatgctttcacttggacatccgctactcaaaccgcatttcacaacctcaaggaagcaatgacccgagctcctatcctggctcttccagactttagtcttccttttatggtcgagactgacacttctggcatggcaataggcgtcgttctttttaaacaaggacatccactcgctttctttagcaaaccttttggaccccggtatgattactcaattcagtacaagacgggtgcgtccaacatagtcgatgatgctctttcttgcattgtttctccgactaatggccaacgtctcattctttccatgcctaatttcatgtttctcgactacctccgccgacccttcactctagcccagctttcaggactcagttggctcacatacaagaacaaccttcagcttatccagattttcaaatctccaatgagctattattctttcaagggtgcatttggttag

SEQ ID NO: 49327 - DNA, 780 bp, Glycine max
  Peptide Sequence Number=SeqID_166105
atgtacctcatgaataggtttgcaacccttagagacaaattaaaaaattacattggtgaggttatgcctaagcccctgaaaagacatgtagtggctgccatacaattcaaaaaatttaaggttgtggattatatggataaatattattcaagggatacatatggtgtttgttatggacataagggtcctggtagaccaaagaagttgagaaggatagagcctgatgaagaccctaataggacaaggctaagaagggatacaacttcttataaatgcagtcgaagtggagcaacaagtcacaataccatgagatgtacattgcaacctcctatagtacctgaagaagtaaacgaggaagttagtggagctgttgaagtgaatctagttgagggtggaaatgagggtacaactaaaggtgcatttgctggagttcaaactgggctagtgaatctaattgagggtggaaatgagggtgcaatcgatcctattcagcatcaaaggaatgtcaaccaacaaatcaaatctacaaacataaacaataaggggcccggtggaaaaaatagatctgtgaatgaaacacttaagaaaattgctcctaaacataaggcaccaacaacaaatattacaaatttaagcaaaaacaaaatgaaaggttgtaacctaccaactgttgagaagaaggttaagaaggaaattggtcttgctgccactcatgccaaggcaaacacatcaattaacaaagctaaaggaccagttgaagatactaatagacaaaaatag

SEQ ID NO: 49328 - DNA, 313 bp, Glycine max
  Peptide Sequence Number=SeqID_166106
aacttcagtgtcaaccttgatagcacacatcaaaagtgctaaaggatacaccacgacgtaccacaaagcatggttggcaaagcaaaaggtcattgacaacatctacgacaactgggaaaagatcgtaccacaatttaccgagattgttgtaagctatgcaacaatttcttcctggtatggtcatggagaaggaaacactaccaatgccacccacaaggagggtaccctccttatggcaattacactagatgacaacaataaaattcttccaatagcctttgctgttctcaagagtgaaacagcgggagcatga

SEQ ID NO: 49329 - DNA, 555 bp, Glycine max
  Peptide Sequence Number=SeqID_166107
atggagctactgagaatgttcacttcgatgctatggaagttagactggaaattaggaagaagaccaaacaaagactcaactaattggttgctgctttcaagatctcaacctcagactgaactggagctagtgcttgttttggatgaaaatgtcaaactttttcatggcgtcaagggatacaaattgtctaaagggaaaaccagcaaccaagcatggagagaaaagatagatattgacacccaacgcttagacctagaaatgcataagattgagcttcaaaagttaaatttgatcaagctaggaaaagaagtagacaagccaattcttattcctaaggcaacctgctacaagggtaaagagaagttgcttgaagatgataaagatacacccccaatggaactaacaagtggggattggcaagctctacaaaggtaccacagattaggagctcactactatggtctggaacctaaggagatgccaccatcaaatggacttcatcacaagactaggcattgttatcagactattaatcacaatcccttttgtggttga

SEQ ID NO: 49330 - DNA, 1132 bp, Glycine max
  Peptide Sequence Number=SeqID_166108
atgaagggatcaaacatagggttaggtcggatcttacttgtagaggagaacatgtgtgaccaaagcgcaagccacctttatctctctctctctcacaaccctctcatcgctatcatggacaatgacatctttgctaacaattcttgttgtgttgagcttgttaacatgtggatggagaagggtttggggcatgacttacaaggtattgctagagagctcgttgggagaaggggaaaaaattggaagttttcaaggatgttagaacagttactgatatttacaagaggagggttaatcctctggacttgtaaggaacttgggaacgctctgaaaggttcacctatcgataccttgatccgttcctgtcttttggaggagcgatctggtgcggcagcatacaattatgatgcccctggtgcttcctacaccctcaagtggaccttccacaatgatcttggtcttgtttttgtggctgtttaccaacggatccttcacctcttatatgtggaggatctgcttgctatggtgaagcgcgagttttcgcaagtttatgatcccaaaacgactgcataccccgatttcgatgagacctttaggcagctgaagatggaggccctggctcgcaccgaggatttgaagcggtcgaattcaaatcctgttgccgggaatgcgaagaagcaggtgcaggggaatgataaatctggatttgagggagggaataagaagaagaagagtggtggtggtgcggatggcgacgatggcaagcggaagttggagaatggacactccaatggaaattttcttgttgctaaagatactaacctgagtagggatgtgaatggtagacataatggaagtcccaatgttggggcttttgatgtacataagcttcagaagcttaggaccaaaggtgggaagaagactgatactgttgttgccaaggcctccaaggcagagccaaacaaaaaagtcacgaagaaaaatagagtttgggatgaagctgcaactacagaaactaaactggactttaccgatcattccggtgaggatggggagaggaacatagattttgttgtggctgctgatcaaggtgaaagtatgatggataaagaagagattgttagcagtgaaa

SEQ ID NO: 49331 - DNA, 1950 bp, Glycine max
  Peptide Sequence Number=SeqID_166109
gtccttgatttaagtggaaatgatttaaacgggtccattcctacagatatttttcaactcagatcacttagtgtccttgaactatcttcaaacaagttaaatggcacgttgaagctagatgtgattcatagacttgaaaatctaactacactgggactttcacacaaccatttgtcaatagacacaaattttgcagatgttggcctaatatcttccatccccaatatgaaaattgtagagttggcctcttgcaacctgacagagttccctagtttcttgagaaaccaatcaaaaataacaactttagacctctcaagcaacaatattcaaggatctataccaacatggatttggcaacttaactctctcgttcaattaaatctttctcacaatttactcagcaatttagaaggacctgtgcagaactctagttccaatttgagtctccttgaccttcatgataatcacctccaagggaagcttcaaatatttccggtgcatgccacttatttggactattcaagcaataacttcagtttcactattccatcagatattggtaattttctgtcttccacaattttcctgtctctttccaaaaacaatttatctgggaatattccacaatccttgtgcaatagttcaaatatgctagttctggatttttcctataatcacttgaatgggaaaattccagagtgcttaacacagagtgagaaacttgtggtattaaatatgcaacataacaagttccatggcagcattccagacaaatttccagtatcttgtgttctaaggactctggatcttaatagtaatctattgtggggctcaattcccaaatctcttgcaaattgcacatcattagaggtgttggatcttggtaacaatcaggtagatgatgggtttccatgcttcttaaagacaatatctacactacgtgtcatggttttgaggggaaacaaattccatggtcatattggatgtcctcatgctaacagtacttggcatgtgcttcaaattgttgatctagctttaaacaatttcagtggtgtacttccaaaaaactgcttcaaaacttggaaggcaatgatgcttgatgaagatgatgatggatcaaagttcaatcacattgcatctccagtccttaagtttggtggtatatattatcaggattctgtgacacttacaagcaaaggtttacagatggagtttgttaaaatcctaactgtcttcacatctgttgacttctcatccaacaattttgaaggaacaataccagaagagcttatgaattttacaagacttaatttgctcaacttgtcagataatgctttagcaggccatatcccttcatctatagggaatttaaaacagcttgaatcattggacctgtcaagaaaccattttgatggggagattcccacacagcttgcaaatttaaatttcctctcgtacctagacctttcctctaatcgtctggtgggaaaaatccccgtaggtaaccagcttcaaacatttgatgcatcttcctttgttggtaatgcagaattgtgtggagcacctttgactaaaaagtgctctgatacgaaaaatgcaaaagaaatacctaaaacagtttctggagttaaatttgactggacttatgtatcaattggagtgggttttggggttggagcaggattggttgtagctccagcattgtttttggagagactgaaaaaatggagcaaccataaaattgataaaattctccttgtcattcttccaatgtttggtttgacttggatacctactgatgatgatgaagcagaggaagatactgaagaaaataactcggacatggaagaggagtctgattacaatgaggatcaaaatagtttggtccatcaaaggtttcaagggtggtattgtgtgttgtgttcaaagcttgatatcagtaagaagaag

SEQ ID NO: 49332 - DNA, 6315 bp, Glycine max
  Peptide Sequence Number=SeqID_166110
atggcagcattgtttttcttccttttctgtgtttactacaccggggtaaaagcccaaattgttgaggatcaacaacaatcattgctcaaactgaagaatagcctcaaattcgagactaataagtctacaaaacttgtgtcttggaatccaagcgtagatttctgtgagtggaggggtgttgcctgtgacgaggatgggcaagttactggccttgacctgagtggagaatctatctatggtggatttgacaattcaagtactcttttcagtttgcaaaatctccagatactgaatttgtctgctaataacttcagttctgagataccatccggtttcaacaagttgaagaacttaacatatctgaatttgtctcatgctggctttgtggggcagattccaacagagatttcttacctgacaaggttggtaactcttgatatctcttctgtttcctatttatatgggcaaccactgaaacttgaaaacatagatctacaaatgcttgtccataacctcaccatgcttagacaattgtatatggatggtgtaattgtaacaactcagggatataaatggagcaatgctttgtttaaacttgttaacctgcaggagctgagcatgtcagactgcaatctctctggaccccttgatccttccttgacaagacttcagaatctatcagtcattcgtcttcatcagaacaatttctcatccccagtgccagaaacctttgctaattttccaaatttaaccacccttgaccttagttcttgtgaattgactggaacatttcaagagaaaatctttcagacattgattgtgagtggcacaaatttctcgggagcaataccaccagctataaataatcttgggcagttatccatcttggatctttctgattgccattttaacggaacactacccagttcaatgtcaagactcagggaactcacttatctggatttgtcatttaatgacttcactggtccaattccatccctgaatatgtccaagaatctcacgcatttagacttctcgagcaatggtttcacaggttcaatcacatcttatcattttgacggcctaagaaatctgctccaaattgatttgcaggacaacttcctggatggaagccttccttcctctcttttttctctccctctgctacgaagtattcgactttccaacaacaatttccaggatcaactgaataaattttcaaatatctcttcctccaagttcgagatccttgatttaagtggaaatgatttaaacgggtccattcctacagatatttttcaactcagatcacttattgtccttgaactatcttcaaacaagttaaatggcacattgaagctagatgtgattcatagacttgcaaatctaattacactgggactttcacacaaccatttgtcaatagacacaaattttgcagatgttggcctaatatcttccatccccaatatgtatattgtagagttggcctcctgcaacctgacagagttccctagtttcttgagaaaccaatcaaaaataacaactttagacctctcaagcaacaatattcaaggatctataccaacatggatttggcaacttaactctctcgttcaattaaatctttctcacaatttactcagcaatttagaaggacctgtgcagaactctagttccaatttgaggctccttgaccttcatgataatcacctccaagggaagcttcaaatatttccggtgcatgccacttatttggactattcaagcaataacttcagtttcactattccatcagatattggtaattttctgtctgacacaattttcctgtctctttccaaaaacaatttatctgggaatattccacaatccttgtgcaatagttcaaatatgctagttctggatttttcctataatcacttgaatgggaaaattccagagtgcttaacacagagtgagagacttgtggtattaaatctgcaacataacaagttccatggcagcattccagacaaatttccagtatcttgtgttctaagttctctggatcttaatagtaatctattgtggggctcaattcccaaatctcttgcaaattgcacatcattagaggtgttggatcttggtaacaatcaggtagatgatggatttccatgcttcttaaagacaatatctacactacgtgtcatggttttgaggggaaacaaattccatggtcatattggatgtcctcatgctaacagtacttggcatgtgcttcaaattgttgatctagctttcaacaatttcagtggtgtacttccaaaaaactgcttcaaaacttggaaggcaatgatgcttgatgaagatgatgatggatcacagttcaattacattggatctcaagtccttaagtttggtggtatatattatcaggattctgtgacacttacaagcaaaggtttacggatggagtttgttaaaatcctaactgtcttaacatctgttgacttctcatccaacaattttgaaggaactataccagaagagcttatgaattttacaagacttcatttgctcaacttgtcagataatgctttagcaggccatatcccttcatctatagggaatctaaaacagcttgaatcattggacctgtcaagcaaccattttgatggagaaattcccacacagcttgcaaatttaaatttcctctcgtacctaaacgtttcctctaattgtctggcgggaaaaatccccggaggtaaccagcttcaaacatttgatgcatcttcctttgttggtaatgcagaattgtgtggagcacctttgattaaaaactgcagtaatgaaacatatgggctgccaacgtcaccacatgcaaggcgatgcacatttggctggaatatcatgagggttgaattgggatttgtttttggccttgcacttgttattggtccccttctgttttggaagcaatggaggcaatggtactggaaacgcgtggacctcattctgtgtcgtgtcttcccacagctgaatcttgaatatgaaagcagtggaggacattgctatcaagttttaagcccaactgtgaatgatgcttctgggccaactgggaacactgagaatgtggttattgggcctgatatgagacctgctcgtgctacccccactccctccatgactaccccacggcacactgctcctccgccgccctcaaacgaggagcttgctcgtcagttagccaccatttccactcgtttggaagctgtctggaaacgtttggatgaccctaacgcatcttcttccacacgatccactgcggaatcaacttaccgtccacggcttaaattggatgttcctcgcttctccggcgacgacgctcctggatggatcttcaagatctcccaattcttcacctaccatcagacgcctgaggaggagagaatcactattgcttcgttttatcttgacggcgccgctctcgcgtggtaccagtggatgtatcgcaaccgccaaatcgtgtcgtggaaccagtttctcacggcgttggagacacgttttgcacctaccgcgttcgatgaccctcgagggaagcttttcaagctcactcagtcctccaccgtgacagcttacctcaccgaatttgaagcccttgctaatcgtttggagggtctatcagaggtagatctgctcagctgtttcgtctcgggccttcgcatggacattcgtcgtgaggtgcttacacagagaccaatcaccatttctcaggcaactggattagcccgattgcaagaagacaagctacaagacatcactcgcatgtcccgttcaaaagtgtggcattcttcgtcaactccgacgaaggaactcatcaaagggggttccgattccacgcctccttcgacgaacaccgctggcctcttaccaacaccggcggcaaagccacgattccgtcacctatctagtgcggagatggacgagcgtcgtgagaaggggctctgttttaattgtgaccaacgatggtcacggcaacacaaatgtggtgctcgtatttttttgatggttgctactagtgatgatgatgatcctttgataagtgaattggagcaagcagttgatcttttggacccgggtgattctgaaattcaggccgctcaattaagtctccatgctttatcgggttctcatgctgcggacacttttcgtgtggtgggcatgataggttcgcattcggttcatgtgcttgttgatggaggaagcactcataacttcatccaaaactcgcttgctctgaccctggggttgaatcgcagtgacattcccttttttcgtgttctggtgggtagtggccaagagcttctctgtgataaggtatgtcatgatgtgacgatgttgatacagaataattcatttcagcttgatttgtattccttggatttgcgtggggctgatatcatattaggagcacaatggttgaaacaattgggtccggttttgatgaattacaccaccttaaccatgactttcttccacaacaactcttgtgttgtgttgcaaggtgcttctccaacaccctctgtgagcctccattgctttcaaaaaatggcccgtctagaacccgaagcccacctttactcactccaaatactagaccaaacaccttcctatccagatacagaccaccacccacccaaaccctctctaataatacctgagaccatcccaattgacccccaaatacaaaccttaattgaccgttaccaacatatattcacagaaccaacctccttacccccatcaaggcctactgaccacaccatacccctcttgccaaacactgcccctgtatccgtccgtccctatcgttaccctcattcacaaaagcttgaaatagagacccaagtggccaaatttcttagctccggttggattcaaccaagcactagtccattctcctcaccggtattgttgttgaagaagaaagatggttcttggcgtatgtgtgtggactatcgcgctttgaatgctctcacagttcgtgaccgatttcctttgcccactattgacgagttattggatgaacttggtcatgcgaggattttttccaaactagacctcacttccggattccaccagattcgtgttgcccctcaagatgtgcacaagaccgcatttcgcacccatgacggccattatgaatatgtgcatttaggagcccttccttctaattatacggcatttaaagtggccgaactttttgtcaatctggtttgcaagcaccatgggttacctaagagcatcatttcggatcgggatcctattttcattagcaagttttggaccgagttgttcaaattcagtggtactttgcttcgcatgagctcttcttatcatccgcaaactgacggccaaactgaggtaacaaatcgcaccattgagcaatatttacgtgcatttgttcatcataaaccctctctttggcacaagtacctaccttgggcagaataccactataatactgcttttcattcttctgctggtatgacaccctttcaagtggtgtttggtaagcctcctccctccctgcctatttatgttgctggtgcgtcaagtgtggcagctactgatgcattactgaatgaccgagaggctgttttggagttgttgcgcgttaatttagccaaggcacagactcgtatgaaagcaatagctgatggcaagcgccgtgatgtttcttatgaggttggttcatgggtccatgtgaagcttcaaccttataggcagtcatctgtttctgggggtaagtacaacaagctcaataaaagatattatggtccttatcgtgttttagaacggctaggtcctgtggcctataaattagaactcccttcaaatgccaaaatccataatgtgtttcattgctcacttttgaagccatatgttggttccattccccccacagtcactgagttacctgagaattttgtagacaatcatcccatcatcactcctttggctctcttggcttcaagaattgtcaccaatgatgctggtaacaaagtctcgcaggttctggtgcaatgggatggtcttcatccagatgatacatcttgggagaattggagtgaaattcaagttgtttacaaccttgaggacaaggttggttttgatggggatggtattgatacaattgatacaagcccaactgtgaatgatgcttctgggccaactgggaacactgagaatgtggttattgggcctgatatgagacctgctcgtgctacccgtttaccaaccaagtttcgtgaccacatcctcttcaaataa

SEQ ID NO: 49333 - DNA, 906 bp, Glycine max
  Peptide Sequence Number=SeqID_166111
atggcagcattgtttttcttccttttctgtgtttactacaccggggtaaaagcccaaattgttgaggatcaacaacaatcattgctcaaacttaagaatagcctcaaattcaagactaataagtctacaaaacttgtgtcttggaattcaagcatagatttctgtgagtggaggggtgttgcctgtgacgaggatgggcaagttactggccttgacctgagtggagaatctatctatggtggatttgacaattcaagtactcttttcagtttgcaaaatctccagatactgaatttgtctgctaataacttcagttctgagataccatccggtttcaacaagttgaagaacttaacatatctgaatttgtctcatgctggctttgtggggcagattccaacagagatttcttacctggcaaggttggtaactcttgatatctcttctgtttcctatttatatgggcaaccactgaaacttgaaaacatagatctacaaatgcttgtccataacctcaccatgcttagacaattgtatatggatggtgtaattgtaacaactctgggaaataaatggagcaatgctttgtttaaacttgttaacctgcaggagctgagcatgtcaaactgcaatctgtctggaccccttgatccttccttgacaagacttcagtatctatcaatcattcgtcttgatctgaacaatttctcatccccagtgccagaaacctttgctaattttacaaatttaaccacccttcaccttagttcttgtgaattgactggtacatttccagagaaaatctttcaggtagcaacattgtctgttgtagacttatcattcaattatcatctgtatggatctttgcctgaattcccactgaatagtcctcttcagacattgatt

SEQ ID NO: 49334 - DNA, 378 bp, Glycine max
  Peptide Sequence Number=SeqID_166112
atgtaccctcccttgttctctttgaacaacctagtggatgtaccctccactagaactgatccacaagagatgtaccctctcttgttctcagtcacaacgacccaagtagatgtaccatctacttgtaccacaaagaatgtaccctccaatgtgttaagacaaagttctcaggcggttagtcctttaaaactttgtgaagggagaaacaaaagaattctcaggcgggagaagggaatgaaaaagatgaatagcacaagttttgttttcaaggtttggaaaaccagaaaacttaagaaagcgtttgcaaaggaagaagaagaagaagaagttcaaagagattcaagggttgtaaaggattgtaatgattgttctgaatga

SEQ ID NO: 49335 - DNA, 3417 bp, Glycine max
  Peptide Sequence Number=SeqID_166113
atggcacacgacaaggacgtggtttactttgacttagcttcaccatcttacactccttctgaggctaagtctttcccattcaccttttccttgcatatattcctaccgagtaattctaacatgcatccatgcaccactccaatgagaattccccatgtttcattgctttccttcatattctgctactgcttctggatacaccacagtgtttactacaccggggtttcagcccaaattgttgaggatcaacaacaatcattgctcaaactaaagaatagcctcaaattcaagactaataagtctacaaaacttgtgtcttggaatccaaccgtagatttctgtgagtggaggggtgttgcctgtgacgaggagaggcaagttacaggccttgacttgagtggagaatctatctatggtgaatttgacaattcaagtactcttttcactttgcaaaatctccagatactgaatttgtctgataataacttcagttctgagataccatccggtttcaacaagttgaagaacttaacatatctgaatttgtctcatgctggctttgtggggcagattccaacagagatttcttacctggcaaggttggtaactcttgatatctcttctgtttcctatttatatgggcaaccactgaaacttgaaaacatagatctacaaatgcttgtccaaaacctcaccatgcttagacaattgtatatggatggtgtaattgtaacaactcagggaaataaatggagcaatgctttgtttaaacttgttaacctgcaggagctgagcatgtcaaactgcaatctctctggaccccttgatccttccttgacaagacttcagaatctatcagtcattcgtcttgatcagaacaatttctcatccccagtgccagaaacctttgctaattttacaaatttaaccacccttcaccttagttcttgtgaattgactggaacatttccagagaaaatctttcaggtagcaacattgtctgttgtagacttatcattcaattataatctgtatggatctttgcttgaattcccactgaatagtcctcttcagacattgattgtgagtggcacaagtttctcgggaggaataccaccttctataaataatcttgggcagttatccatcttagatctttctaattgccattttaacggaacactacccagttcaatgtcaagactcagggaactcacttatctggatttgtcattgaatgacttcactggtcaaattccatccctgaatatgtccaagaatctcacgcatttacacttctggaagaatggtttcacaggttcaatcacatcttatcattttggcggcctaagaaatctgctccaaattgatttgcaggacaacttcctggatggaagccttccttcctctcttttttctctcccactgctacgaagtattcgactttccaacaacaatttccaggatcaactgaataaattttcaaatatctcttcctccaagttagagatccttgatttaagtggaaatgatttaaacgggtccattcctacagatatttttcaactcagatcactttgtgtccttgaactatcttcaaacaagttaaatggcagattgaagctagatgtgattcatagacttgtaaatctaagtacactgggactttcacacaaccatttgtcaatagacacaaattttgcagatgttggcctaatatcttccatccccaatatgaaaattgtagagctggcctcctgcaacctgacagagttccctagtttcttgagaaaccaatcaaaaataacaactttagacctctcaagcaacaatattcaaggatctataccaacatggatttggcaacttaactctctcgttcaattaaatctctctcacaatttactcagcaatttagaaggacctgtgcagaaccctagttcgaatttgaggctccttgaccttcatgataatcacctccaagggaagcttcaaatatttccggtgcatgcctcttatttggactattcaagcaataacttcagtttcactattccatcagatattggtaattttctgtcttcaacaattttcctgtctctttccaaaaacaatttatctgggaatattccacaatccttgtgcagtagttcaagtatgctagttctggatttttcctataatcacttgaatgggaaaattccagagtgcttaacacagagtgagagacttgtggtattagatctgcaacataacaagttctatggcagcattccagacaaatttccagtatcttgtgttctaaggactctggatcttaatagtaatctattgtggggctcaattcccaaatctcttgcaaattgcacatcattagaggtgttggatcttggtaacaatcaggtagatgatggatttccatgtttcttaaagacaatatccacactccgtgtcatggttttgaggggaaacaaattccatggtcacgttggatgtccttattctaatagtacttggtatatgcttcaaattgtggacttgtcagtcaacaatttcagtggtgtacttccaaaaaactgcttcaaaacttggaaggcaatgatgcttgatgaagatgatgatggatcaaagttcaatcacattgcatctcaagtccttaagtttggtggtatatattatcagggttctgtgacacttacaagcaaaggtttacagatggagtttgttaacatcctaactggcttcacatctgttgacttctcatccaacaattttgaaggaacaataccagaagagcttatgaattttacaagacttaatttgctcgacttgtcagataatgctttagcaggccaaatcccttcatctatagggaatttaaaacagcttgaagcattggacctgtcaagcaaccattttgatggagaaattcccacacagcttgcaaatttaaatttcctctcgtacctagacctttcctctaatcgtctggtgggaaaaatccccgtaggtatccagcttcaaacatttgatgcatcttcctttgttggtaatgcagaattgtgtggagcacctttgcctaaaaactgcagtaatgaaacatatgggctgccatgcacatttggttggaatatcattatggttgaattgggatttgtttttggccttgcacttgttattgatccccttctgttttggaagcaatggaggcaatggtactggaaacgcgtggacctcattctgtgtcgtatcttcccacagctgaatcttgaatatgaaagcagtggaggacattgctatcaagttttaagcttttctgctcacacaactgaagatgacattgcatctgaatctgacactactgaaggtggtaaagagattttggcaatttcactagttgagggcatgtttgcttaa

SEQ ID NO: 49336 - DNA, 504 bp, Glycine max
  Peptide Sequence Number=SeqID_166114
atggtgaaatcaatgggagtacagttccatgagatcaatagggtgattgctcctttagttgttgttcaaaacaataatgaagaagagcaacacaataatgagtccacgatacataatgaatctattgtggaagaatcacaagaggtaacattaaggaggtttcaaagagaaaggagaccaactatttcaaatgactatgtgatatacttatgtgaaacagaaacaggcttaagcattaatgataattatccagtttcattttcacaagctgtaagttgtgataattttgagaagttgttaaatgccatgaaagaagagataaattccatgaaatataattatgtttgggaccttgtagaattgccaaagggttgtaagtgggtcttcaagactaaacgtgactttcatgacaaccttgaacgttatgagactagacttgttgctaagggatttactcagaaagatgacattgattataaagagacgttttcaccaatctcatga

SEQ ID NO: 49337 - DNA, 3348 bp, Glycine max
  Peptide Sequence Number=SeqID_166115
atggttggcaatggcaaccaactcgagtgcaacaccatctgcgaggaaattccggtcaccattcaggctcacaattttcacgttgacttatatgttcttcccatttccagcgccaacgtggtgttgggcgttcaatggttgaaatcactgggaccagtgttgacggactacaatacgctcctcatgaagttctttcataatggtggtttgatcacactacagggagacatggatgcttccttgacctcactatcctctttccgtcgtttatcccgaaaacccgataatgccatgtattatcatatcaccctgttaccagacctcaattcaacaacccaccctcttcctcagcccgtccaaacactccttgacaaattcgattcactgttccaaccccctcagtcactcccacctccgagacacactgaccaccacattcacttgttaccacacgctgctccggtcaacgtaagaccgtatcgataccctcattatcagaagcgcgagattgaagagcaggtggattcgatgcttcagaggggcctcattcagcctagcaccagtcccttttcatctccggtgctcttggttaagaagagcgatgggtcgtggtgcttttgtgtggattatagagcactaaatgccttgacggtgcgcaaccggttcccaattccgaccatcgatgaactcttggacgaattaggcggagcttgttacttttcgaagcttgaccttctgcaggggtatcaccaaattcgaatgcatctcggcgacattctgaaaaccgcttttaggacccatcacggccactatgagttcaaagtcatgccgtttgggctctgcaatgccccttcttcatttcaggccactatgaaccagattttccgaccgtacctccgacggttcatcatcgtcttcttcgacgacattcttgtttatagtcactccatggatgaccatttgcaccatttagagcttacattccaggtacttcttgccaatcacttcgtcctcaagttttctaaatgcttctttgctcaactacaggtagagtaccttggtcatctggtctcacgttccggtgtcgagccccttccttccaagatcactgctattcagcaatggcctatgcctcagaccaccaaggcggtccgcagttttctgggcttagtcaggttctatcgtcgctttatacgagggtatgccaccattgctgcccctctggtcaaggcaacgaccgttgaccctttacagtggacggcggaaacccaacttgcgttcgagaatttgaagcaggcgttatcctctgccccaattctagccttgccggacttcagtattcccttcacagtggaaacagacgcttcgggtgtgggtatgggagccattttatctcagaaaggtcacccaattgcatttttcagcaaaccatttagcgccaaattacttcgctcctccacctacgttcgggaactctttgccatcacggccgccatcaagaagtggcgccaatacctgctgggtcaccgcttcatcattctgacggaccatagaagccttaaggaacttctcactcaagctgtgcagacaccggaacaacacatgtacttggcccgtctcatgggctacgattataagattatgtatcgatcgggagcccacaaccaagcagcagatgccttgtcgcgcgctcctgtgagttcctccactctctacatgattctttcagttccctgcttcaccttcttggaggaactcattcaacagctgaaacttcatgatgattatcttcgtcaacgtcagaacatcacaactgatcctaccagcttcgagggatttaccttgactgacgatttcatcctctttcgcaatcgaatttggcttcctcgcgatctgtccatcatccccactctgcttcgtgagtaccacgctactcctactgggggccatgccggaatcaccaaaactctgaccaggctttctgagaattttttttggtcaggaatgcgcagtgatgtctctacctttgtcgccaattgctttgaatgccaatgcacaaaatacgagaccaagaagaagcctggcctgttatgcccattaccagttccccgacagccttgggaggacctttcccttgatttcattactgggttaccaccttaccaaggccatactgtaatacttgttgttgtcgatcgattctccaagggcgttcatttaggaatgttacccacagctcacactgcgcatgcagttgcttctttgttcttgaacattgtagtcaaaattcatggtccaccacggagcttggtgtcggacagggatccattattcataagcaatttttggagagagctttttcgcatgagtggtacccagctaaggatgagctcggcgtaccacccagagagtgacgggcaaactgaagtcatcaatcgggttatagagcagtacctgagggccttcgtccatcggaaacccacttcttggggcagacttcttccttgggcagaatattctcacaacacgtcatggagctcgtccacggggaccacaccgtatgaagtgacctttggaagaaagccttttaattttctcacttacctcgcaggtcaatccaccattgacgcggtggacacgatactcacagaccgcaatgaagtttttcacatgattcacaagaagctgttgaagacacaagaggccatgaaacacaaagttgatctcaaacgccgtgaagtcacttacaaccctggtgattgggttttacttaaacttctccctcacagacaagtctctgccaaaggttctgagcaggtcacgaacaaactctctaagcggttttttggccccttccaagttgtcgagcgcgtaggcaaagttgcttatcggctccaacttccgcccgaggccaaattgcaccccgtctttcattgttccttgctcaaactcttccatggtgatccagcagtggcgtcggactctttcacgagtcttcccttcgatcagcaaggaccagtagctccattggttatcttggccacacgcagaaaggctgatacactcatggaagttttggttcagtggcaaggattgtctccagatgatgctacttgggagaactgggatacccttcacgatgaatttcaccttgaggacaaggtgcttctccatgggccgtggaattatacggaggaacaaacactgcaacccactataacagaggaacaagctactacaattgcagcaaatcaggaaaatgcagaggcaacagaacagagggtacaattagcaaataggcccaaaagaccaattgtcaaaccatcatacctgagagattatgtataa

SEQ ID NO: 49338 - DNA, 576 bp, Glycine max
  Peptide Sequence Number=SeqID_166116
atggtggctttacaagtatcagaactaaggagagttttcacaattgattttcagaatttctcagagcctgaaaatctttctgcatatgatggtttggagttccgcctaaaaggtgatgggcgtagatataaaatcattgttcgcacaagcagtgattgggacactcttggttacactgcaggctttgacactgagaaaggaaaatggcaatcactcatgttcagcaagtttgagtctgatggtaaattaaatgaaacttttgtggaaggtccatttgagcttccggtgtctagcatacgggcatatataaaggatccaataacacccaggtttgtgcatgtgagctcagcaggagttacaagacccgaaaggcctggaatcgatctaagtaaacagcctcccgccgttcgattaaacaaggaactggattatatcctcacatttaaactaaagggcgaggatttacttagagaaagtggcattccctatgcaatcgtgaggccttgtgcattaactgaggagcctgctggtgccaatcttatttttgatcaaggagataatattacggtattgtga

SEQ ID NO: 49339 - DNA, 2602 bp, Glycine max
  Peptide Sequence Number=SeqID_166117
atggcacacgacaaggacgtggtttactttgacttagcttcaccatcttacactccttctgaggctaagtctttcccattcaccttttccttgcatatattcctaccgagtaattctaacatgcatccatgcaccactccaatgagaattccccatgtttcattgctttccttcatattctgctactgcttctggatacaccacagtgtttactacactggggtttcagcccaaattgttgaggatcaacaacaatcattgctcaaactgaagaatagcctcaaattcaagactaataagtctacaaaacttgtgtcttggaatccaagcgtagatttctgtaagtggaggggtgttgcctgtgacgaggagaggcaagttacaggccttgacttgagtggagaatctatctatggtgaatttgacaattcaagtactcttttcactttgcaaaatctccagatactgaatttgtctgataataacttcagttctgagataccatccggtttcaacaagttgaagaacttaacatatctgaatttgtctcatgctggctttgtggggcagattccaacagagatttcttacctgacaaggttggtaactcttgatatctcttctgtttcctatttatatgggccaccactgaaacttgaaaacatagatctacaaatgcttgtccgaaacctcaccatgcttagacaattgtatatggatggtgtaattgtaacaactcagggaaatacatggagcaatgctttctttcaacttgttaacctgcaggagctgagcatgtcagactgcaatctctctggaccccttgatccttccttgacaagacttccgaatctatcagtcattcgtcttgatcagaacaatttctcatccccagtgccagaaacctttgctaattttacaaatttaaccacccttcaccttagttcttgtgaattgactggaacatttccagagaaaatatttcaggtagcaacattgtctgttttagacttatcattcaattatcatctgtatggatctttgcctaaattcccactgaatagccctcttcagacattgattgtgagtggcacaaatttctcgggagcaataccaccttctataaataatcttgggcaggaactcacttatctggatttgtcatttaatgacttcactggtcaaattccatccctgaatatgtccaagaatctcacccatttagacttcacacgcaatggtttcacaggttcaatcacatcttatcattttggcggcctaagaaatctgctccaaattgatttgcaggacaacttcctggatggaagccttccttcctctcttttttctctcccactgctacgaagtatacgactttccaacaacaatttccaggatcaactgaataaattttcaaatatcttttcctccaagttagagatccttgatttaagtggaaatgatttaaacgggtccattcctacagatatttttcaactcagatcactttgtgtccttgaactatcttcaaacaagttaaatggcacgttgaagcttgatgtgattcatagacttgaaaatctaactacactgggactttcacacaaccatttgtcaatagacacaaattttgcagatgttggcctaatatcttccatccccaatatgaaaattgtagagttggcctcctgcaatctgacagagttccctagtttcttgagaaaccaatcaaaaataacaactttagacctctcaagcaacaatattcaaggatctataccaacatggatttggcaacttaactctctcgttcaattaaatctttctcacaatttactcagcaatttagaaggacctgtgcagaactctagttccaatttgagtctccttgaccttcatgataatcacctccaagggaagcttcaaatatttccggtgcatgccacttatttggactattcaagcaataacttcagtttcactattccatcagatattggtaattttctgtcttacacaattttcctgtctctttccaaaaacaatttatctgggaatattccacaatccttttgcagtagttcaaatatgctagttcaggatttttcctataatcacttgaatgggaaaattccagagtgcttaacacagagtgagagacttgtggtattaaatctgcaacataacaagttccatggcagcattccagacaaatttccagtatcttgtgttctaaggactctggatcttaatagtaatctattatggggctcaattcccaaatctcttgaaaattgcacatcattagaggtgttggatcttggtaacaatcaggtagatgatggatttccatgtttcttaaagacaatatccacactccgtgtcatggttttgaggggaaacaaattccatggtcgcgttggatgtcctcattctaatagtacttggtatatgcttcaaattttggacttgtcattcaacaatttcagtgggtgtacttccaaaaaactgcttcaaaacttcgaaggcaatgatgctttgatgaagatgatgatgggatcaaagttcaattacattgcatctaaagtccttaagtttggtg

SEQ ID NO: 49340 - DNA, 282 bp, Glycine max
  Peptide Sequence Number=SeqID_166118
atgtcacgacccagcactttgctactcctcttcatgcttctatttgcttcattttgctcatgtttagaagccagaaaacttgttctagacaagaagctgaacccatcttcaagaagggacagtttgttcctgagtgcactccctaagggcaccgtgccaccttcttcaccaagcaaaaaagggcactccatggaggttgatgagaagctcatagcacgacacctcataaccatcgatccagttcttctaagatctgttcctagccctggtgttggtcactaa

SEQ ID NO: 49341 - DNA, 1122 bp, Glycine max
  Peptide Sequence Number=SeqID_166119
atggaatgcatagaagaagtcatagccaagctagcctccaaccaactccatgtcactaccatactagatgaactcattcaacgcattactgtgttggaagcccgtcaacacaacccacccacacctccatcttcttcctctgcgaagacattcctcacccacaccccaatatcgcctctgtcgctgcctccgccgctcaagccgactccgtcacccacgtccatgccaacttcgccaccacgctctgcactcacgctgcaacaccccgcatccttgctggccccgcttaccagcagaggagacactatagggaagctcgtagcaccacctccccctaccttgcctttcgagcgcagcaacaacatccaccttggtgctcgtcttccccttaatgtgctcaatgtaggtagtagagtaccgcagaccatcctcaggaaggttcttaaggacttcgcaagcccaacggcgaattccgagtttcataatgttctacatgtcacacagcaccaccttgtacccctcggctccttccttgcctccctctcacgaccatggtattcgccgccatcacctccaccaccaccaccgaagccaccgtctccaccaccaccacggtcggtgcgagtaagtcctcttcacatttctacaactgaaggtttatatttcagggcaaagttgctattcgaaggaggagctagtgtttttaccaaagacagatggagaaatacgccacttgatgaagctcaaatgtgtggaaataagaacctgatcaagcttttggaagatgcacaatctgctcaacggtcagaatttccatcccaagaatatacagacgaaaatgcatctgaagcacaacctattttgtttttgaataccaccaagctgtttcggggtctggaattgaggtcccaacaccttgaggacaaggtgttttttgatgggtcagggaatgttatgaatgggaagcaaaacacagaacattatgcagcaacagaacaatatgtagaatcaaatgatgcagcaaaatcagagcatgaggcagaaccaaacaaggaagaatgtcgaaggccaaaaagggaaatcaacaagccttattaccttaaggactttgtcaacaagtag

SEQ ID NO: 49342 - DNA, 1324 bp, Glycine max
  Peptide Sequence Number=SeqID_166120
atggaaaccatgaagcccaaatcagcactgagcaataggagcaagaaactggcaaagacattccagaaggtgatgagcctccgaagtgcaacgaaactcgcttcaaacaatggcatttgcatgctcaattcccacctcaaagtcaaggaagatctcttcaccgatcagaacaagaaaccccaccaaggaaacaacaagaatagagcaattatggaggctctaattgcaagactcttcgctggagtcaccaccatcaaagcagcatatgcagaactccaaatggctcagcacccttacaacaacgagtccattcaagccgcggatcaagccgtggtggatgaactcagagccatatcggagttgaagcgcaggttcttgaaaagggaccttgatctttcgccgcaagtcaccattatgctcgcggagatccaggaacaacaaagtctcatgaaaacctacgaaatcaccatcaagaggctcgaagccgaggttgatttcaaggacaataacatctcatcgctcaaaaaacacctcgacgagtgtgtttccttcaacaaatcgcttgagaagaaactcaactcgagtggctccttgtcattgtttgataacctcacactttcgtcgttgagtccatcccattttgttcatttccttcaccactctttaagatcagttagaagcttctccaagattatgatcgcggaaatggaatctgctcattgggatctcgaagcagcggttaagttcattcatccaaacgcagttttcaacaaaccaactcaccaaaccttcgcatttgaatcgtttgtttgcataacgatgtttgaaggcttcaactacccaaacttcaacgtccaagaagacaaaaacttacacaaccaaggagcagaaaacctctactttgacaaattcaaaaggctcaaatctttgaatccgaaacagtacttaacccacaacccaaactcttccttctccaagttcctgaaatccaagtaccttcaagtggtgcacgccaaaatggagtgctccttcttcggcaacttgaaccagaggaaggtggtgaactctggagggtacccagattctactttcttcatttcctttgcagagatggcaaagcgcgtttgggccctgcattgtttggcgttgtcgtttcaggacgatgatgtcactgtttttcaaatcaagaagaactcgaggttctctgaggtgtacatggagagtgtcacggaagaatctgtttcgccttctgccggggaatcctctgattccagctccggcgagcttagggtgggtttcacggtggtgccgggtttcaaaatcg

SEQ ID NO: 49343 - DNA, 213 bp, Glycine max
  Peptide Sequence Number=SeqID_166121
atggctaatctagattatttccgtggacttgtggaaggactatatgaattgcgttatggccatgagttgctgtcatctgatgatgattttgctggaacagcaccatattacctaggattactcactgcacggcatgttctcccatcatacatattcttcagaattgtgtctcaaatatcatttgttattggtatttttcatcaccatatttag

SEQ ID NO: 49344 - DNA, 231 bp, Glycine max
  Peptide Sequence Number=SeqID_166122
atggtggaaaaaacaaaaggttcacgacgcttacctcgactgtggacgatcacgaagctccctcgacggtggacgaagaagaagaagcagaaacgcgaagaagaagcaccacgacaccttcctcctaatcacggcaacaatggcggcaatggcttgggaggttcacttgggaggcgaagaagaagaagaagaatgaagaagatgcagaaactcgaagaagtagaagaatga

SEQ ID NO: 49345 - DNA, 687 bp, Glycine max
  Peptide Sequence Number=SeqID_166123
atgggaagcgaagatgtgaagctgttgaacttttgggtgagtccatttggtaaaagggttgagtgggctttgaaactaaagggtgtggagtacgagtacattgaagaagatatctttaacaagagcaatctccttctggagttgaatccggttcacaagaaggttccggttcttgttcatgcccagaaacccatcgctgagtcattcatcatccttgaatacattgatgaaacatggaagaagtatccattgttacctcacaatccttatcaaagagcacttgctcgattttgggcaacctgtgttgaacaaaagcttgggaaggctggatgggtagcaatgtctaccagcggcgatgaacaagaagaggctatgaaagaagccaaagaaatgatggagaaaatagaagaagagattaagggaaagaatttttttggaggagacaatattgggtaccttgatattgcaattggatggattgcttacttggttcctgtttgggaggaagttggatcaatgcagataatagacccattgaaatttccagccacctttgcatggatgaccaattttctcagccaccctgtgatcaaggacagcttgcccccaagagataagatgcttgtttactaccacaatcgcaagaacaacttgccttccgtctttcgtaacttggtcaaggattag

SEQ ID NO: 49346 - DNA, 420 bp, Glycine max
  Peptide Sequence Number=SeqID_166124
atggggcccttctggaacattttggaagttgggttgcttaaggaggaagcaactgggtgcaagctcctccaagttttgttgaaaaatagtttctggggcttccgggactttcgtaatgcttccataaagaggagggggaaaaaatcgagtcgaagtgcttctgtaacgcttctgagacatttccgtgagcaaatctgtgaagattttcctccgttcttcatccgttcttcgttcattcttcgttcttcaaccgaagtttccttgaatgaattgactaataaccaaagtgaaactaaggctaaaatcaactcacaaatcaagctttgtgcgcaaaaatcactaaaaaccgttttaaaggtccaacgccttaaatggtcctctttgcttttatcggttaacatggaccattcaaaagcataa

SEQ ID NO: 49347 - DNA, 243 bp, Glycine max
  Peptide Sequence Number=SeqID_166125
atggcacttaaatgcgaaaacaaaatccccgacaacagcgccaaaaacttgttagctctttggcaagtgtaccaaatcgctcgtagtaataatttctcgtgttctgttaagcgttaccctctcccgagtggtctaacccttaaaacagattcaagtattcattccttacccctaattaggctttaccctctcccgagtggactaaaccctaacagaaagcaagttcagagatacaggatgtaa

SEQ ID NO: 49348 - DNA, 1143 bp, Glycine max
  Peptide Sequence Number=SeqID_166126
atgtatgatgcttgcatttcacttaatgcaatacattcaccatactttgcacttgctttagatgcaattgttgctattggtcctagttttaaaggtccatcttgtcatgatttaagaattaacttgttgggagattgcaagagagagtgtcaattagttgtggaaggttatcgagcaaattgggttaagagtggatacacaattatggctaatgcgtggactaatcaaaggcaaagaacattgattaactttctagtctattttccaacaagtataatatttgtcaaatctgttgacgcatcaaatgttgtgaaagatgccaagacattgtggaatttgttttgtgaagttattcagtgggttggagctgaaaatgttgttcacatagtgacaaataatgcagctaattatgtagttgctggtagattgatacatgaaaaatatggaacaattttttggtctccttgtgctgctcattgtttgaatcttcttttgaaggacgttgctaacttgccttatgttgcaaatcttgcctcaaaggcttccaagataattatatttgtatataatcacatggtcttgttatcttggttaaggaaaagagaaggttggaaacaagttgtacgcccaagaggaacacagtttgctaccactttcattactttggaaagtatttatgatcacaagcaagactttcaagccttagttgtgcacaagcatttcactagccacaagttatcaaagactgtagtaggacaaactgctcgattagataaacatttgaaactcaaacttcatgctatagcatactggtttaaccttgcattcagtgagactgggatataccaggagtggcgagaaagttttggtcacccaagcgctcttaatgtatcaaagacaatacggcctgatcaatggtggttaatgtttgggattagtgctccaattttgcaaaagatggaaattcgcattattagccaaactgcttcttcttttgggtgtgatgataatcttgacactatggagtttcaagttgacagtggtgatgttggtggttcaacgacttcaaccaatgaagatgttattcctatcatgtctaaatttgatggaatcaacctcaatgactattatagtgattcttag

SEQ ID NO: 49349 - DNA, 759 bp, Glycine max
  Peptide Sequence Number=SeqID_166127
atggcgtcggaggacatggagaagactatgttcgtcaccctgtggggaacattttgctacaaggtgatgtcctttgggctcaaaaatgttggggcaacctatcaacgagctatggtagcattattccatgatatgatgcacaaagagattgaagtctatatggatgacatgattgccaagtctagaaccgaggaggaacatcttgtcaacttacggaagttgttcgagagactgtggaagtaccagttaagattgaatctcgccaaatgcaccttcagggtcatgtcgggaaagttgctcggcttcatcataagccagaaagggatagaggtggatcccgacaaggtgaaggcaatcattgaaatgcacgatccacgcactgaaaaggtcccctctttaagaattctggtagagtctgggttgaaagagttagaatgggcccaagcacgctttgatcaactcattcttatagaaggtaagagattggcagccatgagccacgagggattatatcaaagatgggtgaagaatgctttcgagaagaaggtacgcccatacaagttcaatgaaggggatcttgtcttgaagaaagtatcccaagcccaaaaagacaataggggaaagtgggccatgaattatgagggacctttcgttgtgaagaaagcattttcaggaggagcattagtactagctaacatgcacgatgaagaattgtcgtcgcccatgaattatgatatcgtcaaacgatattatgcttaa

SEQ ID NO: 49350 - DNA, 543 bp, Glycine max
  Peptide Sequence Number=SeqID_166128
atggaacctctagagatccaccagcacaagttcctccctctctttcatctccccagtcatcctacttattttcctctgatggtcagcgtcaaagtgcataaaattctgataattgttgatcaatctttgttctattccttaactaagttgcccagtcaaggtgttccttttgatgacactcttgttgatgactggaaatttaattattcaagtcatgatgctcgcagaatggtctgcaatgaccaggttgacatgaccggcagattacttgttggagctccgcgatcttcgagcatttgtgatgcaagctccattggagcttgtaggcctaggatcttcttcatcaatggattcctttgcttcttggaagatgaatggcagcggaatggagaaagggagagagagaggagacgccacttcaaggagaagatgagtctagaagaagctcaccaccataggaggccatggataagagcttggaggaagaatgagatgaatgaagggagagggagagaagagcacgaaattttgtgctctaaatga

SEQ ID NO: 49351 - DNA, 312 bp, Glycine max
  Peptide Sequence Number=SeqID_166129
atgggcttaggtcgaaacggcgatggcgtggccatcttggtggaattcaaggagaaccgtggaaggttcaggctaggatataatcccacacgtgctgatgtgagaagaatcaccctagaaaggaaaggcagaagcatggctgaggatgaagaagataaggatgcggggtttcccccggagctagaaaggatggtcacacaggaagaccgagaaatgaagccacaccaagaagagatggaaatcgtgaacttgggtgttggcgaggaaaagaaagaggtaaaggttggcacgtgcatgactacacctgtctaa

SEQ ID NO: 49352 - DNA, 885 bp, Glycine max
  Peptide Sequence Number=SeqID_166130
atggccctgagaaagctccccacgaagaggtccaggaaagacaccactggagagggttccagtgcgaccccacacgccgatgtggacctcgatagacacaggttccgaagtgtggaacaccagcagcggtttgagaccatcagaggctggcatcgggctccgctcgtatcacccatggctaagttcgatcctgaaatagtcatggagttttatgctaatgcctggcctacggaagaaggggctagcaatgcgagtatagccggaggaggagtcaggcctcaagctttgatgaggaggctattagccaattgttgtgcatgtcggggtaggactttgcccggaccgcaacagggagaaagcaaaattctccctagcgaccataactcggacctcaccctactaaagtgtcagctggtctacaccatactgacacatgtgagtgtacatgtggctcagctgatctctgatgctatttaccagtttgcagggattgtgcgtaccagacacccggtggacccggagaagtccaacagggccttgagatttcatgctctgattataggcctctgtcagttctatggagtgtcggtcacccccagcaagcttatccgccctcctattaatagggctttcattgagaagtactgcatgcccaggcaggcacagggccaggcaccacagcagcccgaggatggccagcagcaggcagctgcagacgcaccaccaccatctccaaagtccacctctactcacctgcggaggccagggcctgcagggacctccgaagatggagacggacctcaggaagacaatgacttggccaatgtgatggatttcttccttggaggaggcggagtcgtatggccggggtcgccaaacttgtga

SEQ ID NO: 49353 - DNA, 519 bp, Glycine max
  Peptide Sequence Number=SeqID_166131
atggatatagacttaatattgtggggtgagaataacacaagtcatccaaattacctttacctttcctctctccttgctttccctttatgcttcttgctttcttcctccctaattcaccatgtcttcacactactcacgcccttgcctcctcaccttcaatatgtctttctagagggcgaggatgagaaaccaaccatcaatagtagcacattatgtaatgaggaagaaaagagactagtggaggtactaaagaagcacaagcaagccttaggaaggaaaatctccaaccttaaaggaataagcccatccatctgcatgcaaaacatcaaccttgaagaggacttcaaactagtagcacaacaacaaaggaaactcaatctggtgatgaaaaagggagtccgaaaagaagtactaaaacttcttgaagttggaatgatatatgccatttccaacagcacatgggtaacccctgtgcatgtagtccccccaaaaatatggaataagagtgataaagaatga

SEQ ID NO: 49354 - DNA, 516 bp, Glycine max
  Peptide Sequence Number=SeqID_166132
atgtctcctccacctctagaacctcataatcactcacagactcatcccatgctctcaggatggcttcctctttactctcagttttctgccagtgcccttgctagtgcttgcgtgcttagcgcaactttggctcgcttactctcgcttagtgcgtgtgtccagctcatccttcgtccagattcttcctcacgcttagctgcaagagtggttaaagcacacgaggagagtcttgtagaagagcatgattcaagagaaaaagatgaaggaaaaaaagaaaaaggtgaggagagaacacaacaacaatgggagaagtgcttacaagtagaaattcaacaagaaaggcctctccaggtcaataactctcctcatcaattgattagcaaggaagaaaggcatgaagaatgtgataaatctataagtgtcatttactccttgatcaccaacactttccttgcaatgatatggaaggcgattcggggatacatgattttcatggagtctctagctaagaagtga

SEQ ID NO: 49355 - DNA, 618 bp, Glycine max
  Peptide Sequence Number=SeqID_166133
atggtgattggaggactggaggattggatcaggaaagcaacgactgagattgagaataaggagaaaatagttgaaaagcaaaggatgaagatgatgtcatccgagggcttggtattggatcgaaatcaaagtagggtcatgaacttgagaatctttctttgcaaactagctctccttaaggtggtgatttgggtggtggtggtcattcttgctgtggtgacgatgttcgcggtcggaatcgagatggtgtcgctgccatctcacggcagtggccgtggtgggtggtacgaagcgacagagtcaacgaacggccgggttggaagtggcggttggggatggtgggaagaagctatgggaagcgaagctggcatgggtgtgtctgttggtggtgacttcgcagaggaagaagatgggggtgatttgggagaagatggagtgggtgtaagaatgaatagtcgacaaaggatgacattgagcttggtagtcatctctagagtattggtggtcatggtggataggttttgggcaagggtaggggttacggtaggggaaaaggcaggtagaggtagccatgggtggcaggttggaccaaattgttatgaagtgaaaggtaggtga

SEQ ID NO: 49356 - DNA, 1053 bp, Glycine max
  Peptide Sequence Number=SeqID_166134
atgaaaattttagttgcctttcagggcagacatccgtactcatttggtgataaatttgtgctttcatccgtcttggacttctgtttgaataggataacagatcctgagccatatctgttgtcatttgagcaatttctcattcagtgtatggtgatgattaaaaatattctggaatgtaaggagtacaagccaagtcttactggtagggtgatggatgaaaatggagttacactggagctgatgaagaaaaacatttccagtgctgttggtggtgttttaacttcccttcttcccactgaacggatagtccacttgtgtaatgtattgatatcgaggtattttgttctgacagcaagtgatttggaagagtggtatcgtaaccccgagtcttttcaccatgagcaggatatggttcagtggacagaaaaattgaggccatgtgctgaagctttgtacattgtattatttgaaactaatagccaattgctaggtcctgttgtggtctctcttcttcaagagtctatgaataattgcccaactccagtgacggaaattactcctgcattgcttcttaaagatgctgcttatggtgctactgcttatgtttattatgaactctcaaactatctgagttttaaagactggtttaatggtgctttatcactcgaactctcaaatgaacatccaaatttgcgtatcattcatcgtaaagttgctgtaattttggggcagtgggtttctgagatcaaagatgatacaaaaaggcctgtatactgtgcattaatcagattgttacagggcaaagatttatctgtccggctggcagcatgtcgatccctatgtttgcatatcgaagatgcaaacttttcggaaagggagtttgttgatcttcttcctatttgttgggattcatgttttaagttgttcgaggaagttcaggaattcgattcaaaggttcagattttgaatttgatctctatcctcatcggacatgttagtgaagttattccatttgcaaacaagttggtgcaattttttcagaaggttcaatga

SEQ ID NO: 49357 - DNA, 996 bp, Glycine max
  Peptide Sequence Number=SeqID_166135
atggcaatagtggcaaaagtggtcaagatcttggcacaagagttagaccgggtgaaacaaaatagaaatggggtggttgggataccaaggaagaacttggaggaaaaggcaaaagatttggcagatcaaagagaatggacttcattcgttgatgttttagcactgttggtatttaggatcgtgatctttccgaatgtagacgggctagtggatttagcgatggtcgacgcttttcttgcttatcactacaacaaggaaagcctagtcattgttgttttggcttatgcctatgacactttcgacctaagatgcgaaaagagcagtgctagaattgtctgttgtacacccgctctttatgtatggttggtctcccatgttttttgtcatgaaagtagactcgtctgtcccctacaaggtcattgcatgtgtgccgagaaagggaaaacaaatttggaggaactcttggcaggggtttataatcccatgctggccataagacaactaggctaccctgtgagaggggtgccatcggaagagattattgtgcctttcatcacacggggtttcagtgaaggcaatgtaaaagtgcttcagagattccgaaaagcgtggaatgcggtggaaagaagagatggggagcttaagggaagcaacaacgatgtcatcggcggctatcataagtggttaaaggttaggacgcaagagattacttggctcccaaagctaaaaagtccaagtggggaagaaactgaagtccttgaggaaagtgaagaagtacaagccttgaaagcaaaacttgaaagaacgcgagtggtcaaagaaaagctaaagacgacagtcactagggccaggaaggagtgtgatgagttaagggatgtcaacatgagcacaacccaagagttagagcgggaaacaaagagggcccaaaaagaagaatggggcagaaacaagttccgaggggctctatggggcagcaacaacgagctcaagctttga

SEQ ID NO: 49358 - DNA, 816 bp, Glycine max
  Peptide Sequence Number=SeqID_166136
atggaagatgagaggaccagcattgggggagaggcagagggtagggtgcactggaacaaggtctgggaggagtcttctggtgaaagtctgctgcagatacagcttcttgttgctctgaggaactttgtggttgctcttggttaccagtcacccatttgctacaatatactactgccaattctggagaatgggattgatattaatagtccagatgaactcaatctcctagaagatagcatgctgttatgggaggccacactttctcatgctccatcaatggtgcctcaattgttacaatatttttcacgccttgtggagataatggaaagaaattttgaccatttgcaggttgctgtgaacataattgaagattacataattttgggtggaaataactttctgagcatgcatgcaacaaatattgctaaaattcttgatttagttattggaaatgtcaacgacaaaggcattctttcagttcttcctgtggttgatatcttaatacagtcaattggtataaaaacttcgtatcccattgcccagaggctcttcgctatgcgaaggtatgcccagaggctcttaagtcaattgtgtttccccatggatgtgccgccacttattagcagtactttacaactcttccaaaaatatctcctaacatacacctttccccatctatcaataccccctcccctcaagatggaccttgttctcaaggtcaagttgaggaaaaacagcctgcatttcatcagcaagttcccaactatcttcatggtgggttcccaattctcattcagggctgttggtaatagttga

SEQ ID NO: 49359 - DNA, 2604 bp, Glycine max
  Peptide Sequence Number=SeqID_166137
atgtctcaggcttccatgtcttttgagttttgggaccatgctgttatctctgctgtttatctcatcaatcgccttccctcatcctctatccatcaagaggtaccttatcagaggttgtttaaaaggcttccggattacaagttcttaaaggtttttggctgtgctttgctatcccctactaaggccatacaatcagcacaaacttcagccaaaggtatcaagagtgtctctttcggggttacttatgattacaatgtgactttttcgcctgtaatcaaatctgttactgtcagaattcttctctctcttgctgtgacccacaagtggagtcttcaacagttagatgtaaacaatgcctttcttaatggcatccttgaagaaaatatctacatgagccagcctcctggatttgaaaattccaacaagcaacttgtgtgtaaattgaataaggcaatttatggtctcaaacatgcccctagagcttgtccaagtatattagggatttgttggggaaaacaaaaatggatgaggccaacccagtctcttctccaatggtttggtggctgcaagttaactaaatcagggtatgaggctttccctgatcccacactctacaggtctgttgtgggagccttgcagtatgcaacaatcactaggcctgaaataagtttttctgttaacaaagtttgccagtacatgtcagacccatcagaacagcattgggcagcagtgaagaggattctcaggtatctggcagctaccatcaactttggcttgaagtttcttcctccttctactggacctctcttttcccaacatgcatactatgatgctcactgggcatccgatccagatgatagaaggtcaacttctggtgctgccatcttctttgggtccaatctagtgtcttggtggtccaagaaacaatctgttgttgccaggtctagtacagaagccgaatatcacagtttagcattggccacagcagaggcttcatattttctgtctgaactgcacattcctcaccatactccagtcattttctgtgacatgaccactgttgcccttgctcacaatccagttatgcactctcgcactaaacatatggaactggatcttttctttgtcagagaaaaggttatggttaagcatctccaagtcatccatgttccagctactgataaaaaagctgacattttgaccaaggctttaacttcttccaactttactacttacagatccaagctcagaattgggccatctcaatacagaggtgcaggtcgcaggggcggtagatcatttagaggctatggtcgtggccgattcaatcaccaccgtggtagggggcgtggtaggggtggtgatggtagacagttctcatctcattcttctgaagccactattgctaatgtagcagatgcacctgctgctgatggggccacttcagagatgcaaccatcatcagtctctgggccttcatcattacataatccagcacaagttccatctgcaccattgcaggcaccaccatgtaagttatggtgtgaaatttgtaaggctgagtgcaatactccagaaatgatggagcagcataagaatggaaagcggcataagaagaacttgcttgtgcacgaagaagtacagagacgcaaagctctaaatggacaacagggtggaaatatttctacttctcaatcgaatttaacaatccaacctgaggaagttcaagaatcagaggaaaaaagaataccagaagaaaatatgggttctgaagctacagctgataatcacaatgatggaactgagcttcagaataatgtagaaggggtctctgaagttcaaactgaagagcctcaggagaaacctagagacaactctgccatacagggtcgtgggttcaagcgtaagatgagaggaggcagaggaggtaaatacatgaggagtgatgatgggtcaagaaaatcagtggaaactccaaagcctaagcaagttacatctttgatatgtgagttgtgcaatgttaaatgtgattcccaggtcgtctacaatagccatttggcaggaaaaaaacacttgtcaaatttcaagcgtgtccatggctaccagcctttgaatggagaagctgggattcaaccacttcaccctcctaatatcattgctctgtcaaatgcaaataattttccggtccaacagggtgttagtgtccctctaggcatcaatgatccacgaaaccttctggctcagctcctgatgaatgtgttatctaatgtccaagttccagcaacaacaccactatcaggtcctgtggccgctcagatacaagtaccagcattgatggctggatcaagtcatgaacccctatctcaaaatttgtcacagatacaagtctcagattccttggctcattttgagagtgaaaatcctattggggaaacaaaagatcagatgtcatctgtcacattccaacttgatgagactgctggttcaagcaataatggtaatattgaaactgctgatggaacggtggtgaaactttcccaggattgttcagtaatgacaccagcagaaaacccagttgcagcagataagcaactaccttcataa

SEQ ID NO: 49360 - DNA, 621 bp, Glycine max
  Peptide Sequence Number=SeqID_166138
atggcctatactcccccccagtcaggttgcacagctttaatagatttagtcttcaacaaggctggtgttccaatcaaacaagctttggtccagcggcagggactatcacctgatgacactttttggggaaattgggatgagttgcagtctacttacaaccttggggacaaggttgctttcgatgggggtggtattgataaggttatagagaatggagtagcccaatctgtgaatgaggaagtccaacaggagaggcccaaaaggattgtgaagcagaaatgtggatcagaatatgtatattactggcataagggaatagaagattctagacaaggaatttccctgggcaccccgtcaaggttccccacaagctgcgccagagctccggctacaaccgccaccgccgccgggttgatggaaccgggaaccgtcgcagcctgtagcggggataataaggttgtgatgattgatcatacgatggagtttgagtttgagatgggtcgtagccatgttgttgttcttgttgatattcacgcggctgctaacatctctgttttcttgtcaccgccccctcctaggtatttcactgtgcgcaacagtgtgatactgatgagggagtga

SEQ ID NO: 49361 - DNA, 921 bp, Glycine max
  Peptide Sequence Number=SeqID_166139
atggaagagatgtccaagtttcagaatgaggttgccggaaaaaagcatttcaagcgagaaggaaacaccaagaccgactcacacaggtcagacaacaggcacaagccgggcaagcgccagcctctcccaaaagggcccaggtacgagtgctacacaaccctgacgaccaatcacactacaatccttgaggaggctttcaacttggaggtacccatcaagctacctccgttgctttctcccaggctggggttagacaaaaccaaatactgcagataccattgcaatatcggttacaacacagaagactgctgggctctaaaggaaaaaataaaagagctcatacaggctgggttgggtatctacctaagtttgttaagagaccaaacaaccaccaagcagaagcaagacctggaggaccccaagaggatcaacataggaatcacgacatggacaaaagaagagacaaagcaaaagatcgaggaagacatagacaccaccagagcccgcccagcaaatcagaggtgtaatcaacatcaatgcgggtggattctcctatggagggcagtccaaccaatcttgcaagcatcacctccatgccattcgggacatcgacatcaactatgtcgatattccatcacccgaagtcaccctcttatcactttcattgatagaaacttcaagggtatcaaccctatcaaccaaaatgaccccgtagttgtctctatcgcaatcgctaacttcatggtgtccaaggtcctcatcagccagggtaactccactgacatcttatactggaagacatttcgaagacttgaagtttcacttgacaccatccagccttacgccggcccactccttggctttgcaggagaaagtgtagagactagaggctatgtcaacctaatgagcacttttggttaa

SEQ ID NO: 49362 - DNA, 147 bp, Glycine max
  Peptide Sequence Number=SeqID_166140
atgttgcagctactactcatcacatcaaaaggagttgtagcacatcgatggctttctggcatgtaccctaacatcctcaacagcaattcagacagcattaagctaggtgtgggaacccccacctatgttatagttcaaacagtgtga

SEQ ID NO: 49363 - DNA, 618 bp, Glycine max
  Peptide Sequence Number=SeqID_166141
aagttaatagtaatatgtttgagtggaggagatgatcacgatccttctaaaacatctgttaaagcatcttcggctgccatcctggctaggcttttggtgatgaatacaaattcacttgcccaattagcatcagatccatcaacttctcaactgcttcagacagcatccatcccagttcaagaaaatatacttctttgtctggttgacatttgggttgataaggtagataatgtttcttccatccagaagaagacaattggcttagccctctcaataattctgacgttaagactgcctcaagtactggacaaactggatcaaattttgagtgtttgcactagtgtaattctgggcagaaatgatgacttaactgaggaagagtccagtggtgacataagctccagcacgtctcctgatgagggcactattcctagtaaagaattcagaaaaagacagatcaaattttcagaccgtatcaatcagctgtctcttgaggactgtgtgagagaaaatctacaaacatgtgctgctattcatggagaatcattcaatgctgcaatgagcagtatgcatccatctgcgtttgcacaattgaagcaggcgttaaagatgacataa

SEQ ID NO: 49364 - DNA, 1452 bp, Glycine max
  Peptide Sequence Number=SeqID_166142
atggctattgaggttcttgttgagctacatacacgagctgagtttatgactgagctgcaacttgataagctctttaataggctttgggcctctatcaaaagtgtcattgcgtggatctacattgaattcatcatccaggcttgcttggtagatagtaagggctcaaactgtagacccttcatccatactcatgacctgagtggtaccattcgctttggggtgaggcttgacaggctccctagtgggaggataaggtgccaccttcaggctttctgtgtagcattggtgtgcctgcttttgatcggccttaatcgtcataatctcccgtcaaggtggggaacttcatcttcatatgcggttgacatagcctctagtctctacactttctcctgcaaagccaaggagtgggccggcgtaaggctggatggtgtcaatggagttaccctggctgatgaggaccttggacaccatgaagttagcgattgcgatagagacaactacggggtcattttggttgatagggttgatacccttgaagtttctatcaatgaaagtgataagagggtgatgcttgcaagattggttggactgccctccataggagaatccacccgcattgatgttgattacacctctgatttgctgggcgggctcctgttcttatggaggttgtcaatctctactggtggtgtctatgtcttcctcgatcttttgctttgtctcttcttttgtccatgtcgtgattcctatgttgatcctcttggggtcctccagggttgtgtagcactcgtacctgggcccttttgggagaggctggcgcttgcccggcttgtgcctgtttctttcactcatttgcgcaacttgttcatgctactaaggggctttttgcacagactgtccgtaaacttactaagccatagtgcaaggagcatagagtgtaatgctacctctggactagctagtgtagtagatgtcatacgatgtgatcggatagttgcatattgtgcactaaagcactcgacagtagtgtcggaactgtcgatggaccttggaggaagtccaccataccaggtcaatgccgcccctttgagggatgtggggaagacacaacatagaattgcatcgtcattggtgtacagattcgcctggctgaagaaagcatccagatgttcatctagatcggtggtcccatcataccgctttaggttgagtggtttccaacctaggggtatgtcagcttccataatgcggggtgtgattccctttcattacgctcaggcaatgaggattggagccttcgaaatgggtctcgcgtttgaggccagattgcgtgctaaccacggtgggcgtcaaatggacttaccaaaatttggagctgggacacgtcatggtggacatggtcaaggtgggctcttagacttcgcacgttggctggagagtggccttcgttaa

SEQ ID NO: 49365 - DNA, 264 bp, Glycine max
  Peptide Sequence Number=SeqID_166143
atgaccacagatccacctccactccctgtgtctcacatagacccaggtatagggcctaatatctcaacgtgtgtgcaaaagtgtaggtgccatctgtgcatagagaaatctaagaattaccccaccctacttgccaagcaaacagacaactccaaggtagatgcaacaagtacgtcacatgtcgtctacccaggattcaatggcacaaaaatgtttctaactacgaacgtaatagatagaaaaatacacaccaaaaggaaataa

SEQ ID NO: 49366 - DNA, 258 bp, Glycine max
  Peptide Sequence Number=SeqID_166144
atgagaggaaggcataggtcacatcttagaccttactcccataggatagaaagggaaagaaagcctcaagaggctaacattaacctcccatacttccatgggaaggacaatgtagaggcttacttagattgggaaataaggatagagcaacaacttcaaaggaaggatacttcaaaatcttattggccctcactcttatccaaagaaagaccaaggtcaaggcatcttagaggcggcaccttcgaagcccaaagatga

SEQ ID NO: 49367 - DNA, 4044 bp, Glycine max
  Peptide Sequence Number=SeqID_166145
atggcctcgaaatccaattctgacaagttggaagaagccatagccaagctcaccatccatcaactcagcctcagtgaaagcccgcaaaccatgactcataagctcaataccctcatttctaccttgacaaccaaatctcctgaaccttccccaacctcaccaccacacgtttccccgtcttcgccctcatcccctcatcctcgcgtcaagctcgatgagccccggttcgatgggtctgatccattgggttggatattcaaaatcactcaattttttgaatatcaccacaccccagaccacgaccggctcaccatcgcgtccttttacatggacgacagagctctggatccaactggggccctattcaaattgacacagaaaaccacagtgcaggcttacctctctgaattcgaagatcttgcgaaccgcgttgtcggtctcccacctcacttcctcctcagctgcttcgtttcgggcctcaatgctgacatccgtcgcgaggttcaacccttgcaaccattgacggtcacccaagctgctggtcttgctagattgcaagaggagaagctcttcgaggcgagaaaggctttgcgcccccgtttaccaccatcttcatctcagcctctacccatgagccctttcccactctcgcacccctccttgccctcagctcagtttggcttcaattgcgacgaacgataccatcgtggtcatcgttgcaattctagggtaaatctcttagtggctgatgaagacgagcgccccgtagaagactataccctattgggcctggaacccgacccgtctgacccatcaattgtcaacgaggcccaactaaatttacactccctcactggacccttagcacctgaaactctgcgtttctccggcctcattgctgatcatcaggtgctcatccttgtagatggggggagcacccataacttcattcaggactccatgattactggatttggccttatccctcgtcctaccacacctctgaaagttatggtgggtaatgggcaattccttcggtgtcaacaagtctgccaagcggtaccactgacaattcagaacattgtcttcatcgttgaccttcacgtgttgcctctctgtggtgcacacgttgtcttgggggtccaatggctacgttcccttggtccagtcttaatggactatacctctctctcgatgaaattcatgcatcagggacaaattattgaatttaagggtgatgatacttccacccttcagcctcttacttcaacccaagtccggcgtctggttcgcactgccagggccaccgtctacttccacctttccgttattcccctagacacttccccttctgatacacccaatctttcttaccctcctgctattcagtcacttttaaccaaatttgcttccctatttcaaccccccactgctctccctccttcccgatcgacagaccaccatatccacttaacctcaaactcacaacccgtcaatgtccgcccatatagatacccccattatcaaaagactgagattgaatcccaagttgcttctatgttgcagagagggataattcgttcaattacaagtcccttttcttctccggttcttcttgtccgaaaacacgatggaacctggagattttgcgtggattatagagcgcttaatgccctcactattaaggatcatttttcgatacccacgatagatgagttattggatgaattaggtggtgcttcctggttctctaaattagatttattacaaggctatcatcagattctcatgactgaagaagacatctacaaaactgccttccctacactccatgggcactttgaattcagggtgatgcccttcgggctatgcaatgcaccctcgtcttttcaagctacgatgaataccatctttcgcccttaccttcgtcaattcattattgttttctttgatgacattctgatttatagcgccacgttggaggatcacgtgcttcatttggagcaagcttttcaaattttgttgcaggaacaattcgttttaaagctctccaagtgtacatttgcgcagcctcaggttgaatacctgggtcatgttgtatcagcacagggtgtggaaccagtcatggccaaggtccaggctatacagcaatggctggaaccgcattcggggcgcgcactcaggagttttttgggtcttgctggtttttatagacgcttcattcgcggctatgcaaccatcgcagctcctttgaccaaattggtcacggcggaaccttttcagtggaccgacgaagctcgtgctgccttcactcacctcaagcaagtgttgacctccactcctgtcttgcggttgccggatttctctcttcccttcacggtggagacggatgcttcgggaacaagcatgggagtcgtgttgacccaacagggacatcccattgcgtattttagcaaagcttttcctccaaaattaatgggtgcctcgacatatgttcgagaattgttcgcgatcaccgccgccgttaagaaatggcgcctgtatctccttggccgtcgtttccacatcttaacggatcatcgcagtttgaaggagttgcttactcaggtgattcaaacacctgagcaacagatgtatctcgctcgcttgatgggctacgattacaccatcatgtatcgttctgatagctctaataaagctgctgatgcactctccagactgccgaaatcttcttccactaatttaatgcttttgtcagtaccctatgctcatcctgaattttcagttactaatgatttgatcctccataaaggacgtatttggcttccccaagctctgcccttcactacaactctgctctctgaataccatttgactcccaccagcggtcacatgggtatagccaagaccttagcacgattaacggaaaatttttattggaagggaatccgtcaagatgtagagcgcttcatagcttcttgtgtcgattgtcaacacacgaagtacgaaactcgtaagccggcggggctgctctgtccattaccaataccatcaaagccatgggaggatttgtccctcgatttcatcacaggactcccggcgtttcaaggacataccgttatcctcgtgatagttgatcgattctccaaaggcattcatcttgcaatgttacccacgcgacacactgcatacacggtggccgatcttttcatggacctcctttttcgtctgagtggaacgaagctcaggctcacctctgcttatcatcctcaatctgatgggcagactgaggtcctaaatagggtgatcgagcaatatcttcgcctctccccgtacaagattacctttgggaagaagcctgttaatttcccaaggtacttaaaaggtgactccaccattgttgcagttgaagatatgctctctgaacgtcaagctgtcttcgaggaaattaagaagaaactggaaaaggcccagagtcgtatgaaacgctttgctgatgcgagaaggcgtgatgtccacttcaatgtcagggacatggtcttggtcaaactaaggccccatcgtcagaggtcagtgacgggtcaactcagtggattttctaaattagacaaacggttttatgggccgtttcgggtcatcgagcatattgggccaactgcttataaacttcagctaccagataatgctcgtatacaccctgtcttccacacttcactcctcaagctttttcgttctttagaacctaataatgaccaatattgcagcacattgcctagccactatgagaatgatcaacttgtggttactccgttagccattctcgatacacgtcactttgcagactctaaactcgaggttcttgttcaatggcaaggattatctcctgatgatactacttgggagaattgggatcagttgcgtgaagtatatcaccttgaggacaaggtgcttccggaaggggtgaaggatgatagcaaggaagcagcagaaaccagacccaaaaggaagaagaagataccagcatacctcagagacttcgtttga

SEQ ID NO: 49368 - DNA, 1131 bp, Glycine max
  Peptide Sequence Number=SeqID_166146
atggttgcccgtagaggggatgctctattactaactgattctaatgctttgctctgtggaatcctcacacacaaggatatagcagcaagagttattgccaaagagattaatcttgaagagacaccagtttccaaagttatgactaggaatccggtatttgtcctttctgaaactctagctgcagaagccctccaaaagatggtgcaagtatcaccaacagattccattctgacaacaagaaagaaaatggttgaatttcgtgcaagttgtgcagttgtgacatttaatgacaaacctcttggcatctttatttcaaaggatattttgttgcgtgtaattgcacaaaatctttctccagaatcaacccctgttgagaaggtcatgactcccaattcagtatgcgtagtaattgatacacccattgttgatgcacttcacactatgcatgatggaaaatttttgcatcttcctgcggttgatagagatggcagtgtagttgctgtggttgatgtgattcatgtcactcatgctgctgtggcgacagtgaatcaggttgggaataatgaagctgccaccaccttgatgctaagattttggtattcagccatggccttaaccccaaatgatgatgacgacgatactcgaagtttagatacctggagcatgacagaggttataacttcagtccttcagaggcttggtgatgatattgatcctaacaacataccccaaattctggaaagctggccatatttgccattgtatgaagacgaagatcatgataaagttgtattggcttcagacagtgatcttgcaccagctgtggatcatgcaaggacagctgatttgaaggggattgaaattgcatttagactaggcggtatagtcaaaggttctcgttcaggaagttatgcttattcagatgcatgggcctcagcatacagtgctgcacttgttgctggcctgggcatattaacgtacttcaattttgtacatttatatatacgaggaaaagaaaattgggatggtcatcccttgcttgctgcttgtatacttgtaattttaggatttgcagcctcatcaaccctggagactgtgtacaataacaaaagctctgtccatttttcttga

SEQ ID NO: 49369 - DNA, 1470 bp, Glycine max
  Peptide Sequence Number=SeqID_166147
atggagaagccatcgtcgtcgttgtcgtcgtcgcgaagaaaatcgagcacgatggtgaaagcttcaactgatgcgaacacaagcctgagcatgctgaacgaggaccttcttcagaacattctagcgaggcttccttctctacacttcgcttccgcagcttgcgtcagcaaatcatggaactctctctgcagtcgcatcctctctcgccccaagctctcttcggcgatctctctcaacccttcgctccccgatgctgtcaacgaggttgttcacaaggttctctcggagccaattcgaccccattttgctattgccaatatcggaactggattcaacactgccaagactctgtgccttattagaaagtcgttggggttcaatattcctgttattgttaccgtggcgaatggtattatgggaagggatgctgtaaccgatgagtttaaagaggtcaaatggggtgccctttttagcggctttggagaggaatcatatacgaggtttataaacgaaggcttagttttgactgttgggtacttgcctggattgaaagttgaagcattgccgttgcgacggccaacaaagacatcgcaagcaacatgggttgacaatttcataaaggatattaaggaatattcagcctctgtctccagtagccctttccctgttgggattatattgtttggagaagcaagcagtgacatgaaattggttctggagaaattggatcatgccatgcctatggacatggtcattgtgggtgatgagagaggctcttttgactttgtacacaaaagtgggaatgattctagaatcatttgtagtaaaaaaggaaacatagaagctgttgctcttgtatttgctcaggacagggacaggtctttgggaactattaggtttcatgttgcattgtcaaatggtgtttcaactgtgggtcccagatacaaggcagcctcagttaaatcaaacaatgctgattgttcaacatggctcactgctaggagggaagggcaacaggaaaatcttgacggtgatgaagagtatctatatgttgatggcattggcataaaaacaggagatatctttcagttctactattcagatcctaatactgccttagcttcattaaccaaggtccatgatgccctcaagagtattcatctggaaaaaaattccaagagttccaagggtgatggagacaacgctaccaatgtttttgggggtattgtttttgcttgttacggccgtggtgaatccttctttggacgtcacaatgttgacagctctcctttcttagagaattttccaggagtgccagtgtctggaatattttgtggtggagaaatggtgcgtccttgtaccactgtgattggtcaatgtgaaggagcaagccccattagttgctgtctgcatgtttacagcactgtctacttagcaatgtcatatactcctccctctgtggaagattag

SEQ ID NO: 49370 - DNA, 462 bp, Glycine max
  Peptide Sequence Number=SeqID_166148
gttggccattcctaaggatttggattctgcattggctattcctaaggatttggtgttggtagaagcagaggctcttggctctggttcagccaaagctttgaaggatcatacgaagtcttctgcaactgatggtaaaatgcaacagtggtttgtgaaggttttgcagtttgatgtttctccatgtactggagcaatagttcctataacatcaatagccaatgtttccactgaaaaccatcagaatactaccagtgtcaagaagaccaggaatagaagaacccttcatgagctcccagagccgcttaatggggtctacacgtctagtctaaacataactgaagaacaagtgaaaaatttgcaggaagaccaccttcatgtggttggtgatggtgatgttgatggcatgatgaggccaaaatcactctcttggatttttgtggttgtgctaattgatagtgtcaa

SEQ ID NO: 49371 - DNA, 1245 bp, Glycine max
  Peptide Sequence Number=SeqID_166149
atggactggaatttgaaagcaccttcttgggatttggtggatcatgtggataaggcaacaaccttacaacaaaacataggaacaaaggaggagcaaaacagatttggagtttatagaatgaaaggggagttttctgttgacttgaagcttggtcatcatcatgtggggaattctggcactgaatcagcactagccaacaagtccaaagatgctgctgctgctagtggtgctgctgcttctgcaggagtttccaaaatggcatcttcaccttcagggtcttctaagagagctagaaccataagcagcacatcactcacagtgtcatgccttgttgatgggtgcaattcagatcttagcaattgtagagattaccataggcgccataaggtgtgtgaactccattccaagaccccagaggtcacaattgctggcctcaagcaaaggttctgccaacaatgtagcaggttccattcgctggagcaatttgatgaaagaaaaagaagctgcagaaaacgtttagatggacacaatagaaggagaagaaagccccagccagaacctctctcgcgacctggtagttttttgtcgaattaccaaggcacccaattgctacccttctcaggtccacacgtatatgcttccactgccatggttagcccagattggagtggtgcacttgtgacttcctctgcagatgctaggttgcacaaccacaaccaccaccaccaccaacaagacctttttctcggatcttctcacaaagaagggaagcaagtagcattcttacacagcaaccatcatccctccacactcagcaaccaaaacccgccacctttcccatccccttccatctgccacacgcttctcaggacccgccctctatcagaaacctgcggcggaggagcgagaagcaaaatgttctgtgaaagcttaacaacaacaacaacagcaagtaataataataacaactcgctgcatgacactattccttgtgctctctctcttctgtcatcatcacagacgcacacaccaggagggaatggtttgaaccaaatggtacagcagcctcctcctccctcaatgtccctcatgatgcagcccttaggccttagcttgcaggataataacaacaacagcttagagtctgtggatcattgttcctccatatatagcttggcttctgatcatcatggatcccactgcaatgaagcagcccctcaactgtttccctttcaatgggaatag

SEQ ID NO: 49372 - DNA, 1002 bp, Glycine max
  Peptide Sequence Number=SeqID_166150
atgattctaatagaacttgtcaaccaccaaaagttccaacagaatcacaagagacacaaggaatcccaacacaataagctcaacaaactcaagaaacacaaggagaggctagacaacaaactcaaccacaacaaggacaatactttgctaggtggagatttaatgcatatgagatgtgttgctcacattttgaacttgattgtaagtgatggattgaaagaaattgacctttatgttagtagaataaaggctgcatgtaaatttgctaggtcttctccatctagattggctacctttaaaaggtgtgcatatgaggaatttaaacggattgaatatgatgatcctcaatatttgatagctcttgccaatgagggtgtcctaatagtgatgattggaatcgtgcataggaaaagtaatgatccaatcttgcaaaagttttactacacatatgcaaaccaagtttttgaaatattgggaaatagtgagataaataacttgttttttgtggctgtgtttcttgatccatgctataagcttgaatatgttgagttttgctttggtcggttgtatggtaaagagaggagtcaagagatgataaaaaggttaagagagatcattgaaaagttgcttgagtgttatgttacaatgtatcctcttcctattaatggtagtgattttggtagcatattatcaagtgttgcttctcaacctaatttttccactaatgatgataatgaaagggattgggaaaatgagttcaggatgaaaattataaataaacaaggtgaagtgaagaggaatgagatggatgggtacatagaagatgatgttgaagactcacgtcccaatattgaatttgagattttaaagtggtggagaatgaagttagcgaagtattatattctttcccgtatggctagagatattttagccatcccaatgtctattgtatcatctgagagtgcttttagtataggaagtcgagtccttgacttattttga

SEQ ID NO: 49373 - DNA, 555 bp, Glycine max
  Peptide Sequence Number=SeqID_166151
atgttgagaagacaaaaatgctatggtgatcgttgtcatcgaaaagacaacgagttaaaaaaggaagcacctcggggaagggagcaacaaaactatacaagaagaagaaaaagagccaagcaacaaacactgacacaggaaattttttgttcacaaacaacacaagcagatgatgagtatggacgtatggttttggccgttgttctttattccttcttggctactcttgggacaaaacttcatacatataataacagtaacacgaaccttcttcctatcataacatgtgctatgcttatgttgggaagtgttgtttcaattctggctttgagcttcatctcattcacttttgcttggatcactttggccttgtgggttggaatattcacattgatttctcatgagtatggtgctcataaaaggacaaaaattggattaccggtcgcatcacacggtgctaaggttgttgcctctctagagaaagattctagattcttgattcaggaagaatctattgttggatttatgaaagcatctctactttttcatgcttag

SEQ ID NO: 49374 - DNA, 369 bp, Glycine max
  Peptide Sequence Number=SeqID_166152
atgaggaacctattcaaagagttgtcagagaacattaacaagttctcaacactgctgtttgcccttattacatcaacgaactctttgttcatgaaacagcacaagctgatggtgcttctggttttgagcattgttgtctactccttcttggtgatcattgggacaatacttgagaaacataacagaagccttcttccaatcataatttgtggcatgcttattgtgggaggtgctgcttcatttatggctttggccatcatctcattcactgttgctattatcactttggccttgtgggttggaatttccatattagtagtgtatatgtatgtttctgctccaagaagctcagggttacttcctctctag

SEQ ID NO: 49375 - DNA, 576 bp, Glycine max
  Peptide Sequence Number=SeqID_166153
atggaagaacaacaatccaaaacgacgcaagagttggcgatggaagggcagaagtacttggaagaaaccatagagaatgctttccagatcctttcttccatgaacgacgagctctgcaaccccgttttgtggtccacctctccctccgcctcctcctcccccaacgccgacgccacttccgaaaactccaaccaccacgccgacgccaccaccgccgctgctggcggcggaggcgccctcgaacaggcccgatcccgatacaagaaggcagtcgccgcgcttcgcaccattctcactgccattcctaactcccagaagctctatcccactgcaatccatgctatttctgccgcaaaagtggctgcaacattgaagcattcttcaatggcaaatgcattcaatgccagttcagctgctagccctgctgatgaagctgaaatcgataagttggaggagcgagcctcttctctaagaagggagcttgccaacaagaacttgcacctaaagacactcatagatcaactgcgtgatcttatcactgatatatcaacatggcatagtcctttttcaacctga

SEQ ID NO: 49376 - DNA, 465 bp, Glycine max
  Peptide Sequence Number=SeqID_166154
atgcaaattaacatgttcatcaatggattaagacctcatactagacaattacttgatgctttcgtgggtggcaagattaagttggagaccccggaggttgcaatgaaacttattagaaatatggttgctagtgatgaggctattcatagggatagaacttttattccagccaagaagaacctattagagcttaccgctgatgatgcaattcttgttcaaaataagctcattgccaaacaaattaaagccttaacggataaacttaataacctcccacaacaactgcatgctcttcaacctactcaaccttccaatatgcaagttggaggatgtaccttatgtggtggagctcatgaagttgggttgtgcatggtccaagaggaggctaacaaggagctcaattatatggcaagtgtttctccttggcaagtgtaccaatttttcaaagtaatattaaaacaataa

SEQ ID NO: 49377 - DNA, 900 bp, Glycine max
  Peptide Sequence Number=SeqID_166155
atggatactgacaatccccagaatccggcggaagtccgccggttggatctaacttatccagaagtcgacatcacggcgcaggacttccagttcggcgaaaaacaacttggcagcctggacctgaaggctttcaatagcggtgaaagctgggtgatccaacgtatgaacctcaccaatcctgatagccagctcacggcggatggcacctggcgtaattcggtacgtaatccgcaaacacagctcaagttcaacctgacctccagcaacctgggcaaaacactgcaacgcttccagcctggtggtgaaatggtcaaagggggcacgggcaatatgagtggccaactgggctggccaggcagcccgcacgaatttgccgtagagcggctggatggcaactttaccatgcagctggaaaagggccagatcctcaaagtccagcctggcgtaggccgcctgctagggctgttgagcttgcagagtttgccacgccgcttgacgctggatttccgcgacctgtttagtgaaggctttgcgtttgacaagatcacctctaccgcaaatattagggatggcattttgcgcagtgacgacctgtttatgaccggtcccgcagcagaggcgcgcatcaaaggcgaaaccaatttaaaaacagaaacacaacgcttgcgcgtgaaagtggtgccgcatatcagtgattccgtatccttggcagcactggcaggcggaccgattgttggcgtggccgcctttgttgcacaaaagctgctcaaagacccgcttaacaaaatcagtgccagtgagtatatgattacaggcacctgggacaacccgcaggaagccgatatagataaaaagacacccgctgcgccttctgttcaacccttgaaaagtcagcattaa

SEQ ID NO: 49378 - DNA, 540 bp, Glycine max
  Peptide Sequence Number=SeqID_166156
atggaaggctcattcctctgcactgccatcatccccaacttcctcacaaggttacaaggactaaagagttgtgccaccatgtcggacgatgaaagggaggagaaagagttggatctctcttctgccgaagttgtcaccaaatacaaaaccactgctgagatcgttaacagtgtgttcctcactctcttacacttaatgtttgtggtctcaaattctatctgggttttgaatgtaaaccgaaggcgaagattgtggatatttgtgagaaaggggattcatacattagagagtaagcttataatattcataaatgaaggagcattgcctgttcttaacatatatcaaactggaaatgtgtacaagaatgtgaagaggaagattgagagatgtgttgctttcccaacatgtttatctgtaaacagcgttgtctgccatttctctccaatggagtcagtggtttctgctattattctgaagttgatgtgtaaggtcatacactattataagcaattcagcttagtaaaatcggagagaaattag

SEQ ID NO: 49379 - DNA, 388 bp, Glycine max
  Peptide Sequence Number=SeqID_166157
cgacaaagtgataaatgtattcaaggaattgcaggagatcctcatcaaattcctaacactgctcattgctctgatttcagtaacaaacactgattcagggaagcttttgtttacagaacagcacaagctactgatgtctctgattttaaccattgtcttatacttcttctttgcttccattgggacaatacttcagatatataagggaagccttcttcaacacgtaatttgggtcatgcttattgtgggagctgttgtttcagttctggctttgagcttcatttcagccaccgtagcttggatcactttggctatgtgggttggaatattagcagtggttgcctacgactatggtgttcctcaaaggatcacgaattggattaattaa

SEQ ID NO: 49380 - DNA, 181 bp, Glycine max
  Peptide Sequence Number=SeqID_166158
atttttagtgcatcaacaaggaaggaagaatttatgggttgataaagcagcttgtttggcacacttgcatgcacttagcacgttagagtcaactgggaaggccacatggcaagcatctggagactattggcggaaatttgaagctcggtgcatgtttagtgtgaggtgtgcattgaactaa

SEQ ID NO: 49381 - DNA, 2382 bp, Glycine max
  Peptide Sequence Number=SeqID_166159
atggaatgtaataaagctggtgccttaagggctaaagaacttgcagagaagatgcttttacagaggaactttggtggggcaagaatgctcgcaatgaaggctctagaattatatcccaatcttgatggtcttcctcaatttctagcaactattgaggtgtatatctcttccgaagctagagttaatggagaacttgattggtacagtatccttggtgtgcaaccgttggctgatgaagaaacaattcgaagacgatataggaaactggctcttactctgcaccctgataaaaatagatccgtaggtgcagatggggcatttaaccttgtctcacaggcttggagtttattatctgataaagccaagagaatcacctatgaccaaaagagcagtttatggggtaatggaaatcctggtgggaaaccttctatgccagctagtcagaatggtttacatactaacgtcttcaatcctgtgttgttgaaacccacattttggaccttttgcagtttctgcaagacaaagtttgagtaccataatgcttatattaacagcaatcttgtctgtacctgctgtcataagccatttttggctttcgagacattgcctccacctggatacagaaatgtttcatccacccagatgaagcagcataacttcaactcaacgagaatggaaagaagttatcatttttcaggacggacacctatgtctactgtcaattcatcacttgggtcaggccctttctctatgcctggcagtatttcccatgttccgacatcagcttctagtgctgcagaagctcctggtgcttttaggatgccatctgagaatttgaagacaaggcatgaagattcggcaactgtcttgagggaagatgcccattttgggaaagctcatgctgttgagagaactggtgctggttcagcttttcagtcctctcgttttggttcaaattctattatgaaaggagacagaccaaggaaaaaaaggcccactgatgaacataaagtttgtagtgatagaagggatatggaaaataaaacagcatctcaaaatgaaggaataaacttggcaaatggatttgggtcaggaagggttaatgctgctggaaatcacaaacgcaatggtgttagggacagatcacagcagcaaataaagaacatattggtggaaaaggctcggaaggagattcttataaagcttgatgaatggaaagcttcttctgcattaaagaatttcgacaagtcaaagaatatagacacagaaatcggagagaagggcaaagaaagggaagtaaatggtgtaaaacctggtgcacaagttggtgattctgagaccgtggacaagaagtgtttctctgctgatccagagccagagctgcctgtttctctctcaatgaatgttcctgatccagatttccatgattttgatggagaccgaattgaaaatgcttttggtgagaaccaggtatgggctgcatatgataatgatgatggcatgccgcgctacttttgcttaatccatgatgttatctcgaaaaaacctttgaatatgaggattagctggttgaatgccaaaagcaatgatgaattggccccaataaagtgggtcagttctggctttcctaagaccagcggagatttcagaataggaaagcgtgtatcctatagcactcttaattccttctcccacagggttaaatggacaaaaggttcaagagggattgttcatatatatccgaagaaaggtgacgtatgggctttgtatcggaactggtcccttgactggaatgaatttaccgatgatgaaatcatacagaaatatgacatggtggaggtgcttgaagactacagtgaagagaaaggtgtgaatattgccccacttgtcaaggttgcaggtttcaagacagtattccgacagaacgctgatccaagaaaagtcaggaatatttcaaaggcggagatgtttcgtttctcacaccaggtaccttcatacctgcttactggtgaagagggtcagaatgctccaaaaggttgcttggagcttgatcctgctgctacaccgatggaactttttcaggtgttagccgaagatctggagcaagaaattgtaatgacaactgaaaaatctgtggaagatgaattgaagcacaaagagaattccggggaggagggtttgatcaagaagtgccagacaactaaggaagaaggttctgatgaagaaggattggtgggagagaagaaaaggaagcctgagagttgccagacaactaaggaagaacgttccaatgaagaactgggagagaagaaaaggaagcctgagatcttgtttgtatataagcggagacgtctaggtgaaaagagagctgtgaagtgttaa

SEQ ID NO: 49382 - DNA, 903 bp, Glycine max
  Peptide Sequence Number=SeqID_166160
atggagaccaacaaccagcaacaacaacaacaaggagctcaagcccaatcgggaccctaccccgtcgccggcgccggcggcagtgcaggtgcaggtgcaggcgctcctccccctttccagcaccttctccagcagcagcagcagcagctccagatgttctggtcttaccagcgtcaagaaatcgagcacgtgaacgactttaagaatcaccagctccctcttgcccgcatcaagaagatcatgaaggccgacgaggatgtccgcatgatctccgccgaggcccccatcctcttcgccaaggcctgcgagctcttcatcctcgagctcaccatccgctcctggctccacgccgaggagaacaagcgccgcaccctccagaagaacgacatcgccgccgccatcacccgcaccgacattttcgacttcctcgttgatattgtcccccgcgacgagatcaaggacgacgctgctcttgtgggggccaccgccagtggggtgccttactactacccgcccattggacagcctgccgggatgatgattggccgccccgccgtcgatcccgccaccggggtttatgtccagccgccctcccaggcatggcagtccgtctggcagtccgctgccgaggacgcttcctatggcaccggcggggccggtgcccagcggagccttgatggccagaggatatcccctagccgagagctagagactaatccttcaaggtacttagatccatgtaagaggatgacttctcccaatagatgttcttccatccgtctattctatttaaaacatgctagtagtaggcgtgagctcttgtgcatgagatcgggcaaagtagagctgatgcaaatgataagtctctccccctcttcccacaaaatggacctatctttctag

SEQ ID NO: 49383 - DNA, 297 bp, Glycine max
  Peptide Sequence Number=SeqID_166161
atgaagtgcactccctcatcttcgtttttcgaaggcgtaatcggtcctctacctcgtaggcttcttttcaaccccaacatcatcgccgacagctctgacgtcatcttctacatcgtaggtcacccctcctccgtcctttttgtgatgaacggaaagggtggggcattatcgtcgtcttcgtcatgtcctatgatggttaagtgcaaatgtgaggaatccaatttttgcagaatttttcaatgggttgatgatactgaggtcgtggcaataatgtttttgcagaagggagtgaattga

SEQ ID NO: 49384 - DNA, 297 bp, Glycine max
  Peptide Sequence Number=SeqID_166162
atgggcttagaggtgattggtggtgctttgaaaaagataagagaaagtataaaatatgtgagagcatcggaggcaataaagattgcattcaaaaagtgtgttcttcaagtgaggggtattgatactaaggtgggtttgagaatgaatgtagcttgtcgcaacctactcttcgacgggagggcgatgcgtgactcgcgggtgcgtgttacaagaaaggaatacgcatggagtcgccaccaacgtttatttgaggaaaatatcggaaaaaccggaaaagatgtgatctacgaactttaa

SEQ ID NO: 49385 - DNA, 600 bp, Glycine max
  Peptide Sequence Number=SeqID_166163
atgataggcaagcaagtcgcatccaaaggcatcaccattgttgacgacggcaccatcgctgaccgccgtggctctttaaccatggacgatgaaggcaatgcgccacaaaatactgttttaattgaagacggcatcctgcgtggttacatccaggacactttgaatgcccgcctgatgggcatgggtctcaccggcaacgcacgccgtgaaagctacgcgcatatccccatgccacgtatgaccaatacctatatgctcaacggcgacaaagacccgcaagagatcatcaagtcggtgaaaaaaggcctctatgcagccaactttggtggtggccaggttgacattaccagcggtaagttcgtctttagcgcggccgaagcttatatgattgaagacggcaaaattacctatccggtaaaaggtgctacactgattggcaacggccccgacgtactgaccaaagtcagcatgattggtaatgatatggcgctggatagtggcgttggtacttgtggtaaagaaggccaaagtgtgcctgtgggtgtgggtcagcctactttgaagattgatgggttgactgttggtggtacatcagcttaa

SEQ ID NO: 49386 - DNA, 915 bp, Glycine max
  Peptide Sequence Number=SeqID_166164
atgcctcctgatgtaattcaatttcgtcctaccttagcacctcttcaattttcttcacaacttacattaaagcaacgttctagcccaagagatcatcgccaaggaatgaacctcaccaacaaaaagaaactcatgcctatccttcttttgatcctttcaatcatatcaatactcaggcttctgagcctcattctccgcacttcatcatctgctactatgtctccaccacccagttcttcacttttttccactcacaacaaagttgcaaaacatgcacccgattcctcaaagcaccccaattccaccctaactgaaaaagagttcaaagttctctcaaacctcgttgctcttaaatccccaagcaacctcctcatatttgggttccaaccgcagtaccttaccctctcttcaatgaatgcacctggaagcaccatctttctttatgatgacatgatagccaaggtagcaacaaactccaataacactcaaacatacaaacttgggtataatgtgccatctaaaaaggcttataatttgctcaaacatgcaaggcagaaccaattagcttgtgcaccaagttacccaaaactactgcttcagaaatcgaaatgtaagcttgcattgatgaatttacctgcagaagtgtatgaaaagaagtgggatatcattgtggtagatggacccaaaggggattcgccagagtcaccgggtaggatgggttctatatacactgctagtgttctagctagagctgggaatgtttctgacgtagttgtgcatgatgtggatcgtatgatagagaaatggttttccttggagtttctctgccatgagaatttgttgtgttctaaagggaaattgtggcacttcaggatcagtggtcactccaattcaacaacgttctgcacttcctga

SEQ ID NO: 49387 - DNA, 1332 bp, Glycine max
  Peptide Sequence Number=SeqID_166165
atgggggagcaacacgagaacgagaatgggagaacgggaacaaagaaccagcatcagcagaagaagaagaagaagaaaagcgagttcgagttctgcaaagcgtgcaacataaaccacgaccaaggtctccgccacaagtactttcctaatcacaagaaatccctctccaccttcctctcccgcttccgcaaaaaactctccgacgttcgcttcttcctcaacgccccaatccctctcaatccccaactcgcttctcgcaatcgcttctggtgcgtcttctgcgaccagcacatcgacgaactcaacagttcctttgcctgcgctaacgcgattcgtcacctcgcgagtgcggaacacgtgaagaatttgaagcaattcttctggaaatacggtggtgccgcggatcaattggacgcgtttatggtttctgacgatgacgtggataagtgggagaagaagtgcacggctcgaaaggatgaagcgagtgagggaagtcgcagaacagtgattggtccttcaagtgatgatatccatagtggaaatgttgatagttttgaaaaaaatgtttattccaattctctgaaatcgtatccttcaaatgctgttttgcctttacaaagctatacaaatgagtatcaggtatcttgttcaggactctccggagttgccactggtgctacctcttcagaagtttgctctggtgcaaataatttttctttgcaagattttgcagttggacgtagtagcctttctctccctcatgatggtagacaacggtcaagtaatggttactcctgtaataaaaaggtgcgtgaaaatggaagaatggtaagcggagagagcagtcatcagggtgtacaaatggtcactcagatatctactggaagtgctgggggaaaggttttttctgaagaacctccaccatggcttggaacaactgatgaagttcagatgcgttcttcaaacaagttagggaagtccaaaaagttgaattcaaaacgggttggagcagcttgggttgaaaagaggaagattgaaatggagaaggaaaggaggggggagtctataaggaatgagtgtgattccaactggcttcctaattttggtagagtctggcaatctggtagcagaagagaatccagaaaagagtttgagagggagaaacagaagttaaatgttgaaactcaatctgagatggcaatcaagataaagccttatgtaagcaaaagaatgcggatggatagtggagttattgggtgcttattgtcgccaggcagcttgcttttgaatgtagggatggttgttatcgatactcagataggcattgcctag

SEQ ID NO: 49388 - DNA, 1092 bp, Glycine max
  Peptide Sequence Number=SeqID_166166
atggggactaacaggcaggagcatgaaatttcaggaggatccgaggtaacatatcaggagatggtagaaaatgaagtcaaggacactcagaaaggtccaacacgcaaattaataactgagagctgcaaatcaaacagcatggttataaagaaacgacatacgttgattcctcctcacatcatagctgaagccatatcaactatccctgatcttgacattagatggtcaggtccaatcacaccaaaagaaatggaatatgttgaacaatatgttctagcaaagtatccagaatattcaggcctcatggaaggagaaggaaatgggataaacttgtctagctttatgatctttgaggagcctaattcagaaccaatgatggatgataggggcaagtcaccaagagagtcttctacatatttgtttggaagcaataatctccctgaaatggatagggccaaaatccagttagagccatcaagattactagacattctcaacaagaaatcctcattccctggaagtttcatctctatcccagaaatccaagcacgcaacaaggttttgaagcattatggtttgcctgatgaagagtaccttgttctcttcactccaagctacaaggatgctatgatgttggtgggagaaagttacccttttgtcaaggggaactattacatgaccattcttgaccaggaagaagactatataagggaatttgcttcttttaaggagtccaaggtgatctcagcaccaaagacttggctggatttgaggatcagcgggtctcagcttagccaaaacttcaggaggaggtgtaagatcagctcaaaaggcttgttctcttatccggtcgatgcaaatggaacaatgcattggatttctgaggctcataggaacaattggcatgttctacttgatgcttctgccttggaagtgggaaaggaccggctgcatcttctggcacttcaccggccggactttgtgatctgtagtcttgacaaccctcattccaatccttcaagagtcacctgcctcttagtgagaaagaaatcctttgaggtctcagctacttcatctcaggcagttgaatga

SEQ ID NO: 49389 - DNA, 669 bp, Glycine max
  Peptide Sequence Number=SeqID_166167
atgtccatcatctccgccactatattcgccggtcttgatgtccataatctccgccactatatttgccggcctcttggtctccgtcgccgtcgaaatcaaagagatgcggtggctctggcatcacaatactcaactactctaaaactaaaaccctattcctctgtttttgttattcccatcatcatcacgatgatggctccttctcagccacctcattgggccccatctccaacaccaatcctcagcaagtctttcctacccccgccgtcaaactcgccggcggttgacttcactccgcccttaatagcaatggtcgtcgtcgtcgccgccgcgtttcttgtcgtcacctactcccgcctcatcgcgcgtcacctcagaccacccgtccaccgcctcctctgccgcttccgacgccgccgcttcctcccctcctccgtcggcgacctcaagaccctcccctacgattctcccttcgacggaccgcacgtgttctccccctacggtttggacgaaacggtgattaaaacaatcccgttctcgctttatacagcgaaatacgacgcgcattttgatgagtctcgctacgactgcgccaaagagaagagagaagagagaagagaaccagagagaagagagaaagagaagaccaaccagagagagaaaagttga

SEQ ID NO: 49390 - DNA, 183 bp, Glycine max
  Peptide Sequence Number=SeqID_166168
atgaaccaggagcttctcaagccttccgcattcgtcatgctccattgtcactccaatgtgctcgtggacatgggtggccttgagatagtgaggggcacgatggagggaggtaatgactacttgcagcactcctcaacaaacaattgttacttgcaaagttgtaacaatgttgttaagaagtaa

SEQ ID NO: 49391 - DNA, 351 bp, Glycine max
  Peptide Sequence Number=SeqID_166169
atgccggatcagtggaagcatgatgctgcaaaatacatgaactgtagcttgttgttcataccgttcatatacttgggcataccaattcggacaaacccatggcaatgtcagttgtgggatcctatcattaacaaggttcctaatagagtggtggacaagctggtgagtatacaacgccgattcttatggggtggcggcattgaacaaaagaagattgcatggattaagtgggatacaatgtggcttccaaaggaaaaagggggattaggcctcaaggacattaagaccttcaatcttgcactgtttggcaaatggaaatggagtttatttcagcaccaaggagaattatag

SEQ ID NO: 49392 - DNA, 165 bp, Glycine max
  Peptide Sequence Number=SeqID_166170
atgtccaaattggtcaataatagtaagaagaaatgggataacctcgttgaagggcagaggatatggaatattgaaaataaatactatgattctgaaaattcatctgggacccccaccagaggagctgctttttcttccttcgagaggatttccaccgggtattag

SEQ ID NO: 49393 - DNA, 306 bp, Glycine max
  Peptide Sequence Number=SeqID_166171
atgggaaacttggctcagggcatttcggcctgttccttttctctgtttttgtttagtgtgggcgaaaaagtagctggcgcacaagagtttggtagcttaacagtgaatggatcgtctttcttggggacatccttctgttccttcttttgggggccagggcaaaatttcccttcctgggtcaaggccggtggaagggttaagattttggctcaaagggcttgtagaaaggctggacatgatgtatgtcaaggcattggttttgccagcgctttagggataagggaatgtaccatatcatttccatga

SEQ ID NO: 49394 - DNA, 435 bp, Glycine max
  Peptide Sequence Number=SeqID_166172
atgaacccgacaagaagttattatatccaacgggacaaagtggtgaatgtattcatggaattgcaggagatccttatcaaattcttaacactcctcattgctttgatttcagtaacaaacactgagtcagggaagcttttgtttacagaacagcacaagctaatgatgtctgtgattattctaagcattgtcttacacttattctttgcttccattgggacaatacttcagatatataagggaagccttcttcaactcgtaatttgggtcatgcttattgtgggagctgttgtttcagttctggctttgagcctcatttcagccaccgtagcttggatcactttggccatgtgggttggaatattcgcagtggttgcctacgactatggtgttcttcacaggatcatgaattggattaagggtccatcacactga

SEQ ID NO: 49395 - DNA, 515 bp, Glycine max
  Peptide Sequence Number=SeqID_166173
atgaactcgctgagcgaaacaacctcacttagcgagttcattgaaaacccagaaagtgaggctagtgagcctcaagtccttaagccaccatacaggcttagaagctcaaggctaagtaagcctagaccacttttgagttgctcgctgaatgcacatgcctcgcttagcgaggtctcgcttagcccaatttgcattaaagttcacacagaggcatttttgagctcaacgtatatgcacactgagcaagggatgtggtttggcatgcttagcaagaatacagctcacttagcgcatagacttcctatgcttagcgcacagggtgcgcttaacgagatggcaacaacccgtgcctacatgcagtctgtcgcaacctacccttcggcgggagggcgacgcgaggctcgcgggatgcgtgttccacgaaaggaatacgcgcggagtcgccaccaatgtttatttgaggaaaacgtcagaaaaaccggaaaagacgcgatctacgaacttttaagtgaaag

SEQ ID NO: 49396 - DNA, 306 bp, Glycine max
  Peptide Sequence Number=SeqID_166174
atgcatgttggactggagtggttcgacatgccacatactactttttgttttgtaaaaactagtttctcgttcgtgcattgcccgggacttaaaagtacaatctcggaggaagatctttttccacttgataatgagattgaaagaacttgtcagaggaacaacaccataaagaaaaagcgacaacaacaagagaagagggctggacaaagggctcaagaagcctctccttctcaaccaacatcaccaccttcacctcctcccagcctagaggagcctccgatcatggcggaagaagagcaaccctga

SEQ ID NO: 49397 - DNA, 840 bp, Glycine max
  Peptide Sequence Number=SeqID_166175
atggaaattcgcaacgcgatcaagatagcaagactgcctaatgatatgattcgtctcgacttgttttcattttctttggtcaatgatgcaaagaaatggctagattctttcaaaggtcatagcttaagggattggaatgaagtgttggacaagactaattttgagggttactttggaagactcctaactcatagatttagtgagccgatgcaaattaatatgttcatcgatggattaagacctcatactagacaattatttgatgctttcatgggtggtaagattaagttggagaccccagaggttgtaatggaacttggaaatatggttgctagtgatgaggctattcatagggatagaacttttattccagccaagaagaacctattagccaaacaaattgaagccttaacggataaactcaacaacctcccacaacaacttcatgttgttcaacctactcaaccttccaatattcaagttggaggatgtaccttatgtggtggggctcatgaagttgggttgtgcatgatccaagatgaggctaacaaggagctcaattatatggcaacggtgcttacaaggagtttgagaaaggatagccctgttcatgatgggattgtagaggatgtagtggaggttgcaagtgatagggatgatgttgtaggtgttgatgaggtcttaagtcacaagaccaaaagtcaagtagtgagaaaaatagagaaatgtgtaagtagtgaccccaccaaggatgtgccctatcctttggtaccatcaaagaaggagaaggagagccactttgccaaatttcaagatatgttcaagcagttggagaccatt

SEQ ID NO: 49398 - DNA, 426 bp, Glycine max
  Peptide Sequence Number=SeqID_166176
atgtgtgtcctgaattcctctcattccatttcaatgagggacaaagtggtgaatgtattcaaggaattgcaggagatcctcatcaaattcttaacactgctcattgctttgatttcagtaacaaacactgagtcaggaaagcttttgtttacagaacagcacaagctcttgatgtctctgattctaaccatcgtcttatacttcttctgtgctaccattgggacaatacttcaaatatataagggaagccttcttcaactcataatttggaccatgcttattgttggagctgttgtttcagttctttctttgagcttcatttcatccaccgtagcttggatcactttggccatgtgggttggaatatttgcagtggttgcctatgactatggtgttcctcaaaggatcatcaattggattaattaa

SEQ ID NO: 49399 - DNA, 366 bp, Glycine max
  Peptide Sequence Number=SeqID_166177
atgggtttgggcagatacccacgggtaactaaaaattatctcaacaacaactcctcgtcgtcgttcagaccaggcatatcggtggtgggctacgttttgacaaccatagtctcccttacattgctcctcttcctctacatcaaacactgcaacggcggcatcacagacgacaaaggcggaaactcagctccgtggacggtggtgtcattcgccagaaggaaaaaatctgtcattgacctgtctgtggtggaatcgttactgattttcatattcggagccctatggaggcaaaaggaaggactcgattgcatagtcaatgttgggaactcagatagcgagttaaaaaataggggaccgattaagtga

SEQ ID NO: 49400 - DNA, 228 bp, Glycine max
  Peptide Sequence Number=SeqID_166178
atgtcggatacaatgtccaggacatcctgcccgaaaatactggagttgctaaaagcattgaagttgcaggatccacgatgtcggatacgatgtccaggacatcttgcccgaaaatactggacatataaatctgttatatctttaacagattattgtgcaattttcaggaagaatgatagatctcatccagcacaagctgttgcagcccagacccacacactgctataa

SEQ ID NO: 49401 - DNA, 516 bp, Glycine max
  Peptide Sequence Number=SeqID_166179
atgcagttagagctagtgcttgagctagagtgtggagtaggcaaatggtacccaaatgtggcacggggtgtcgaccactttattgagtacctcagattcatgatgatgtccttagttaagcttgtagaggcaccagtcctatactattgtaatactgttatgccaccttatggagatcatagagatttcctcttctttgtcgtcatcattttcattcgacacaccaaactatgcactagggtcatccaagggccaccatacgccgaggaagactctcctcattatgtgctagggccaccatacactggggatgacttagagcacactgtggcaacccctcttgttccaataccaaatgtgagggacgacaacattgaggaggatccagagatgatggaggagtatcgatcaaaggtggcagaggagcctagtgatctagtgatcagggtatggaggatgacaccaggggcagacccaacgaaaaagattaggggggggggggcaaatataacctag

SEQ ID NO: 49402 - DNA, 672 bp, Glycine max
  Peptide Sequence Number=SeqID_166180
atgccaccatttggcttcccatctccaccgcaagatcactctcctaaacccaattgtaactcacctcctcaagtcaatgtagccaatgcttctaacacctcatcaaacagctggaaagcaaagtacggagatggtgttgtgtgggaagaggggcaccacgtggacactggagaagctggacgactcttgtttggagaggtgttgcagaaggcttatccctgtgacgacggcgaatgtgaccctgacaatggcaggtgctcttacgcgcacggtaaggattcagagtcatgcgaggctgtccgtgattctagcggatgtgaaagagatctggttgacgccgttggaaagattttgaaggacaagcaataccgtgggcggtttttgggacaactccaaagatgggatcgcagagcacatcgtagaggtggagacaatttaccacgatgggtacgacagtgtctaaattcctccgacaaaaccgtttgtgctgcaaattgttttgtcactagagtggtcacctctggcgaaatctgtttcgattgtggccacgacttcatcggaatctgtgtggttgacgcggaagtgaagcggggtgatttgggagatgatggagtgattgtgagagccaataaccagtcaaggatgacgtcgagcttaatagccaactcctga

SEQ ID NO: 49403 - DNA, 330 bp, Glycine max
  Peptide Sequence Number=SeqID_166181
atggtgctttcatcagcccactcccttcccacacacactccatcacctcccatggacattccggtgtctaacaggaaggttgtgtctggtttgaagtccatcacgtctaaacacctggcgttggcaagtcaagtcattagttttgtacatgctattattccagaaattcggaagattctttttcttaaagtacctgagactagaaaaacactattgctttctgagatcgatcgggttgctcagaggaagggaagcagtaatagagaggacaagacttgcacaaatatttgcaagttgaaaattgcaattgcaacaatatgtgagtgttga

SEQ ID NO: 49404 - DNA, 651 bp, Glycine max
  Peptide Sequence Number=SeqID_166182
atggcttctgcaaacaacaattcttctccgtcaccacctatgccgcctgtttcgacaccggcactgtgctcccctgccttgttctcgcatgatgtaacggcgaaactcatggattccaattaccttttatggtgttctcaggttcaacctgtaatcatcggccatgatcacgagaacaacatcgttagtgctgcctatcgtttctgggagcaagaggatcaatttttcctctcttggcttcaatcgactatttcagaagcagttcttccttgcatcatcaattgcgcaacctcgtggcatctgtgggatcaattgcatgagcactttcaatccattgcaagtgcaaagaagaagcaatcacatagtgattttctaagtttggacgatgtcacttccatgccactggctgaggaatctagcattgaaaagtctcgcaagaagaatttgggctcattgaatcttgtcgagggttcgaattccaattctacttctgaagctcaagttcatctaactcagggtaacacacactcctcctcaaactatgattttgtgtctgagggaggggtgatggtggccattcgtacggtcgaggtggagctcgtgggagagggcgtggcagagcatggcagatttgctcatgttcagtgttag

SEQ ID NO: 49405 - DNA, 1284 bp, Glycine max
  Peptide Sequence Number=SeqID_166183
atggatcagatgatgtcatttggcatggcacatttagtgcgggctgctgaagtgaaaaagacgattgaatggattttaagcaaccgtgatggtcattatgctaccgattcagttgtggcggcaattgttcatggtgctgtagctgcagaaacatcccaagaaagcgagtctcatggtactacatttttgccatattcaccacaaagaagtattgccaagggttcttcatttcagggaaaagcaattgattctgtgagctcctcaaacatgtcaaaaaatttcagttgttttcccatttgtttgatattctcaaacaatctggttctaaacagagctgatatattgcgagaaaacgcagaagctgtctttgcagcatgtgatgctgctcatggaagatgggcaaagcttcttggggtccgtgcaattcttcatcctaggttgaaattgcaggagtttctaaccatatacaacattacccaggagttcattactgctacagaaaaaattggtgggagattgggatacagcatccgtgggacactgcaatcacaggccaaggcttttgttgattttcagcatgaatctcggatgtcaaagattaaggcagtgcttgaccaggaaacctgggtggagatagatgttcctgatgaatttcaatccatcattaatttgctttttacatctgataatttggcttctgagaaccttaatgaaatcgaggatgatatttctaccagttacaatggtgtggtgactaataatgatgttctgccgatggcagacagttcagagtcaactgctgaacagcaaattatgcggtctaattccattgaagcatctttgaataatgaaacatcagatagatccaagtccccggttgattcaacggaaccaaataaagctcatggtaggatttcatcagcacatagtaacaatactgagaaagaccataaaaaatctacatctcaggctctttattacaaaggtgttggttatcacatggtaaactgtggcttaatattgctgaagatgttgtcggagtacattgatatgaacaaccttttgccaacactatcttcagaagttgttcaccgtgtagtagaaatcttgaagtttttcaacacaagaacatgccaacttgtgcttggggctggtgctatgcagcctctatcatatccttgttcatccgcctcaacatttccatttcttgtgcacttaatttttgctcttgctggcacctcatttctcaatattcagtaccatagagcatcaccggtcttttag

SEQ ID NO: 49406 - DNA, 285 bp, Glycine max
  Peptide Sequence Number=SeqID_166184
atgaaaggagagaattttctacaattggggtggatggacatagactatgctatatggaaaaatgaaccacccacaatcattgatgaaagtagcccagctgttgttgtgctatatgagcagtgggagcgatccaaccagcttagcctgatgttcattaagaccaaaatctcagccaagatacatggttctgtcgaccagcatgaaaaggtccgagacttgctgaaggccattgatgaccagttcatcacttcagataaggctttagcaagcaccctaatcatttag

SEQ ID NO: 49407 - DNA, 581 bp, Glycine max
  Peptide Sequence Number=SeqID_166185
atggaatccttactgacagcacagcagcaaagattgctggatacgctgctggacaatctggatggcatgatctaccgctgcctgtatgacagcagctggaccatgatttacatcagcaagggctgtgagcctctcacaggttaccctgcgcaggagttattgctgaacaaaaccatttcctacgaaaacattacccatccggatgaccgggaaaaagcacgggccacgattgccgcggccatcgacaaaggcgagcgctttgaactggaataccgcattgtccgcgccgatggtgaagaggtgtgggtcgccgagcgcggcagtgctgtgctggatccttctgggcagccagttgcgctcgaagggattattcaagacatcagcagccgtaaacgcattgagcatgagttatttagtaccgaacaaaaataccgttccatgttcgagaactcgacactgggcatgttccagactaccgagtctggcacttatctgaatgccaatccggccttggccaagctctatggttatgcttcacctgccgccctgattagtgacttgaataatatcagctcgcagct

SEQ ID NO: 49408 - DNA, 1248 bp, Glycine max
  Peptide Sequence Number=SeqID_166186
ggcctgtgcagcacttaacgccaccagttgcccatccactaaaggctgtagcaatttattctgagggccaaaacgtcgcgaaaatccgcctgccagcaataagccgacaacaggttaaaaggtggtcaacaactcacttcactggcgcgttcatgtatgctcttgccatcctcttgtctggagcacttatgatttcgcctaaacgtttatattacagtgtgttacttggtttattaagttttcctatatgggtatgggcacagcttgcggttggcgattatgagtttgccgtgaccatcaatggtgacaagcgcccttatctggttcatgtgcccatgcagtcgaaagctggccaggccttgcccatggtgctggtattgcatggcggcctgggtaatatgcaggtacaggccaatgagcgcttttaccaccaggtttcggccgcagaaaaatatggctacattgtggtgtttccgaatggatacagccgtttcccgggtggcaagtttgccacctggaacgcgggcaattgttgtggtcctgccgtcaaaaaacaaagtgatgatgttgccgtgatccgcgccatcatccaggaaatgcagcaacgcgccaatgtggatgccaagcgcatttttgtcgatggcatgtccaatggtggcatgatgagctatcgcttagcttgcgaactctctgagaccgtaagcgcaatcgcttcggtggcaggtaccgacaatacacaagattgccaacctgccaggccggtcgccgtgctacatattcatgctaaagatgacgaccatgtgccgtttaatggtggcaaaggccagcaatcgatggcggatgtgagtttcaattcggtggcggcgacggtgcaaaaatgggtgcagctcaaccaggcaaatgcacaagccgaacgtattgtagaggtcgcaggcgcttattgcgagattcaccgtggcggactggcaccagtgcaattctgtgtcaccgagacaggtggccactcctggcccggcggcagtaagccacgaggtgggactgccggctccacggcgatttctgccaatgatgtgatctggcagccggttcgctgtgacttcgttgcgatgcacaccaaagtaataattattgaatttctggctgttccaggtcgccccgaccaacccattcaggcgtgccatagtcagtttgccaacgcagcagtggggccgacaaagattgaaaaagtccctgtcgtccatgccgcgg

SEQ ID NO: 49409 - DNA, 222 bp, Glycine max
  Peptide Sequence Number=SeqID_166187
atgagaaacaacgtaaactgcatgctttccctcccaccagctcacgtgaaagttgtcccgcttggtcacatgctggtttcgccaatgtcaatggcgaaatgccatgctggtttcgcagcccctattggcgaaatgtcatgctccatgccacgtggacaacaacctgaaaaagctgaaagcatgcgaatccacgtgaagtctctgtttcgcagcctcgactag

SEQ ID NO: 49410 - DNA, 600 bp, Glycine max
  Peptide Sequence Number=SeqID_166188
atgaacataggagctcttatttctggccagatgacttctatagcccattctaacacctctagacttgggtttcctactctgatcaccacactatgtagagctagaggggttgtctctgacagccttacttttgagtgcctgagtctgagtttacaagtggtggcacctccaggatctattccttcagttgagcaattcagggagatggtagcctggcccgggactcaaccttctcttcatatggaagatgaaggtcctacagcccaggtaccacaacatgtggaggatgagtcatctgaggccaccattccagagccatttgttcaagggggggaggcaggtgagacacaggtgagacaggtagctgctaccactaagagatctcttgaggtcactttagagcctcctacaccagtggtggacctaccctcatctcagtgtacaatagacccctccactcctattctagagatactagaggacccaaccacaccagtcctggctatggacacttcacctccagctactccagtacttcatctgacagatgaggaggatgttcagacacaggatactcaggatcagtcacagaaattctaa

SEQ ID NO: 49411 - DNA, 225 bp, Glycine max
  Peptide Sequence Number=SeqID_166189
atgtcgaacccaattgcctcaaaagttgacggagaatctttaatttcttttgccaagtatcaccaggcaaagtatttggtaacaaagtcaagttgcatgccatacattatgaaattctttctcctggttgcatcaactaatcaagtaaatttaaaaggtacctataaccctatgtcttataggcttgatatccacaagcaagtgaaaagagatattgtggactaa

SEQ ID NO: 49412 - DNA, 303 bp, Glycine max
  Peptide Sequence Number=SeqID_166190
atgaaggaggaggaatcaacagcaattccgattgaggacgaagacgatccttcatcaacgcttctggatctcacgagctaccagctccacgaccttgacttggtcgagttgccacccaatcttactgcgaatcgcttgtccctgctggacccgcacatagggaacctctcccatctcaagaagctttcccattgtgaaaacctagccgtcgttcccctctctttccccaaaacgtcgtctcctctctcaagcgatttcgcggaggttctagacgtgtatgagaggggagatgggctctactag

SEQ ID NO: 49413 - DNA, 171 bp, Glycine max
  Peptide Sequence Number=SeqID_166191
atggtgttgcgagagtacgagagtgggagtgagagtgtgagattgggagtagggtgtgcgagagtgcgagagtacgagaggttagacggcacagtggtggtggtcgacaccacggttagcggtggtggtggtttctgttggagaaagagaaggagagaaagggaagaatga

SEQ ID NO: 49414 - DNA, 279 bp, Glycine max
  Peptide Sequence Number=SeqID_166192
atgagtataacgtatgacatgggaaattgtggactagttttggatcggaagtatggttcgctggcactagcgtcagtcccacgcgtcacaggacagccatcatgtataacagactatgaccaggagaaattccattacgttacgtggccttgctttatgttatttgttactttcctctttgcaaaatcgatagcttcattctttgactctctcatacatgtcagcgatcctatttgctttcaagcctgttcgaagacggtgttactcctttctccttga

SEQ ID NO: 49415 - DNA, 621 bp, Glycine max
  Peptide Sequence Number=SeqID_166193
atggtgaatgaagctagagttgctgaattaattgttggttttgttgacgcaaaagcggctcgtgacggtcaccggtggtcagtggtggtggaggaggagcttgggggtgttggggaaggtttatgtgaagagaaggaggaagaatctgactgttttacactgctgaacgtatttgaagcctgcaacactcacccaggcgagtttggctcgcctgggcgagctgatccacagctcaaattttcggcttcgtttctgttcggtgattgtgctctgcgtttagggtttgagatggaggcaaagaacaaagtgaagatcgaggattctacaacggagtctccaacttcggtccttgaagacgagaactggtgggattttggtaagatggatttcttcatgcttatcacgacttatgggaagctaggagacttcaatggtgccgagaaggtcttaggcttgatgaataagaatggttatgcacctaatgtggtgtctcagactgcacttatggaagcttatggaaaaggaggcagatataataatgctgaagcaatattccgaaggatgcagaaatggggccttgaaccttctgctttcacatacccgataattcttaaaacattt

SEQ ID NO: 49416 - DNA, 551 bp, Glycine max
  Peptide Sequence Number=SeqID_166194
cggctcgtgacggtcaccggtggtcagtggtggtggaggaggagcttgggggtgttggggaaggtttatgtgaagagaaggaggaagaatctgactgttttacactgctgaacgtatttgaagcctgcaacactcacccaggcgagtttggctcgcctgggcgagctgatccacagctcaaaatttctgctttgtttctgttcggtgattgtgctctgcgtttagggtttgagatggaggcaaagaacaaagtgaagatcgaggattctacaacggagtctccaacttcggtccttgaagacgagatggatttcttcatgcttatcacgacttatgggaagctaggagacttcaatggtgccgagaaggtcttaggcttgatgaataagaatggttatgcacctaatgtggtgtctcagactgcacttatggaagcttatggaaaaggaggcagatataataatgctgaagcaatattccgaaggatgcagaaatggggccttgaaccttctgctttcacataccagataattcttaaaacatttgttcat

SEQ ID NO: 49417 - DNA, 1203 bp, Glycine max
  Peptide Sequence Number=SeqID_166195
atggcggatgctacacataatcacgttcttgagcatgaaattgaagatcgcgtggagaatcgtctcagttccaagattgatgaaagattcatggagatggcagcttcgatgcagcaaactcttcatgattccctgacactgtcattagccttgtcgatatcgcagcaaatgcatgaccttatacgcaataacagtaagggtaaaactcattctccaacggggggaagcccaattcgaggtgagagatcttcttattcttgcagaacacgtctagctagaattgattttctgcgtttctctggtagtgatgttaaacaatggttaatccaatgtgatacatttttctctattgataatacacttgaggagtttaaggtaaggttggtggtggtacatttcgaagggaaggcccttcaatggcatagctcttatgtgaaatctgtaggattgcagaacctaccaccttggtcagaatatacaaggattttaattgaaaggtttggcaaagtatgtgatgatcctatggctgaattgatgcaattggggcagaagggatcgataggggaataccatgaagcttttgatgatattgtagctcgcttggatttgagtgaggagcataggctaagttgcttttcgggggggggcttaaacaagaagtccagagttcgaatgtttcaaccaaattctgtccgacgggccttcacattagcaaaaatgcatgaggcagcaactgtgcatggttctgttacaaaatcttggaataaacagtctaaacctgaggtttcttctaaaccaccattgttacctacacctcctaaaactatttccaagacacaagatatacccaaaataaagcagcaagcctctaaaactttaacccctgcgtatatgagtgatagaagagcaaaagggttatgttatttctgtgatgaaccctttacgcctgagcatggtttgagtcataaaacactgcagttgcatgtgatggaagtggatgagttacaggagggtgcagaggaagaagtgttgcttgaaaactcaacggggtccagctctatagatcctcaaatttctgtccatgccctcacaggaattgccaatttccacaccatgcgtgtgacaggctattaccaaaagaagcctctccatatgttgattgacagtgggagtgatgtgccatcattttcttctattttctaa

SEQ ID NO: 49418 - DNA, 234 bp, Glycine max
  Peptide Sequence Number=SeqID_166196
atgaaaactaaaatacctgaatatccttccatatcaaatccttctaagcagcagggacttccttccaagtctcgatcaacgtggaccatcgatctctttgccctaggtggtctagtcgctaaggatcgtagtcatgtgactttgcgtgtccacttcaaggtagacaaagactatgatggtactgcaagaggaggaggaggaggcgaggcaggtggagtagccatgggcctgtaa

SEQ ID NO: 49419 - DNA, 1711 bp, Glycine max
  Peptide Sequence Number=SeqID_166197
tgaacacggtatcacagaacgcgcgtgccctttcagaaacttcggcgggaactcgtggctagaaatggcggaggaatctagcgggcagcacgacgccacgtggaagagcaaccacgtgggcatccgacgtggcaccctccttccgctgaaaatgattctgggaatggccatcaataatggtgggggaagcgaggaaggggcattgcagacagtgctttacatgtggggctaccttcccggagctctgccgcagaggacgcccctcttgacgccggttgccgttagggttccgccgtgtgattactcttggaatgatgtttgcggcggtggctgtggattcgctattgctatatctgaatcggggaagctcatcacatggggctcaacagatgatctaggccaaagctatgtgacttctggcaagcatggggaaactccagagcctttccctcttccaacggaagcctctattgtaaaagctgcagcaggatgggctcattgtgttgctgtaacagaacatggagcagtttatacatggggatggaaagaatgtattccctctgggagggtatttggtgaaccatcaacaggggtaagtcttgagaaagatgtgccaggaaggcatagtcaagtgtccacagagcaagtgagccctcgttctcaaggctcaagatctactggaggtactgcctccagtaacagtggagaagaaagtacaaagcgaaggagagtgtcttcagcaaagcaaacagctgaaagctcgtcatccagtgatgatagtctgacagcattcccgtgtctagtcacactaaatccagggataaggatagctagtgttgctgctggtggacgtcatacgctagcgttatcagatacaggactggtgtgggcttggggctatggaggtgaagggcagcttggtttgggttccagaatacgcatggtttccactcctcatcttgttccttgtattgattcctcttattatagtaaagatagatctgctacactggctcgaggaaacatggattcagagggacaaacttttagagttcctggaagttatataaagagaattgcttgcggaggtcgacatagtgcagtaattacagatgctggagccttgcttacttttggttggggactctatggacagtgtgggcaaggaattaccgatgatgaactaagcccaacttgtgtatcttccatattgggtatccacatagagagagttgctgcaggactgtggcatacagtctgtacatctgctgatggtgatgtgtatgcatttggtgagaatcagtttgggcagttgggaactggtgctgatcaagctgagcagactctaccaagactactggattctccgagtttggataatttgcgtgcaaagaatatatcttgcggtgctcgccacactgctttagtaacagagggtggaaaagttttctgctggggatggaacaaatatggacagttaggagtagtgttgggtattagtaacattgtcgtggaatcatctcttctaagttgtgatttctgggcgttgcagctgggcctcggtgacgttgtgtacccaaaaatgttgcttgtggttggtggcatactcttcttctggccgagtcccccacttgatgtcatggtttatcagaggctcttgacccaattgttagatagtggttcggcaatgtatatgaacatacgggcagtg

SEQ ID NO: 49420 - DNA, 1827 bp, Glycine max
  Peptide Sequence Number=SeqID_166198
atggttggcgggcggcagctggcatttgaaaatgtagcagttggcggcaagtgcaagtgtctagttttcttagcgaagcaatgttcatcaagcaagacgctccaacaggttcacgcccaaatggtggtgaagtcctccatccacagccccaacaaccaccttctctccaaggccatacacctcaaaaacttcacctatgcgtcccttctcttctcccacatcgctccccaccccaacgactacgccttcaacatcatgatccgcgccctcaccaccacctggcaccactaccctctcgccctcaccctcttccaccgcatgatgtccctctccctctccccaaacaacttcaccttccccttcttcttcctctcctgcgccaacctcgccgtcctctcccccgcccgcgccgcccactccctcgtcttcaagctcgccctccactccgacccccacaccacccactccctcattaccatgtactcacgctgcggccgcgtcgcgttcgcgcgcaaggtgttcgatgaaattccccgcagggacttggtgtcgtggaactccatgatcgccgggtacgcgaaggcgggctgcgccagggaggccgtggaggtgtttggggagatggggaggagggatgggtttgagccggatgagatgagcctggtgagtgtgctcggggcttgcggtgagttgggggacttggagttggggaggtgggtggaggggtttgttgtggaacgtggcatgactcttaactcgtatattggttctgctctgattagtatgtatgctaaatgcggggatttggggtccgctagaaggatctttgatggcatggctgcaagagatgtcatcacgtggaatgctgttatatcaggatatgctcagaatggaatggcggatgaagcaatctctttattccatgctatgaaggaggactgtgttactgaaaataaaattaccttgactgcagtgctctctgcatgtgccaccattggcgctctggatttggggaaacagattgatgaatatgcatcgcaacgaggatttcagcatgatatttttgtggctactgcgttaattgatatgtatgctaagtgtgggagtttggccagtgcacagagagttttcaaagaaatgccccaaaaaaatgaagcttcttggaatgcaatgatctcagcacttgcttctcatggaaaagccaaggaggcgctatcactatttcagtgcatgtcagatgagggtggaggtgcccgtcctaatgatataacatttgtagggttgctttctgcttgtgtgcatgcaggccttgttaatgagggctatagattgtttgatatgatgagcacattgtttggattggtaccaaaaattgagcactactcttgtatggttgatcttttggctcgtgctggtcatttatacgaggcctgggatctaattgagaaaatgcccgaaaaaccagacaaggttacattaggtgctctgcttggtgcctgtcgaagtaaaaaaaatgtagatataggtgaacgggttatacggatgattctggaggtggatccttcaaattctgggaattatattatctcatcaaaaatatatgcaaatctgaacatgtgggaagattcagcaaggatgagattgttgatgagacagaagggtattactaaaactcctggttgtagctggattgaagttgagaatcacttgcatgaatttcacgctggtgatggtttatgccttgactctatagatctaagtaacattattgatttgctctatgaggaactcaaaagggaagggtatgtcccaaaagttgttgaatag

SEQ ID NO: 49421 - DNA, 519 bp, Glycine max
  Peptide Sequence Number=SeqID_166199
atgacgggagtgtccattagttggttcccacggtggaaagaaggagagccaggagtgttatgctcatgctatcctatgagaggtgagtcgtcggagaaaatcatcacgcctttcatcgagcgaggtttcaatgaagctaatgcgaagatacttcacaaaatctgtaaagcgtggaatagagtgggaagaaaagataaggagcttaggggaggtagcaatggcgtcatcagtgactatcacaagtggttgaagtctagaatgcaagggatagcctggctcccaaagctgagaagtctaagtaggaaagaggctgaaattcttgtggaaagtgaagaagtgcaagctttgaaagcagagctcgaaagaacaagattggtgaaagagaatcttaagacggtagtcactagggtcagaaaagagtgtgatgagctgaaagatatcaacatgaccacggttgaagcattagagtgggaaacaaaaagggcccgaaaggaagaatggagtaggaacaagttttga

SEQ ID NO: 49422 - DNA, 1203 bp, Glycine max
  Peptide Sequence Number=SeqID_166200
atgaaggcctcaatctccagcaatggcgattttctcaagatcgcgttcttcttcctcttcgtggccttcacgttcttcttcgtcggcaagcacttctccgacagctcctcccagcagctaatcttcttctccgccaccaccgccgccgcctccactaccaccaccgccgaggtcaccatatcccccaacttcaaccaattctttaacgtcgccgccctaatcgaagcccagacccccaaaaccaacccctcccaacaacctcctccccctccccctccgccggagcttctcgacacgatcaagcgcttcggcatcctcaatgacaacggcaccatgtccgacgacttcgagatcgggcatttcgaggaggggttgccggaggattggggaaacgacaccgtcgtcgaggattccgtctccgctcccagaatcgctgtgagcaagttcgggatgtgtccgcgcggcatgagcgagcatataccgtgtttggataacgccggcgcgattcggagactcaagtcgacgcagagaggggagaatttcgagaggcattgtccggaagaggggaaacgactcaattgcttggttccgccgcctaagggataccgtcctcctattccgtggcccagaagccgcgatgaggtctggtacaataatgttcctcacactcgtcttgttgaagataaagggggtcaaaactggattaccagaggcaaggataagttcaggtttcctgggggtggtacgcaatttatacatggagcagatcaatacttagaccatatttctgagatggttcctgatattaagtttgggcagaatataagagttgctcttgatgtcggctgtggtgtagctagttttggcgcatacttgttgtcgcgaaatgtcataaccatgtctgttgctcccaaggatgttcatgagaatcagatccagtttgctcttgagcgtggtgtgccggcaatggtggctgcatatgcaactaagcgtttattatatccaagtcaagcttttgacttgatacattgttcacgctgtagaattaattggactcgagatgatggtattttgctgctagaagttaataggatgctaagggcaggagggtactttgtttgggctgcccaaccggtttataaacatgaggaagttttagaagaacaatggaaaggtatcattcagcttgatttccattcataa

SEQ ID NO: 49423 - DNA, 715 bp, Glycine max
  Peptide Sequence Number=SeqID_166201
gtatgttaatctaaaaccatgcatctctcaattgcctgagaatggatatggagcaaatgttgcccgatggcctgtacgcttgcatacaccacctgataggcttcaaagcataaaatttgatgctttcatatccagaaatgagctttttagggcagaatcaaaatattggcatgagataataggaggctatgtacgtgctttacgctggaagaagatgagattaagaaatgttatggacatgagagctggttttggaggatttgcagctgcactgattgatcagagtatggacagctgggttatgaatgttgttcctattagtggtccaaacaccttgcctgtcatatatgaccgtgggctgattggagttatgcatgactggtgtgaaccatttgacacctacccgagaacctatgatttactgcatgctgcaaacctgctttctgttgagaagaaaagtgattctttactattgttgcatttttctcttgtcagatgcaatttgtcatcaattatgcttgagatggatcggatactaaggcccggtggaagagcatacatacgtgatactcttgccatcatggatgagcttatagagattggcaaggctatgggctggcaagtgtcattgcgagatacagctgagggtcctcatgcaagttatagggtcttgatcgccagagcagctggggtaggcatagtgtgcatcatttaa

SEQ ID NO: 49424 - DNA, 1659 bp, Glycine max
  Peptide Sequence Number=SeqID_166202
aattcatggtgcacaagggacctcagatcttatgctggccgtagcaagaagtctggtggtgctggctcctctggcggtcgaattgaaggcaatgccgagttccggagacggttgaagcgcaatgccagggcaagaagcaagaagtacgccgagtctctattctaccggctgaaaaacccgaaggggggtgggaactatcccgataacttcaccgaggatgagctccaacaaattggcctcggctatgatcgaatggtccggttcatggagaaggatgacccaaatttacgtcatccgtatgattggtacaaatatggtcaatatggaccctattcttggcgtggagttgttgttggcgagccagttcggggtcggttctccgatgagtgtgtgacaataatcagtgaagtgaaggaccatgaggagtgggagcagattgaacaaggtgaaatggctgaagagtatggggaaaaattgaagcagctggatcaaagtaaattaaagtatttttgggtatttgtaaggcacccaagatggagaatttcagagcttccttggcaacaatggacgttagttagcgaagtagtgcttgaagctggtaagcagagattagataagtggaatttgatgggtagacttgggaacaaggctaggtcatcgatagggcaatgtgctgcatggatgagacctgatattgtatatgtgaagaagccagttttccagtgtaggtttgagccacaggatgactttttcaagccaataattccatttctgaatcctaaaacagaacaggattttctttttgagttagagaatgatgatggtagtgttgagttgtgtacttattttggtggattgtgtaagattgtgaaggtaaatcaaaaggcatttgtcgatgatgtggtgaatgcatatcagaaattgagtgatgagaaaaagtcaaaatgtttggagtttctgttgaaaaatcatccagtggaattgttgcatccatatactaaagagtggaaggctaagttggaagagatggagctgggttgtgatgctcctgatgaagaagatgatgctattgttgatgatcccgatgaaactgaagttctagattggattgaggatgaaggtagtgatgatgatactaacattaccgatgacgatgaggatgaagaggagctgattgatgatgatgatgatgatggcgatgaagaccaagatctagtcatggacatggaagaaagtgaagatggaaaatttcatgccatggaagaggatacacttgatgaggatgagaaggactttaactggaatgaggagttccaaaaggcattaagtagtggagaagcaatggagaatctggcaaagaaggctcttgagttcaataagaagttgaataagaatcaatttatgatgaacaaagtagaggaagaaacagcgctctcagtagatggagacgaaactgccttgagaggcaagcgagcaaaggtcagtcaagaagagtggaagtatattggagttggtccatggagaaaaaagattaagaagagcaaaattcctccagagctatttttgcgagcggttgttagaccattcacttacagaaatcttgttaaagagattgttttaactaggcatgcaattttggatggtgaaattggtgcctaa

SEQ ID NO: 49425 - DNA, 222 bp, Glycine max
  Peptide Sequence Number=SeqID_166203
atggcgttgggagagaagcttttgaagaggggaaacggggcaggcacctgggggccacacaccctgcccgtcaccgtcacgggcatcacccgacacatacaatgcaatcccagcccttcatcgtacctctccaaacctcttattccgacacgtggtgctgtcttttatgatccaacacgtggaccaatcggaaggatccacggtctaagtctaacactctaa

SEQ ID NO: 49426 - DNA, 360 bp, Glycine max
  Peptide Sequence Number=SeqID_166204
atgtataatactacaataacctatattggtctcctctatagtgcacactggcaaatggtcatcattttgcctaaggaaaatcttgttgtttggttttgttccttgcataataggccagacaactacctgaaaggaataattaacagtgcttttaaaggacttgacgatactccacaacctaaatccaaggttggtgctaggtggattttgttaaaacaaaaaggaagcactgagtgtggctattacgtgatgcactggatgtcaactataatcttaggaagttttaggaataattgggaaacgtattttaatgatggtagaccattggaatcagagagattgaaggcgcttcgcatctag

SEQ ID NO: 49427 - DNA, 319 bp, Glycine max
  Peptide Sequence Number=SeqID_166205
catctacaccgtgctggccggttttgtcgaagtcggcgaaacgctggagcaggcggtggcccgcgaggtgatggaagagagtaacgtgcgggtaaaaaatgtgcgttacgtgacctcgcagccgtggccgttcccgcactcgctgatgatggcgttcatggcggagtacgatggcggcgagctgcagcacgatggtaaagagctgctggatgctggctggtatcgctacgacgatctgcccctgttgccgccgccgggcaccgtggcgcgccggctgattgaagatacggttgcgctgtgtcgcgccagcgcggcgtga

SEQ ID NO: 49428 - DNA, 802 bp, Glycine max
  Peptide Sequence Number=SeqID_166206
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgattccaggagaagttccggggcctgaaagaaacgatcaggggcgccctcgacgagaagctgttcaatgcgattgccgcggccatccagaacgtggacaaccagacgcttgaccagctcatcgcgtctctgggtgcgacgcaatggaacgcattgaaggcgaccgatgccttcaacggcatgctgggcgccatgcgcggagaggcgtggcgggacgaggtcgagtggatccggctgacccgtggcgagtacgcggcctggatggctgaacgcggcgcggagatcaacgcaaggggcggcccggacaagatggacccggcccagcgcgcagagttcaacagggatgccgcgcgcaaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 49429 - DNA, 558 bp, Glycine max
  Peptide Sequence Number=SeqID_166207
gtgggtctactggctaagcagttagctgagaagtcatccagcagctttggagcaaatattgagaagaatcccaaagaagagtgcaaagttgttatgacaagaagcagaaagcttatggctgctgaggataaggatattgttgctttgaaggaacaagttgttttgaaggacactactgataaagagaatgatgaggtaaaagatgaaaggagtcagtggagagaaaaacaaataattgtcggaaagaaagaaataaaagacaatgaaaaagaaataaagggagaaaaacaaaaagaaaaagaagaatttgaaaaatataaagaagaaaaaaaaagtaagagtgaaaaagcaagagaaaagagaaaagaaacaacttctgatgagggaaaggaaatgccataccctttggtacctgtcacaacctacccttcggtgggagggcgacgcgtgactcgcgggatgcgtcttccaagaaaggaatatgagcggagtcgtcaccaacgtttatttgaggaaaacgtcagaaaaactggaaaagacgtggtctacgaactttaa

SEQ ID NO: 49430 - DNA, 522 bp, Glycine max
  Peptide Sequence Number=SeqID_166208
atggccccgaggaagcttgcctcaaagaggtccaggaaggacaaggcggccgaaggaactagttccgccccggagtacgacagtcaccgctttaggagcgttgtacaccagcagcgcttcgaagccatcaagggatggtcgtttctccgggagcgacgcgtccagctcagggacgacgagtatactgatttccaggaggaaatagggcgccggcggtgggcaccactggttactcccatggccaagtttgatccagaaatagtccttgagttttatgccaatgcttggccaacagaggagggcgtgcgtgacatgagatcctgggttaggggtcagtggatcccgttcgatgccgacgctatcagccagctcctgggatatccgatggtattggaagagggccaggaatgcgagtatggccagaggaggaaccggtctgatgggttcgatgaggaggccatcgcccagctgctatatatggatgacgttgctcctcagcaacatcctgcccaccgatcataa

SEQ ID NO: 49431 - DNA, 297 bp, Glycine max
  Peptide Sequence Number=SeqID_166209
atgcttgatgatgaaccatttattcaagtcaagcgctcctttgctattggtgccggtgtagtgacttcttttggataccatgagcgtactccttctcctcctcctcatcgagatgattcagccctcatgaatgaagttctttccgagttacggggtcttcgtacttatgttggtgaacgttttgattctctggatactcgctttgccggcatggatatccgtctcacacaacttgaagaagatgtgggttatattcatcagagcttcgaccttccaccaccacctccaccttcttag

SEQ ID NO: 49432 - DNA, 703 bp, Glycine max
  Peptide Sequence Number=SeqID_166210
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtg

SEQ ID NO: 49433 - DNA, 1314 bp, Glycine max
  Peptide Sequence Number=SeqID_166211
gggcgacagcggctccggctggtcgggcgtcagcgagaacggattcgggatcggctcctcgcgcttgatggcgtcgcggatcttggtgttgtagccggccaggttgcgcacgcccatcttgctcatcaggcggtagcgcttttccatctcgcccacgcaccagttcagcgcgttggcggcatggcgcatgtccgtgaccaccggcgccagcaaatgcggaatgccttcgtagacgctcatttcgagcatcttcgggtcgatcaggatcaggcgggtgtgcgaggcgtcggccttgtacagcagcgacaggatcatggcgttgatcccgaccgacttgcccgacccggtggtgcccgccaccaacaggtgcggcatcttggccaggtcggccaccaccggattgccggcgatgtccttgcccagcgccatggtcacgaccgaatggctggcgtgataggtctgcgaccccaggatctcggacagcttgaccacctggcggcgcgggttgggcagctccaggcccatcaggttcttgcccggaatggtttccaccacccggatgctgaccaggctgagcgcgcgcgccaggtccttggccagattgacgatctggctgcccttgacgccggtggccggctcgatttcgtaacgcgtgatgaccggaccggcctgcgccgccaccacggtgacggacacgccgaagtcggccagcttcttttcgatcaggcgcgaggtgaattcgatggtctcggccgacacggtttcctggttggccagcggcggatccagcaggctgatggccggcaggtcgccctcgccgcccggcggcggcgcgaagaacagcgattgctgcttttccttttcgacgcgttcggacttgggcaccaccgtgatcgccggctcgatgcgcaccggctgctcgtgcaccagcttttcctgcttggccaccacctgctcggtgcgcacggccttggccacctcgccgaccttgcggtcttcgcgcgcggcgtaggaattgcgcacccggcgcaccaggccttcgatccaggtgccgacgcgctcggccacggtcagccacgagaacgagaagaacaggctcagcccgatcgccagcatcaccaggaaggccagggtgctgccggtgaagccgatgctgcggctcatcagatcggccagggtatggccgatgacgccaccggcgccgctggcgctttccgaggcgcccggcagatgcgtgccgcggctggccaggcgcagggcttccatgcccagcgagccgaccagcagcaggaagaaaccgatgccctcttccca

SEQ ID NO: 49434 - DNA, 201 bp, Glycine max
  Peptide Sequence Number=SeqID_166212
atgactggccctctcgatgggccgacctcttgttttctcataaaggtggacccttgggtactagtacctatcacctttagaggaccatatgtcctcgccatcagaggactgcacgccctcgcctttagagggctacgcgtcctcattttcagtgtgctccatatccacaccttagaagaatataaggtcctttgcccttag

SEQ ID NO: 49435 - DNA, 333 bp, Glycine max
  Peptide Sequence Number=SeqID_166213
atgccaatctccccctgcagatgtatcagttgggatcgcgcccacaagacgcccaatggacccgaagatgtccaacaaggccctggggtttccagctctggttacgggcctctgacagtcctacagggtacccgttcccccagcgaggaatcgcacccacaaagacacccagtggacccggagaagtccaacagggccctggggtttccagctctggttacgggcctctgtagtcctacagggtgcccgttccccccggcaagagatcgtgcccgcaagacacccagtggacccgaagaagtccaacagggtcttgaagtttccaagctctaa

SEQ ID NO: 49436 - DNA, 246 bp, Glycine max
  Peptide Sequence Number=SeqID_166214
atgttgctaaataacaacgtcatccatatccatgtaagagtggtcatgttggtgcgcatgatccgtactcgtctttttgcagcggcacgagtgaaatcttgccccagtatgcatactagatgcgtgatagcctccctttttggatgtgctcgcacagttggtcgccctccaatatcagggggtggcccaggaactgataaaaggaaactaactggccccttaaccgggagcgcaagtctcggttaa

SEQ ID NO: 49437 - DNA, 303 bp, Glycine max
  Peptide Sequence Number=SeqID_166215
atggaaaagatgagaaaaaagaataggtatacttcggtggaattgttgggttctcggcagaatgtcaatagcaactgtccatgcgatatctgcaatattatatgcattatgttggatagtggatttgaagttgcacaagggaactttcattttgctagtgtggtcaaaattttacgtgttgaatgctgcgttgctagctcagggaaggaaaatcacaaattcctcgtacaatctaacgtgaattttcacgtcccattgaagtcatcaactctatcttttgcatcttgtaggcatcatacatga

SEQ ID NO: 49438 - DNA, 568 bp, Glycine max
  Peptide Sequence Number=SeqID_166216
atggaattgacggaagggactaacaggagtagaagcatgcagcttaatttgtctcaacacggggaaacttaccagggtggtggtgcatggccgttcttagttggtggagcgatttgtctggttaattccgttaacgaaacgagacctcagcctgctaaaatagctatgtggaggtctgtgatgcccttagatatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgttgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaagtgcgactcccgggggcccggagacg

SEQ ID NO: 49439 - DNA, 378 bp, Glycine max
  Peptide Sequence Number=SeqID_166217
atggaagaatccaatcgggaaaataacaaagatcacatttcccagtcaagaggttccgctctccacggtgaagaacacattggagaatggaggaacccaatcgggaaaataacaaagatcacatttcccagtcaagagggtccgttctcgacggggaagaacacattggagattggaggattcaatcgggaaaataacaaagatcacatttcccagtcaagagggtccgctcttgacggtgaagaacacattggagaatggaggaatccaattgggaaaataacaaagatcacatttcccagtcaagagggtccgctcttgacggtgaagaacacattggagaatggaggaatcccatcgggaaaacaacaaatataa

SEQ ID NO: 49440 - DNA, 306 bp, Glycine max
  Peptide Sequence Number=SeqID_166218
atgcgcttggcaagcaatttgtggggctccagactcgatggtggaggatgcatgaatgacaatcaattcatggggctccggataagatttgagggtggagaatacacgaatagcgctaggcaagcatttcgtggggctccagactcgatggcaatccattcctggggctccgtactccatggtggaggatgcatggatgacaatcaattcatgaggctcgggataagatttgtgggtggaggatacactaatagggctgggcaagcaattcgcggggttccggactctaaggtgcaggatgcgtga

SEQ ID NO: 49441 - DNA, 502 bp, Glycine max
  Peptide Sequence Number=SeqID_166219
atgagagagtggtttgcttatagactacaatgcagacccaatgaaggtcaaactctactgcattctagaaaactattccaacaatttgttgctgaaggatacacaatgattgaatctgaaagactctcctatgttagaaacaaccaaaagaaactcagagttgacaagttctgtagcttgcagcagtcattcgaagctggaaatatagaaggtttagcccaaggcaagaggatcatcttacctttaacctttgttgacagcccacgttacatggatcaactttattttgatggcatagctatatgcagtcacgtaggcttcccaaatctttttattacttttacctgcaatccaaattggcctgaaattcataggctgctgatacctttgaatttgacagcaatagataggccagaaataatctcccgcattttcaagcttaaatatgagcagatgttatcagaccttacaaagaatcacctgctaggcaaagtcgtcgcat

SEQ ID NO: 49442 - DNA, 347 bp, Glycine max
  Peptide Sequence Number=SeqID_166220
cagtttcggaagatggtacctggcctagaatccaacattctcttcacagggaagataaaggtcccacagcccaggtaccacagcatgtggaggatgagtcatctggggccactattcctgagtcattcattataggggaggaggtaggtgagacacaggtgagacagatagctgatgctactcctgagagatctcttgaggccacttcagagcctcctgcaccagtggactcgaccacaccaatcctaactctggacacttctcctccagctactccaatacttcatctgacagatgaggaggatgttcagacacatgatactcaggaccagtcacaggaattctaa

SEQ ID NO: 49443 - DNA, 441 bp, Glycine max
  Peptide Sequence Number=SeqID_166221
atggggtgcaagaattccttaaccctgttgtctgtggtattatgtctggttaatgtgaaggccaggtatgggtggagtgacaaaattttttcctcactgcttgaggtagtgcacaatctgcttccagaggacaacatgctgcctaaaacttactataaggcgaaaaagatattgtgtccgatgggtatggagtatgagaagattcatgcttgccccaatgattgcatactgtataggcatgacttccaagaaatgtccaaatgccctatctatgggacttcatggtacaaagtggaggatgaagaggaaagcagttctgatgaaaactcaaacaagggccctccagtgaaggttttgtggtatcttccaatcattccaagaagattgatggtttgtatccggattttgggaaagagccaagaaatcttagacttggactag

SEQ ID NO: 49444 - DNA, 429 bp, Glycine max
  Peptide Sequence Number=SeqID_166222
atggcagaacaagctaaacaggtgttttatgttcaagatccttatgatgaaaggtggcacatggctacaccacccaactctcctcctcctcttcttgagtcagcagcacatttgctgtctacgccgaagaagacaagaaaagcaacacagcttagatcattggctactagactagttgaggcggagagaccaatggttcatgtggatcctgccactgggaatgtcgttgatctccacagaaagaaattaagaatgtatttggggatcgttactcgccataaggtggatgttacaattgataattggaaacaagtccatgcagctcaaaaggatttgatctgggaggatattcaggttgaatttgatattcctgaagcatccaatttgagaatgaagaaaaaaatatttcagactgtaggagagaggtag

SEQ ID NO: 49445 - DNA, 365 bp, Glycine max
  Peptide Sequence Number=SeqID_166223
atggcattagcgtgtgacttttgtaaggagacaacccatggggtattttgggttagaataggtagcgaaatacctttggcaatttacactttgggtatgatggcaaaatacttggatgtattagaaataccaagatgtgcacatgtgcaatttttggtaccccaaaatgcttggagtatgcatgtatgtgaatttagccaaggagatgtgtgggatgttatatgccatttttgtcttaagagtaatgtcccactggtaaaactaactttccgaatgtttgccttcgcaggaatggccccgaggaagcttgcctcaaagaggtccaggaaggacaaggctgccgaaggaactagttccgctccgga

SEQ ID NO: 49446 - DNA, 618 bp, Glycine max
  Peptide Sequence Number=SeqID_166224
gtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcaccgggccccatccgcttccctcccgacaatttcaagcactctttgactctcctttcaaagtccttttcatctttccctcgtggtacttgttcgctatcggtctctcgccagtatttagccttggacggaatttaccgcccgattggggctgtattcccaaacaacccgactcgccgacagcgcctcgtggtgcgacagggtccgggcacgacggggctctcaccctctctggcgcctctggtaacaattag

SEQ ID NO: 49447 - DNA, 591 bp, Glycine max
  Peptide Sequence Number=SeqID_166225
atgatatatgtgagtgcattttctcgagctttgaggcatcactttgcaaagattaaagatgctgacagtgcaataagattggaaaagatttgggttgaagaaggtcttcaatctgaacaagttgctttggacttcattgttgctagatcctatggttcttttagggatgttgaaactatgcttgatcaactgagtttgcttggtaaaataattactatttccttagtccacaagctttatgttttgccctttgtttttctgctgactggggtcatttctgatcatgaattgcttgatttgttggacttggctttatcaactgacacttcaaatacaattgtaagagcccaggaacttgtcaggacaaggatagatcctttacaacttatatcacaattggaaaatcttattatagacattcttgtagcagaagcagacctacaaaaactaagtcatgcatcaagaatactatctaaaatagagaagaagttgagaatttccaaaaatcaaacaacatggtttactatagctcttctacagctgaactccctagaatattcatctgcggatacgaatgatactaacttgtga

SEQ ID NO: 49448 - DNA, 234 bp, Glycine max
  Peptide Sequence Number=SeqID_166226
atggatacagatgttgatatttgcaatacatttcctaaaggggacaacttggagcatcttgctacaacaggattaggagtacaggaggatcacaaaggaacattggattctatatggtataaagctattgagatgtgtctatctagcaagctcaaaactttaacaaacaatatgagatctacttcttcttctccactcatgattaaaattgcttcaagaattatgttgaagtga

SEQ ID NO: 49449 - DNA, 878 bp, Glycine max
  Peptide Sequence Number=SeqID_166227
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcccgatcggcagaacatgggcagagcgtcggcacttcgtaggcagatgtcgtccaaccgatggagaacatgttgaccacggccggctgccggctcaggattgcgccgtggacgccaccgcgatgctcgaggacctgggactctcgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49450 - DNA, 477 bp, Glycine max
  Peptide Sequence Number=SeqID_166228
atggaggttgttgctcacgctattgttgctggtgtctctgtcttcctcagtcttccgctctatctcttcttctttctgcttcgtggttcctatgctgctcctcttggtgtcctccagtatttggttgcgtctaaccccgacctgggaggtttcgtagggggtagcttgatggtcggtcttggtgctttcttcttacttgttgcacttctattcgacttgtctaacttcattcctgaatttggacatttcttcaatctggatgtagcccttggcttactcgcacaactcgtccatgctactaggatgactgtgtgcccaaatatgtccatgaattttcttagagactcattgtctgcttgtcgcaagctggccaaggctgccgaagtcatgttggtgtcaaagctgtctattgatctaggtgggagtataccgtaccaggtcaatgttgcccccttgagggatgttggaaagacatga

SEQ ID NO: 49451 - DNA, 453 bp, Glycine max
  Peptide Sequence Number=SeqID_166229
atgattggtgaggtccctattgagctgcgtacactgctcgagtttaggttcaagctacaacttgatgagctcttcgatgggttttgggcctttgtcagaggtgtcgtctcacggatctatatcaaattcgtgttcccgacttgcttggtagacgaccaaggctcagatcgaagatcctttgtccatgcttatgacttgagtgcccttagctgctgcgggatgaggcttggaaggctccctggcaagaggatatggtgctaccttcaggctctctacatagcactatcgtgcttgcttttggatgttagtggaattgccctggccgatgaggaccttggacaccatgaagtttgcaatgatgatggagacaaccatggggtcgtcctagttaacgaggttgatacccttgaagtccttatccgcgaaaatgataggaaggagacttcgttgtga

SEQ ID NO: 49452 - DNA, 414 bp, Glycine max
  Peptide Sequence Number=SeqID_166230
atgcagagttcaaagcgcgatgtctatcttggagcctacctaaatggcggacactggcagatggtggtcatcctgcccaaggaacacctagttgtctggttttgttcattgcataacaggccagacaactaccttcaggggattattaatagtgctttaaaaggtcttgatgatgctctacagcctaaatcaaaggcttctgctaggtggattgtcgtcaagtgtaatagacaaaaaggaagtactgagtgcggctactatgtcatgcactggatgtccaccatcattttaggaacttttaggaataattgggaagcgtattttaatgatcctagaccattggagccaaagagattaaaggcgttgcagatccagtgggcacagttttatcttcgatgtagagatcagacttag

SEQ ID NO: 49453 - DNA, 507 bp, Glycine max
  Peptide Sequence Number=SeqID_166231
atgtccaaatcttgtggatttgggatgaccggccctctcgatgagtcgatctcttgctttctcataagggtggacccttgggtacttgtacctatcaccttgagaggactacatgtcctcgccatcagaggactgcatgtcctcaacttgagaggactacatgtcctcgccatcagaggacctcatgtcctcgccttgagagggctgcacgccctcacctctagaggactacatgtcctcgccttgagagggctacacgccctcacctgggttaccctcgccttgagaggactacacgtcctcgccaacagagggctgcacgccctcacctctagaggactacatgtcctcgccttgagagggctacacgccctcaccttgggtactagttaccctcgccttaggaggactacacgtcctcgccaacagagggctgcacgccctccatttcagaggactacatgtcctcgccttgagagggctacacgccctcaccttgggtactag

SEQ ID NO: 49454 - DNA, 132 bp, Glycine max
  Peptide Sequence Number=SeqID_166232
cactgttttagtgcagctgcgttgcctgctggcggtgcagcgcacaactgcaccgatcacttcttcgccagtcaccccgccgataaaataagcactggcgcaaccagcaataaacctgacacggcgatttaa

SEQ ID NO: 49455 - DNA, 124 bp, Glycine max
  Peptide Sequence Number=SeqID_166233
atgggggtcaacctctttcatgacccatggccccagggagttagttgggctgtagttgagacacgtttttcggatatggattttttcgagatggttaaccacttttttaaccgtgagagggagg

SEQ ID NO: 49456 - DNA, 543 bp, Glycine max
  Peptide Sequence Number=SeqID_166234
atggtgatgaggaagaagctctttagcgccgaagaccgacaacattggcatgtagacaacgggcagctgcaactgttgctgaggatagtgagcatatggagcctcaatggttgcacattatttgctaacaagagtgtcacacataccagtgtggtattcttagacgaacttcgtgaccttaatcaaagtagagggttttcatgggaagcggctgcactatcttggatctacgagcatttcccaagtattgggaatatgattgctaatgaggactaccacgagagcaaaccacatgcgtgtcgctggaagtgtgagaaggcattatcagtgaccacctatcataagaggttggataggttgatggaaaattttggctatgttcagtccattcctccactccctggggattatagttctccatcactatccacggaggacattgatgatagatggttgcacttttcacaataccttgcactgatagaagagtttgttacttttctggtcaatgtgctccaggctatatggagtgattttatatga

SEQ ID NO: 49457 - DNA, 549 bp, Glycine max
  Peptide Sequence Number=SeqID_166235
atggcaagcagagaccaagtttggtcattctgcacacatgatacgcggagataccttacggttatccgcccccctttgccattcagacacagtcgtgttcgatggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccaccccccctttgccattcagacacagtcgtgttcgatggcaagcagagaccaagtctggtcattctgcacacatgatacgcggagataccttacggttatccgcccccctttgccattcagacacagtcgtgttcgatggcaagcagagaccaagtttggtcattctgcacccatga

SEQ ID NO: 49458 - DNA, 618 bp, Glycine max
  Peptide Sequence Number=SeqID_166236
atgacatcggcagaaatgcagttgagaagagaaaggggcctatgctttacttgtgatgacaagttttcccctagccatcgttatcctaataagcaatatttttttccacagtgggaagaagaggatgaacctgcattacaaccagatccaccagacgaggttgagacagctggtgaccccagtttgcaagatcatcatttgtcttataatgctttaaaaggctcatcaggtcttaggacaatgaagtttcaaggatcaataaatggattgggagtggagattctactagatagtgggagttcagataacttcctccagcctagactagctcaatgcctgaagttacctgtagaaccaattcctaatttgcaggttttggttggaaatggaaatgccttgactactgaaggattaattcaagacttggaggtgaaaatccaaggtcatacactgaagctaccagtgtacctacttccagtttctggtgctgatctagtgctcggggctgcatggttggcaacaattgtgcctgatctttcagattatagtactctgacattgaagttttacttgggtaatcaatttatcaccttgcatggcgagagaccctctctatga

SEQ ID NO: 49459 - DNA, 132 bp, Glycine max
  Peptide Sequence Number=SeqID_166237
atgaaatttggcggaattattccgtttctcatttctatgacgaggggggttacaacccactctttgaggattcaaactactgagtgtggtggtgggactgccactgtgagatataggctaatctctaagtga

SEQ ID NO: 49460 - DNA, 276 bp, Glycine max
  Peptide Sequence Number=SeqID_166238
atgacaaggagggtggaattggtgtcggggatgctccgaattccaatcggtggaatcaagagaaaatcaaaaaagaagaagattggaagttgtgggagtcaatttggtgtagaaatgagagagatatggtgtttggaagattgggggaaaagaggtacgtcgaggggaggtgtggctgcgcatcactgctggttctcgttagcttttatagagaagaccactggtaatcgattacaggatattgtaatcgattacaaggttgatgttctactgtaa

SEQ ID NO: 49461 - DNA, 373 bp, Glycine max
  Peptide Sequence Number=SeqID_166239
atgacacagggtagttttgttccccatggtcgagatgacatcttgaatatggccattggaaaaccggaacatctaggtcgagttcgtgcagcgggatctggtatgacccttactcaattttatggtagggcaacacgtacgtcgagtagttcctcagcaacactaatgcagcaacagtgggttgacattattggaaacataaaggaacaagtaaggaatgaatatgaagaacaacacaagaggagtttggaggaatttaagaaggagttgtccagtcagatcttcattcagttgagtcagatgggatcacaatactctccccttattgaggtggatttacaggcattggctgcacgtcttagcactaaaggaa

SEQ ID NO: 49462 - DNA, 279 bp, Glycine max
  Peptide Sequence Number=SeqID_166240
atgatagagtctgagatgattgtcgacatgggaactgcggttcactggtcaagatgtttacgcaagattgagaggactggaggggaactaacagaagccctacagaagacctttcctcctgattggacctcacataatgttcttgatgtcaatagtgagacagaaactgcagatcttcaaattgatgatgaggacgaggatgaggacgatgtgcattataatgttaatggaatcaataatgatgatgatgacactgatgatgatactgttatctcatag

SEQ ID NO: 49463 - DNA, 195 bp, Glycine max
  Peptide Sequence Number=SeqID_166241
gttcactgcgaaggatgtcaggggatggctcaggatttaggagcgattgctgaggatttggagcgggtcatcaacctcaggatggtcactaagggcactgacttatatgacatcatgactcgttgtctgaggagaactagaggtgacaccacagatggaagtcttaggccgcgccagagacgccgcatagattag

SEQ ID NO: 49464 - DNA, 346 bp, Glycine max
  Peptide Sequence Number=SeqID_166242
gatgtgcggaaaaagacataggtcatccagaagcaaaacactgccccacgtgttgtctcatgggggttatgaatatttagaacagaagttgatggctgagaatacaaagaaaaaactaaaggaagctgctcaatccaaaagcactgaggtcgtgatggaccctccatctcccatcagacgacacgtgaagtggaagatggcccgcgccaagaaaactggccagatgacgtttgaggcagcaaaggaaattgctgagaagattgatgtcctgactgctgccattgggcgaccagaacaccctggtcgtgtgcgtactgctggagctagtgtgaccatcaaacaataa

SEQ ID NO: 49465 - DNA, 621 bp, Glycine max
  Peptide Sequence Number=SeqID_166243
atggatgcagtagatcgaatactttgctatttaaaatcctcaccaggaaaaaggttgatcttctctaagaataatcacttgagtgttgaagggtacaccggtgcagattgggcagagaatcatgatcaaacaaagcacgtggaggtagataaacatttcatcaagatgaatcttgaggagaagatcattcgatttccacttgtcaagtcggaagaccaattggcagacattcttacaaaggcagtgtccgaagcaaagcttcatgaaaaatcaagattgattcaaagatgttttgatgataacaaagatgatgacaaaggtgatgacaaaaagctcaaaggtcaatcaaagaatgagttcaagatgttcaagatagaatcaagaacacttcaagattcaagaggaaagttgatttcaagaatcaagaatcaagattcaaggatcaagcttccaagaatcaagatcaagattcaagaatcaagagaagacttaatcaagataagtatgaaaaggttttttcaaaaactgagtagcacatggatttttctcaaaacatgtttaccaaagagattttactctctggtaatcgactaccagattgttgtaatcgattaccagtag

SEQ ID NO: 49466 - DNA, 246 bp, Glycine max
  Peptide Sequence Number=SeqID_166244
atgcatattgcagcttatggaacgaaggaatttcttatacctcagaatttttcagtcctagcaatccaaccaattggatttgtccccatgaacgctagcagctccaccttcttagtccaaatttgtgcttcctccatctctaacactagcttcccctcaaagatccgacaggtttcaagcgagagtttacccaatatcagctgctacgagttacaaaacaacattgaagaaagtggactttactga

SEQ ID NO: 49467 - DNA, 807 bp, Glycine max
  Peptide Sequence Number=SeqID_166245
atggagggtgctgcgacacattggttctacatttggagccaaaacaatctagattcagattgggagtcattttccacagctttgatcaaaagattcgaagatcaccatggtaaccacatctttgaaagattgaatatcttgaagcaagaaaagtcaacaaagacaaaaacccacataaaaaaatgggagacttccacaaagttcttgaaatggaagaccggcatttcagagtggaaacacatgttgcacaagatattgaatgaagaagttgattcacatgcctctcaacaagacaaaaatagcatggagggaagtgggttagaattcagtaaagcaaaggctagttcttgggcaagaaaggtggaactacctagctttgatagaaacatagaaaggggaactgatttgaagggtagcagttttgagtgtgacagtgacccattgcaatacttgaattcagaaaacagaagtaaagaagatttgatcaagaaggaagtcgaaattggtgattcaaccaagccacattgttttcaagattcagatttccataaaaagattgttatggtgaaacaaaaatcattcatgaaggtggttggaacaacaatggtgctgaaatctaggaatgtcaacttgttgggtgagcctttagcattaaattttgttgcatctatggctgacagcttagccatggagctaagacagaaggaatgtactgagccagtcaagctgattaaagttatatggagtccacctttgtccctcccaccaccagacctcagttttgcaggggtagtgggtcgttcctag

SEQ ID NO: 49468 - DNA, 315 bp, Glycine max
  Peptide Sequence Number=SeqID_166246
atggtcatcaaactggaagtagaagacaacctcatcttcggccatcaattttttttcatgaaggtactggaatcatgggtcagcaatagatggcacaccatcgttgatggtgacctaccattggatgaaaagaagttagtcttcaaggttgatgtcctcctcctcccattcaatttcttttctgatcaaaagctcccatgcatggccataaaaccgaaagtagaagacaacttcatctctggccatcaattttttttttatcaagatactggaaccatgggtcagcaattgatggcacaccatcgtggatggtga

SEQ ID NO: 49469 - DNA, 597 bp, Glycine max
  Peptide Sequence Number=SeqID_166247
atgactgacacccagatggaagtgcgcttcgacaaggcctgctccaactatgtgccgaaccgcagcctggaacgcgcgatgtatcaaaacctgtgtgatttcggtctgcccgagtacagcgacgccgaacgccgcttcgccgaggaaatccgccagacgctgagccgcgacgatctgcgcaacgccaaactcaacattgcccgcaccggcggcgcagccgggcgcgagtgggtgcagctgctgggagaaaaggtgctgatggacgaggtcgctccttatgtggaatccgacgacctgctgtacggttctaccgacgttggcgacgtaagctgggtggcaccgaccgcccaatgctttagcccctgtttcgcactcggcacccctctgcacacctggcaactggtggcgcagggccgcaccgctatcgcccataagggcatgtgcctggccggcaaggtgatggcggcgaccgccatcgatctgctgagcgacagcgctctgctggcgcgctgccgcagcgagtttgaacgccggcgcgccgaacagccgtaccgctgcccaatcccgcagggggtgaaaccctccccattgaaatag

SEQ ID NO: 49470 - DNA, 358 bp, Glycine max
  Peptide Sequence Number=SeqID_166248
atgaaacgtgtattggctgatgtattgaaagatcaaaggaatttgggcaacaagggctatagaggttggaaaagtgagatccttggccagattgagtttgattgggatgacactaagcacatgatcacaattgagaatgaaaatgcttggaatgaatattgcattgtgcttcaaaactggggtgatatagtggatttgtgtgctaaagatagagccattggtcatggagctgaaactactatggatgttgatgaagcgatgagtagagaaacaaatgaagtggaattcatgggtttaggtgctactgctactatatacttagaagaaccaagctttaatacagaaggaaaaagacaag

SEQ ID NO: 49471 - DNA, 255 bp, Glycine max
  Peptide Sequence Number=SeqID_166249
atggcttcctatggtgtcagacctcaagaagcaaaggaatatccattgatgaagaagatccaaggcctacaagctccacatggagctacatcatttacttgctacacgccattgccaaatcatatagtcacactttgtgcatatccttcatgctttacatgcctcatgaaatctacgcaaaagagagaacaaccaccaaaattgagtgcatcacaaaagagagaacaacctccaaaattgaggaccgttttgtaa

SEQ ID NO: 49472 - DNA, 226 bp, Glycine max
  Peptide Sequence Number=SeqID_166250
gctaacgacggtgctgaatgtgttgaagaataaagatgtcgtgagcaatttggagaactgcaactatgggttgctatttgatgcaaaatacatggccactgtattttcaatgggagcttatggatcagaaagcatgggatggctaatggccaagcatgcttacatgaagctcattttatgtgttcacctgctacaccattgtgatatatgcacaatgcacaactga

SEQ ID NO: 49473 - DNA, 1122 bp, Glycine max
  Peptide Sequence Number=SeqID_166251
atgggatcaaatcaagcacctttgtctaagaaaaggttctatcaagtcaaaatcaaaagcctagaggttgccatcttgcaagaattggggcaattgatggaccagccccaacgtcaagctttccacaagacctatgggaagatttgggatctagttatgatagaactagtgccgactgtggaagagtttgaagagatcttaggatgtccgctaagaggacgaaggccatctcttttctgggttctatccctccatggcaagaatagccaagtaccaaggaagcttttgggggaaaaggcaaaggcattggcggatcaaggtgaatgggcttctttcacggatgtcttggcattattgatattcggagtcatcctttttccaaatgtggatgggctagtagacctagcggcgatggatgccttccttgcttatcaccatagcaaggaaagtccgatcgctgctattttggctgctgtctatgacacgttcgaccgaagatgcgaaaagagcaacgcgataattgtctgttgtacacctgctctctatgtgtggctagtctcacacctcttttgccatgaaagggcatccattaattggttcccccggtggaaggaagggaaagttggggttttgtcctcatgcaaaggattcccaaacattcccttgttgggaatgaggggttgtatcaattataatcctgtccttgccataagacaacttggctaccccatgagaggagcatcatcgaaggaaagtatcacgcctttcatcgcacggggtttcagtgaccccaatgcgaggatacttcaaggagtccgcaaagcatgggagttggattggctcccaaagctaaaggtttcaagcgaggaagaggctgaaacccctgaggagggtgaggaggtgcaagccttaaaagagaaacttgaaaaggcacaattagtcaaggaaaagttcaaaataatggccatcaaggtcaagaaaaagtgcgataaactgagggacatcaatatagccacgaccaaagctttagaacgggaaacaaagagggcccgaaaggaagaacacggccgaaacaagtttcgaggggctttatggggtagaaacaacgaccttaagctttga

SEQ ID NO: 49474 - DNA, 858 bp, Glycine max
  Peptide Sequence Number=SeqID_166252
atgggtgattctagtgattatgcagtagaagtagttctgggtcaaaggaaaaataaagtttttcatgtcatacactatgcaagcaaggttttaaatgaagctcaatctaattatgcaacaactgagaaagaattacttgcagtggaatttgatttggaaatcaaggataagaagggaagtgaaagtcatgtgcctaatcatctttctagcctaactattaatgaggtgactacacaaggtcctgagattcaagaagggtttcctgatgaaaagctattcaacattgcaaaaggccatgcaaataatctcctgaggagatatgtaactcaggcagaggcaagaagcatattgtggcattgccatagtgcacctcatgaatgccattacaatggagaaatgactgttttaaaggttctccaatctggtttttattggcctaccttatggactctctatagaaggaatgaaatgccactagagaacattctggaggttgaagcttttgactgctgggggataaatttcattggtttgtttccatcatcttactcacatgaatacattctattggttatggactataaaaatatcttctcaaagtttggcacaccaagtgatgcaagctccattggagcttgtaggcctaggatcttcttcatcaatggattcctttgcttcttggaagatgaatggcagcggaatggagaaagggaaagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 49475 - DNA, 768 bp, Glycine max
  Peptide Sequence Number=SeqID_166253
atgcatcattctcatacatccatgtttttcattggttgcaaagaattgggaagtatgagcaccccccgttttgtgcaagttcaaaacaagcatcccttcccgccatatggcttgcccaattatacaccacccaatgtggcgcacactctcgatgagaatgtcaataactccactcccatactcattgaaagccaacaaactcaatctgatcatgcacatatccctcaacccatgggggagacacatgaaataccccaccacaatctagttgacttcgagcctcgcctcagatacgcccctgaggggcaagcaattggtggggtacccccgccaaacactttggagggccctcagtttcgcctacaactgcaacccttgcattttgcggtgggaaaagtccctcctgctatggtggaaaaggagaaattggatcatatagaggaaaggcaaagggctattgaagaagacggagatcatgtttttgctaacatggcagagttatgcctagtgcctgatgttatcatccctccgaaattcaaggtgcccaattttgataagtacaaggggactacttatcccaagaatcatctgaaaatgtactatcggaagaaaggggcatacgcgaaagatgaaaaactgctgatacatttcttccaagaaagccttactggggcagtcgtcacctggtataccaacttggaaccttcccgagttcattcttggaaggacctaatggtgcttttgttaggcaatatcgggatcctctag

SEQ ID NO: 49476 - DNA, 252 bp, Glycine max
  Peptide Sequence Number=SeqID_166254
atggagtatcagaagattcatgcttgcccgaatgattgcatattgtacaaacatgaatttgaagaaatgtccaaatgtcctaggtgtggggtatcgcggtacaaagtcaaggatgatgaagagtgtagtagtgatgaaaactcaaacaatggctggccccctagcgaagacgttgctaaagaccttacatggcatgcaaatgggagcaactacgatggaatggtctatcatccggctgattgctcgtactag

SEQ ID NO: 49477 - DNA, 636 bp, Glycine max
  Peptide Sequence Number=SeqID_166255
atggtgaagaagagcaagaagagtaagagcaagagggtttcgttgaagaagaagtacaaggtcataaggaaggtgagggagcacaacaggaagaaaacgaaggaggcgaagaagcttcgcttgagtgggaagaagaaggttgagaaggaccctggtattcccaacgattggcccttcaaggagcaggaactcaaagcgcttgaagctcgaagggcgaaggctattgaggaattggagcaaaagaaagcggaacgcaaggagagggctcggaaaaggaaattgggcttgctagaggatgaagataactccaaattgagtgacatggatattttaaaagagagtaatgattttgctactgttgggaagactagagatagctcagatagggccttttacaaagatttggttaaggtcattgaagcctctgatgtcttactggaggtgcttgatgcccgggatcccttgggtactcgttgtgttgatatagaaaagatggtgatgaaatcgggacctgataaacgtctcgtcttgcttttaaataaaattggtagcttgctgatcacattcattttgtttcctttctactgtttggaatatttatttttccactggctaatcatttggctcttaaaatag

SEQ ID NO: 49478 - DNA, 1475 bp, Glycine max
  Peptide Sequence Number=SeqID_166256
atgccgtccgctttcgatgcggagcccgatctcattgccgagccgcaactgcttgccgaagatgcgctggaaccggttccagctgcagccgagccgcagccgctggatgtcgcggccgacagcggcctggacgtgggcgagctgaccgccagcgacgatctttcgcgttacttcgacgccggctgggcgtcggtgccaggcgaagctgaacctgccgtggcggacatcggcacgattgaatcgatccagccggtcgagagtgcgcctgttgtcgaagtggccgacgtagatgccgtgcccacgatcgcgacggtcgaagacgctgatctgaccgtggccgacgatctgtcgccgtacctcgacgcccgtgcgctgccggtggatgaccgtgacgcggaagagctgccggtgtctgcggatgttgacgcgatcgacctgaatacgtcgctgtcctttgattcgggccgtggcgatgaccgcgtcattgacgacgctgctgcactgccactcgacagcgagctgtcgagcctgcaggatgaaatggctgtgccgggttttgcagaaccggtcacgctggcagccgcgctcgaggccggcctgcacgtgatcgaggaagagcagaccctggacgactacgggcaatggttcgtgatcggcctccaggccagcgaactcgcgccgggcgaggcagatgcctttgccgaggatgcggacgtcggcggggaggcggcggtcggtgaaggagagagcgccgatcagccgtccccggcgacggtgattgaggagatcaccgcggagcccccgcagggcagcgctgctgtggtgcgcttcttcgagatggaagaggcgccgggccagggcatggtcgaagccgatgccgatgccgatgccgatgccgatgccgagattgcagaggccgacgtcacgccccgtgcgccgcacctcgagcaggcgcctgatgcggccgatgccgaagacggcgccgacgcacttgacttcagcgtgtacgaccgcgagctggtcgatatctttgtcgaggaaggcaaggacctgctcgaccactgtgatggcctgatcagcgaactgcgcgatgcaccgcaggaccgcgaggtgctggccggcctgcagcgtgacctgcacaccctcaaggggggcgcgcgcatggccggcatcaacgccatcggcgatctcggccacagcatcgaatcgctgctggaagccgtcgccgccggtcgcaccgagatcgagcgccgtgatgtgcagctgctggagcgtggcttcgatcgcctgcaccagctgctcacccgcaccggtgatcatcgcgtggtggaaccggcgcaggacctggtcgacgcgttcgaagtgcgtaccaccaccgatatcgctgcggctgcggcggccaacgtggcgagcgtcgcagaaaccgactcggcaccggtcgccagcccggctccggcactgctcgatgcgccgtt

SEQ ID NO: 49479 - DNA, 642 bp, Glycine max
  Peptide Sequence Number=SeqID_166257
atgcctttcccagaggttccatttttttgtatggggctctgcaagccatacgtgatggtttctaaaaaacacaaagcttcaacatcacaggctaggccacaggagcccaaacaagaatgggactccaccaagttcacattagaagtggcctggcacaaatatcaggagaatgttcatctccgaaacatccttccaaagaggaacctccagctgacctactccgactatgacgagttcctaaaggagttcgagcggagacattgggataggatgttcaccaggcttccagagaaaaatactgatgtggctttggtgagggagttatactccaacatttatgatcctgaggacgactcacctaaacaatgcaaggtccgaggaaaggtcatcaagtttgatgctcaaacattgaacaccttcctggaaatgcttgtggccattgaggccaagctctacctacctggaggctccttcattatgaacgttgagggagccccatggaagatccatagactaggatcttcttcatcattggattcctttgcttcttggaagatgaatgacagtggaatggagaaggaagagagagaggagacgccacttcaaggagaagatgagtctagaagaagctcaccaccatag

SEQ ID NO: 49480 - DNA, 117 bp, Glycine max
  Peptide Sequence Number=SeqID_166258
atggggagagttaacctagggttaaatgtgagaatggtagtgatgacttgtgggaaagcttgggctgagcaaatgagaaaaatgagtgacaaaggtgaaagcaagagccatttctag

SEQ ID NO: 49481 - DNA, 648 bp, Glycine max
  Peptide Sequence Number=SeqID_166259
caccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatccttcagcagctgcttgtaggtcagctccaggccctcgcgcagcggatgcgggtcatcgccggccgccttcaagccggcatccaggctgtcgaacaccggcagcagctcgcccagcagcttctcgttggcgaacttgcgggcctgctcgatgtcacgggcaacgcgcttgcgctggttctcgaggtcggcgcgctcacgcagcgcatcggccttgatctgctcgacctcggcgcgcaggcgctccacttcgtcgttgacgccggcggcggcggccgcatcggcggcagtctgctgggattcgatatatcaagcttatcgataccgtcgacctcgagggggggcccggtaccagcttttgttccctttagtgagggttaa

SEQ ID NO: 49482 - DNA, 573 bp, Glycine max
  Peptide Sequence Number=SeqID_166260
atggccaatttcaaagcagttggtatcatccccaaagacctcacttggcagcagcaaaatttttttttccatgatgctcgattttatatatgggatgatccacacttgttcaaggtaggtgcaaataatctccttagaagatgtgtgacaagtgaggaggccaagggtatattgtggcactgttataattcaccatgtggagggcattatgatggagacaaaacagcaactaaggtcttacagtcaggatttttttggccaacactcttcaaagatgcccatcaccatgtcttgatgtgtgatcaatgccaaagaatgggggggatttcccgaaggaatgaaatgcctcttcaaaacattatggaagttgaagttttttattgctggggtactgacttcatggttcctttcccttcatctgtaggtaatgagtacattttggtgactgttgattacgtgtctaaatgggtggaagctgtgatcactccaggaaatgatgctaaggttctgcttcaaaaggtgttgagtcaatatcatgtgaatcataaggtggcatccctctatcacccttaa

SEQ ID NO: 49483 - DNA, 1329 bp, Glycine max
  Peptide Sequence Number=SeqID_166261
atgaagggtgaacttgatcctgtaattggtagggaaaatgaaatagaaaggttaatgcaaatacttgtaagaagaaagaaaaataacccagtgttgataggcgaacctggtgttggaaaaagtgctatagttgaaggacttgcacaaaaaatcgtatcaggcgaagtacctgaaccattgaaaggaaagactatcttttcattggatgtcgcagcgatagttgcaggtacaaaatatcgtggtgaatttgaaaaaagaatgaaaaagctactccaagttgttaaaggcaataaggacataatactattcatagacgaacttcatatgattgttggtgctggctctgccgaaggagctgtagatgctgccaatatccttaaacctgcactcgcacgtggcgaattacattgtattggtgcaaccacaccagatgagtacagaaaatacatagaaaaagacgctgcactcgagagaagattccaaaaaatatacgttcaggaaccaacaccacaaatggctctcgacatacttaaaggtcttaaagctaaatatgaatctcatcacaaagtaaaatatacagacaaagcacttgaggcagctgtttacctttcacaaagatacataacagatcatttcttaccagataaagctatagacgtaatagatgaggctggttcaagggcaagactaaaattgtttgttatgccaagtgaattgcaactactcaaacttcagattgaatctgtgaaaagagagaaagaagaggctgtaaataatcaagattacgaaaaagccgctgagttaaaagccaaagaacaggaattaagagaaaaattcaatgaagattataacaaatggaaaagagaaatagaatctgtgatagccattgttgatacaccagacatcgaagaagttgttgccggatggacaggtataccgctgcaaaaactcgaagaaactgaaagagaaaaactacttaaacttgaagaagcgttacatgaaagggttgttgggcaagatgaagcaattaacgctatatcaagagcaataagaagggcgcggagtggcttaaaagatccaagaagacctgttggcgtatttttattcctcggaccaaccggagttggtaaaactgagcttgcaaaagcattagctgaatacttattcggcgatgaaaaggctttgataagatttgatatgagcgagtatatggaaaaattctctgtctcaaggcttatcggtgcacctcctggatacgtcggatacgaagaaggtggaactttaacggaaaaagtgagaagaagaccatttctctgtcatattatttga

SEQ ID NO: 49484 - DNA, 258 bp, Glycine max
  Peptide Sequence Number=SeqID_166262
atggaagtttgcaaatacatggacagaagggtgccagaagtgctatctgacactcacattcagtttcacctataccagaggcacttccttgctgtaagaagtaattatcttgcaatgtatgaagcaatagagctaaaatgctgtaaccagtgggttccagaagtttcaatggctatctcccaagcaactttctcatttgatggccaggctgtgtatgccagttttgttgatggagctgtggcaatatttgatacttga

SEQ ID NO: 49485 - DNA, 264 bp, Glycine max
  Peptide Sequence Number=SeqID_166263
atgaattttgatgatgccaaagaaggatcaaacaaggccgcttcaaaggataagcatttgcttcaagattcattgaagattgcttcaacaaacaaagcattttttaaagattcactaaagatcaagccctgcctcaaaacaatgggtttcaaagtcatgcaaggctctggtaatcgattaccagaagggaagaatgaaaaagagctattaaaaagggttttgaatttgaatttgaacatgcaatcgattaccatatgtctgtaa

SEQ ID NO: 49486 - DNA, 268 bp, Glycine max
  Peptide Sequence Number=SeqID_166264
atggagaattggcgaacagcgctatgcaataacttcgcggggttccagactcgtaggtggaggatgcatgaactgcgtcaggcaatggcattcatggggctccgtaaaaaacgctacgcactaacttcgcggggctccagactcgtaggtggaggatgcatgaacagcgtcaggcaaggacattcatggggctccgttaaaaagtggagaatggaggattggggaacctctagagctacgcataacttcgcggggctccagactcgtg

SEQ ID NO: 49487 - DNA, 189 bp, Glycine max
  Peptide Sequence Number=SeqID_166265
atggagaattggcgaacagcgctacgcaataacttcgcggggctccagactcgaagagcgctacgcaataacttcgcggggctccagactcgtaggtggaggatgcatgaacagcgccaggcaatgacattcatggggctccgtaaaaaagtggagaatggagaattggcgtacaacgctactcaataa

SEQ ID NO: 49488 - DNA, 150 bp, Glycine max
  Peptide Sequence Number=SeqID_166266
atgcttctggacaactcatccttcttccatagtcttctatgcgctcaaccagcggatgtcgcgcttagcggatggctcgctcagcgcatgaaacagcttaggactaaaatgacattaagttctattgttcagggacttatttgtcagtaa

SEQ ID NO: 49489 - DNA, 1047 bp, Glycine max
  Peptide Sequence Number=SeqID_166267
atgttttcaaccgaaactattaacagtttaccctttgctatccagagacgactgagtctgatggcatgcggggaccgtaatgctccctttgtcatccagagacaatcgagtccgatggcatacggggacaaatcatggtcttccacctttcaatattttcaaaattattgcagttccctttccagactctgtttattccaggtgatggaacaacaaaccgtttcaatagcaaaggcaggtattattgcttccctcaatgctaggacttcggtgttggcttgtgcaaatccaagtgggtcaagatataatcctcgcttgtctgtcattgacaacatacaccttcctcccactcttttgtccagatttgatttaatctacttgatgcttgacaaggctcatgaacagactgataggcgccttgccaaacatattgtgtccctacactttgagaatcccgagaacgtggagcaggatgtgttggacatttctacattaaccgattatgttagctatgcccgaaggcacatacacccacagctttctgatgaagctgctgaagaattgactagaggttacgtagaaataagaaaaagaggaaattttcctgggagtagcaaaaaggtgataacagcaacaccgaggcagattgagagtctgatacgcctaagtgaagcattggctcggatgcgcttctcagaatgggtcgaaaaacatgatgtaatggaggcttttcggcttttggaagttgcgatgcagcagtctgcaacggatcattctactggaactattgacatggatcttattactactggagtttcggcaagcgaaaggatgagacgagaaagtttgcaacaagctactcgtaacataatcatggagaaaatgcagattgggggacaatctatgcggttattggagttattggaagaattgaagaaacaggatactggtagcgatgttcatcttaatgatctaaggaatgcaattgctactctcgctgcagaaggatttgttaccatgcacggtgacagtgtaaaaagatcttga

SEQ ID NO: 49490 - DNA, 1311 bp, Glycine max
  Peptide Sequence Number=SeqID_166268
atgtgcagaataagtgcaacattcatcttgtttgcaagatcatgtgtttggtataagtttgccctggttgctaagtatcaggaggcaaatccgactgtgtatactgtagttacctttccatttctttttgctgtaatgtttggtgattggggtcatggaatatgtttactactggcagctctatatttcataatcagggagaagaaactttctagccagaagcttgatgacatcacggagatgacttttggaggtcgttatgttattttgttgatggctatattctcaatctacactggctttatctataatgagttcttttctgtcccatttgcaatcttcgctccctctgcttatgaatgtcgtgacctttcttgcagggatgctacaacagtgggcctgataaaagtgcgtgacacttatccttttggagtggatcctgtgtggcacggcacacgaagtgaactaccattcctaaactcattgaaaatgaaaatgtctattcttcttggagttgctcaaatgaaccttggaattgtgatgagctatttcaatgccatattctttagaaatagcgtaaatgtgtggttccagttcattccccagatgatatttcttaacagtttatttggttacctatcccttcttattattgtcaagtgggccactggttctcaagctgatttgtaccatattctgatctacatgttcctgagcccaacagatgatttgggtgagaaccaactctttgctggtcagaaaaatctgcagcttgtgcttttacttctggctgttatctctgtgccctggatgctattgccaaaaccttttattttgaagaagcaacatgaagctaggcatggggttgaatcctatgaaccacttcaaagtacagatgagagcttgcaagtggagtcaaaccatgattcccatggtcatgaggaatttgagttcagcgaagtatttgtacatcaacttatacataccatagaatttgtactaggagcagtctctaatacagcttcttacctccgtctatgggcccttagtctcgctcattcagagttatcaagtgtattctatgagaaggttctgatgatggcatgggggtacaataacgtgattatcctgatagttggtctcattgtcttcatttttgctaccgtgggagtgttacttgtcatggaaactctcagtgcctttttgcatgcgttacgtcttcactgggtggagtttcaaaacaagttttatgagggtgatggatacaagttccaccctttctcgttctcctggctggatgatgaggaatga

SEQ ID NO: 49491 - DNA, 171 bp, Glycine max
  Peptide Sequence Number=SeqID_166269
atggcacttgttcacaaccgatgcaggtttgctgacaagcaaattgtgagggtccaggagacacctgacgagattcctgaaggaggaacacctcacacagttagcttgctgatgcatgacaagttggtggataatgcaaagccaggtgacagagttgaggtcagactgtag

SEQ ID NO: 49492 - DNA, 159 bp, Glycine max
  Peptide Sequence Number=SeqID_166270
atggctaaacgttcacccaatgtctcaagtgcaaggactggggtcacctatgaagcacggacacctcagccccttgtcgtgttcggtgtccgacacgcgttcgtgtgtccacgtgtccatgtccgtgtcgtgtccgatgtccgtgtcgatgcttcatag

SEQ ID NO: 49493 - DNA, 223 bp, Glycine max
  Peptide Sequence Number=SeqID_166271
tccctccagtattgaggatgtgtgctatgccttttgatcctcaggcaaaaccagttagcagcattgctgtgcaagatgacgctgcagtaagggaccgtgttgcagtggtcgtggcggtagtgttggtggacaatgcgaaacacctccggcaaaactacttgcgtcaccacgtgtttcgtcaccagagggggcaacatggacgagaactccaacgccaatacgg

SEQ ID NO: 49494 - DNA, 361 bp, Glycine max
  Peptide Sequence Number=SeqID_166272
agaagttcaaatttccagctgttatgagttccatggcgtcattcagctgcgttcaggtgcgttctatagatggcacggtcaatgaaatcgcgtatcaagcaactgtgaacattggaggacatgtatttagtggtcttctttatgatcaaggccctgagcaaagcttcaatgctaagggtggcaacataggccctcttgatcaacaacaaaatctcaatctttggagtgtttcaatccacactactcgtgatggtgcaagtgcaactatgcctccactatcagccactgctgctcaggaaccattttttcctccaccacatccatttcccctagcttccttcagacctgatatgacatacat

SEQ ID NO: 49495 - DNA, 2781 bp, Glycine max
  Peptide Sequence Number=SeqID_166273
atgctgaccaagttcgagaccaaaagtaatagagtgaagggactcagtttccacagcaagagaccctggatcctcgcgagtcttcacagtggcgtgatccaactatgggattaccgaatggggactctcattgacagattcgatgagcatgatggtcctgtcagaggtgtccatttccacaattctcagcccctctttgtctctggaggggatgattacaagattaaggtttggaactataagatgcataggtgtttgttcactcttctaggacaccttgattatatccgtactgtgcaatttcatcatgagaacccgtggattgtgagtgccagtgatgatcagaccattcgcatttggaactggcagtcacgtacctgtatatctgttttaactgggcataatcattatgttatgtgtgcttcattccatccaaaagaggatattgttgtgtcagcctccctggatcaaactgttcgtgtttgggatattggttctctcaaaaggaaggccgggcctcctgcagatgacgtcctacgattgagtcagatgaacacagatctttttggaggtgttgatgcagttgttaagtatgtattggaaggtcatgaccggggtgtcaactgggctgcttttcatcctacactgcctttgattgtctcaggagctgatgaccgacaagtgaaactttggaggatgaatgacaccaaggcatgggaagtggatactctgagaggacacatgaataatgtttcatgtgttatgttccatgccaaacaggacatcattgtgtcaaattctgaggataaaagtatccgagtatgggatgccacaaagcggactggaattcaaactttccgcagagagcatgatcggttttggattctatctacacatcctgaaatgaatttgttggcagctggtcatgacagtggcatgatagtctttaagctggagagagaaaggcctgcttttgcagttagtggcgattctttattctacacaaaagaccgattcttgcgtttctatgaattttcaactcagagagagacacaagtacttacaattcgacgacctggttcttcatgtctgaatcaaagtccaaagtctctttcctatagccctactgaaaatgcaattctactctgttcagacgtggatggaggatcttatgagttgtattgcatatccaaagatggcacaaaggacagttttggtaggggtgatacacaagatccaaagaaaggtcttggaggatctgcagtctttgtggctcggaataggtttgctgtgcttgacaaaggcagcaaccaagtctgtgtaaaaaatctgaagaatgagcttgtcaaaaagagtgccctccctatttctgcagatgctatattctatgctggaacaggcaacttgctatgcaggtcagaggatagggtttttatatttgatctacagcagaggattgttctcggtgatcttcagaccccttttataaagtatgtagtatggtctaatgacatggaaagtgttgctctgctcagtaaacatgcgattgtcattgctagcaagaagcttgtgcaccaatgcacactccacgagactatccgagtaaaaagtggagcctgggatgacaatggcatttttatttacacaacattaaatcatataaaatattgcctccccaatggagatagtgggataattaaaacattggatgtcccaatttatattacaaaggttgttggaaacaccatcttctgcttgggtcgggatgggaaaaacaaagctataactgttgatgcaacagaatatatctttaagctttccttgttgaagaaaaaatatgatcatgtaatgaacatgataaagaattcgcagctttgtgggcaggctatgattgcttatctacaacagaaagggtttcctgaagttgcgctccattttgtgaaagatgagagaatccgattcaatttggctttggagagtggcaacattcaaattgcagttgcatcagcaacagcaatcgatgaaaaagatcactggtatcgattaggggttgaagctcttcgtcaaggtaactctggtatagtagagtatgcgtaccagaggactaaaaattttgagaggttgtcattcctttatctcattactggtaacgtggagaaactttcaaaaatgttgaaaattgctgaagtgaagaatgatgtgatgggccagtttcacaatgcgctatatatgggtgacatcagagagcgtgttaagatcttggagaatgcggggcatttgcctcttgcttacatcactgcttcagtccatgggctgcatgatgttgctgaaaggcttgcagctgaactgggggataatgttccatctgtgcctgagggaaaagtacaatctctcttgatgccaccatcacctgtagtgtgtggtggtgattggccccttcttagggtcatgcgaggaatatttgaaggtggttttaacaatacagatcgtgatgctgatgatgaagagtatgaggctgctgatggtgactgggttgaggagcttgacatggttgatgtagatgggttacaaaatggagatgttgctgcaattttggatggtgtagaagtggcggaagatgatgacgaagaaggtggatgggagctggaagatttagagcttccccctgaagctgacacgccaaaagtttctgtcagttcgcaatcttcagtttttgtggccccagcacctgggatggcagttggccagatatgggattcagagatcatctcttgcagctga

SEQ ID NO: 49496 - DNA, 189 bp, Glycine max
  Peptide Sequence Number=SeqID_166274
atgaagatccagtgtgatgtgtgccacaaagaagtggcctccttcttctgcccctcagatgaagcctctctctgccatgcttgtgatcgcaccatccaccatcccaacaagctctcagaaaaacacaaacgcttctctcttcaccaccccatttccaccaaagactctcctctttgtgatatctgtcat

SEQ ID NO: 49497 - DNA, 885 bp, Glycine max
  Peptide Sequence Number=SeqID_166275
atggcgtgtttggatctaaaaaacaggacaactttcatatgtgcagccaatcaagaagctgaggaagcttttaagaagactgttgaaattgataggctcatagatatgctcagagaagctaatcctcgagaaattcagaaacttgttgttgaaaacatccttgctttcaatccaagcttttgggtacgacttgcagctagaactgatacttgcaagtctgaggatgataaaaaagattatgaagaattggctgcgactgtcatgactgtggtggattgcgtggtgcataagactaaagaaaagatagagtcttccacagatgtcctgaagggagtactaaaacctgtgattgatgatgaaggagagattccatggcctcccagagatcgtcaggcactaacattgatgaaaaaggaaataagtcaaagggagcaagaaggacagctggatgaagggttccttgctgaagttaatgcacagctacgacaatatcttgcctataatgagcaggcaagggaagatggtgataaaccggggcttgaggctatgctgcaaaaggtgttgcagctttatgcttccaaagttctctcaaaacgtagttatgccatgaaagggaaggaagttttgaaggatgagcaactccttgaaaccataatccaagctcctgaacaagaatggagccatattttgatcaatggattgacgattggtgctggggatatttcagcagaggatctctttgctgtcttgaagaaacgaattgaacgtgttttgattagaactgagggaggttcttaccaacagcggattctgacagaatacctgaaaggcattgaaacaagagcagaggagattgttcaagtgctccaggggagaccacaatag

SEQ ID NO: 49498 - DNA, 333 bp, Glycine max
  Peptide Sequence Number=SeqID_166276
gattatgagcaccaatcagcgtttcagaaccaagatgttcaagtcagcatgcgttcgttcccactgcaaacttgggtaccacaatctcaaggtggatcccctcaacgtagctttacttcgaatctttatccccagattgattctttagttggagtgatggaaatgcctaaagccaaagctggtgaaggatactccaattggatatataattatgactacgcagcttacaaacttccttcaatttgtcctccattgatcaaaaaaatgcaaacgctctcgttaatcaattatgcagttcagctaacaccttttaaaggccatccttatgtataa

SEQ ID NO: 49499 - DNA, 546 bp, Glycine max
  Peptide Sequence Number=SeqID_166277
atggcatgcgaggaaccatttggtcccgcaccttttcaccttttgtcatccagaggcggcgagcccgatgacatgcggagacaaattatagtcattcggcttacctttttccatccagacatagtcgtgtccgatagcatgcagagacaaattatggtcattatgcgtcttttgtcatccagaggtggtgggcccgatgacatgcgggaaccatttggcgacaggcccgatgacatgcggggaaccattggtcccgcactttttaccctttgtcatccagaggcggcgggccagatgacatgcggggaacctgttggtcccgcactctttcaccttttgtcatccagaggcggcgggctcgatgacatgcggggaaccatttggtctcgcactttttaccttttgtcatccagaggcggcaggcccgatgacatgcgggaaccatttggtcccgcactttttcaccttttgtcatccagaggcggcgggcccgatgacatgcggggaaccatttggtcccgcactttttcaccctttgtcatctag

SEQ ID NO: 49500 - DNA, 234 bp, Glycine max
  Peptide Sequence Number=SeqID_166278
atgagtgataaacgcgtagagatgaattatggtcattctgcgccctttgtcattcaggagcagcaagtcgagtggcgattatgtccggtggcacgcaaagacaaattatggtcattctgcgccttgccacccaggctcgatcgtgtctgtggacacgcagaggcaaattatggtcattctgcaccttgtgtcaaccaagaggaacgaattcgacagtatcaggatgatgtgtcg

SEQ ID NO: 49501 - DNA, 210 bp, Glycine max
  Peptide Sequence Number=SeqID_166279
atgatagaagtttccgtggaagccatcgcatccctcactcagtactatgaccagccactaaggtgcttcacagttggggactttcatgatgcaatcctccctaggaagggaccagtcactagagccatgagcaaaaggctccaagaggattgggctagagctgctgaagaaggccctagggttctcatgaatctcagggtagatttctga

SEQ ID NO: 49502 - DNA, 650 bp, Glycine max
  Peptide Sequence Number=SeqID_166280
cattcatggacgttgataagatccgtccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcactggtggcttggttaagggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctggttctccccgaaatgcgttgaggcgcagcagttga

SEQ ID NO: 49503 - DNA, 294 bp, Glycine max
  Peptide Sequence Number=SeqID_166281
atggtggtcggtactggttacagcacaaggccaagggatcacttagggtttgatggttgtttgtcagatccagaaacaaaaaaccacaaggaaaagggcaaaatggtcatttccaagaattttctggaccgggaagaggttcaagggtggagaactgaagaaggagaggaagaaatgcagaaagagaaagagaagaagaagaaaaaaagtaaagccgaggcgctgccgaatcacaatcgtggatcattccctacatcatttctctcgctagccttgcaccccacgcaacagtcg

SEQ ID NO: 49504 - DNA, 369 bp, Glycine max
  Peptide Sequence Number=SeqID_166282
tctcgaaattcaagttggtaagctagtaaaagaagtggctaaatttgtggccacaagagaagaaaactttgtagaggttgaagctcatgaggaaagccttgtagaagagcatgattcaagagaaaaaggtgaagaaaaaagtgaggagaaagcacaacaatggaagaagtgctcacaagtagaaattcaacaggaaagtattctccaagtcaatacccctcctcatcaactgattgtcaaggaagaaaggcatggagaacatgagaaatccataagtgtcattctttccttgatcactagcacttctcttgcaatgacatggaaggtgtttccgaaatacatgagtttcatggagtctctagctaagag

SEQ ID NO: 49505 - DNA, 219 bp, Glycine max
  Peptide Sequence Number=SeqID_166283
atggtgaaatctattgctcctccaaaccatatacggtttgcgccggatcgtccacgctgtgtaaactcgtctcgtggtggaatcgtgttggttggctatgatcctgaggtggactcatatccttcatggctagtctctcaaccatattatcatcttttaccttcggttgttgctcctggaactccaattagctcgtttaaaggaggaaattggaaataa

SEQ ID NO: 49506 - DNA, 744 bp, Glycine max
  Peptide Sequence Number=SeqID_166284
atgctgacgctgttcagctgggaagccgaccagcttgatctgctggcgcgtacccacacggtgcgcgtgccgaaggtctacggcgtcggtaacgatcgtgacaccagctttctactactggaatacattcccccgcagccactcgacgcccaaagcgcattccagcttggccagcagctggcccatctgcaccagtggagcgagcaaccacagtttggtctcgacttcgacaacaacattaccaccacgccgcaacccaacagctggttacgcaaatggtcggtgtttttcgccgaacagcgcatcggctggcagctgcagctggcggcggagaaaggcgtgcactacggtgacatggagttgatcgtggattgcgtgcagcgcagcctcgccagccatcatccgcaaccgtcgttactgcatggtaatttgtggccagccaactgcgccggcagcgccagcggcccgtggctgttcgatcccgcctgctactggggcgatcgcgaatgcgacctggcgatgctcagctattacgccgatctgccgcgccagatttacgaagggtatcatgcggtgtggccgctgccggaaggcttctcgcagcgtcagccggtgtatcagctctactatctgctcaaccgcgccaacgtctttggcggcaactgggccggcgaagcgcagttcgctatcggccagttgctggaggaggatgcgctgggccagcgccaggtcagaccggcctga

SEQ ID NO: 49507 - DNA, 336 bp, Glycine max
  Peptide Sequence Number=SeqID_166285
atgataaatggcttgttggtggtgcttcaaacactggtggagccattcttagataagttgttcactgatgaacaattagagaaactgagtgaacaaattaatccctcacaaccttcacttctggattactatcctctggcaatagcaggtgaaggattcccagtagcagatccagatttggctccaaggctacttccacgtccagaaaatgatgttgagtgcttgcatgggattttagaatccattgcacgtatagaggcaaaggcatatgggttgttaaaggagctaggagcaacccaggtagacgaaatttttcacagccggtggaggagctaa

SEQ ID NO: 49508 - DNA, 2149 bp, Glycine max
  Peptide Sequence Number=SeqID_166286
atgctgcctgccacaccggtatcggcggtggtattaacacctttcacccccgagcgcaacgacaataaagttggcgcttattgcttatgtaatggttccacccagacgctaagcggcgtgccgcgctttaccgctggagaaagtggcatgagcagcgtcacgctgggtgaactacaaaaggttgggcgtattattaatgacaatttaatcggcgagccccgcctgcaactcggcgcacaaaattacgctattggtattccggatgaagaaacaggcagttatcgtgtctatcaggtttataatagtgcggaaatgattgcaccggcggaaattaatggcgctacggtagtgccagattattatgatgtgaacgataaacaatatattgatgcgcgcgtggcgacagtcactaatggccggttaaatatcaatattggtcagcaaggcgcagccgctaacgccagcaccaatcgctggtcaatggctgccaaacagagtcagttatttgccagcagtaataacggccatattaactgggacagcaataaccgtatccgctttaccgccgccacgccgccgtacggtggcgatcggctggcatttgatgccggaggcgtggtgacctacgccggtctgtttgatgtcacgcttaaggatggcagcagcaacgcgtactacgtcagtaatctcaatgaattgcggaactataacgactggctgattgaccagattagcggcggcaacctgagcccggaaagttataacgccgcgctgaaccaggcgttcagcctgcgcgacggtcgtgtggtttaccgcatgagcaccggtaattacgatgatgaagtggctgccgcactcggcgatcaggtggtgctgagtgccgatggcgcgaaagccagtgtgaaaatcaatcgcggcaaaacgctggaagtggctaatagcgccatcgccgtgatgcgcgccagcaatggtgcaacggcgattatcgccggaaaactggcgaccagtaacgcgccctcatccgaagcgggcgcactggagctgatcagcggcgcgcgtggtatcaataatggcgtcatcaacagtggcttttttaatgccgccaatgggcgcggcgtggcagaagactctctcggctatgcgggcacggcggtgtcagcgatttatgacagtgagttccgcaacaatggtgtgctcaatgtgcatattggcgatgcgccgtggggcaccgccggcttattcctcggcagcagcagtgcggtcaatcacggcaatattaacatcggcattcacgatgtggcgaacggctcctcagcagcggcggtgagtttcagcggcgagggtagcttcgtcaacgcgcgcgatggcacgatttatctcggtcgcacaccgcaaaatcacaagggcgacgtcacgcaggatgtcgcggtcagcctcggcggtggcatcagcgccatttccggcctgctcgactcacgagccatcaatgatggtcgtattgttatcggctcaaaagtcgagaacgccgttggcatgcgcatcgaggccgggcccaatgcggtgtcactgaataacggtgttatcgatgtcaacggtatggcgcaggcgctaccgcgcgaaaatatcgccatgctggcgatggattccggcagcggcggtcaggtgggcaaccgcggcaccctcaatctgaatggctataacagcaccggcctgaaagtgatcgccacggcgggcaaccaggcgcacgccttctccagcggcgcgatcaacgtggcgggtgacgccgaccgctttggcggcaccaacaatacggcggtgtgggtaactggcgaaccgggcggtcacgccagtgccgatatcaccggcccaatccggctcagcggcaaagcgggcattgggattcgcgctgaaggccaggcaacggtcgacgttagcgcccacgccattcccacctccagcggcagcgacagcatgctggatagcggacagatcagtttctaccgtatcggcccggatgcgcgcattaatctgccggccaacggccgctacagcgcctccgtgtggaacggtacgatttttcgcgtcgagcagggagcggattttgacgggcgcggcctgactttgtcgatgaacagcccgtttgcgaccg

SEQ ID NO: 49509 - DNA, 198 bp, Glycine max
  Peptide Sequence Number=SeqID_166287
atgggaggggagatcactctaatcaattcagttcttaatgctctgcctatatacctcctgtcattcttcaagatccctcaaaagcttctgatcaccaacagctttgggttaggattatcaattctaagtatggaggttgggaggccttgcagtctactcgggctcaaggaagacattctggttggtggagggatctaa

SEQ ID NO: 49510 - DNA, 1818 bp, Glycine max
  Peptide Sequence Number=SeqID_166288
gatggtccttacctgaatgccgaagacgcgcacggctttgtcgctctggcgcgctatgccaacggtgatatcgcgctggcgaaatatacttacggtaaaggcacggtgctcctgagcggaccgcatccggaagcggatgaaagctggatggcgccggagaaaaacaatccggcctacacctcagccggcagcaagatggccaggctgtttaatgatttaaagcccgggagagcagcagctgctcaaattgcttatcccttgccgccagcggccacaactcgaggtagatcaaccagtgagaagccggtccgtctggcaggagataatccaccagcgcacgaaaaaagagaaagcggcaacgtcctcatccagcatgaaagcaatcgagtccagcctcagcgcatcccagtttttgaaatagtggtagatatggctgcgggatatgcccagcgtattggtcagatcgcgggccagccagggtttgaacgcagtgcgagggcgcggctgcggcgcaaacctgcgctgagcagtcagggcggtcttgaatcacccatggacgatagcaagcaaaattcttcgcagtctcaatccgatgatggcggcagcctgacgttcactgttcagcagcgcctgttttttgtggtgttagtcgccacgatgggcgcgctggcgtttggctacgacaccggcattatttccggcgcgctgccctacatgacgctgcccgccgcgcagggcggtctcgatctcacgccatttaccgaagggctggtgacctctgcgctcacctttggctccgcgctcggcgcgttcatcagcggttatgtctcggaccgctttggtcgccgtatcacgttacgcagccttgccctgttgttcattgccggggcgttaggcaccacggttgcgccgaatctggaaaccatggtggtgatgcgctttattctgggtttcgcggtgggcggcggatcgtcaacggttccggtctttatcgctgaaattgccgggcctaagcgccgggcaccgctggtcagccgcaacgaactgatgattgtgtcagggcaactgctggcttatgtcgtcagcgccgccatgagtttgctactgcacgatccgggcatgtggcgctatatgctgtcgctggcgatgatccccggcattctgctgtttattggcaccttttttgtcccggcttcaccgcactggatggtggcggaaggacgctttaatgaggcgctgcgtatcctgcgcaaactgcgggaaaatccgcgcgagattaaaaaagagatggcagagatgcggcagaatgcccgcgaagcccgtcaggggccacccgcgcgcgaactgttaaaagagaaatggattgtgcgtctgctgctgctgggctgcggcatgggcatcgtcgcgcagtttaccggcgtcaacgccttcatgtattacacgccagtcattctgaaaagtaccgggctgggcaccagtgcttcgattgcggccaccatcggcaacggggtgccatttcggccggcgcccgatgctgatgaccgggctgtcggtggtgattgcgatgcagctggcgctgggcgcggtgctggttctcatgccacaaagcctgacgcaaagcctgctggcgctggcgtgtattctggtgtttctgttctttatgcagatgtgcatttccccggtttactggctgctgatgtcggagttgtttccgatgaaagttcgcggggtattaaccggttcagcggtagcatttcagtggatatgcaacgccgtggtggcgctggcgtttccgcctttgctgtcgctggtgggtaa

SEQ ID NO: 49511 - DNA, 577 bp, Glycine max
  Peptide Sequence Number=SeqID_166289
atggaggaagtaaatttgtctattcaacacgacgggaaagggcacgtcattattggcgaagcggcactaagcctggctttgggcaaaaagaagatcagcgttaatacgcttatcgacgagctcagacacatgaaacgcgctggcggcagcgacacacgcctgtccgcgatttcagaggcgatcggctggctcagaagctttgatgagcctgagcaggccgcgatccatgtgcccgtgtaccggccggagaaaactgtcagggatgacgtcttcaccaccatcaaacctcgtattaatgattttcggcaacgcggcatgtggcaacggatgcgggctttagcgacggatgtgcaacgcgttgaagacgtcatcgtccgtgtcattgatgtgcccgataagcttgaggcagatcgcggtgcgcgtcagccgacgttcctgacgcaaaatttcaacggcggcagcccgttgtttctcatttgtccacctgcagcacacgatcatcttgtagggcgcaaagtaaccgatacgatatcgtctgtacagcaacaatcctcttcccgtgtcaggaaatcagcgg

SEQ ID NO: 49512 - DNA, 708 bp, Glycine max
  Peptide Sequence Number=SeqID_166290
aaggctgcctatcttgctgagaagcagaatttacatgtgaccgatgcagtccttgatgcattacaaaaagcaaaaccaagatcacataaagttatgattcagtcaactcatagctctgtgctgaagatattcaaagataaatccaaatttgaaagggtttacaaggttgatgagaacattcgcgacgcggctgactcagccattgaggacatcaaaacatttgctgattctgtggttataggaaaggcatctgtttttcctgaaagttcagcctttctagttaactctacaaacactgtggcaaggctaaaatcatttaagctcccagtttatgtagaaacttttagcaatgaatttgtatcacaagcatgggactactactcagatccatccattgagataaattcatttgtcattggaaccaaggttaatggcattattactgacttcccaaagacagcaaatagatatagaaggaacttgtgtttaaagaatggcaacaaagaaccttacaggagccctattgaacctggcaaactttttaaacaaatttctaacttgtaccttccaccacttccccctccactcccagtcttgactgatagtaatgtgacagaggcacctttgcctggtgtctctggaaaagttccatctagcaaagctgctcctggagtaggagcagcagctccagcccccatcacagcataa

SEQ ID NO: 49513 - DNA, 228 bp, Glycine max
  Peptide Sequence Number=SeqID_166291
atgacgaagcgtgaaacagaaggaagagaaagaagaatgaaacgagacacgaaccaagaccatagcgagcagcgagtgaagaagaagaagcagaaagagagcactgggaacggcgcgtggcttccacattccggcgaagtttctgcttccggtgaagttccggctaagcctgccggagaaaaaaagccgagagttttagccagcttacaaggttgtgtacttgtgtga

SEQ ID NO: 49514 - DNA, 1410 bp, Glycine max
  Peptide Sequence Number=SeqID_166292
atggtcatagcacgtggtgggttttcagggatatttccagattcaagttcacttgcctatggtttggcacttgatacttgtggtccaaatgtgactctatggtgtgatgtgcaattgacaaaggatggagttgggatctgtttcccagagctcaagctagacaatgccactgacatttccattgcttacccaggcaaggcaaaggattacttagttaatggggtctcaacccggggatggttttcagtggattacaactttggtgaactagcaaatgtctctgttgtccagggagtgtactctcggactaataagtttgatggcaacaagcttcccattctcactgttgaacaagtagctaaattaataaaatcaccatctacaggcctgtggttaaattttcagcatgcttcattcttcaagcaacagaatttgagtgtagaaaattttcttcaatctctccctggtagaagtgtaccggtcaattacatctcatcacctgatgtggacttcttaagaagagtaaaatcaagctttagttctggaccaactagcttcatcttcaggattctggagcagtctaagattgaacctacaaccaatcagacatatggtgaactcttgaaaaatctcgcacttatcaagacattttcttcaggaattcttgttcccaagggctatatatggcctgtagactcagatcattatctacaaccacatacccctcttgtcacagatgctcatagagaagggctgcaagtttttgtatcagaccttactaatgatgttccatttagctacaatttcagctatgatcctctggctgagtgtctatctttcatcgacggtgatgatttttctgttgatggtgtgctgtcagacttcccagtaactccatctgcagccataaattgcttttctggtctaggggaaaatgcaaaaagacaagtggacactttggttatcacaaaatatggagcaagtggagacaatcctgcgtgtactgaccttgcatacaaccaagctaaatcagatggggcagatgtacttgactgtcctgttcaaatgtccaaggatggaatacccttttgcttaagctctattgatttattagagagcacaacagttgctgatacacaattcaaaaaccgtgcaacaactattctggagattaaatttcgcagtggcatatatacattcagcttgacatgggatgagataaaaacattgacacgtgtgatattgtttagccattccccctccttgttttatttccttatggagtatctagcaatgggaactttgaattgtttaaaattgttcaaatcatttattcctagtttttttccactagctaaaagtcccagatataattttattggaaagctagagcaagggaagaacaaataa

SEQ ID NO: 49515 - DNA, 906 bp, Glycine max
  Peptide Sequence Number=SeqID_166293
atgcagactggccttctcacagcatatatcttgaaagccttaagctttggaagacattcaagtgttcgtgaaatttccttgatgatcttaatggcatacctatcctacatgttggcagagctattcgatctaagtggaatcctcaccgttttcttttgtggaatactaatgtcacattatgcatggtataatgtgactgaaacttcaagaatcacaaccaggcatgtgtttgcaacaatgtcatttattgcagaaaccttcatatttctatatgtgggcatggatgcccttgacattgagaagtggaagatgacccaattaagttatggaaatttgatggggatatacagttccttaatcctattgatattgcttgggcgggcagcatttgttttccctctctctgctctggccaattatacgaacacacgtgctacttctgaccaagcctcaagtatcacattcaaacatcagataatcatttggtgggctgggctaatgaggggagctgtctccattgctctggctttcaaacagttcacgttttctggagttactactgatccagttaatgcaacaatgattaccaacaccattattgttgtcctattcagcacactggtgtttggttttctcacaaaaccactaattagatatctgcttccccacagtgcaacaaggaaaagcatcagccattcagaatcaggtccaccatttgacgacttgaatcttcctttcctatcccttgaggagtcagcagcgaccaacatcagccgcgcaaaggcaagtttgtccatgttgatagaaagtcctgtgttcaccatacatcgctattggaggaggttcgatgatgcctacatgagacctatatttgggggacctcacggtaaccagtcacagtgctag

SEQ ID NO: 49516 - DNA, 171 bp, Glycine max
  Peptide Sequence Number=SeqID_166294
atggcatacaccagaccagacttagcacaagtagtcagtgttgtgagtaggtgccttaagagtacaattgatattggaatcgtctaccatgaagtcacgttttgtgctctcgctgattactcaaattctgagtatcctgcatatttgggtgcaaggagatctaagatttga

SEQ ID NO: 49517 - DNA, 406 bp, Glycine max
  Peptide Sequence Number=SeqID_166295
tgtagtttacaaaagcaaaggtgaaaggaaagatattgagctggtagaggaggaacaggcatggattggtgttgatccttctagtgagacctccaataaatctgagaattataaggaggaagcacggaagaaaacacagaagcataaaccaaagagggtagagagtgtcaacgctgatgcagaagcctttggagattcaactatgctgaagataggagattcagctaaagttgtgataaaacaagacatgaaggggagaaggcataaatatgggtttaacaacaacaaacgtgagaaggcacagaagaaaagggtggtggatgatgaaactgggacaaacatcagctggatgaagtcctatgaagatcctcctcattctcaaagaggggaacgagcaacaatttga

SEQ ID NO: 49518 - DNA, 264 bp, Glycine max
  Peptide Sequence Number=SeqID_166296
atggctatgaatgaggagatggaatcccttttgaagaatcaaacatgggatgtaattgagctacctaaaggtagacaagtgctagggtgcaactgtgcaatggaaattttggacaagaagttagagtattttgatgtcaaaacttcctttctccatggaagattggaggaagacattttgaggcaagaacctaaaggttttgaggtggaaggaaaagaaaattttatttatagattgaagaggtctctttatgggctgaagtaa

SEQ ID NO: 49519 - DNA, 621 bp, Glycine max
  Peptide Sequence Number=SeqID_166297
atggcagcaccggaccttgccgactataaaccgatcttttttagcgctgaggagtggcaatttattctggccgcgaccgatcggctgatccccgccggtggcaacggcaaagcgccgggtgcgctggaaaccaatgtgccgatcttcattgaccagcagctgcacagcccggagttcggcgcagagatctacctgcaggggccgtttgacgtgcacgcgcccgccaccatgggctatcagatcccgttcacgccacagcagatgtatcgcaccggcatcaaactggtggagcagtggacgcagagcacttaccacaaagcgttctcgcagctgacgctggcggagaaagacgcggtgctgaccaaagtgaataaaaacgacggtatcgacttcgccgcgctgggcgaaccgaacctgaaagcctcgcagttcttcagccagctgctttccgataccaaacacggctacctcgctgacccgatgtacggcggcaacaaaggcatgaaagcctggatcgccatcggcttcccgggggcacgcgccagcttcaccgaatgggtgaagcagcacaacgtgccgtatccactcggaccggtcagcctgatgggcgaacgcgcctga

SEQ ID NO: 49520 - DNA, 918 bp, Glycine max
  Peptide Sequence Number=SeqID_166298
atgcgtgcgctgcgcgggcggctggcggatgaggcgcagtttatcgcccaggcgcagcgtcagcaggcgcagggttatcgcctcaccggtatcgaacatcagggacagccagcggtgctggccggttatcgcctgctggaaaattttatccatggcagcttctgctacgtcgatgacctggtgagcgatcccgcgctgcgcggtcagggcttcggtgccgcattgctcgacggcttagcggtgctggcgccgctgcggctatcaggcgctcggcctgcatttttatcgctctatcgtatgaggaatctctgcatgaatgtgctgcacattaaagtcagcccggatctggcgggatcgacgtcgcgcatcgcctcggcgcgtctgatcgaaaagctgcgcagccgccatcacgatctgcacgagacggtgctggatctggcgcaacagccgctgccgcatctcgatgctttcaccatcagggctttttttaccccaccggaggcgcgtgatgaagcgcagcgtaacgccattcgcacctcggaacggctggtggatcagctgcttgcctgcgacaccctggttatctcatcgccgatgtggaacctcgggctgccgtcggtactgaaagcctggttcgaccatattacccgcgccggccgcaccttcgcctttacgcctgaaggcaccaaagtcgggctggtgagcggcaaaaaagtttactgcgtgatggccagcggcagcgtgtttgctcacgggccctttatgcaggatgaccagttcacgccttacgtgcgcgcggcgctggcatacatcggcatcagcgatgtgcagtttatccgcgtcgacggcacgcacgatccgctcagccgtgcccgcgcgttacccgaagcactcgaaaccattgaacgtctgttctga

SEQ ID NO: 49521 - DNA, 414 bp, Glycine max
  Peptide Sequence Number=SeqID_166299
atgaaaggaagaaagggagagagagattctgtttgtgtgtgcctttttgtatcgaggaagagagagagagatgcagtgttgggagaggaaggcaaagtaggcgttggaagggtcgtcaagaatagcggtggtgaggaaacggcgagtggcggagataagggttggggaggagcggaaggtggatttggaagagatgaatttgttactaaaaagaggggaaagagggagcgagaggttgaaggggtaattggaaggggaatatccatcatggtcactacacctcccatgtacatatacaacatacaccatcacaatggcattttcaacatcaacaacatctcaactcaatgtcattatcaacatcaacatcatctcaatgtcattttcaacatcaacatcatctcatctcaatga

SEQ ID NO: 49522 - DNA, 588 bp, Glycine max
  Peptide Sequence Number=SeqID_166300
gacatagcgcagtggctgagaaaggagtgacgcgtgggttacaaagagatttaccagcgcttccggcagcagattcttgccggacagctccggccgggcgaccgcgtaccggcgatccgcgtgctggcgggcgagctgcagggcgcgaagggcacgcgcgtcaatccgcagctgaagctggcgagcgcaactacgccaccgcgcgcaccggcgacgacgcccgcgctgctgccggtgaccgagggcaaaggcgagctgcggctcggcatcccggcgctggacgagtttccgcacaaaaagtggcggctgatgtcagcgaaagcggcgcgcagcctgcggccggacgagatgatgataccgccggtgatgggatatgcgccgctgcgggcggctatcgccagctacctgaacatttcgcgcggcctcaactgccagccggagcagatcttcatcaccagcggttaccgcgccaacctgcggctgattctggcggtgctggcgcagccgggcgacaaagtgctgttcgaagatcccggctacttcttcggccagcagctgctgaagcgcatcgcacccaacctgcactat

SEQ ID NO: 49523 - DNA, 258 bp, Glycine max
  Peptide Sequence Number=SeqID_166301
atggccgtcggtccccacaagaagaaattaagaacatatttggggattgtcgctcgtgataaggctgaatttgatatccctgaagcatctgacgttaggacaaaaaagaaaatacttcagactatggtggagcggtggagacagtttaagtctactttgacgtcaaaatgggtacttgcaatcgacaaggacagtgtcgatgacactgtttgtgaaaaatatggcattagcaaggagaaatgggcccaatgttgttag

SEQ ID NO: 49524 - DNA, 180 bp, Glycine max
  Peptide Sequence Number=SeqID_166302
atgcagttccaccagttccgtaaagatcggactttctccatccgtgtagagttcatcccggacaaatggctccgcctctccctaaaggaacatttttcaatgttggtactgctactgcatcgcgatccagctataggaattacggatgctggtggtgctggttgccatgatgctaggtag

SEQ ID NO: 49525 - DNA, 139 bp, Glycine max
  Peptide Sequence Number=SeqID_166303
atgggacctagccattcacattatgtgcaagcacaagagctggctaaagaggcaatgatagtggcaaagatagcaaatcttttggactgcacttcttggtcaggggctggaccagggctaatggacgctgttactcaag

SEQ ID NO: 49526 - DNA, 762 bp, Glycine max
  Peptide Sequence Number=SeqID_166304
atgaggataagagacaacaaaggatatttttgttcgtatgagccagagctcgcagcaccaccaccagcaccaccaccagcaccgttctattcttcttccacaatgggtatctctcgtgattccatgcacaagaggcgcgccaccggcggcaagaagaagtcttggaggaagaagagaaagtatgagcttgggaggcagccagcaaacacaaagctatcaagcaacaagacggtgaggaggattagggttcgcggtggaaacgtgaagtggcgtgctttgaggcttgataccgggaactactcttgggggagtgaggctgtgacccgcaagacaaggattcttgatgttgtgtacaatgcatccaacaatgagcttgttcggactcagacgctggtcaagagtgccattgttcaggtcgatgcagcgcccttcaagcagtggtatctgcagcattatggcgttgaggttggccgcaagaagaagagtgcagcagcttctgtcaagaaggaaggggaggatggtgaagctgcaactgaggaggtgaagaagagtaaccatgttgtgagaaaattggaaaagcgaaagcagaaccgggtgcttgatcctcacattgaagaacaatttggaggtggtcgccttttggcttgtatctcatctcgacctggccaatgtggccgtgctgatggatatatattagagggcaaagagctggaattttacatgaagaagcttcagaagaagaagggcaagggtgctgcttaa

SEQ ID NO: 49527 - DNA, 267 bp, Glycine max
  Peptide Sequence Number=SeqID_166305
atggtgagtatttactatgcacaccgtgcagagtttataattagcaagaatcggatcatgggaggcaaggattttgagtgtgatgagtggattgaggaacctgcacttctggtgacacgttttgagtatgctaatctttttcacactgttacagactggtacagtgcttatgtttcttctagagtcactggtctgcctaatcgaccacatttgatctttgttgacggccacagcaagaatctagatgctttttgctttcttccataa

SEQ ID NO: 49528 - DNA, 1083 bp, Glycine max
  Peptide Sequence Number=SeqID_166306
atgccacaaagaaaaggttgcagttctctgaatgagcctcgtcttgttgccaggaaattcttggcacgacctcagattgagggtgttgggactgttgttagaagaagcataggagggtttgagctcaagtatttgatcccttcattgtgttggatgaattctcagaacgtgaaattttgtgacattgcagttactgctcctgctggttttcctgatcatccccatagaggctttgagacggtcacatacatgttgcaggcttcttctcatgctcagttttcccgatggcaaacatctcatgctgcctgtataactgtttgccatcattggacaaatctttttattggttatttacttttgtggaaatccttttcaaagttggaaacatattgttttaatggactaatggccatcataaagggagctataatgcatgaagattttgaaggacataaggggacaatagaagctggtgacttgcaatggatgactgcagggagagggattgttcactcagaaatgcctgcggctcaaggcacccaaaagggtctacaattgtggatcaacttggcttccaaatataaaatgattgaaccaaggtatcaagaagtgttgagtaaggacatagcagaagctgaggatgatggtatcaaggttagagttatagctggggaagcactagggataaagtctccaatctacacaaggacaccaaccatgttcttggacttctctctcaaacctggaggtcacttgcaacaacctataccaaattcttggaatgcttttgtctatatattggaaggagagggtatatttggaaacatgatatctcagccttcaaactctcaccatattcttcttcttggtcctggggatggcctagaggcatggaacaaatcttctaagctccttaggttcattttggttggagcagaacccttgggggaacctctagtgcaatttggaccctttgtcatgaattcacaagaagagattgatcaaaccattgatgattttgagaactttgccaacggatttgaaaaggcaagacattggacatctgaaagccaaattaattaa

SEQ ID NO: 49529 - DNA, 1113 bp, Glycine max
  Peptide Sequence Number=SeqID_166307
atgaacaaaagaaccacgttgcttattcgaaccctcttgttcctcttcgtacttaactccctctatctctctctctacttcacccacaaaccctcttcttcttcagaagaagaacaagaaaaatctgaacttgaaccagacacatatctcacaccattttcacacgaacctcacttttcaaagccatggccaattgtcccctcccacatcccctggactaccacttctgcgcgatcccactcctgcgaggcctactttgggaacggcttcactcgccgccgcgacgtcctccttccccgcggcggcgcggggtggttccggtgccaccacagtgacacgctccggaactcggtgtgcgagggcgggagactccgcatggcgccggagaagatcacgatggcgaagggtggcgaggatttggcggcggttatggggcgcacggaggacgaggagatgcccgtgtttcaaaacggtgcgtttcaggttgacggcggtgaagtcgtcgttgaccgggagcttctggttgaccaagagtttttggatgagtatgtgccgaggggagggatcgataggcacaccatgcgggagttgattgccaagatacggatcgtgagagggaaggattttcaatgtgatgagtggattgaggaaccaacacttctggtgacacgttttgagtatgctaatctttttcacactgttacagactggtacagtgcttatgtttcttctagagtcactggtctgcccaatcgacctcatgtggtctttgttgacggccactgtaaggctcctcttgaagagacatggaaagccttgttctcaagcgtcagatatgctaaaagcttcagtggttcagtttgttttcgtcatgctattctctcacctttgggatatgaaacggcaatgtttagaggactttcagaacatatagattgtcatggagctcctgcacaagaactactgcaaaagcctgatgaccaaaaaactgcacgcctttctgagtttggagaaatggtcagagcagcattcgggctacctctaaacatacaccgcgatggaaatcactcgctggacataatgtcctctttgttcgtcgtgaagattatttag

SEQ ID NO: 49530 - DNA, 183 bp, Glycine max
  Peptide Sequence Number=SeqID_166308
atggaagcagtgacgtacctcaaccgtggtagagacgaactcgtttgcggtagttgcagcttcagtgacagtggtagcttcagcagcgcagtttccggtagtcacagggtcaggaagaaggagaaaggagaaaggagaaaagggtttgagcgggggggggggggggtgggtgggcgaaaatga

SEQ ID NO: 49531 - DNA, 537 bp, Glycine max
  Peptide Sequence Number=SeqID_166309
atgccttgcataattcagcatgacgaggtcgatgatgtacatgcgattcgtaatgatcacgatgaagggtcatgggaacacctccaacgtccccgccgcattccgatgaccaaatttgatatcccaaaagcctcaaatgccaagaaaaaggtgatgcccatgatggccactagatggaggcaatttaagtcttcactaaccactaaatttgtctatgctaacattgacgaggaagaaaaagaagatccttctataaaatatggtatagatcaacaaacttgggatgaatttgctgcgagtcgtgtattacaggaaataaggaaaaaggtgcaacaaattcagaaaaacaatgactgcccccacgtactgtctcgtgggggttatgatttgcttgagaaaaaactaatagacgaaaaaagagaaaaacgaaaagaagaggcaatgctaactgagaagacaccattgcttaaggaccctccatctcccattgaaagagatgtgaagtggaaaatggctcgcacaaagcgatatgggtaa

SEQ ID NO: 49532 - DNA, 693 bp, Glycine max
  Peptide Sequence Number=SeqID_166310
atgactcatattgttgggttacaaagtgagttggaagtgttggtaaagtccatggcatacttggcgaacctcattaaaactcttgtgtttgcgtatgtgtgtgagatttctctcataccttttagaattccgattgctactgctaacagctggtatcagatggcacttaagtcaagggcaaaattcgaagtggagaagttcaatggaagtggaaatttcatattactgcaaggcgagttaaggatttgttggcactacaaggtcctttatcacgtgatggagttgaagtcttctggggaggaggattcgaatctccaacaacacgtgaatgccttcaatcaaattgtcaatgatctgacaaggctaaatgtaaaggttgaggatgaggataaggcatgtattctactgtgttctttgccttcttcttacaaacatttggtcataaccttaacatacgagaaagactcaatcattctagagatgatacatgttgcacttatgtctcactctcaacagagacagaatgtagtggagagtatgcaaggcgatgatctggattgtctagagttgaagaaatctggtgaagagagatttcacttagcaaatgtggcagagattgatgattcagactactacactgaaggagatgtctactacagtgcaagagatgttctttctagtttatgcagttag

SEQ ID NO: 49533 - DNA, 801 bp, Glycine max
  Peptide Sequence Number=SeqID_166311
atggaggtcaaaaaattgcggcccttcttgcttgttcttccaattagtgttgcactagttttactagtcgcttggcttcaccttacatcattttccatatatcacaaccaattacaccatgaatattctgagattatcattcccgaacactctcttgaccctctaaccatccatgaattcaacaagaacagaaccatcctctctaaccaccctttcttcaagtccccattcagttacactattaaatatgttgtcctggaagaaccagaaaaacaactagtcctcaaatggaagaagggtgatccacctttgcctaggaaggcatccatggtagtggtcgacgatgacatctttcgcgagctcattgtggaccccaaaaccgacctggtgactatccatgaaaccaaacttagcttcggggtaccgtactataaccttaatggacctgatggaaaggaagaaaggaaaggtcacagctggtttgggacaccagtggaggagaacaagaggttgattaaggtgaaatgctattcaaaggaaggcattgtgaatttttacatgaaaccagttgaaggtttcagtgccttggttgacatgcataaaaaagaggtactggttgtttcaaataatgggcagaacatccctgtggccaaaggaattaacaatactagtactactaaataccattgctccattcaaaagcttaatagagagttaaggatgttgaatccaatatccttggagcaaccgaaaggtccaagctttataattgatgggcacttggtgaaatgggcaaattga

SEQ ID NO: 49534 - DNA, 246 bp, Glycine max
  Peptide Sequence Number=SeqID_166312
atgagaaacgaaagcaaggaattctctctaagtgtggatcttgatcttgagcattcttggaagccaaccattcttgttaagcataatgtcttccatcttttactaaaccaagaagacatggagcagaaacaaccactagaagttatacggtgttggaacagtaaagaatcattcaagcctgaatatgcatggagtataaatagatacaagagatcaacaagtaaagctggagattatgagatttga

SEQ ID NO: 49535 - DNA, 441 bp, Glycine max
  Peptide Sequence Number=SeqID_166313
atggaggaagacgagaccggtgacgagcctcagtgtggcgttgtttccgataacgaaattgacaaaccattccttgagactcacgatggagaaatagagggcgaggagtttgatggcttaaggagatgtgggagtgtcgtcttggatctcagagatgacgaactgggtttggtcgagggcgatttagcagcggtggacaagaggatcgaaggtgaagacagagatgccatcatgacaaactactccctggatctggttgtccaacaccagatctggtattttcaaccccagatctatttagccaaggtgaggatgatggcttccacggcggtgtgggatggaaggagagagggcacgagagataggtctgagagcgtgagagagaatgagagagtgagactgagagagtgtgacaataatgaaacatttgatttctattga

SEQ ID NO: 49536 - DNA, 351 bp, Glycine max
  Peptide Sequence Number=SeqID_166314
atgtggaaaacaccacagcagaatggtgttgtaaagagaatgaatagttatcttattgaaagggtcccatgtctaaggttgcaagttggcctttctaaaggttattccaaaggtgtgaaagggtttaagttttgggatccaatttctaagaagatggtgatcaacaaggatgcagtgtttgaaaagcaatccatgttgccaaagatagttgatacaactatgccagtgtctgatagagcttcccttaactccatggaggttcaagtggacctagagcacctgacagtgattcctaagagggcagaaccgtgcaatccaagacttgaggctacaccctacacttgcgcctaa

SEQ ID NO: 49537 - DNA, 800 bp, Glycine max
  Peptide Sequence Number=SeqID_166315
atatcttgactactaccattgggaaactagagtaccctggtcgtgttcgtggtgttggtggaagtatgggtattaggaaatattttggaccacctacccatcatggctccatctcaataactatcagcatgagatatttgaggctcttacaaaacggatccctgagcaagtcttgtggaagcaaagcttccaagcttattttgatgatgccaaagactcaagtcaagaatcaagattcaagaaagtttcaagaatcaaagagtcattcaatcaagaatcaagattcaagtaaagaatcaagagtagactcaagatatgcaagaacctcaagaaaagcatcaaacataagagggagttacgttgatgttgatccatcgggagaagacaatcacattgatatccatcaattgtgtgagctatatgttgatgttgatcctccacttttaatggcaattggaaaaatgtacaatctgaggtcaatcatacaccacaagaaaatagaggatgataatgctagagtggtggtcgaagagtggccgagaagactctccaaggctattacgaccaaggctgtggagcgatgtagcaaagatgttccacacaaaaaggtggaacctgaacttgatccacttgagcatttattgatgatagcaagtcaaaataagaatcctatacaactaccttgggatcctaatgtactaagtaggccatcttcaatgcccttttatatccatcagaaacatcttttggaagtatatttgggtacaaaggtgtttaacatcttggttatgcaactatga

SEQ ID NO: 49538 - DNA, 168 bp, Glycine max
  Peptide Sequence Number=SeqID_166316
atggtaaacaatactagtgagttcaacatacataggaaggttgaaattccgaaatttcaattgaaaattactgtgaaaacaagtgccaaagctagagggaattggaaggaggattggtgccatcccttgaagaatttgagtcaagaagaaaggggccaaccaccttaa

SEQ ID NO: 49539 - DNA, 750 bp, Glycine max
  Peptide Sequence Number=SeqID_166317
atgaagctcagacgaaatgtatctaggtatgttggcgatggacaacaaaaagcgagcagtcacggtcgtcagcgtgatggagaaagcttagatgcagaacacgaagaagatgaagagagcgcaagcaaaataggaagaaatgccattgaaacttttaatgggatgatccataggggactaaaaccaaatgcagtaacatttgttaacctttcaaaaggatgtagccatgcaggaatggttgaggacgggttaaactactttaattccatggaaaagatttatggggtagtccctaaagaagagcattacagttgtgctattgatttgctaggtagagctggaaagcttaaagaagcagaagactttataaataacatgtctttggctgcagacaaattgatgaaggctgaacctaaaaatagtgtggctcatgtttggctttcaaatatttacgcaaaagaaaaacaatgggaagatgtacgaaactggtctcatcctcaaaagaaagaaatttatgaaaagcttgatagtcttcttgatcagataaagcgaatcgggttacggaaagaaatatcagcaggtttcatcatttctccaatggttcatgttcctgtggagattactggcactaaaccgataatgaccctggaaaagagagtggccaaggatgttggattggcttcaggttcaaagattactgaagtgttgatgtttcagctactcggaaccaaagaaaagtgcaagggttga

SEQ ID NO: 49540 - DNA, 273 bp, Glycine max
  Peptide Sequence Number=SeqID_166318
atggagcactacctaagcatgtggttcgccagcaagcggccaaccaccacggacaggtgcagttgcataagtgcctctaccagttcagcctcagccagcaggttcggagctacgatcgcatggcctgcagactggcctgatgctcagacgggggcaggacccgcaggggcccccggagctgaggacgaagcccaagaagatgaagatatggctgacctatttgacttcttgggaggaggcagatccatgagatcaggatcaccggactcgtga

SEQ ID NO: 49541 - DNA, 231 bp, Glycine max
  Peptide Sequence Number=SeqID_166319
atgggacaccttaggtttgtcatactttttggtaggaataatcaacatgaaaatacagaaaaaggggttcccatgaaccctaagagaataaaggtcattcctgagtggcccgctccaccaagtgtgttgaggaaaaaagcccagcgtttcaagaacctcggggatttgaggtcaaatccttttcaagggggagggaatgatgcaatcctactccgcaagggcattggatag

SEQ ID NO: 49542 - DNA, 276 bp, Glycine max
  Peptide Sequence Number=SeqID_166320
atggtcacgaaagggtccataaagcttttaacgagtttcaacaccgagaaggatgggtataaatacgtcatattcaagtacatgttttcagctggtgatgggtcaagagtcacaattcatgcggatcaaaaggtagcatgggaatgctacatggctagcttgaagctcacacccatccaagaagtacaaaggacccaagcaatcaatgtggtaacttggttaggaatggacatggtagaagctctcgacctagatccaaggactgtggaagattag

SEQ ID NO: 49543 - DNA, 330 bp, Glycine max
  Peptide Sequence Number=SeqID_166321
tcctacagggtgcccgtcccccccagcaaggtcatgccatcgcgacatagggatcgcgcccgcaagacacccagtggacccggagaagtccaacagggtcttggggtttccagctctaattacgagtctccatcagatctacgaagtgcctgtcacccccagcaaggtcatcaagccctctactaaccgagctttcatcaagaaggatggccggcagcgggcaacagacgcaccgtcgccacctccaaagcccctcagctcatctacaaaacctggagcgttgcctacgacccgtggtcgaccagtaggcgaccaagtccaaagccaaag

SEQ ID NO: 49544 - DNA, 278 bp, Glycine max
  Peptide Sequence Number=SeqID_166322
atggccaaaagaacaagtccgatttacataggattcgtgattgtattgtgtgcctcaagcatgtttgtaatttgtatgggagaatgggaatcaacttggagcacaagagctgcagaagaagctgaggctgtggcagcaataccatgctcaggacatggaagagcctacttagatggtcttattctaaaagggcatgagcctgtttgtgagtgcaatccatgttatggtggatctgattgctccaacttattatctgattgtgctgccaatgctggaag

SEQ ID NO: 49545 - DNA, 180 bp, Glycine max
  Peptide Sequence Number=SeqID_166323
atggatgacagtggtcgagagggagatgaatttcaaaaatgtagagggagttttgcggtgcagtgtggtgtgatgttttgccaaggttcgttaatgagtattggtcatcgatggcaagcattgaaacatgttcatggccttcatggatttggatgtgagattcatgatgtccgagaatga

SEQ ID NO: 49546 - DNA, 141 bp, Glycine max
  Peptide Sequence Number=SeqID_166324
atggctgctgcttctggtgaaaggtggatggaccgtcttcagttttcctcattgttctggcctcccccactagatgatcaacaaagaaagttgggattatatccttattatccctgctctgtcctcctttttgcattttaa

SEQ ID NO: 49547 - DNA, 450 bp, Glycine max
  Peptide Sequence Number=SeqID_166325
atgttgctgcgcggggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcagtctggagaagcgtcctcagtggcggaccgggcccaagtcccctggaagggggcgccagagagggtgagagccccgtcgtgcccggaccctgtcgcaccacgaggcgctgtcggcgagtcgggttgtttgggaatgcagccccaatcgggcggtaaattccgtccaaggctaaatactggcgagagaccgatagcgaacaagtaccgcgagggaaagatgaaaaggactttgtttggagagtcaaagagtgcttga

SEQ ID NO: 49548 - DNA, 813 bp, Glycine max
  Peptide Sequence Number=SeqID_166326
atgataaactttttgccacaggtgtatagagcacagacacaatttttcaattctagagattttagttatgaaggagacacgtccttgtggaaaaacagcacagatagcaactctagatttattgagtttgtgacttcaccaaacaatcccgatggaaagttgaacaagggagttctcaaaggccctaatgtcaaaaccatttatgatcgagcctattattggccacatttcactgctattccttcaccagctgatgatgatctaatgctgtttacaatttccaagctcacaggccatgctgggagtagatttggatgggcaataataaaggatgaggcagtatatcaaacgatgttgacatatttgcaattgaacacctttggagtttcccgtgacgctcagctgagagctttaaagcttttggacgtggttcttgaaggagatggaaaagaattattccagtttgcatattcaaccttgaaagatcgttggaggaggttgaaacaaatcatatctgaatcaaaacggttttctctacagaatttgtctccccaatactgtacctttttcaagagggtcaaagatccttcgccagcatacgcttggttaaagtgtgagagacaacaagacaagaattgctatgaaatccttgaagctgctggcatcattggccgtcaaggcagtgactatagtgctgataatcgttacctgcgtctcagtctcattaggagcgaagatgattttgagatactaataaacaagcttaaaaatctagttccaacggaaaaggaaaccaaggattttaacaactag

SEQ ID NO: 49549 - DNA, 873 bp, Glycine max
  Peptide Sequence Number=SeqID_166327
atgggtcacttcatttcacagaaatctcaaagttcaaccgaaaaattgcttgaatattactatttcataagaaaaactacgggagaatgggagccaacttggagcagtagagctgcagaagaagcagaggctgtggcagccataccatgctcaggacatggaagagtctacttagatggtcttattctaaaaggccatgaacctgtttgtgagtgcaatccatgctatggtggatctgattgctccaagttgttatctgattgtgctgctaatgctgcaggtggagatccatattttatggagccattttggatgcgacatgcagcaagtagtgccattttagtatcaggatggcatagaatgggttattcttatagtgataaatcatacatctcacaactattggttgagtacataaaaaaacttcatgccatcgttgggaatgcaatcaccaaaggaaagtacatcgtatttggaagtggctcaactcaacttctcaatgctgctgtttatgccttgtctcccaactcttcaatgtctccagcaaaagtggtagccacagcaccatattaccccgtctatcgaacgcagacacaatttttcaattctagggattttagttatgaaggagaaacatcctcgtggaaaaacaagacagataaaaactctatatttattgagtttgttacttcaccgaacaatccagatggaaaattgactaaggaagttcttgaaggtcctaatgtaaaatccatttatgatcgagcctactattggccacatttcactgctattccttcaccagcagacgatgatcttatgatatttacaatttctaagctcacaggccatgctgggagtagatttgggtga

SEQ ID NO: 49550 - DNA, 237 bp, Glycine max
  Peptide Sequence Number=SeqID_166328
atgggtgctgttgagggttaccgtattgctggtgggcctctcggtgaagtgactgacccaatctacccaggtggcagctttgacccattgggccttgctgatgacccagaggcttttgctgagttgaaggccattgtgacaggaaagggacctttggaaaatcttgctgatcacctagctgacccagtaaacaataatgcctgggcctatgctacaaactttgtccccggaaagtga

SEQ ID NO: 49551 - DNA, 882 bp, Glycine max
  Peptide Sequence Number=SeqID_166329
atgggcacgagagaagagaaaggggttaaatatggagtgaaatcaacgcatgactttcggatgcaaggtgtggtccatgcggtgatggagggagaatgggagccaacttggagcagtagagctgcagaagaagcagaggctgtggcagccataccatgctcaggacatggaagagcctacttagatggtcttattctaaaaggccatgaacctgtttgtgagtgcaatccatgctacggtggatctgattgctccaagttattatctgattgtgctgctaatgctggaagtggggatccatattttatggagccattttggatgcgacatgcagcaggtagtgccattttagtatcaggatggcatagaatgggttattcttatagtgatggatcatacatctcacaactattggttgagtacataaaaaaacttcatggcatcgttgggaatgcaatcaccgaaggaaagtacatcgtatttggaagtggctcaactcaacttctcaatgctgctgtttatgccttgtctcccaactcttcaatgtctccagcaaaagtcgtagccacagcaccatattacccggtatatcgaacacagacacaatttttcaattctagggattttagttatgaaggagaaacatcctcgtggaaaaacaagacagataaaaactctatatttattgagtttgttacttcaccgaacaatccagatggaaaattgactaaggaagttcttgaaggtcctaatgtaaaatccatttatgatcgagcctactattggccacatttcactgctattccttcaccagcagacgatgatcttatgatatttacaatttctaagctcacaggccatgctgggagtagatttgggtga

SEQ ID NO: 49552 - DNA, 1413 bp, Glycine max
  Peptide Sequence Number=SeqID_166330
atggaagtcaaaggaatcagggcaaattttgttactttgaacatcctcatcaattgtttctgccacttgggccaaatggccttttctttttctgtattgggcaaaattctaaaattaggttatcagccgaataccgtaaccttgaatacactcatgaaaggtctgtgtctcaagggtgaggtcaagaaatcactgcactttcatgacaaggtcgtagcacaaggatttcagatggaccatgttagttacgggaccctgctcaatggactatgtaaaataggagaaacgagatgtgccgtcaagttgctgagaatgattgaagacagatcaactaggcctaatgtggtaatgtacaacaccatcattgatggcttatgcaaagataaacttgtaaacgaggcttatgatttatattctgagatgaatgctagaggaatttttcctgatgctatcacttacactactctaatatatggtttttgccttttgggtcagttaatgggagcatttggtttattaaatgaaatgatattgaagaacatcaacccggatgtttatacctttagtatattgattgatgcattatgtaaagaaggaaaggtgaaagaagccaaaaatttattagctgtgatgacgaaagaaggaataaaacctggtgttgttacttatagtactttaatggatggatattgtttagttggtgaagtgcagaatgcaaaacagatattccacgctatggtgcaaatgggagtaaatcctaatgtgtacagctacaatataatgattaatggattatgtaagtgtaaaagggtggatgaggccatgaatctcctaagagaaatgctgcataaaaatatggttcctgatacagtgacgtacaattctcttattgatgggttgtgcaaatcagggagaattacttctgctttgaatcttatgaatgagatgcaccacagaggtcaaccagctgatgtagtcacctacacttccttattagatgctttatgcaaaaaccaaaaccttgacaaggcaactgcactattcatgaaaatgaaggaacggggaattcagccaactatgtacacatacacggcacttattgatggattatgtaaaggtggaagacttaagaatgcgcaagagctttttcaacatctcttggttaaaggctgttgtatagatgtctggacatatactgtcatgatcagtgggctttgtaaagagggcatgtttgatgaagctttggccattaagtcaaaaatggaagacaatggttgcatccctaatgctgtaacttttgaaatcattattcgttctctttttgagaaggatgaaaatgataaggccgagaaacttctccatgaaatgattgctaaaggcctattaggttttaggaattttcatggggagtga

SEQ ID NO: 49553 - DNA, 246 bp, Glycine max
  Peptide Sequence Number=SeqID_166331
atgaagaatggctccaaactcattggtggaggatgcatgaacgaaaacgcaattcatggggctccgaataaaaggcgaggatggaggattgcactaagcaatcactacgcatggctccaaactcatgggtggaggatccatgaacgaaaacgcaattcatggggctccgaaaaagggttgagaatggagaattgcactaagcaatcactacgcatggctccaaactcgtgggtggaggatgcatga

SEQ ID NO: 49554 - DNA, 387 bp, Glycine max
  Peptide Sequence Number=SeqID_166332
atgaaaggtctgtgcctcaagggtgaggtcaagaaattactgcactttcatgacaaggtcgtagcacaagcatttcagacgaaccaggttagttacgggaccctgctcaatggactatgtaaaacaggagaaacgagatgcgccatcaagttgctgagaatgattgaagacagatcaactaggcctaatgtggtaatgtacagcgccatcattgatggcttatgcaaagataaacttgtaaatgaggcttatgatttatattctgaaatggatgctagagaaatttttcctaatgttatcacttacaatactctaatatgtgccttttgccttgcggaatgcaaaacagatgtttcatggtataatccaaacgagagtaaatcctaa

SEQ ID NO: 49555 - DNA, 219 bp, Glycine max
  Peptide Sequence Number=SeqID_166333
atggaaagagtcacaaataatattggagatgaagtcacaactattcaagcaactgaggaatggacaagattctatgatagtttagcaatgaatatagaaatggaatcaagcaatgtgaagaacaagtcaagtggaaaaagaaagatgtctagtgaggacacaagaagttacttcacatggaacttggaaatggatcgtgtgctagctgatgtgctttga

SEQ ID NO: 49556 - DNA, 546 bp, Glycine max
  Peptide Sequence Number=SeqID_166334
atgggtgaccaagaggagacacgggaacagatgaaagctgacatgtcggctttgaaagagcaaatggtttccatgatggaggccatgttaggaatgagacaactcatggagaataacatggccaccgctgtcgctgttagttcggctgccgaagcagacccaactctcccagctatcgcgcaccatcctctcccaaatgcggtaggacgagaaagtagcacactggggcgcatcatcaacccccatttgggatacaaccgggtggcttacccttatggattaccacctaattacacgccaccagtcatgcgtgatgatgcgggtcatgggccggcgcccaacacattgcctcagcacaacctcacagcacaaccaatattcttgtcagaaagaccacccccggtggcggaagaaagaaggaaacacgatatcattgaggtgggattgagagatgttgaaggctttggtgactatccattcgcggacatgacggattctttgcttggtaccggacgtcgtcatccccccaaaattcaaggtacctga

SEQ ID NO: 49557 - DNA, 1523 bp, Glycine max
  Peptide Sequence Number=SeqID_166335
atgtcattctcattctcattgtcaagaaggttaagctcttctccctctcttcccattcccaactttcctccttttcttccaaaccccactttccctctttgctttcactctcagcctccatccattgacaatgttgttgatgatactgtttcccagttcagtggcatgctccttgttcgtcataccccacccatcatcgaatttaacaagattttaggatcccttgcaaagatgaagcagtatcttactgccatttccctttctaaacaaatggaagtcaaaggaatcagggcaaattttgttactttgaacatcctcatcaattgtttctgccacttgggccaaatggccttttctttttctgtattgggcaaaattctaaaattaggttatcagccggataccataaccttgaatacactcatgaaaggtctgtgtctcaagggtgaggtcaagaaatcactgcactttcatgacaaggtcgtagcacaaggatttcagatggaccatgttagttacgggaccctgctcaatggactatgtaaaataggagaaacgagatgtgccgtcaagttgctgagaatgattgaagacagatcaactaggcctaatgtggtaatgtacaacaccatcattgatggcttatgcaaagataaacttgtaaacgaggcttatgatttatattctgaaatggatgctaggggaatttttcctgatgctatcacttacactactctaatatatggtttttgccttttgggtcagttaatgggagcattcagtttattagatgaaatgatattgaagaacatcaacccgggtgtttatatctataatatattgattaatgcattatgtaaagaaggaaatgtgaaagaagccaaaaatttattagctgtgatgacgaaagaaggaataaaacctggtgttgttacttatagtactttaatggatgggtattgtttagttggtgaagtgcagaatgcaaaacagatattccacgctatggtgcaaatgggagtaaatcctaatgtgtacagctacaatataatgattaatggattatgtaagtgtaaaagggtggatgaggccatgaatctcctaagagaaatgctgcataaaaatatggttcctgatacagtgacgtacaattctcttattgatgggttgtgcaaatcagggagaattacttctgctttgaatcttatgaatgagatgcaccacagaggtcaaccagctgatgtagtcacctacacttccttattagatgctttatgcaaaaaccaaaaccttgacaaggcaactgcactattcatgaaaatgaaggaacggggaattcagccaactatgtacacatacacggcacttattgatggattatgtaaaggtggaagacttaagaatgcgcaagagctttttcaacatctcttggttaaaggctgttgtatagatgtctggacatatactgtcatgatcagtgggctttgtaaagagggcatgtttgatgaagctttggccattaa

SEQ ID NO: 49558 - DNA, 315 bp, Glycine max
  Peptide Sequence Number=SeqID_166336
atggcgatggaacgcgtctccgaatttcctcacacttatatggatcgtcgcccaagaaaaagagttcccaaggttgtagatctggtgaaatttgcgtacattggttatatttgcttcagtttttgtggttctctgaatcatggagatggaacgcgtctccgaatttcctcacaagaaggatccagcaggaaagtaacactgatcttgcctattgaatgttcttttcctattgagaaaacccatctcttcctttttcagttttcttcagcttggtggttgtgcaacgtgatgatgaagaagcatccaacaggcaag

SEQ ID NO: 49559 - DNA, 1681 bp, Glycine max
  Peptide Sequence Number=SeqID_166337
gttaagctcttctctctctccttccattcccaaatttcctccttttcttccaaatcccactttccttccttgctttcattctcagccttcatccattgataatattgttgttgatgctgtttgtcagttcaatagcatgctccttgtgcgtgataccccacccatcatggaatttaacaagattgtgggatctcttgtaaagatgaagcactatcccactgccatttctctttttaaacaaatgcaagtcaaaggaatcgagccagatctttttactttgaacatcctcatcaattgtttctgccacttgggccaaatgaccttttcttttactgtattgggcaaaattctaaaattaggttatcagccgaataccataaccttgaatacactcatgaaaggtctgtgtctcaagggtgaggtcaagaaatcactgcactttcatgacaaggtcgtagcacaaggatttcagatggaccaggttagttacgcaaccctgctcaatggactatgtaaaataggagaaacgagaagtgccctcaagttgctgagaatgattgaagacagatcaactaggcctaatgtggtaatgtacaacaccatcattgatggcttatgcaaagataaacttgtaaacgaggcatatgatttatattctgaaatggatgccagaggaatttttcctaatgttatcacttacagtactctaatctatggcttttgccttgcgggtcagttaatggaagcatttggtttattaaatgaaatgatattgaagaacatcaacccgaatgtctatacctatactatattgatggatgcattatgtaaagaaggaaaggtgaaagaagccaaaaatttattagctgtgatgacgaaagaaggagtaaaacctaatgttgtttcttataatactttaatggatgggtattgtttaattggtgaagtgcagaatgcaaaacaaatgtttcacactatggtccaaaagggagtaaatcctaatgtttacagctacaatataatgattgatagattatgtaagagtaaaagggtggatgaggccatgaatctcctaagagaagtgttgcataaaaacatggttcctaatacagtgacctacagttctcttattgatggtttctgcaaattagggagaattacttctgctttggatcttttgaaggagatgtaccacagaggtcaaccagctgatgtagtcacctacacttccttattagatgctttatgcaaaaaccaaaaccttgacaaggcaactgcactattcatgaaaatgaaggagcggggaattcagccaaataagtacacatacacggcacttattgatggattatgtaaaggtggaagacataagaatgcacaaaaactttttcaacatctcttggttaaaggctgtcgtataaatgtctggacatataatgtcatgatcagtgggctttgtaaagagggcatgcttgatgaagcattggccatgaagtcaaaaatggaagagaatggttgcatccccgatgctgtaacttttgaaattattattcgttctctgtttgagaaggatcaaaatgataaggctgagaaacttctgcatgaaatgattgctaaagacctattacgttttagggattttcatggtgagcgatctccagttacaaataagttattgtga

SEQ ID NO: 49560 - DNA, 432 bp, Glycine max
  Peptide Sequence Number=SeqID_166338
ctggtggatttgtcctctttctggcaggatggtgatcttgatttgaatgcttcccctcaagcacttgacaaattgttgggtcatgtgcttgcttttaaggtcaggattcaatcaaaattcaagaatgcagttgttcttagatactcaaatgacctagatttgatcaatgctattctcaaaatgttggctgatagtgaggcatgttgcaaaatagatccttccaatgttgattgcaataatactacccatgctgaatgtcaatctctgtctattacaaccgaccatgattcggttgccggattccctttaacgcccaaaaaacggatgtcatctgatgaagttgatgatgatttaggaagctcgcaaatttccccagcccaactatcgtttaacaaattaacaagacattctcataagagccaatttagctga

SEQ ID NO: 49561 - DNA, 450 bp, Glycine max
  Peptide Sequence Number=SeqID_166339
atgatgccgccagcaaagccaagaatcagcagcgtgccgagcgccagacggctggggcgtcgccaccagcgccagatacgtataagtttctgtttcatcgccacctcactgcccaaagccgtcagccggcttaaaggtgttttccaccaccggtttggcatcggtctgcggcacgtgacactgcaggcagaagtagcgacgcggcgataccgtgctgctcaccacgccgtcgcggtcggtaaagtgcgtcggactgacgcgcggcgcgccggtggtcagatagctctgggtgccgtgacactgcaggcagcggttcacgttcttcgtcacctggtagccctccacgctgtgcgggatcaccggcggctgattaacatagttcagcggcttgcggctctgctctttgggctgatgaatggtgccctgctgcgttgccgtcacttccggtga

SEQ ID NO: 49562 - DNA, 324 bp, Glycine max
  Peptide Sequence Number=SeqID_166340
atggtttttcacttaaggcatgtaatgagcttaccaaaggaattaattcaaggtaggctcatttggctagaggcttataagaacaaaatgcctaaatcgtctcccaacatgcatgtgaagcaagaagtatcaacaagagtcaagccaaggctaatgtgcaagcaacaaatggggcaaaacacactgaataaaatagatgatgatggctcaaattctcaccaaggccgatgcccattgtcataccttaatttcgtccggggacctttgcttgatgacatgcgacttttgtttggtccttgtaaggtgcttggcacccatcattag

SEQ ID NO: 49563 - DNA, 1023 bp, Glycine max
  Peptide Sequence Number=SeqID_166341
atggattttgttagccaaaggcacctacttcaattgtcacatgcaacacctccttcttcttcaaataattattccttcttagtaatccttgtcataggaataatgtttacatctttcttccttataggctactacatgttagttgtcaagtgctgcctcaattggtcccatgttgatcatgtaaggattttttctctatctaggcttcatgaagatccatctgcaccatactcaacagcatctgagcctagagggctagaggaagcagtgatcaaattaatcccagtgattcaatacaagccagaggaagggaacacagaatttggtgaaagaagcttaattagtagtgagtgttcagtttgcttgagtgagtttgaacaagatgagaagctgagggttataccaaactgtagccatgtctttcacattgattgcatagatgtttggcttcaaaacaatgctcattgccctctttgtagaagaacagtttccttgacaagccaagtccatcgtcatgttgaccaagtcaaccttcttatcactccaaggccttcccatcagggccaaagccaaaacaatgaaaacctcactgatgaaggaggttttgttgtgattgatttggatggtgaacatgatagagaccaaggaagacaagaagagttaccaacaacatgtcctatcattagtctttcttcaggaattaagttattggaggagaagaaagcaaggaagcttcaaaaagtgactagtttgggagatgagtgtattggtgttagagccaagggtgaaaggttatcagttcaagccatgaagaggtctttctccatggactcatcagtggatagaaagttttatggggcagttcaagaggctttacatcaacaacagcaaaatgggaatgtgtttgaggtcagcacaattgaagcttctggtgaaagtgatagagtcaagagatcattcttttcttttggacatggaagcaaatcaagaagtgctgtactccctgtttatttggacccctga

SEQ ID NO: 49564 - DNA, 192 bp, Glycine max
  Peptide Sequence Number=SeqID_166342
atggtgtctatggatgcatgtagccaaatcacatgtgtgaacaccgaagttgacattccaggtgatgctgctgcgtgtcaagagaacaccaagaagaggggacatgctgattcaagctgccaggtgggatctaaagcttgccgtgagaagttgcggagggagagactcaatgaaaggcatgcatgcttttaa

SEQ ID NO: 49565 - DNA, 345 bp, Glycine max
  Peptide Sequence Number=SeqID_166343
atggaagcaatagacccagcagcaaaaatgaactgtgaaatcctaagaacaagcccaagaacagtgccaggtgtcccagagaaatccttcatctttctcttccaaatcaaatcaatgctcagaaaccctcaaatacctaacaatgaaaacccatcttcagattccagtccaatgcaacaaaaacaaatcaccaaagaaccccaaaaggtgagacttttaacaaccacttcacagccacatcacacacaccacacaaagtcacaagcaaacaggaagataagacacagaaatagagagccagagtggaaaaagaagacaaatcagagattccaagatgaattttga

SEQ ID NO: 49566 - DNA, 267 bp, Glycine max
  Peptide Sequence Number=SeqID_166344
atgtcaggtgtggcagagaaaaatgaacttcgggaagagaaacttgttctgaaagcagataaggaaaggattgagaagcagttgaaggccttacccgttgcaccagcagggtatatgactccacctgtagctgctgctgcatatcaagcaggggttaacaagatggctctttatccaaactatggctacatcccaatgtggcaatatcttcctcaatctgtcagagacacatctcatgatcatgagctcaggcctcctgctgcatag

SEQ ID NO: 49567 - DNA, 675 bp, Glycine max
  Peptide Sequence Number=SeqID_166345
atggagaaaatgagagtgatactaatgactctattcctatacataggtacgttagttgcagaagatgctgatattgacaaagctattaataatgcaagagatgctgatattggtaaggccattaatccaacagaagacgctgatattggtcttcttagcgaacctgaggcctatgagtctcccgtattcaaaaaatacgtgacacagtgcactccgcatgttgctacaacatgcagtattacaagtaggacggacttaaagattgaaagtgaagcaatattgggtctttgtctttttgattctatggagagatgcttggtacagcatgaaataggcaacgttaattatcgattattcaggccaccaagcccaccaccaggacgaggaccaccaattgaaccaatagatccaattcccccatggattccatcaccacccatagttcctaggaccaaactagataaccatcaacatctccaatattatcagacacttctcactgagactacaaaattccgaaccgtcttgagaagatgtactcatgttagtgcacagagttgtctcactgctcctaatgttgcttcatccacacttttagcggcttgtctcattccatccatgaatcaatgcgtgtatcccgctagagctcaatctgcaagctcacctcagatatga

SEQ ID NO: 49568 - DNA, 347 bp, Glycine max
  Peptide Sequence Number=SeqID_166346
ttggacatgaaagttccaccatagagtcattgcaattcaatttgccaacaattgtagcagctacaaacaacttttcatatgagaacaagattggcaaaggaggatttggggaagtttataagggcattcttagcgatgaaagaccaatagcagtaaagaggctctcaagaacttcaaagcaaggtgtagaggagtttaaaaatgaggttttgttgatagccaaacttcaacatagaaatttagtgacatttattggattttgtcttgaagagcaagagaaaatacttatatatgaatacgtgccaaacaagagtctcgactacttcttatttggtttgatcctttag

SEQ ID NO: 49569 - DNA, 945 bp, Glycine max
  Peptide Sequence Number=SeqID_166347
atgtcaagttgcaccaaggttcaacacgcaagaaacgcaagagactgtataggtcttccaagctattctgcaatagagaacaacacatttcacgaagaggtgcccaaagcttggcaaagtcaacgttgtgaaagtaattcaaggaatgcattgctgatatggcatggttacttgttgaaaaagcggcacgagttaatgactcacacgctggcaagaaacaacacgatgtgcacattagagaagagaggacccctcttcgtcctaaccctaaccagcgaattcgacgaccagcaccgcctcaaccccaccctcctatcttccctcctcgctgcgctctccgaagtcaagtcccaagccaccgccggctccgccctcctcaccgccgcgcacggcagattcttctgcaacggcttcgacttccgctgggcccaggccgccggcgaccagccctccgcccgcctccgcctccgccgcatgtccgacgccctccgccccgtcctcgccgcgctcctctccctccccatccccaccgttgccgccgtctccggccacgccgccgctgccggagcaatcttcgccctcgcgcacgactacgtcctcatgcgcgccgaccgcggtgtgatctactttccggaggtggacctgggaatcactcttccagaatacttcgccgccgtcgccggggcgaagatcccggcggcggcgctgcgtgacgttgtgttggccggaaggaaggttagggcggagggggcggtggagatggggatcgtgcactcggcgcacgatagcgcggagggcaccgtggaggctgcgatgcgcctgggggaggagttagcacggagaaagtgggttggggacgcttatgcggaaatcagaaagagtttgtaccctgaagtgtgtgctgctttgggattaacacccaaaaccatcgtttctaagatctga

SEQ ID NO: 49570 - DNA, 1074 bp, Glycine max
  Peptide Sequence Number=SeqID_166348
atggctgattcagatagagaaaaggagctcaaggcttttgatgacacaaaacttggtgtgaaaggacttgttgatgcaggcatcaccaagatacctcgcattttccatcatccaccagataacttcaagaaggcctcagatttaggctataaagattacactattcctgttatagacctcgcaagcattcgtgaagatctgagagaacgcgaaagggttgttgagagaatcaaagaagcatcagagacatggggtttctttcagattgtgaatcatggcatccctgtgagtactcttgaggagatggtagatggggtgctaaggttttttgagcaagatagtgaggtcaagaaggagttttatactcgtgagctaagaccatttttttacactagcaattataacttatatactactgctccaactacttggaaggactctttctactgcaatttggctcctaatgcccctaagccagaagatttgccagcagtatgcagagacatactggtggaatactcaaatgaagtattgaaattggggactttattatttgagttattatcagaagctcttggtctggatccaacttacttaaccaatattggttgcactgaggggctttttgcttttagccactactatcctgcatgtcctgaaccagaattaactatgggaacagcaaagcattctgatatggattttattacagtgctcttacaaggccatattggtggcctccaagtttttcataaggacatgtggattgatttaccccctctaactggggccctagttgttaacatcggtgattttttgcagcttatctcaaatgacaaattcaagagcgctcagcatagagtactggccaatcctataggtccaagggtgtctattgcatgcttttttagcacaggtcttaatccaacttcaaggatttatggtcccatcaaggaacttttatctgaagacaatcctgcaaaatacagagaatttaccgttcctaaatttttagctcaccacagaacaaaatgtctgaatggtacttctccactactgcatttcaggatttga

SEQ ID NO: 49571 - DNA, 570 bp, Glycine max
  Peptide Sequence Number=SeqID_166349
ttgtggggcacctcagcgggtggtaaatgtccaatccgtcgtcaattgctccagaaagacgatctgattacttattcatctgaaagtccattcaagctcgatgttaagaacaatgtgacggagtcttcaaaggtttcaaagctatttgaattcctgcaacgtattttgaacacatcaagtgaaaagagtatcgtcttcagtcaatgggcatcatttttttatctgttggagaattctttgaggaggaaaggaattggttttctgagatatgatgggaagttgactcagaagcagagggagaaagttctggatgaattcaaccagacaagagagaaaagggttatgttgatgtcactaaaagatggtggtgtgggcttgaacttaactgcagcttcaaatgttttcattatggacacggtggaagaccgattgcaacaagttcaagctaggaaacaaaggttgatatctggtaccctcacagatgatgaggttcggactgctagaattcaagatctcaaaatgcttttcacacgagagtttatttatttagaaggtgatttatttgtctag

SEQ ID NO: 49572 - DNA, 958 bp, Glycine max
  Peptide Sequence Number=SeqID_166350
atggaacgtggggttcttgatggtatcatcaataggctgcttcaagtcagagggagacctgggaaacaggttcagctttcagaggcagaaatcaggcaactttgtgcggtttccagagatatctttttgaagcagcccaatctattggaacttgaggccccaattaagatatgcggagacatccatggtcaatattctgaccttctgagactatttgagcatggtggatttcctcctcgctccaactacttattcttaggcgattatgtcgatcgtggaaagcaaagccttgaaactatgtgtcttcttttggcctacaagataaaataccctgagaacttcttccttcttagaggcaaccatgaatgtgcttctgtaaaccgcgtatacggcttctatgacgaatgcaaacgaagattcaatgtcaggctgtggaaaatattcgcagattgcttcaactgcatgcctgtggcagctatcattgaggaaaagattttctgtatgcatggtggactctctcctgaattgcacaatctaagtcagattagtagtttgccgcgtccaacagaagtacctgagagtggtctactatgtgatctcttgtggtctgatcctagtaaagacattgaaggttggggagagaacgaccgtggagtttcatatacttttggtgctagcagggtcacagaatttcttggaaagcatgatctagacttgatttgtagagcacaccaggttgttgaagatggatatgagttttttgccaatagacaacttgtgactatcttttctgcacctaactactgtggagaatttgacaatgctggagcaatgatgagtgttgatgagacactcatgtgctcttttcagatactaaggcctgcggaacacagaaagcctaagtttgcttttgggagcaaaactacattcaaggctagtacttctaacaaaaatcttg

SEQ ID NO: 49573 - DNA, 888 bp, Glycine max
  Peptide Sequence Number=SeqID_166351
atgactattcactcctctattctgcatatggaacaagggtccggagttgatgtgttcttcttgtcacaagccatgacctcatgtgggtccaagcgtgacctttcaggaggaatccaacatcactgcctagcaataacaactggcctcattgccagtgtttatgttggaagttctttgataagtttgtacacaagatatgccttgttgggtgatgcataccgtgtgtttaaagaaatgcctgtgagaaacgtagtttcgtggacaaccattattgctggatttgcgcaagaatggagtcttgacgtgtgcttggagctcttccaacaaatgaggggttctgattcgagaccaaattgtttcacgtacaccagtcttctgagtgcttgtatgggcagtggagtactggggcatgagagatgtgctcattgccaaataattcaaatggactttcactcttacctccacattaataatgctctcgttgccattgagcagggatgttgtcacatggaacaccatgatcatggatatgcacaacatgggcttgcacatgaggcaatcatactctttgaagagatgataaagcgaggtgttaatcctgatactgttactcaccttggtgttttatcctcgtgtcggcatggaggtcttgtcaaagaaggtcaagtttactttaattccatggttgagcatggtgtgcagccagagctagatcattattcttgcattgtagatcttcttggttggcctggtttacttctaggggctcgtgatttcatccaaaatatgcctatttttcccaatgctgtaatatggggttcactgctttctttctctaggcttcatggcaatgttcaaattggcatccaggcagcagagagtaggtag

SEQ ID NO: 49574 - DNA, 582 bp, Glycine max
  Peptide Sequence Number=SeqID_166352
atggcctccggggtgcttatgcctggcaaacaggaatatatcgctaacgatacaaaaagtaatacgtccgaacgctatacatgggatagcgatcaccaaccgcgttatgaagatattctcgccgagcgtatgagagcgtcagaagccccagcagggctggcgttgaatcaggccctggcgccgcctgatttgagtcacggcatgagcgtcggatggaactattcactggccagcggcgtgacctccgggccggtcgccagcttgcgtagcgatctcaatccgccgccagcgacgcgtcgcgcgggcgaaagtatttacgtcaacacgctcggctggcgtatggactatcagcagctgtggggcgtgcatccatgggcgcaggtgagctataaccagtctatctctatcgacaacaatgcgtcgattagccgtggcaaagacggtagctggggcgacgttacgctaggcgccgatatgccgctgggttcgcatctggcggcatgggccacgctttcgcaggcagataaagtgcgaaggggtgaaaatacgctgtatctgatgggggtcagcgccaatttctaa

SEQ ID NO: 49575 - DNA, 360 bp, Glycine max
  Peptide Sequence Number=SeqID_166353
atggatgaaatacacaaggtgcaagagcagattaaggccgacacggaggccttgaaagagaaaatggccacaatagtagaggccatgatgagcataaaggagatagtggaggttagtgcggcttaccaaacccgtgctagagctagagtaatgggtgaagtagagaaggtgcaagagcagatgaaggcagacatggaggccatgaaagagaaaatggccaaaatgatggaggccataataagcatgaaaaagataaaggaagtcgatatggttgcagttgccactaccaacgttgttgctaaggtgaacccgatgcccccatctggcctcaaccaaatgaatcatccaacctcaaatatg

SEQ ID NO: 49576 - DNA, 315 bp, Glycine max
  Peptide Sequence Number=SeqID_166354
atgcctttgcgggataggattgcatcactttacatgaaggaaaggtctaacaggttaaatttgattgttatcaagaagattctccttgaacatcttttgagtgatctgccagagaaagtgatagctaaggagttcctcgatgctctaggaaagaggtaccaagtacctgataacgtcgagtctagatgtctaatgaagcagttaacaaacacaagatatgataatgttaaaggtgtaagggaattcattatgaagatgtttcacatccaaaccaagcttaaatctcaccgaattgaccttaatgaacattcatag

SEQ ID NO: 49577 - DNA, 357 bp, Glycine max
  Peptide Sequence Number=SeqID_166355
atgactcaatcagacatccgagtaaaaagttgttgtcgtttgaatttgctcagagcttcaacattcaatttcgagcgtttcgatatattacgggagtcaatcgaacatccgagtaaaaacttattgtcgtttgaatttgctcagagcttcggtattccatttcgagcatctcgatatattacgggactcaatcagacatccaaagcttcggaattccatttcgagaaactcgatatattacgggactcaatcggacatccgagtaaaaagttattgtcgtttgaatttgctcagagcttcggtattcaatttcgagcttctcgacatattacgggactcaatcagacatccgagtaa

SEQ ID NO: 49578 - DNA, 504 bp, Glycine max
  Peptide Sequence Number=SeqID_166356
atggcacctttcttaagctctttgattgaggattgggtaagagatggactggaagactttgttgaggttagagaaagcccatacatggtagacataagaacccaaaaggaaaagcatgacaagttgaaggagaagggaaggaaagaagtccggtaccgcggcgtccgaaggcggccgtggggcaagtatgcggcggagataagagacccttctaagcaagggtcacggttgtggttggggacttttgagacaggtgaagaggcagctagagcatatgatcatgcagcctttaccatgaggggtcatgttgcaattttgaattttcctaatgagtaccattctcatcatgtcaggggctattctccaaatttagcatcatcatcatcttccattactcatgccggtggtggacaacaaaggcaagtttttgagtttgagtatttggatgataaggtgttggaggagcttcttgagtttgaagaaaacaaggttcagaaaggttga

SEQ ID NO: 49579 - DNA, 603 bp, Glycine max
  Peptide Sequence Number=SeqID_166357
atgctcaaaagaaatactgattcagaaggagcaacattgacagaggccagaccttttgggtcatcagctaaaatccattatggaactgagcatatttcaggtttctttaccctggaccatgtgaaggttagagatttggttgtttatgaccaggattttattgaggcaattagagagcctagcatcacatttttgggagccaaatttgatggcattttggggataggatttcaagtgtataacatgcttaatcaacatgttctcgcacaaccaatattttcattctggttaaatcgtaatactaatgaggaaaaaagcggtgagattgtatttggtggaattgattcagatcattacaagggtgagcacacatatgttccagttactcagaaaggctattggcaagatgccattgctcaaatcaatcatgcaattgaagcagttggtgttatgagccaagaatgcaaggcggtggtgtgtcaatatggaaaaaccatattggataagctgataaatgaggttctctctgtgtctgccgttagggataatatcttggaggttgtcaaagttttaattggtactcttaatttttctttaaaatga

SEQ ID NO: 49580 - DNA, 801 bp, Glycine max
  Peptide Sequence Number=SeqID_166358
atgccggtcaccacggtgcagaagatcaccggggcgatgatcatcttgatcagtttgacgaagccatcgcccagaggtttcatctcggcgccgaggtcaggggagaagtggccaagcaggatacccagcgtgatcgccaggagaaatagcgattttcggacggggaaaagtaccggaaaggtaacgcggcgcttacggcgccgcgcggcaaaactcggcttcgaacgctgcgcgcggcagcggccgggcgaacaggaatccttgcccgctgcgaatgccgtgctgcagcaggcagtcgcgctgctcggcgttttccacgccttcggccatcaccggcaacgccagcacttcggagatcgcactgacgatgcgcaccatcgcatcgtcggccggcagcccctgaatgaagctgcggtcgattttaatcaaatcgatcggcagggatttcaagcggttcaggtattccagactggagtagcccatgccgaagtcgtcaagcgcgatcgacaatcccagatcgtgcaactcgcgcagcagcgccagcgcgcggtcgagatcgtcgatgcgcaccgtctcggtgatctccaacagcagcttgcgcgggtctatccgatactgcgccagcaggtttttcagatgcgggacgaacgcctcatgctgcatctgtataccggaaacgttgaccgccagcggcagcgcaatgccgcgttgctgccaatccgccaggatgcggcaggactcttccagcacccagttgccgagaggcacgatcacgcccagctcttccgcgagcgggataac

SEQ ID NO: 49581 - DNA, 345 bp, Glycine max
  Peptide Sequence Number=SeqID_166359
atggcttatggacatggttttttttaccccctaacaatcttagaagaaataagggctttcaacaaggaactacttggaaaatggaggtgggatatgcttcagcaaagtaacaagttatggtccaagatactgcattccaagtatggtggatggagatcattggtggaaggcagtagaaggaataatgagtcaggttggtggaaagacttaatggaggttacacatgaccaacagatgaattctatcctccaagatggcactacttggagggtgggatgcggggataaaataaaattctgggaggactcatgggctggacacggaaaggctcaaaagataaaataa

SEQ ID NO: 49582 - DNA, 333 bp, Glycine max
  Peptide Sequence Number=SeqID_166360
atgcttcactcaaagattcatcaggaaactgatgatgaagagattacagctttcccttctgcagtcttggactcttggaagtatttctttaggaacttttcaacaacttcttcccagagctacctcttgtcttctcctaccaatgacaatgagaaaatgctgagcctaatagcttcatctgcttgtacttcaggacgtgcaatactggtgaaaaattgtagtactgaatgtagaagcaagtatcgtgatgatgattcaagtagtttcgatgatgacaaaaaatccaaaagaatgatttcaagattaagtcaacaagttcaagatcaagattaa

SEQ ID NO: 49583 - DNA, 519 bp, Glycine max
  Peptide Sequence Number=SeqID_166361
atggatgaaattgtattgtcaagcaatgatttggctgagattcaaagtattacacatctattagacaatgctttcaaaataaaggacttaggtgatttgaagttctttataggttttgaagtagctagaacacctactggcatcaatctgtgtcatagaaactatgctttggacattcccaatgacactgacatgcttagttttaagctagtgtctactccttctaattataccaccaggctgcaccaacatttagacattacatatgttgttcaaaatttgagtcagcttgtggctgaacctacctcagctcatcaagaagctgcatctagaatccctagatacatcaaagggtctccaagtgtagggaatttccttttttctaatagtagcatccacttaaaaggtcttagtgattcagattgggctagctgcattgacactagaaggtctatcattggttatgccatatatcttggtagttcatttatctcatggaagtcaaaggaaacaagctaa

SEQ ID NO: 49584 - DNA, 327 bp, Glycine max
  Peptide Sequence Number=SeqID_166362
atggctatgagcactgcagggtgtgctctctctcttctgtcatctgggagtggaagtagggatcatcataattggctatctcatcatgcggatttctccacaagatgcagtgcagcattgcgtgaattgatagcagaaaatcgtgctgccctaatgactagacaacaacaacaacttgtttatgatcgagtttggcctcatcttgttgtggcgccccaccatgatgcggatgctgcagtggaagaagaagactttgaggacttacaacaacaacaacaacctgagtccaattattttccacaacatatgtttccacagacacaataa

SEQ ID NO: 49585 - DNA, 264 bp, Glycine max
  Peptide Sequence Number=SeqID_166363
atggagctcaagggcacttacgaggactgccactccgtcaacctcatcatggagttatgcggcattggcgagttcttcgaccggatcattgtcaagggctactactccgagtgtgtcgctgccaacctttattgccagatcgtgactgtgatccacgattgccacaccatggaaatcacatctaaactgtgtgaaaatgttcttatgaattctgaaagcaatgtccatggatgcattttaactgggaaatttctttcaccatga

SEQ ID NO: 49586 - DNA, 240 bp, Glycine max
  Peptide Sequence Number=SeqID_166364
atgagtggtgaacaaccacaacaagatcaatcactaaacatacatagcccctactatcttcatctcggagaaaatcctgcaactgcacttgtttctccagtgcttgattcatcgaattacaatttgtggagtcgttcaatgcttactgcattgagtgtgaagaataaagttgagtttgtcgatggttcaattcaaggatatgcatcaaatcatgcacttcacaccctagaagaggtgtaa

SEQ ID NO: 49587 - DNA, 447 bp, Glycine max
  Peptide Sequence Number=SeqID_166365
atggactggacaaggaaaaataacaagttgttgctactacagggaatggttctgatgatttctatgatggacttgggtgctgtcatggctggagggttaactgagattggagatggaagaaatcaaccgagtactagtgaagctactaatgcatattatgttgttggcttgatgggtctggcttatggcaaagctgattctattgcttcagctccaatagggggttttaatgcagctaggaaaggcaggggaaaggacattgaaagtcatgatatgctaagacaaggtttcactcatgttttcttgatggcattcaatgggaaggacgagttcaacgcatttcaaactcacccgtatgaccttgagtttactggagtattttcacctgctattaagaagattgtggtgctggatttcccatctaaccttgtgaaagcactagcatga

SEQ ID NO: 49588 - DNA, 313 bp, Glycine max
  Peptide Sequence Number=SeqID_166366
gctagcagctggtgtctcgctaaacgaggcttgttcccttagcgagaatcatgcgctaagcgaggcactcagcccgcttagtgagttgggagaatctggaggaaattctgataagcatctgtgcgctcaacgcatcatcagcttgctcagcgaggcatttgtcttttcccgcgctaagcttggaaaaatcaagcattattcatctggggaggctaattcagagtgtagagagcagaacagaggcaaaaaccagaacaaggaagccaaaaacctcagctttcaagaggatcttaggtttaggagtaatttccag

SEQ ID NO: 49589 - DNA, 444 bp, Glycine max
  Peptide Sequence Number=SeqID_166367
atgtggcatgataggagatcattccatggcgatggacaatcctccttatttttcacaaactttcctgaaacatttaaggttaaagaaatgtgggataattttaggaactgtaggcagatatctgagataagatcttcattcatggcaaaaaaaatcatagtgaacttgcctaggctttctagaggaagttggaaagaacaaagaccaatcataggtgataagaggggcaaagccgggaagaaaccagttataaaaggtagtggtgcaaacttggttcaaaaggatgtttcatatgctagtgtcacaaggaaggttgtcccgaatgaagttataaaaaacaagggacatttgaatgaaggaaaatttttcaacatgtccttcacacctaatcaaaaggaattacagaggttacaacaggctttcattggatgggtcttacgctag

SEQ ID NO: 49590 - DNA, 207 bp, Glycine max
  Peptide Sequence Number=SeqID_166368
atggaacttgttagagtcagagagaagatgaaaatggtgaaaatgaaattgaaggatgggtcaagactagagtttgggaaactggatgaaagtattaggttcaaggttggaagccctgttgcgaaaaagtgtggggagtggagagcaaacactcttctgggaggattcttaggtggaggagagatcactaaagcaaacctttcctag

SEQ ID NO: 49591 - DNA, 414 bp, Glycine max
  misc_feature (400)..(400): n is a, c, g, or t
  Peptide Sequence Number=SeqID_166369
atggacatggacctgggcaacatgatctcttctcaaattactcacattgctcagtccaattcttcgaggttgggcttccttgccttgatgacgaccctctgtgatgccaaggggagggttagggctggggccgctccagatgctccactggttgtccctcctccactctccgccccactttctcttgtctctactcagcccgagcagctccccccatgttatagagtctccataaggtcgcttggccaagggtccagccttcctctgctcggggagggaggtgacacctctggagttggagctgatgctgatgtcagtgatgatgatgttgcagatggtggtgatgacgaggaccatgttgtagatgttacagctgcccagggagtttgggacccttggnccactcaggattga

SEQ ID NO: 49592 - DNA, 336 bp, Glycine max
  Peptide Sequence Number=SeqID_166370
atggcgaaagatcgtccaaagaggatgacgttgggggatttctctagctttgctacacctcagtacttcaccagcatagctagactggatgttcaagtggccaacatcatatatccacattccttcatccagttgatccaggggaatctattccatggcctactgagtgaagatcggaatagcctatggacatgggaaaaggtggtggagaagttcctaaaaaagtacttcccggagtccaaaacagctgaggggaaggtggaaatctcatccttccaccaacaccctgacgaatcactgagtgaagcactagatcacttccatgggttgctctaa

SEQ ID NO: 49593 - DNA, 1281 bp, Glycine max
  Peptide Sequence Number=SeqID_166371
atgactcttcaactagcagactgctctatcgccgagctagatggtttagttgaagacgtcctggttaaggttcgcttgttcaattttcctgtagattttgtgatcatggacatagaggaggacttagatattcccttgatcttgggtcatccattcatgcttacggccaaatgtgttgtggacatggggaatgttgagcaagaagctgaccttgctatgcagcgcttgaccattcattcaccattggaaaaggctttaatgaatgctattgattgcctgaccaatgaggaggagaaagatcttagggcttgggaatatgcctttcaagaattgaagaaagataatgtagtagagaagcctaaagtagaattaaaggtttttcccgctcacttggagtatgtttttatcgaggaaaatgatgctaagcttgtaatgatcagtattgatttaacatcagatgaagaggcacgattagtagaggtgcttagaaagtataaggcaaccattgtgaggcaaccgcagaggagacttaatccatccatgaaggaagagaaaggcgatatgattgtggtccggaatgacaaaaatgacctaatccctacacgaaccatcacgggatggagaatgtgcatagattaccgcatgctcaatgatgccacaaggaatgatcacttccctttgccattccttaaccagttgttagagcagctaactagacatgctttctattatttcttggatggttatttggggtataatgagattgcagtggaccccgaggaacaagaaaatactgattttacacgcccttttggtatctttgcctatagaaagatgccatttgggttatgtaattccccagccaccttccagaggtgtatgctagccatttttgctgatatggtagagaaatgcatcgaagtgttcatggatgattttgtagtcttcggtccttcctttgactattgcctcaccaatctagaatcggtgctgcagcattgtgtagagactaatctgatgctaaagtgggagaaatgtcatttcatggtccatgaagggatagttttgggccataagatctcagctagagggattgaaatagacagagctaaaattgatgttattgagaagttgcctccaccagttaatgtaaagggcattcggggtttccttggacatgtcggcttttatcggcttaaatttgatgaagagtacctgacaacctttcagactctaaaggaaaggcttgtgtacgctcctgtaatagtggcccctgattag

SEQ ID NO: 49594 - DNA, 177 bp, Glycine max
  Peptide Sequence Number=SeqID_166372
atggctaaagaaggagggtttccccttagggataagctcaagctctctaagactcggtgtgtctttcccttctacttcatcttccttatagaggctccatcgactttgggcttcaatgtgggctttcttcgtgttaagcctggagtgcacgctaagcctggattgcacgctgagtga

SEQ ID NO: 49595 - DNA, 210 bp, Glycine max
  Peptide Sequence Number=SeqID_166373
atgagctcaactggtcctttgtgtgttgactcggaagttgagaggacaactaggagaaacaacagtttgacaaggaagaccaaaacactagagatgctagctagacaagagcctaattcacctatttcaccaaatcttcctctaccatctattcaggaggaagaacacaccatggtggaagaagagccaggacatcaaccaccaagatga

SEQ ID NO: 49596 - DNA, 1263 bp, Glycine max
  Peptide Sequence Number=SeqID_166374
atggcaatcctccctacaacaatgcttttaatcaaggttggaggaacaacaaaaaccatggttggaagcaagatgtcgattcctccaatagactatcaccttatggatagtctcaatcaattcgtgcaaatctttatcactagccaaaacaatatagatgcttctatcaagaaactagagatacaactgggacaagttgctaaggatgtggttgaacttaaaaatgtagtattttcggccaatacacaaaccaacccaaaggagcattgtaatttcatcactacaaggaggggtacattggtaggtgacttaaatagagagaaaaatgagcaagaggttatagttgaggaagttaaagatgacgaggaaggcagcttcaccattccaataactattggagatctcaaggcggggagatatttacttgaccttggagctagcattaatgttatgccttgctcttacttggcaaagaatgtggataaattcattttccctgccgattttgtagtgatggacatgaaggaagacttagaggtgccacttattttgggaagagccttcatgaatatagctaggattttggttaatgttcatgatggccaaataaagctaggggtgtgtgatgaagagatcacattcaatgtgtttgaatctttgaatcaactaaaagatgaagaaccttgttctcgggtggatgtgcttgatgaagttattgtggacactaagaagcaattgcataactcttctcctcttgagaaggttcttattgacgcatttgaagatctcaataatgaagaagaaaatgagattgaacaatgcctgtcaagtcttgatggtttgaaagagattcctccacataaggtaaatatgaaagaaatgaaggtggagaacaagatagagaaagtcaagaatgagctttctatgctttctcctagtcttaagtgtgtctccttcaaagaggatgttcaaaaacaagttgtcatgagcaattctttgtcaaaagtgaagaaaaggagattgaagttcttggatctaagtagaatgaggttgcctgtatataagtctttcagattctacaactcaattgctaagaaactcaaatccaaattttccaaacacttcacaatacaaaatgctaaaccttatggagttgtggaacttgaagaacctaattgggtggttaatggccaaaggctcaagctatatttgggtggtgaagttgaagaacttacgaccattgtgcttctcaatgacccttga

SEQ ID NO: 49597 - DNA, 333 bp, Glycine max
  Peptide Sequence Number=SeqID_166375
atgcagggtgataatgatgctaactctaaaaagcaatttgacccctgctcaaaggaaatgaataaagagactaatgtggagccaggggatgtttcaaataagaaggatgacatgtgccctactaatgtggagcatgaacatgctgagcaaagggatgttccaaatgaaaaagatgacatggagtgtacaacaaacttgaatatccatgctagtgataataatgtgagacgattgccaatgatgataaacaacaattttgccagtaaagacaaccaaatgacaaaattatgggactactacaccaaatacaaacgatttaataaggaccagtaa

SEQ ID NO: 49598 - DNA, 363 bp, Glycine max
  Peptide Sequence Number=SeqID_166376
atggcgctctccgcggtcacggcgacgttgacttcggtcattttcgcactcggcgttggcgcacatccgacgtacgttcagtgcgatcgcacgacgcgtacttcgagtggggcaaccggaagtgacgtcgcccagcgctcgcgcatcatgggcatgaccgtgcagactcgcctcgtacaatgcgagtacgacggtgacgctgacgctgacggggctcggtacgggggcgttcctgcacgcaacggctgggacgttgagtggactgagctcgccgtggagttcggcaccatgcgtggcggcgtcactgcacacaaaatcgtcgagtgggtcgtcttacgtagcgagttggatggcgccaagtga

SEQ ID NO: 49599 - DNA, 576 bp, Glycine max
  Peptide Sequence Number=SeqID_166377
atgtcaacatgcggcgcatgcaagtaccaacggcgaaggtgctattcggatatttgcatgttcgcaccatactttccagcggagaacatccagcggttcgcgtgcgtgcaccatgtgtttggcggtggcaacgtaggaagcatgctcaacatcacaaagccaaagttgcgggggtgggtggtgaagacgttggcataccaggcagaggcacgtgtgagggaccctgtgcatgggtgcgtgggcctcatacgggagttggaagagaatcatcgcaaggtgaaagaggaccttgccaaggcccaaatggagctggcccgatacatgggcccggagtttgtgagaaagctgagtcccaattatggtggtgagtcttctttgaagggtaagtttgtggcacatttgcagccgacaacaatggagcttgactttgctccctctattgccattgatgttgatgatcttgataagtgggacccttttccaccatgggaaactagttttcagaatgttggtccttcttcttcacatgcacatggtgaaggtgggaataggaagggtaagggtgttgctccttaa

SEQ ID NO: 49600 - DNA, 405 bp, Glycine max
  Peptide Sequence Number=SeqID_166378
atgaggaggaggacatggaggaaggaattggaatatcctgaggcttggagtgtcgttggcttctactcgaagaacctttgcgcttctttgatgctactttggttggttctattgtggtcgtcgcctaccgtggtgacacctttgctgagtgccagtgtggcaacaactggtgctcatacgatgttgcctccttcctcgtcggcttcgatgctttctccctttactgttttggtggccgtggaatcgccttctacgtcctctcgccctcgcgtctccctttatcacttgtacacctctagtgatgctgactcattgtgggatgcaacttataagctggagcagaagaccttggttgactttgtgtcagcctttgacaagaatcttattaggtcaactggggtgtag

SEQ ID NO: 49601 - DNA, 132 bp, Glycine max
  Peptide Sequence Number=SeqID_166379
atggatcgccctaaggtggccaatgccactgttgcttttgttgaggccgtaaggtcaaatcgccaattatcttccaaagttagtggtagagaagaaggacctaggcggctaggtggagagtgtggcggttga

SEQ ID NO: 49602 - DNA, 966 bp, Glycine max
  Peptide Sequence Number=SeqID_166380
atgtcaggcatcgacttgaaccgtgcgggtactccgttgctggaaattgtgaccgagccggatatgcgtagcgcggctgaagccgtggcctacgccaaaaaactgcatgaactggtgcaatggataggtatttgtgacggtaatatgcaggaaggtagtttccgttgtgatgtaaacgtgtcggtgcgcccaaaaggcagcgagaagtttggtacacgccgcgaaatcaaaaacctgaactccttcaagttcatgcagcaggcgattgagtacgagacccaatggcaaatcgagacattggaagacggtggcaccattcagcaagcgactgtcttgttcaatccagataccggtgaaacccgcgccatgcgtactaaggaggaggctaacgattaccgttacttccccgacccagacttgttgccactagaagtcacagaagcggacaaagcgcgcgtcagggcagcaatgcctgagctgccgcaagcgctgcaggcgcgttttatcagtgattaccagctctcaagttacgatgccagcacgctgacggcatcacgcagcttggcagattatttcgtggccgtggtcaatgctggcgcagagcctaagcaggcagcgaactggatcatgggtgccttatccgccaaactgaatgcggaagaaaaaacaattactcagagcccggtgactgccacccaactggctgctttacttaaacggattacggataacaccatttctaacaacgcggccaagcagccaaaggcctcaagcaggtgtcggatacgggcgccatttgaagcgattattaatgaagtgctggccgctaaccaggccatggtggatgagtataaagctggtaaggagaaagcttttaatgcgctggtgggccagtgcatgaaagctttccaaaggcaaggccaacccagcgcaagtcaacgagctgttgaaaaaggcactgggtag

SEQ ID NO: 49603 - DNA, 312 bp, Glycine max
  Peptide Sequence Number=SeqID_166381
atgggtaaagcggaggaggtacaagagaagatgaaggccgacatggaggccatgaaagagcaaatggacacaatgattgaggccatgatgagcataaagaagataatggaagtcaatgcggttgcagttgccactatcaatgttgttgctaaggtgaacccaatgccccccatctggccttatccaaatgaatcatccaacctcagatatgaaatgggaaagttggatcatctagaggaaaggctcaaggacattgaaggaggcgaaaggacaccaactaaggaaagaatttcgcagcgaaaaagcctgtag

SEQ ID NO: 49604 - DNA, 963 bp, Glycine max
  Peptide Sequence Number=SeqID_166382
atggcgcaattacctccaaagatcccaaacatgtcaccaagttggccagatttctcttcacaccaacagaagatgcaattgccacctcttaataacaacggcaccatcaccaacaactatcatcagcacaatcagaacccttcttgggtggatgagtttctcgacttctcctcggcccggcgcggcgttcaccggcggtcggtgagcgattccatcacctacttggattcaccagtgaagtgtggagggaataaaaacaacaacaacaatgagaacgagtttgacaagtttgatgatgaacaattcatgtccatgttcacggatgaagtagtgctctctggggtccccttgccaccaccaaccaccttgtcctcctctaacccttcaagcccttacgatcagaacttcatcaatgatgagaaggagaagaaggaggaggaagaggagcaccaccaccaccaccaattgaaaaatgaagcagatgaggttgaaagccaatgcaaacaggaaattatgcagcttccaaatgacaccaatacttgttcttccagcgagagaattactgaccccaagagagtcaaaagaatcttggctaatagacaatctgcacaaagatcgcgagtgaggaagctgcaatacatatcagagcttgagcgaagtgtaacttcattacaggccgaagtttcagtgctgtctccaagggttgcatttttagatcatcaacgattgcttctaaatgtcgacaacagtgctctcaagcaaagaatcgctgcccttgctcaagacaagatctttaaagatgctcatcaagaggcactgaagagggagatagagagactaaggcaagtttatcaccaacaaagcctcaagaagatggaaaatgctgcaggatcaccattaccatcaccaaagcctatatgcgatgctcaaacagaaaaggaagcaacacttctcaacgcttga

SEQ ID NO: 49605 - DNA, 1092 bp, Glycine max
  Peptide Sequence Number=SeqID_166383
atgacttccgcatgcaataagaatcccaagcccattgcggttcgtttctttaaaaacatcttcagagcaagtcttgcacatggattactttctttgcagaagctcccaacaattttcactaaaaaatacggagatggaatgtcaaaccctgtgtctctaaagtccccagatagtactagatggaaaatatattggaccaagcatgatggtgagatttggtttcaaaagggttggaaggagtatgccacatactatggtctagatcatggtcacctgctgttctttgaatatgagggaacttctcattttaatgtgcacatattcgacaccagtgccgttgaaatagactatccttccaatggtactcatcatggaaaggacagcagccatgtcgagattagcgacgatcctgttgaaattttggatgagaaattttcatgccaaaagactagagagaaatccacagtgtcttctcctcaacctaccaagaaaatgaaggctggactaactacaaatgttaaaaaaaggcccaatgtggtgaacttgcatcggcatgtccaaattagaagcattaaatctcaaaaggcaaaatttgtcaagcatgaattagatgaagatgaaagtagaggcatttttcacactgaacggccaaaaggggagcaattaacttctacagctttaaacagagccacagctttcagatctgaaaatccctctttcaagcttgtcatgaatccatcctttatttatggagactacctggaaataccacctgaatttgcagaaatatatttgaagaagacacatgcagttgtcatccttgaggtcttggaagggagaacatggcctgttatttgttctgctcctacaattactgggggatggcacaaatttgcatctgaaaatcatttgaatgtgggggacgtttgtgtttttgaactgatccagaagatccagggccttgccttcaaggtttccatctttcgaggtgcagaagaaccaagttgccccatttcacaagcaagtgccgatggattctgtgaggaagtattttgtaaagatgaactggaatgtggtgatgttacagtttag

SEQ ID NO: 49606 - DNA, 387 bp, Glycine max
  Peptide Sequence Number=SeqID_166384
atggagaaggaagagaacgaaccccacgttcagaaaagtggcggcgaaagcgaagacgctgaacccatagagctcgttctctttcaagtgcccgagtgttacgtctacataatacctccaagaaagagtgcagcttcttacagggctgatgaatgggatgtcaacaaatgggcatgggaagggatattaaaagtcactagcaagggagaagaatgcatcataaaacttgaagataagagcacaggtgaattatatgctcgggcatttttaagaaatggagaaccgcatcctgtggaacctgttattgacagcagcaggtggttttccttgactgttgatagtttaagttgtttgttatcatacttttttgtagttcaggatgcttaa

SEQ ID NO: 49607 - DNA, 1122 bp, Glycine max
  Peptide Sequence Number=SeqID_166385
atggatgcaaaaggcataacttgggttggaaacatattccagaagtttgaggacatttatgtggacgtggaagacacaatgttggagttgtttgaacttaatcccatactttctgtttcccttttttggggatatgaaaccgttaagtacatagggaatcagatgcagactgttggggaaagtgttaaaaagatctattcagatgtcatgcaagatttacttcctccgcctttatatgatttggatgaaacatcagcctctgagttgccaatagatcaatatattgacgctggattctctaataagtcatttcaaggttccaagaaaataactgtaaaggatgataccaaccaaacaactgaggattcaaggatcaaacatgatgttgataatgatgtaatccatgctaaatccggtgattctgatgctttgttcacatcagcttcttgcaactctgtcaaagggaatagttttatttcacatgcaagacaatacgttggtagcacagatattagatcaaacctcggtggtgatgaaaatcgacaaaataaaagcatacctgcttccaagacagtcagtgaaatcactttgtcaaaagcagatacatgcagtacatcacaatcatgtgaactctcccgggtaaatcaaaatcatgcagccactgtttcaaaggcagcttttgctgaagtaactaccattacctctgtagatgactgttgcaatgaaattgaaaatgcaagtactgaagaaatccccaatgtgctggtattggcagctgaatcagccgaagagaaagagatgcatgttagttcatattcctccagtgacctatttggagatccatatggggtcactatggtcggaacatttgagcctgacaattattcttaccccacaaccattgcatctcatccagaaacatgggatttggatgtaccaaagattggtactattattgtagagcaaggccataaaaccatacagcaagatgatgaactgaagcttgaggaaacttgtgttatggtgactagagatgaacttgaatcagttgccattgcactggaacaagaagaggcaacccttttctttgtccaagaaggctgcaaggaggcaagagtatga

SEQ ID NO: 49608 - DNA, 288 bp, Glycine max
  Peptide Sequence Number=SeqID_166386
atggacaaaagtttcacaaaagaaaatcacgttcaaatggtgggtcctgacaaggtcacgaatcatctaaattgcattcgggtttgccctgacaattccaactcaagaaactcattgtccttggtggtccgttgcggcagggccaccattaaaaaagagcttggtgaagcaggttggaatggggaagaaaggctgtgccttttgcttttaaacatgggagctttcttctgtgttggtttgaaagttaaatctgatgcagttgcttggggcacccagcaacgtgggtga

SEQ ID NO: 49609 - DNA, 354 bp, Glycine max
  Peptide Sequence Number=SeqID_166387
atggaagcctttgccccacataggattagtgatggttttcaagtgagttgtggtgtaattggaaatgggtatggttcatcttcgtctctagtgttggataaggagaagggagagcttgtggaggcccctgtcaaattggaacgcaagggtgtttctcctgagagaagcattgaagccttgaagaaccatagtgaggcagagaggagaaggagagcaagaattaatgcacatcttgatacacttcgctctgtcattccagtttatttttgtcctattcaagtgatcgttgtttggcctgtcaggccacccgttattagattactcacggctctaatcctgcaacttcatgcttga

SEQ ID NO: 49610 - DNA, 585 bp, Glycine max
  Peptide Sequence Number=SeqID_166388
gttgaattggagctttcaaacatctgtaatgatgttatgacagtgattgatgagcaccttatcccttcggctgcagctggtgaatccactgtgttttactataagatgaaaggagattattatcgttatcttgccgaatttaaggcaggcaatgagaagaaggaagctgctgatcagtctatgaaagcatatgagtctgctaccactgcagcagaggctgatttacctccaacacatcccatccgattgggtctagctttaaatttctcagttttctattacgagatcttgaactctccagaaagagcctgtcatcttgcaaaacaagcttttgatgaagctatttctgagcttgacaccttgaatgaggagtcatacaaagacagcaccttaatcatgcaacttctcagggacaacctaactttgtggacttctgacatcccagaagatggagaagatgcccagaaagtgaatggcactgccaagcttggtggagtgagtccgattgttgatgggatcttccttaggattcgatgcatgcgtttgggaatgaaacatgagggccgttacttatccgtgtattag

SEQ ID NO: 49611 - DNA, 1314 bp, Glycine max
  Peptide Sequence Number=SeqID_166389
atgagttgctgctgtgagttcaacggctgtaatcaaggagccaaggttttggctgtcatttttgacttggatggcacccttttggacacagaaagggcaacaaggggtgtgttgaatgagtttttggcaaggtatgggaaagaacttgatagggagaaggaagagaagaagaggttggggatgacacaaaaggattcagcagctataattgttaaggactatgaacttccattgacacctgatcaatttatcaaagaaatcactcctctctacagggaaaggtgggcaaaggccaaagcattacctggtgctaatcgccttatcaaacatctccagaaaaatggagtgccaatggctcttgcctcaaattccttgcaagaaaacatagaagcaaaaatttatcatcacaaaggttggaaagaaagcttttctgtgattctaggaagtgaccaggttaaatctgggaagccttctccatatttatttgaagaagctgccaagaaaatgggtgtagatgcagttaattgcctggtgattgaggattccttttggcaagataattcaaaccagagagtgatcacagatgaaaaggccactgtaccaccagtgatgaagcctataatcaaagtataccatgaaccaaccatttgttcatatccaaatctagaagcatacacagatatatgtggatggctgttgagtgcaaaaggatatgtgacagcatctgctgccaagtttgctatgcacattttgtgcagtcatgtgaatttctgtcatgcagccaatgctgcaaaaatgaaggtagtggctgtcccatctcgaagggaagctgattgtaacgggctagcaaatgctgttcttcattcactattagagtttcaacctgagctatggggtcttccaccttttgatgactggatagatgacacattacctattgacccattacatctgagtggtttgtatgtcactggatgtctacaggaagccacagagaatgcaacacttgcccttcctgatcaagctgttgggctttacttcggttggaccaaggttgatacagatgagaaccttaagatattggtcagcattaatattgacttctcctgtgttggctacaaaaaaatacatgtttatcttattgatgcaaacagtgaacttaaacataagcagatgatgcaaatccatcttgttggctacataagagcgtgggataacaaggaactcacgtcaactgaattggagaaactcgatgaatacaagtctattgccagagcttcactggatttgccatcattcacttgttgtttatag

SEQ ID NO: 49612 - DNA, 411 bp, Glycine max
  Peptide Sequence Number=SeqID_166390
atggcagaaaaggaaggaggagttgtgaagaaggggcacgaggaaggcctaaaactcgcggcttcgctgctgcaagagttcgagctcccggaggggcttctccctctcgctgatgtcgtcgaagtagggtacgtgaagggcacagggtacatgtggatagtgcagaagaagaaggtggagcatgagttcaagatgataagcaagttggtgagctatgacactgagataaaagggtatgtttctaagaagaagataaagaagctgaagggtgtgaaggccaaagagctcatgctgtggcctcctgtgagtgagatcactgtggatgacgctccaactgggaagattcacttcaagagttttgctggtatcaccaagactttccctgttgaggcatttgctgctggccagtaa

SEQ ID NO: 49613 - DNA, 1761 bp, Glycine max
  Peptide Sequence Number=SeqID_166391
atgtccaatactctgcagcaacatcaacagtgtcccgaatcgaagcgtctcgatccgggttccaacgctcgccggcctggacaccggagatcggtatccgccggagctccgttaatctactccggcggagccaccttactcccaagcgggaacatttgtccgtccgggaagatcctcaaaccgggcttgccctcgcgcgggtcgaaccggactgatgtgttgggctccggcaccgtgaactacggccggggcagcatagtgcgaggcgtctcgggcaatattccggtgcccgtgggcgcactgccgcctacggtgaagcgcgcgctcagcggctccgatcccgaggagttgaagagggctgggaatgagttgtatagaggcgggaactttgcggaggcgctggcattgtacgatcgcgccgtcgccatctcgccgggaaacgccgcatgccgaagcaaccgcgcggcggcgcttacggcgctcgggaggctcgccgaggccgcgagggagtgcctcgaggcggtgaagctggaccttgcttatgccagagcgcacaagagacttgcttctctttatctaaggtttggacaggttgagaattcgcggcagcacctgtgtctctctggggttcaagaggataagtctgaggagcagaagctggtgttgttggagaagcatttgaatcggtgcgctgatgcgcggaaagttggtgactggaagagggtgcttagggaatctgaggctgccattgctgttggagcagatttttcgcctcagattgttgcttgcaaggtggaagcctatttaaaactgcatcaacttgaagatgctgaatcaagtctctcaaatgttccgaagttggaaggttgtcctccagagtgctctcagaccaagttctttggtatggttggtgaagcctatgttccttttgtgtgtgcacaggttgagatggccttggggaggtttgagaatgctgttgcggctgcagaaaaggctagcatgttagattgcagtaatgttgaagttggtaggattgtaaatgttgtgaaaatggttgcaagagctcgttcaaggggcaatgaacttttcagctctgacaagttttctgaagcttgttctgcttatggggagggccttaagtatgacaactccaactatgttctatactgcaatagggcaatttgttggtctaaacttggactatgggaacaatcggttcaagactgcagccaagctcttaacattcaaccaaattacaccaaggcccttttccgcagggctgcgtcaaacacaaagcttgaaagatgggtagaagttgttaaagattacaaggccttaaaacgtgaactgcctaacgacaatgaagttgccgagtctcttcgacaggctcaactagcattagaaaaatctcgacaaatggtatatggtactaagtttggagttgaagttgaacaaatctgtgcattagataaatttaaagctgcattagcctctgcaggtgtatcggtagtatatttcaaagaggcatcaaacgaactatgtgaggaattatctccattcataaatacattgtgtgttagatatccctcggtgaaatttatcaaggtggacgtggaggagtgtctagcaatagcaaaagctgaaagcataagaagtgttccaacctttaaaatttacaaaaatggagagaaggtgaatgacattatccggccaacccatcaattattagaggactcagtaagaaaaagtagtagtctctag

SEQ ID NO: 49614 - DNA, 387 bp, Glycine max
  Peptide Sequence Number=SeqID_166392
atgtcccataaggaagaaggtgatttggttgaggaaggtgcaagtgaaaacatcttttttgtcgatcttggagttgtcgaagaggatggggaaggttttcacgtcgaggagaacgataacatttgggttgggggcgaggaaggggccaggacttgcagaactcgtcacggccctggttgtagaaatagtcttgttaggaccgatcagcgggaagccgcagtcgccgggaattttgtggattgggctcaagggagggtaattctagtcgaaggaagggagaggagagcgtggtggaggctgaggatgccatttttggggaataatgatgatggaatggaaagggagaggggtattggtattatatatataccactaagtgatcactga

SEQ ID NO: 49615 - DNA, 675 bp, Glycine max
  Peptide Sequence Number=SeqID_166393
atgatgatttatttatgttctcgcaagtgtctactccgaagtaactgctggaaaaagaaagcatcatctgcaataccaaagacaacaacgacactacccatcactaacaaagacaaattacaatgggacacgtggagcccactcactggttggaaatcaaagttcagtctctaccttcacgcacttaatcatatccctggagtcaagttcgagcatcgaaaggaccaaaaaggaaaaacagagaaaaaggaagggacacatttgacatttcacgaccgcgttcttttctacggagcctcgaccaagaagaatcgcagagagaagagggtcagagtgagaaagagagagagagagagagaaactgagagaaattcgcaaaccctaatttcggaaagatcggcgatggctgcctccaaggatcgcgagaacttcgtctacatcgccaagctcgccgaacaggccgagcgatacgaagagatggtggaatcaatgaagaacgttgcgaatctcgacgttgaactgactgtggaggagcggaatttactttctgttgggtacaagaatgtgattggtgctcggagagcatcgtggaggatcctgtcttccattgagcaaaaggaagaaacaaaagggaacgagttgaatgcgaagcggattaaggagtacaggcagaag

SEQ ID NO: 49616 - DNA, 429 bp, Glycine max
  Peptide Sequence Number=SeqID_166394
atgacgatcatagaaatgagagtacacatggattgccctggatgtgaaaacaaagtgaaaagtgcactacaaaaacttaaaggcgtggatgacattgaaatagacatgagtttgcaaaaggtgactgtgaatggctatgctgaccaaaagaaggttctgaaaacggttcgaaaaactggccgtagggctgaactctggcaacttccttacacaacggattctcagaaccaatatgttcaacagcaccattgcaatggccctatcaactattatgcttctcaaacttcctcatcttataactattacaaacatggttatgatagcagtgatcctcgctattataactacccctcacaatcttccatctttggctatcaaactggtgccacttttagtgatgacaatcctcacgcttgtgccatcatgtga

SEQ ID NO: 49617 - DNA, 208 bp, Glycine max
  Peptide Sequence Number=SeqID_166395
atgggttttggttttggtttgggttatggggtttatgaggactttgttgttgtcgttgttggctttggctccgtgtggagtgaaaaaatgggcaaagtctacgtttcgttggcggctccactagcgcctctccgtcgtgccgctgtcgccgtcaacgctcactctagcaggtcgtctctcagtgctgaggatcttgaatgcactcaag

SEQ ID NO: 49618 - DNA, 171 bp, Glycine max
  Peptide Sequence Number=SeqID_166396
atgtctccaactcatcaagaggcactgaagagggagatagagagacttaggcaagtttattaccaacaaagcctcaagaagatggaaaatgctgctgggtcaccattaccatcaccaaagcctatatgtgatgctcaaacagaaaaggaagcacaacttctcaacgcttga

SEQ ID NO: 49619 - DNA, 549 bp, Glycine max
  Peptide Sequence Number=SeqID_166397
atggatgtcatgaggttcaagtatggtattggtataagtttggctattgcttggaaagccaggatgattgctaaagcaatattggatggggatgctatcagacaatactcttatctagaagcttatggtgaagagctcaagcgtggaattgaaacacctaacaaaaaagtcaagaggtttgaaagatcaacacttgttgcacgaataacccctactagaattgacagtgtgaaaaagttgtcaaaactaacaaaaggtcaatctataaatgatgtcattcaaaggaaaagattacaatcaacaagattgactaaattgaatgagaggttggcttttccaaaacaagcaacatctaatgttgttgctagtcttgacaaggttgtttctaatttgattgaacccttctctttgatagatacaagggttagggacaaggccgaagttgttagaccatcaacaatagtgacaagaagcaaagtcaaaagaaggaataatctgtctgaagttaataaccttcatgttgggcagcaaggaacacctaagaagtag

SEQ ID NO: 49620 - DNA, 234 bp, Glycine max
  Peptide Sequence Number=SeqID_166398
atgttgaaaccacttcagtttcaggctaaaagaagagaaggtcaagcaactggtgtctcgctaagcgaggcactcaactcgcttagcgtgatgagaaaccctaaaagaggatcagccagagatgtgctcgctcatcgtactacaagctcacccagtgagtcatttgtctcttctcgcgctcagctctctaagccgaatttcactaacttgcgcttagcaagtcaatctcgctaa

SEQ ID NO: 49621 - DNA, 507 bp, Glycine max
  Peptide Sequence Number=SeqID_166399
atggaggaatttattggtatcactttttcttcttcctctgaacagtggggacagttaaagaggcctgatcatgctgacctgcggtacaagtgcaggacatatgcacgtcttctgcaacatttgaaggcccgtgagtttgcaaatgaacttcgtgctagtactaaagcatctagaaatccaactgtttggcttgaaggttccacaggttctggtcagaatgtaaatgctactgacacttcgacagtctctgatgcttatgcaaagatgcttacaatttttatcccacttctggtggatgagagttctttttttgcacacttcatgtgctttgaagttcctacacttgttcctccaggaggtgttgttaatggcaacaaagctggatatgatgatgatgatgatttgggaattatggacattgatgagaatgacagcaaatctggtaaaaattctgcggagcttgaagctttgaataaatcacttaaggatttacttgatggaatacaa

SEQ ID NO: 49622 - DNA, 339 bp, Glycine max
  Peptide Sequence Number=SeqID_166400
atgatggaatctcatgcaagcaaaattgaagtagtggcgagtataggaattcaaaaacccagagaggcatcgccaaatcatgcacggggctcaatgcaacgcaagacctcacacaaaacaattccaaacattacactgcagaaaacaaagaaaatggtgaaggagttgcagagttctccaaacccaaatgcaacaaacaaaaacttcagtgcctccaatactcttatcattcctgttagaaaaataaacaataactctgacactacccattactttaatctgtcaaattcgaccaacatgctagcatatagccagtccagaacaaacacaagagaataa

SEQ ID NO: 49623 - DNA, 900 bp, Glycine max
  Peptide Sequence Number=SeqID_166401
atggctcgtaacgaggagaaggcccagtcgatgctcaaccgcttcatcacgatgaaggcggaggagaagaagaagccgaaggagcgccgccccttcctcgcctcagagtgccgcgacctctcggaggccgacaagtggcggcagcagatcatgcgggagatcggccggaaagttgccgagatccagaacgagggtctcggcgagcaccgcctccgcgatctcaacgacgagatcaacaagctcatccgcgaaaaatcccactgggaacgccgcatcgtggagctcggcgggccgaattactcgaagcactccgcgaagatgacggacctcgatggaaacatcgtcgacgtcccgaacccgggtggccgtggcccgggataccgctacttcggggctgccaagaagctccccggcgtcaaggagctcttcgaaaaaccccccgagcttcgaaggcggcgtactcgatatgatatttataagagaattgatgcgagttattatggttaccgtgatgaggaggacggtgtgctggcgcggctggaggggccggcggaggaggcgatgaggcgggaggcggcggaggagtggaggaggttggatgaggtgaggagggaggcgaggaaaggggtggtgagcggggaggtggcagaggtgaccgcggtggcgagggaggtgctgaaggaggatgaggaggaggtggtggaggaggagagggcgagggagagagaggaggagagggagaggagggagtttgtggtgcacgtgccgcttccggatgagaaggagattgagaggagggtgctggagaagaagaagaaggatctgttgagtaggtacgcgagtgaggggctcgtggaggagcagactgaggccaaggacatgctcaacattcagcgttag

SEQ ID NO: 49624 - DNA, 609 bp, Glycine max
  Peptide Sequence Number=SeqID_166402
atggtggagttgaggccgaaattgggttctggagagggagcaccaactggggaaggagtgaggaaagttagcataatgtttgcaactttagaaaaaattgcacaaacagatccaaagtatgcagatatttttctttttgagaactatgctgcttttcagaatagtttgtatgacctcgccaacattgtgcccacattggccaagttttatcatcaggccagtgaagcctatgaacaagcttgtacacgccatattagcatgattatctactatcaatttgaacgccttttccagtttacccgaaggattgaggacttgatgttcactgttgcacctgaagagattccttttcagcttggactgtcaaaaatggatcttcggaagatgttaaaatccagtttatctggggttgacaagtctattgctgcaatgtataagaaactgcaaaagaatttgacttcggaggaattgttaccctccttatgggacaaatgcaagaaggagtttcttgataagtacgaaagttttgcccaacttgtggctaagatttatcctactgagacaatcccgtctgtagcggagatgagagaccttttagcttccatgtag

SEQ ID NO: 49625 - DNA, 165 bp, Glycine max
  Peptide Sequence Number=SeqID_166403
atgaagggtcgtaggaagaggaagaggaagaaaaaggccgtaggaagaggaagaatgatgtgcacgatgggtgaaagacatttttgccatttcatcctttggtttgggtgtctcaccaaaaatgctggatacaccaaacaacaccattacaggaaaatgggttag

SEQ ID NO: 49626 - DNA, 132 bp, Glycine max
  Peptide Sequence Number=SeqID_166404
atggtgtacggcactataagagtattgggaggcactggagtttttgcggacaatttgttagcatttaggtttttggagaactcttcgacgatgttcagcaggctgtggaaggcagtggctggagattattga

SEQ ID NO: 49627 - DNA, 1056 bp, Glycine max
  Peptide Sequence Number=SeqID_166405
atggcgaaatcaagcgccgacgacggcgagctccggcgagcttgcgacgccgcaattgaggacccgaggcagaagatcgtgatggcgctgcgcgtcgccaagagtcacggcatctttggaaaatcttcctctaagcttggtcgcatggccaagcccagggttctcgctctctccattgttggtgacgacgtggtgtttcctgcagcgaaatcgaaggggctgaggacatcggcttttcttcgagttttgaagtattctacgggaggagttcttgaacctgcaaaactatacaagctaaagcacctgtcaaaagtggaagttgtagcaaatgatcccagtggatgtacatttactctgggatttgataaccttagaagccagagtgtggctcctcctcaatggaccatgcgcaatattgatgataggaatcgcctccttctttgcatcttgaacatctgtaaagatgttttgggtcgccttcctaaggttgttggtatagatgttgtggagatggctctttgggctaaggaaaatacgccatctgtttcttcccagaataaagtgcgagatggtggtcctgctgcatctgttgtgactgagacagaaatcacagaattgaaagtcaacgttgaaaaggaacttgtctcgcaggcagaggaagaggacatggaggctcttttgggaacttatgtcatgggtattggtgaagcagaggaattttctgaaaggttgaagagggagctccaggctctggaagcagcaaatgtgcatgctcttttagaaagtgaacctttgatggatgaggtgttgcaagggcttgatgctgcaaccagttgtgtggaagatatggatgaatggttaagcatattcaatgtaaaactccggcacatgagggaggatattgcatcagtaaggacctgtgcccgtcagtttaagaatataaatttcctagatacaatttactctctggttgtaatggctgtgtttgctggaagcatgattcatatgtttagttttctttgttcctttgttaaggcaaggcaatttatgcattag

SEQ ID NO: 49628 - DNA, 801 bp, Glycine max
  Peptide Sequence Number=SeqID_166406
atggcagaaatgcggtgttgggctgacccgacccaaccctacccgagaacatattgcaaacgcgcagcacacaatggggagaacccacagaacacagcacacaacggcaaccagcagcgaggaatggcagtgacggcgaacggcagcgacacacccgcaccctcacgccaaatattttgggacagttggttcatgccaaatattttcagtgtaggagttcttgaaaagcactggcctcttactttgttttgtcttaataacttttcttatgtccagatagaaacccgcaataacaacctggaaatgcaatcagtaaataacaaatctctcattgaagagcttgataagcttcttgagcgattgcgtgtcccttctgagtatgccacaaatttgactggaggttcatttgatgaagctcgaatgcttcaaaatgtagaagcatgtgaatggttgaccagtgccttgcgtggtcttggagtgcctaatctagatcctagttatgcaaacatgagagctgttaaagagaagcgtgcagaacttgaaaaattaaaatctacttttgtcaggagagcctctgaattcttgagaaattattttgctagtttggtggacttcatgataagtgataaaagttacttttctcaggaatttattggtatcactttttcttcttcctctgaacagcggggacagttaaagaggcctgatcatgctgacctgcggtacaagtgcaggacatatgcacgtcttctgcaacatttgaaggttaaaatttgggattcaggagctgtttacttttag

SEQ ID NO: 49629 - DNA, 874 bp, Glycine max
  Peptide Sequence Number=SeqID_166407
atgagcgctttagggcgtcctcaagatatgttttcagatacggctatacaattacaaccggtctttgctcaatggatacaaaatacccatgctttagcaccaggcacaacagccccagtgggcggtaaagttgctttgttacctattccgttaggaactgcggattttttggtccatcatattcatgcatttacaattcatgtaacagtattgatactcctaaagggtgttctatttgctcgtagttcacgattaataccggataaagcaaatctaggttttcgttttccttgtgatggacctggaagaggggggacatgccaatcagatgtttggggtagtataagtgatcaagggatagtaaatcatatcacaggaggaaattttgcgcagagttccattaccattaatgggtggctccgtgatttcttatgggcacaggcatcccagcctagagccttgagcattgtacaaggacgtgctgtaggagtaacacattaccttctaggtggaattgcccacaacatgggcattcttcttagcaagaattattgcactcaagaccccactactcgtcgtatttggtttggtattgctaccgcacatgacttcgaaagtcatgatgatattactgaggaacgtctttatcagaatatttttgcttctcatttcgggcaattagcaataatttttctgtggacttccgggaatctgtttcatgtagcttggcaagggaattttgaagcatgggtacaggatcctttacatgtaagacctatagctcatgcaatttgggatcctcattttggtcaaccggctgtagaagcttttactcgaggaggtgctctaggcccagttaatatagcctattctg

SEQ ID NO: 49630 - DNA, 166 bp, Glycine max
  Peptide Sequence Number=SeqID_166408
gcaacaacaagaagagcaacaacaaccagttttcgagactagtcaagatggtgcacatcatgagcagccactggttcaacccactatggcaaatgttcctttgagtgcagtcacaaagcttaatcccccgactttcagcagctttgacatttatgaggatccttag

SEQ ID NO: 49631 - DNA, 408 bp, Glycine max
  Peptide Sequence Number=SeqID_166409
atgcaactttctaggtatgcaccacacttggtggctactgagaagttacaagttcagaggttcttggaaggacatggtgacacaacttgtgatcaagccctaaatagggctttgactgttgagcgaggaaatagagataggggtgaaaattcttgtgacttacacaagaggtttcactcggagacatcttgtggtggccatcagggccatggtggtgaaggtcttagagatgatacaaatcaacatcatcaaggcataggcaaggatcaacaagttgttatcaatgtgggcaagttgggcactttgctagaagttgtcctatgtcatcttttcaatcgtcttctagcggagtggaaacacctatggtctagatgggacagtctagtggttatgaatcacgtgtactaa

SEQ ID NO: 49632 - DNA, 249 bp, Glycine max
  Peptide Sequence Number=SeqID_166410
atggatgtgctcatcaggaaacaatatcaccttatatctttttgttataggttaattgagaaaattttgcagtttccattggtggcccaacttatttctggtatcattcttatttgggatttgctaggggcacccagcagcattgctggtgcacccagcaaatttcaaatggcaaaaatgcccttcagcttttttcgaaccttcttccgccagagtcaacggaagaaggttcttccgtgggttaattag

SEQ ID NO: 49633 - DNA, 144 bp, Glycine max
  Peptide Sequence Number=SeqID_166411
atgggtcactcgttttacacctcacgcctaatctttttctccatctgtgccttctttcctgtaccagagttgtcgatggtggcgttggatggtggtgttgagtggtggaagcaattgtcacatatgaggtatttttccaagtga

SEQ ID NO: 49634 - DNA, 174 bp, Glycine max
  Peptide Sequence Number=SeqID_166412
atggagggctttttatttgaagtagggtgccccctctttaggttcgaacgagctagttttatctgcttttcgaggtatgaaaatctctcatctcctggtcctagcaagcattggaacctacttctggtggaggagaagctgctcttagttagagtagcatcctacctatcttaa

SEQ ID NO: 49635 - DNA, 1623 bp, Glycine max
  Peptide Sequence Number=SeqID_166413
atggccacccagttcgagcaccttgggaaggacactcctcagggtagcatagaagcgttgcaagttggagagagggtcagagagactcacgagttgggtgcacactttgaatccctcgctgacaaagcaccgaatgtagttggaaacaaagacaatgaaatagaagctcgtggcggtgttcgtgatgttggaaagttcgaaatgaagggaaacaaggatagacaagaactcgaaaaacgaacaagagaggtaataggaagagaagagaaaaaaaaaggaagagaaagtggaggacaagtagtggcagagaaaggaaggggaagggttggacctgaaaatgaaggtgcaagaacaaccgcggttataacttgcacgttggaaaaaggtggtgctactcagaaaccattaagagaagaagagagtgaaagtactgaaagatcaacgtgggaacagatttccaactacagtgatcaagccacgcaaggtgtgaaggagaggtacgatagagcaaagcaagcagcgagcgagacactgaacaccacagcagaaaccgcacaagagaaaagcgcacaggctaaggaccttgcaacacaagcaaaggacgcaacgttggagaagggtcaacaaggctatgttgcgacgaaggacaccatttcaagtgctgcaaaaaccgcttctgaaaaaactgcgccggtggcagagaaggccaaagagtacacacttcaggctgcggagaagaccaagagtgtcggtggcacgacggcgagttacgtcggagagaaagcggtgcaggccaaggatgttaccgtggagagtgggaagaatgccgcggggtatgctgccaaggtggctgtggatttgaaggacaaggccgcgtcggtggggtgggccgcggcacatttttccgcggagaagacggtggaggggaccaaggccgccgcacatgttgtcgagggagcggccgggtatgccggacataaggccgccgagcttgcttcgatgtcgaccggtgctgttaaaggcttggctgcttcagctggtgagactgctaaggaatacactacaaggaagaaagaggaggcacagcgggaattggaggccaaaaaagcatttcaacctcaggaagccgaggagagaccatcccaaggaattggcgaaacagtgagcagtgtcggtgagaaggtaaagaaaccatttgaaaacattttgggaggagaagggaaaaaagatgaaagtggtggcaatgaccaaagtagtggaggaggtcaagaacagggaaagagtatcattggtcaaacactgacaagcattggtgagaagttgggtgatgcaaaacagagagaggagctgatagacaacgtcactgagggagggagcgaggtgttaggagcagtaggtgaaaccgtgggtgagattggacagaacacgatgaagccagcggagatagttcaagaacgtgctcacgtgcgacaagagggtggggtgttggatgccattggcgaaaccattgctgagattgctgaaacaactagagtcatggttgctggagaggacaagagagtgatgccggagactcgtgtaactgatcgtgccaagcatgaagaaaggtcggagagtgcttga

SEQ ID NO: 49636 - DNA, 1536 bp, Glycine max
  Peptide Sequence Number=SeqID_166414
atggaagaaagggaaagcacagagataaagatagccaggttttcaagttgtcgcggggtagcatttgaaatcgatcctaatagaagcaacccctttgcaattggatcaccaacaaagcaggaagggattggaacttggctttggcttccatggactcgaaacagttcattcaaagttcttcctcagcctcataacattagtccaactcggagccgggtcagcagccacttctgtgacattgacattgatgcaagtgatgttgaggtagagttcatagctgaagttcaagatatagaaaaaccagataaagctaatggagttaaggtgcaaaagctacttcccaaaactgatccaccaaggaggtcaaggctgtccataattttgcttgatcaagggttcacattctacaaagggctttttctggtttgcatggccttgaatgtggtggcattggctctttccgctgcagggtatttcccttatgctaagacaagagctgcattgttctctattgggaacattctagctctaacactatgtagaagtgaagcagttttgagagttattttctggttggctgtgaagattattgggagaccttgtgtctctcttagaatcaaaactgctaccacttcattccttcaaagtgttgggggaatccatagtagttgtggtgtctcttccatagcctggctagtttattccctagttcttacattgaaaaacaaagacaaaacttccccagagataattggggttgcattcatcatcctctcactcattctactctcttcccttgcagccttccccctcgtccgccatcttcatcacaatgttttcgagagaatccaccgtttttccggatggatggctctcatccttctctggctattcattcttctctccgtaagctatgaaccaaactcacacacctatcacttgaccatatctaaggtggtcaagaagcaagagtgttggttcactttagccatcacagttctcattatcattccttggttgagtgttagaaaggtacaagttagtgtatcatctccatcgagccatacctcgatcatcaagtttgaaggtggtgttgaagcaggtttactaggtagaataagtccttcacccttgtcagaatggcatgcctttgggatcatatctgatgggaagaaagagcacatgatgctagctggtgcagttggtgatttcaccaagtccttgattagtaccccaccaaagcatctttggcctagtaaagctaatgtgtacttaatttgggtggctaaggacattgaattgaactttggaagggagataatagagttggtgaacaaatattcaaaagagaaggtgatagtgcatgacacagcaatttctggtcgtcccaatgtagctgagatgagtgtgaatgctgctattatgtggaatgttgaagtggttattgtcactagcaaccctgaaggaagtagagatgtgcttagagcatgcaagagggctaaaatccctgcctttggccccatttgggactcttga

SEQ ID NO: 49637 - DNA, 1170 bp, Glycine max
  Peptide Sequence Number=SeqID_166415
atgcagcgtctgaaagtggaagtgatggtggtatcactatcagcctcacgctactctcacggttctgccttgcatttcaagtccagacgcttctcttcttcttcatgttcttgtctgaaggtttcgccgtggcggggtcttaatgaatggagggagagtcctctgaacgagaatcgcaagtggggagagcatggccctggtcctgcttcagaaccccaccgccaccaccaccaccgtgactctccatttgggcaagcttctaccttggctgagattggttctattgttctttccactagcgaccctcactggaagtcccagctttctcacatggcttactccatgtggcgccgccacaacctcccccttggcatttccaaacccccctctcgccccgccagacccccaataccccaattggtttcccctaaggaaattcctgctcccaaggactcaggtttgcctctgaatgcttatatgcttcataatctagcacacgtggagctcaatgcaattgatttggcctgggatactgtcgtccgattttctccctatagtgaaattctaggggaagggttctttgctgactttgctcatgttgctgatgatgagagccgccacttctcttggtgtgcacagaggcttgctgaactgggttttaaatatggtgatatgccagcccacaatttgctatggagggaatgtgagaaatcatcagacaatgttgctgcacgtttggctgtgatcccactagtccaggaggctagaggacttgatgcagggccacgcctggtaaaaaaattagttggctttggagataataggacatctaagattgtggctagaattgctgatgaggaagttgcacatgtagcagttggtgtctactggtttgcttctgtctgtgaaaaactgaattgtgctccagactccacttttaaagacttactaaaggaatacaacgtggaactaaagggtcccttcaattattcagctagagatgaagctggcattccccgtgattggtatgatgatgcatcatccacaagcattaaggacaagaaagacaaagatggcaatcaagaacagctctctgcagtttacaagaggctggcttccatcattgctatggaaaaagagaattcaagtttgaccaagccacctgaatga

SEQ ID NO: 49638 - DNA, 1941 bp, Glycine max
  Peptide Sequence Number=SeqID_166416
atggcttcggggccaatagttggagatgatggagccaaagagaagcagaggtacaccgagagtaaggtttacactaggaaagcgtttaaaggtccgaagaacaaaggtaacgccgtcatcaccgtgaacgctgttcctcctcctcctcctcctcctcctcctcctgccgccgtagctactaccaacggcggcgacgacggttctgctactgttattgccgttgattacaacaataaggataacagtactgtcgataacggtgatgttagggctaaggataatagcaataacgcctctgttcagccggtgccggaggatgggaattcagcccgtccgcaagttaattcgatgttggatacggtttcagatgactcctccagcttgaaccgtcctcaagatgaaccttttagtgttccaggcgtgggagagcggtcgccgggaccggagaattgtgtcaggatcagtttggcttcgcggtctaagcaggagaagcgggagctgaggaggaggcttcagggtgagcttaatagggttaggagtttggtgaataggattgaggagaagttgggggtgcttggtgggtatggtaattctgatatgatggtggatcgtgggattggtaatggggttggagctaagagggctcactcggaggtggcatctgctgttgttacacctcgagagcgagagcctacccggcctttgcatcagttgagtgtgtcagtgttggagaatagtcaaggggttactgaaattgttgagaaggagaagaggacgccaacggcaaaccagttttatcgcaattcggagttcttgctggggaaagataagtttccacccgcagagagtaacaagaagtctaaattgaatgggaagaagcatgtcgagggtgagatgggacatggaatgggttccaagcttttaaagagttgtagtgcgttgcttgagaagttgatgaagcacaaacatggttgggtgtttaatgctccggttgacgtggagggtcttggtttgcatgattactttagtatcatcacacatccaatggacttgggaactgtgaagtcaaggctgaacaagaattggtacaaatcacccaaggagtttgctgaggatgtgagacttacatttcataatgccatgacttataatcccaaagggcaagacgttcatataatggcagagcagctacttaacatatttgaagaaagatgggctataatagaatcaaattactaccgtgagattagatatggcctggattatggagcaccttcacctgtgtctagaaaggctcctccctttcggccaccaccaattgatatgaggcggattttggataggtcagaatcaatgacacaacctccaaaaatcatgggcatcactccttcgtctcgaacccctgctcccaaaaagcccaaggccaaagatcctcataagagagacatgacatatgaggaaaagcagaaactcagcacacatcttcagagtctaccttctgagaagctagatgcaattgtacagatcattaagaagagaaactcagcactttcacaacacgatgatgaaattgaagtggacattgatagtgtggatactgagactctctgggagcttgatagatttgtgaccaactataagaaaagtttgagcaaaaacaagaggaaggctgagcttgctattctagctagagaacgagctgagcagaatgcccagcagaagagtcaggcaccagttgcagtagagattccgaaagaaacacaagcagatgaaagaaatgttcccccatccttgcccgagcaaggacaaattccagtggataatgggagtaagaccagtagttcaagcagctccagcagtgattcaggctcttcgtcaagtgattctgatagtgatagttcctcagcctctgggtctgatgcagggtcaccaaaaacctga

SEQ ID NO: 49639 - DNA, 1163 bp, Glycine max
  Peptide Sequence Number=SeqID_166417
ctgaggaatttgatgagtccttgttgttcaatggaaaaaacgtttccagtttcagcagtggcagaaagcttggtgcaggaagatgcaacttgttccgtgggaaatgggtttatgacccttcataccctctctatgacccttctacatgtcccttcatagatccacaattcaactgccaaaagtacggtagacctgacaaacagtatcagaaatatagatggcaacccttctcttgtcctttacctaggttcaacgcatttgatttcctggccaagtataggggcaagaagattatgtttgtcggtgactccttgagcttgaaccagttcaactctctggcttgtatgattcactcttgggtgcccaacactagaaccagtttcataaagcaagatgctctctccaaaatcacatttgaggactatggccttcagttatttctataccgcacagcatacttggtagaccttgaccgtgagaacgttggaagggttctgaagattgattcaataaagagtggtgatgcttggagaggcatggacgtcctagtttttaacacgtggcactggtggacccacaccgggagttcacagccgtgggactacattcaagagcgtaacaagttgtacaaagacatgaaccgtttcattttattctacaaaggtttgacaacttgggctagatgggttaacatcaacgtgaatccagcccagaccaaagtcttctttctaggaatttcccctgtgcattatgacgtgttaatgaagcacggacacttcactcttttgtcgtgttcggtgtccgacatgcgtccgtgtcagtgtccgacaccgacacgatacccttattacgttttatattttggacattacagggggaaagattggaatcaaccagcaaaatcttgcatgagtgagacagaaccattctttggattgaagtaccctgcagggacaccaatggcatgggtgatagtgaacaaggttttgagtaggataaagaagccagtgcaattcctagatgtgactacactctcacagtacagaaaagatgcacatcctgaaggctacagtggggttatgccaactgattgcagccattggtgtcttccaggactgcctgatacatggaatgtgcttctccatgctgctttatttgactga

SEQ ID NO: 49640 - DNA, 378 bp, Glycine max
  Peptide Sequence Number=SeqID_166418
atgagactgcctgattccagcgactttggccctcaccttcgcgagcacctccggagccgctttgctgatgcttttatccgagagcttgccgaagtgaccataccacctgaaagaatatatggccttggaactggaagttttgaagtagcttcagaaaaagctagagcaccaaggactgacactgcattaatcttaaccagctttgttgaggatcggctagctaccttaaaaaatgtcatcaaagagcctgagttagaccaatggaatttgtatctaggtaattggggttacaacacccagaaagaaagagaggaagttgctgctatccccagaattcatgttcttgagctctccgacttcagcaagaagttgaaatag

SEQ ID NO: 49641 - DNA, 351 bp, Glycine max
  Peptide Sequence Number=SeqID_166419
atgactggaggagataactataagatatggaaggagagaattcttcgacaattagggtggatggacatagactatactataaggaaagacgaaccacttgcaatcactgatgaaagtagcacaactgttgttgtgctatatgagcggtgggagcgatccaaccgactaagcatgatgttcattaagaccaaaatctcagtcgggatacgtggttttgttgaccagcatgaaaaagtccgagacttgcttaaggccattgatgatcagttcatcacttcagataaggctttagcaaacagcctgatcatgaagttctcctctctccgactcaccagtgagaaaggtgtgtga

SEQ ID NO: 49642 - DNA, 2823 bp, Glycine max
  Peptide Sequence Number=SeqID_166420
atggcattattgggcacgagtgcaaacagacaatgcaatgtctatttcccaggatatcattgcccgagggattttgtctttggcactgaaggcagcccatggacctcatctaatggtaacagtgaacgtgagaatgactgttaccgacttggttccttgccattgtcatcaccttgtcatatttcaggacacaacaaggaacttctgaaacaaacaatactcaagcatgaagcgatatttagggaccaaattcaagagcttcaccgcatttaccagaaacaaagggagttaatggatgaaattaaaaggattgagttccataaacacagtttaaggatggagatatcatcttcaagttcctctttgtattactcacaaaacatgccttggttgactagtcaatcatctgttttaaatcctgaacgcatccagttaccattggcttctatgcaagaaaagagcagggaattatctcctactcctcttcctgctccaactgcgatcaaagaatctttagatcctaaactgtcagggttgacttacagaaaagttggtaagaaaatactggatcttcaacttccagctgatgagtacattgacagtgaaggtgattcttgtgagaatgaaagggttatcaaacagcccccactgtcaacttatactgttgagaaaccatatagaatcaattctaataatggttttgccgacttaaatttaccatgtaagcttcaaaaagagacaggtgtgaagtctgatgattttggggcctcaatccctcacagaaaccatacatttcatgatatgcccgggagaatgacaccaggctctcataattttcccaatgatgtcatcctgaatttgaaaagaaaacaggatcatgaagcttacccagatctcccactatcaaatcacgggcagaaacatggatggctgccctcgggcacttgtgctgggcacaatggcagtgacttgggttttcttgctaaatttaatgatatggaaagccaatctgtttcaattgattctgtaagtaagaagctgaaacaagttaagtattgtccatgttttcattcaatacatcaaattgtcccaagatctagaaccgagagccctgcaggaactcatgatcctactagtggtggctggcttcgaccaagctttgcttcatgcacatgtgctcctcataagcttgtttctgattctgatatgaaaaattctggtatttcaccatcagtgttatggaaaagtaccacatctgaccctaatttagatcttcaacactatcttcttaaccaaagtttttgcagcaggtccaacatattggatctaccatcaattagtactggtgatctaaacagcattgacaactttggttcatcatcagctgaccatgagcttaggaagtatgttaaggatttggtatatgtggggactcacaagagcataaacctgaatattatgcctgctggttgttcggataaaacagctgcagcatttcaaagtgatcagattacaggtgaagaagataaatgtcaggattcacgattgtcttggctgaaagcaaagcctgtagctaaaggaaagcccaatgaagaaagtcaactctcaacccaagttgactccttccttttgaatccttataaatctggttgtatacattctgatttgatgttcaataaggttgagaaaagtgactcgtgtacagaaaagactctggcatttgaccttaatggaaagcctcagacatccaaagtcttccagagcctgtccaagaatcattggattgaagaaattaagaagatatccaatataaattcagcttgtgatagtgatcctgatatgggggaacaggcacctgctagtgaacgtttcacgaagaatgagaagaaacacaagcatttggaaggtatttttgacctaaattcaggcatgaacgaggatgagaatatgccaattgatattgatttacaagcacctgcaagtccagaaaacaaggaatgttctccacccagaggagaatctgatgaaaaccagcttgagatgcccttgcaaatggaagggcaggagcaggaggatctggaagcacgagaaaagcaaaccaaaattgcagctgaggctttggtttccatatcagaaactgtggcctataatggcctccaaatgacaacttgtccatcatctgaatcttctgtaagtagttctctctactggttttctgaaattgtttctacaatagtggatcattcagagtgtgaggttaaggaggatttcagttgtaccattaaggatcttgaggactttctgcctgctgactttgattactttgagttcatgtccttaaatttgaccgacacaaaggacctagattatggctgctataagagttgtggccaaaatgagcaagaagttgaatctagttcaccaattcaaccaagaaattgccgaacaaacaggaagcggcgtgggaacgactttcaaagtgaaattctcccgagccttgcttctctgtcgcggtacgaggtaactgaagatcttcaaacaatcggaggtctcttggaagctgccagaagaactcattcagcaacaggttgcctaagaagtgcatgcaaaaatgcattggctaaggggaagaaaaggtcttgtgcttctgtctctaataacatcacagacttgctgttgaacttgaaggaagtaaatattgatactgaaattgccattgagaaaatgggattcataagttgggggaagatttgtagaaagccaagggggaagagagttgctaccagtaaaccccacttaatttttagcaaagtacataactaa

SEQ ID NO: 49643 - DNA, 516 bp, Glycine max
  Peptide Sequence Number=SeqID_166421
atggtggtcaaaagtagaaacaccatttcccatgcagaagacttaacagaagtcttaaccgagattagaaaatacaacatgaggttaaattcaaaaaaatgtaaattcaaagtacagggcagaaaattcttaggatttatgctgactcacaggggaattgaatctaacccagataagtgtgcaaccatcatagcaatgaggagtctgaacacattgaaaaagaaaatcaaagaattccgtgcttcgccacccatcttgagtaaaccccaaccagagtcgaaatctgagtggtggaggttgaatgtagatggttcgtctaatgaaaagaggagtaggactgaagtcattctagaaagcctagatgaagtcatcctggagcaatctctcaggtttgaatttgaaacaacaaacaaccagggcaagtatgaaactttagtagccgaactaagattggctaaggaagtaagggtcaaatacttaaaatgttggagcgactcccaactcatcactagctag

SEQ ID NO: 49644 - DNA, 690 bp, Glycine max
  Peptide Sequence Number=SeqID_166422
gcaaaaggccaccttagggcggttacagcttgcccaggcgagctgaaacttaaccctgaagcagtgagctcgctcaggcaagctggtcccttagccttgaagttatttggtggcccaggggagtcaaatgttggcctgggcgagctggggcctaggaaaaacaaggaaaagacccttttgccctcctttcttggaccaattactttaaaccacaacaaaagaggagagttggctactcatagccatggaggagaagcttttgatggaggacgaatcaaaatgcatccaaagctgtcaccacgtctcgggtctctttctctctctatactttcaaaagtgtggaagcctagactaggacaaaaggcttccaaaattctcccgataaagctaattgtggaatctcctttacttgatctggacttcaaaaaggatcctacaaaacataagcaagcaacccaaagattaagcgcaaaaggagatgattttgctgagaatgatgccaaggtgcttgacaataaggttccctttgtcggggcgataggtgacatggatgatgagaaggtgccaccctcggtggtgaagttgttttttcaaaggtctagttatcttagttcgatgaactctggtgagaagtacatcaagtctcaagacacagtaattgtcgaagaggttcaagagataggtggataa

SEQ ID NO: 49645 - DNA, 318 bp, Glycine max
  Peptide Sequence Number=SeqID_166423
atggagagccgaagccgagtgttggaagaagcctacagcgtaaagttgacccacttgccagctaaaaatcgacctcccccgggagtggacaaatctaaatactgtcactatcaccaagtggtgatgcacgacactgaagaatgtaatacattgaaggataagataaaaaggctcatccaaaaaggacatcttcataagtttgtcaaagacaaagaccattcttgtaaccatgaacatgagaaggaaagaagccaagaacgaaacaagcctttgaagcatgcaaagggaacacatctaaaactcaactgcgagaagtga

SEQ ID NO: 49646 - DNA, 1380 bp, Glycine max
  Peptide Sequence Number=SeqID_166424
atggtttctgagacactccaaagccaaaccaagaacgtgtgcgtgattggagcaggaccatcagggctagtggcagcaagagagttgagaaaagagggtcacagggtggttttgttggagcagaatcatgatgttggaggacagtggctatatgaatcaaatgtggaaggagaggaccctttagggaaaaagccttttctaaaggttcatagcagcatctatgaatctttgaggctcacatctccacgtgagatcatggggttcactgatttcccttttttggtcaagaagggtagagacatgaggaggttccctagccacacagagctgcttatgtacttaagggacttttgtgaacattttggcttgggagagatgataaggttcaacacaagggtggattatgtgggaatgttggattatggtgtctgtagtaatgatttgaagtgggttgttagaagtgaagataagaagagtgaaaagacggtggaagaggtgtttgatgcagttgttgttgccactggtcattactctcaaccaagattgccctccattcaaggaatggatacatggaaaaggaaacaaatgcacagtcacatttacaggaccccagaaccattccgcaatgagattgtagtggtggttggaaattccttgagcgggcaagacatatcaatagagcttgtggatgtagcaaaggaagtccatatgagttccagatctcttaacatctctgagggtttgtctaaagtcatatccaaacatgccaactttcatcttcatccacagatagagacccttcaagaggatggacgggtaacattcgtggatggttcttccattttggcagactccattttgtactgtacagggtactcctatgcattcccctttcttgacaccaaagaaatggtggttgtagatgatgacagagtggggccattgtatgagcacacttttcccccatcacttgctccatccctttcttttataggcatccctagaaagatcatagggttccctttctttgagtcacaagcaatatggatagctcaactgctttccgggaaaaaagtattgccatcatgggaggaaatgatgaaatccatcaaggaattctaccaatcaagagaagcagcaggcattcccaagcactgtactcatgaaattgcaaactttgggtactgtgacaaatacggggataatgtggggttcccacgtatagaagaatggaggaaacagctatgcctatcagccttaattaactctgatgccaacttggagacatatcgagattcatgggacgatcatgagctgctccaagaggccctccagagcccacacttcactcaacttggacttgaagattctcccatgtaa

SEQ ID NO: 49647 - DNA, 1021 bp, Glycine max
  Peptide Sequence Number=SeqID_166425
tccttgccacataggattgctgacttggactcaaacttgccacattgggatgcttacgtggactgaggctagtaactccagggattcagaggggttaggttcacattggttgcaacaagggatcaacgacgaagcggcaattggggagctttttaaggttgtggttggccagagggtggatgtcaaggcctcatgtaacgacaatatggaaaggacaattatgtcaaagcgttgggtttcaaaaaagaaggaattccctccgattactctccccagttatgcatgggtgaaaggcgagaaacaagtgcatatgaggtatgatgactttcctgagagttttatgaatgaagacaagaagcttaacctgactattcttgataagctccctcgaaggttgttggccaaagcaattgttactttacacaagtcttctactttaatggaggacttgccagctattcccaatttgctgggatggacaccctcgatgaagcttacacaaatgctggtaatgcttcggttaccgtcttggcaacatgagtcctcctcctcattagccaagcaagtggcttcactagccaactcttcatcggttcaacattcttccttcagggccagggcgactgctgttgcacaacacatggtcttgtgcaagtcttcatttcaccaggagatcccaaagctaaataagtccttagaggtgatgaaatctaagaaggatgagtttcttgtcgtaaaccttttgttgactactgataatgaaggtctgaaggttgaggataagattaataatcttgaggatgctttggaaaaagttgaaaggaagagggatagtgatagggctatagatgaatatgaagttcttttgaggagtgcttggatgaaggtgattgaggaacacaatgctgccaaacaccaactcctcccccctgacactgctatgaatgaggtggcttccaatgatgaagttgaagctcccaaaggtgatgatgaggttaacaaccaagggtttggccagtga

SEQ ID NO: 49648 - DNA, 177 bp, Glycine max
  Peptide Sequence Number=SeqID_166426
atggagtggagtgtgttttgttggtctcgtattgattttggtagtgtttgggttctggtccatgtgagtggggtgatggaacaatggagaacgattgagtttcaaggggatgaagagacggtgatccaggttgacgagggagattgttcaaaaaattcagaggatgaaggtgcctag

SEQ ID NO: 49649 - DNA, 201 bp, Glycine max
  Peptide Sequence Number=SeqID_166427
atgccacatgggaattacaaagtcagatgcaagcagcctccatggttgtttgagtcagttttagtcaaggttcctaagacaatccgccatagtctgaccgttgggattttgcaaataacaacttttgatgtcttgataagagcgaagggtgcgctaagcgcaattccaaccaaagagggagttgcactgagcgagacttag

SEQ ID NO: 49650 - DNA, 372 bp, Glycine max
  Peptide Sequence Number=SeqID_166428
atgtggggtgctaataccttccccgtgcgtaaatacaactcccaagcctttcacttaaaagttcgtagatcgcgtcttttctggtttttccgacgttttcctcaaataaacgttggtggtgactccgcgcgtattcctttcgtggaatacgcatcccgcgagtcacgcgtcgccctcccgctgaagggtagggtgcgacaacaagcacacgttgcgttcgagtcgtattctcggagaaatggagggattgcctttgtggataactgggcggtgggtaaggagaaggaatggcagtcacagcatgggcttctacttcatcctcaccctcttcatttgccccaattttctcattcgtccaagcaggatgactaa

SEQ ID NO: 49651 - DNA, 285 bp, Glycine max
  Peptide Sequence Number=SeqID_166429
atggtggaaccatcaaagaagcgcaaaggttcttcgagtagaagccaacgacactccgaggctcaggatactacaattccttcctccatttcctcctccccattgttctcatcgaaagaacaatgtatacgatacaaaaacctcttctcctctcattctatcattgaccctaagttcatagatatgaatttcttttctgatgagagttttgaatgcattcaagcatttcagaactcaaatctcattccctttatgtctttaaaactgcctgtgtattttgaattg

SEQ ID NO: 49652 - DNA, 240 bp, Glycine max
  Peptide Sequence Number=SeqID_166430
atgcggggttaccttatggttacccacaccgttcgtcaaccaggggcaaacgagcccattggcgcgcggaggctaacatcatcttctgcaccttttgtcgtcctgacccgtgaagtcagtcaggtgacatgcggggttaccttatggttacccgcaccttttgtcaaccaggggcaaacgtgcccgttgacgcaaggagagcaacatcgtcttctgcacgtttgtcgtcctgacccttga

SEQ ID NO: 49653 - DNA, 238 bp, Glycine max
  Peptide Sequence Number=SeqID_166431
atgggaattgctgattctattctaaggcatttctttctgtgtgggacgatgccgcaagcagagctggaaacgaggtatgagattgctcgcagaggactaaggtcgacagatagggataggccagcaaatgcaatgagaaagtcttcttcttttcttgctcaggacttgtcttggaagacgcctgattggattccatcctctattctctacccgatctctatgagagctttgaagtcgg

SEQ ID NO: 49654 - DNA, 805 bp, Glycine max
  Peptide Sequence Number=SeqID_166432
agatagacctgctgacgaggatgctgccgatgttcccgagaggcgtaggcctactgcctcagcccgtaggctacgcgttcatcagatgactacggagggacgtgatatggctgaggacgtcgctgacatgactaacgatgtccctgagcagcctacggaggcacctgagatgcatgcggacgcacagggtgttgatagtggcgaggggtcagatgatgatgatgctgctgagggattccctggtggtccacgtgacccgtcagtgctcacatcatttgccgagcatgttgcacatgcagaacgccctgatttgaagttagtgtcacatgggaggaaggtgacactgattgggaggccagtgcctgagattgaaggcctggtggctgccataggattaagtccactgatagattgtttagttattactgacgatcctggacttatatccgcatttgtggagagtttccacgctctttctatggaggaggccagattcttgcttacagagttgctggaagtgtctgccgaggaggccagagccgagacatcactcacacgtggagcatatgcctggcggtggattgtcgcaactcgcgcttatctgctgcaccttgtcggttgcactctttttgctaataagagtgcaacatacgtgcatgtggtccaccttgacgctttctgggacctcgctcatagtggtggttacgattggggggttgccgcgctggttcatatgtatgaccagttagatgaggcttgtaggaccaccacccgacagcttgcggggtacttgacgctacttcag

SEQ ID NO: 49655 - DNA, 1038 bp, Glycine max
  Peptide Sequence Number=SeqID_166433
atgcaatccgcggtctggtggctgcccatccttatcatgcccgccgtgggcatctttatcgtctgggtgaccaggacctggcttgccggtgccgccggtagtggcatcccgcaaaccattgccgccctgcaatacgaagaacatcaatccatcaaccatctggtttccatcagaatcgccgtgaccaaaatgctgttagtcacgctggggctggccgctggcttctcggcaggccgggagggcccatcggtgcaggtcggcgccagcatcatgcatggcttccgcaaatatttcccggcccacttttatgtcgatcccaagcacctgatcctggccggtggggccgcggggatctcagccgcctttaatacgccgctggcgggcattgtgtttgccattgaagagctcagccgcaagtttgaacaaaaaaccaatggcgtcatgatcaccgcgattgtactgtccggcctggtctccatttccatgcagggcaactacacctattttggcagtttgaacgtcggcgccattcataccgaaatcatcattccggtcatcatctgcgggctggtatgcggcatgtcaggaggcatattcagccgcaccattattgagttcacagagcggctacccgacaggattaccgcttatcgcacccgccacccgctttactggacaggcttttgcggattgctggtggcaggcctgggcattgtcagccacggtgccgccaatggctcaggttactcaatgaccaaggccatgcttgatggcaccatcaatgaaacctggtactaccccatcatcaaatacctctccaccattttcacctatctcagcggtattccgggcggcatcttcgccccggcactctccatcggcgcaggcatcggttacgacctgtcgaccatctttcactatcatgacatcgccatcgcgatcagtgccttatgcatggccggtttcctggcaggcgtcacacaagcgcccatcacttcctttattattgtcatggagatgatagacggccacgaaatg

SEQ ID NO: 49656 - DNA, 144 bp, Glycine max
  Peptide Sequence Number=SeqID_166434
atgtttctcttaatcattgcttttaagggattcaacgacagtcaaggaagtaaatctaaggctgttgctagatggattgtagttaaatattttactgatcaaagatcattagaactagagagaatgaaggcaattcgcatttag

SEQ ID NO: 49657 - DNA, 906 bp, Glycine max
  Peptide Sequence Number=SeqID_166435
atggcacgtgttgctgataaaataaaattgatagatggatcaagggaagctcttaagctttctgtaaggatcactgatctttggttcattgggattcccggaaagactgaacaagccgaaatggtggttgttgattctaatggagatgaaatgcatgttgtttgcaagcaggatcagctgaagtatcgcaaggctgatttgaaagagaatttggcttatgtgatgcataattttaaagttatcaagaatgatgggaaattcagagtttgtgatcatgaatataaattatgttttactggagttactgttgttaggcaatgtgatatggaacagttaccttttaggaaattcagatttgttgctttttccagtgtcatttcagtggccagatcatattcggcatcggtcagtaattctttcaaggcgtccaaactcatgatcaatgacctcgtgctggaaattcaagaatttagagagagtcttttagatttagggatcgaggttagatcaattttggcgcctattggacaagggagttcacaggtttcaggctcatctcaattatcatcaaaagatgcgtttctgtcaaagactaaagagtttgtttgtgttactgtcgccaagattacaaccatagtgatggacaactattcatggtgctatccggcttgtggtcaatgttataaaaaagatgacatgctaactgtgccgttgacatgtccgtgtgtcaaagagaatgatcaacctgtactgaggtatcgggttgaggtgatggttaatcacaagggtgaacaaaccaaatttttgatctgggatcgtgaatgtgcacagttaattggtcagtcagcggatgaagtcaacaggctcaaaatagatgttattgtattgtcatgcaatgttttttaa

SEQ ID NO: 49658 - DNA, 480 bp, Glycine max
  Peptide Sequence Number=SeqID_166436
atggcagcaagaaaggaagaaaagaaagaagacattgaagtgatcactgctatttacaaagttaacctgcattgcaaggaatgtgggagcaaaatcaagaagcatctcacgattacccaaggggtactgagtgtggaaatagagtttgagaaaggagaaatcaatgcaaaagggaaaatagagcctttgaaaatcttgaagcttatagagaagaagagcaaggaaaaagttgaattaatatcaccagaagtgaagcctaaggagattacttctacggaaataaagccaaaggaaatcaaagatgagtgtcttagtgacaaaaaatacttggggtctagatctcaagaggagattaaggatagcgctaggagtgacctagagagtactcgttgtagccaaaagtggcatagagaattcttggttgtaatcaaaggtttgattagtggaacccttcaagttttgaaggagaaatggatgtag

SEQ ID NO: 49659 - DNA, 681 bp, Glycine max
  Peptide Sequence Number=SeqID_166437
atggagttcagtttcgatgagaaggactttgtgtcgtgctgcgggagcactaaattcgcgaaggaaatggcttcggcctctcctttcggttcgttgcaggacgctgtttctgttgccagagacgtttggttcaacagcgttgatgtcaatggttggcttcaggccttctctgcgcaccctcagatcggtcaaagccacgctccctctgttgcctctgaagccagtgctcagttcagtacttcaaattcacctcttttccccatccgggtcactctcttttttgtgttttggggtattaggatatggattctccacgatcacgccttcaggtggagtaagggagagcaatcaactgctttagcaactgctactggttcgagcttacaggaactatctgaatggaatgctcggtacagggaaaagtttgggtttgtatttctcatttgtgcagctgggagaagtactgatgagatacttgctgaactgaagagacgttatacaaacaggccaattgttgaatttgagattgctgctcgggagcaaatgaaaattacagaactacgccttgcaaagctcttttcaagtagagaaaacatttcttctacagctgataagaattccactgctagaaaggcagaagtatatcaccagccatttagaatcaaccatcatgagttgtga

SEQ ID NO: 49660 - DNA, 294 bp, Glycine max
  Peptide Sequence Number=SeqID_166438
atgacagttttaaggcggcatggccccccactgcaatggaaagttgaaacgctgaatcctgctattggtggaaaaggtgttgtccaaccatggtatgattttcttcaagaaatggattttgatgatggagatgaaatttctatttattataggtattatgaaaaaatttgggatatcataatcaggaggcaggaagattgggaagatgatgacagaaaagaagatgaagatatgcagatggagaaggctcaagctacttcaaatatgaaatcatttgctgttggagatgtttaa

SEQ ID NO: 49661 - DNA, 540 bp, Glycine max
  Peptide Sequence Number=SeqID_166439
atgtgtggtttcaagccaattatccgcataatctcggtgagggttcacatgcattgtggcaaatgtgaggcagacctaaaaagtagattaataaagcacaaaggtattttcaatgtgaaaaccgaccagaaagcacaaaatgtaacagtggaaggtacaattgaagtggagaaattgatatcatttttgagaaaaagagtgcacaaaaatgctgagattatttccataaaggaagtgaaaagggatcaagagaagaagggcaaagaggaagtgcagtcttcagaaaccagcaaagagaaggatcatagtgaatcaaccaaggaaaaagaagacggcaaatctagtgaaacaaccaaaataatgagtcatcaagggcacccaaaagaggaaaataagataaaggataatgttccttatattattcattatgtctacgcgcaacaacttttcacaggtcatatgtatggtaatattcgcttccctgattcacttgtttgtaaaatgctggtgcgtgttatttcaaatacagtatacaattga

SEQ ID NO: 49662 - DNA, 810 bp, Glycine max
  Peptide Sequence Number=SeqID_166440
atgggcgcaccttcgtccaaggttgcacctgctcaacaacgtccacctcccactttcattgctcccaaggcaataggtgccatggctcatataacgttctacctgttcgacaatagtttgaacaaagtcttcgacggactgagaccatccatcttaggaagaaaaagaagaaaactgagtccactgccaatatggacgatgaagtttagtatgaagcaccttcatctcccatccaccttgatcgcttccaacatcaaggtccaatggccatcgaccccaacctcacaattgaagacattgcaagaagaagaagaagttacatgcccttcgtccatttacaaagattatcaagttgcatcctctactactaagctgaaaccaccaacagggattgaagttcttcctccaccaacatggaagcgacttcaccccaagtggccaagctatcctcttggcattcacataagatgcaccactagtatcaagttcatgcccgatctcattgctctgaggttgccaccattggacctttggaagaagaaagacatgcatgaaaattctcgtctttcgtccacttcagaatatgacaaggaagacacctccaatcatatgcgtatgagcatacattctatcttgattagaacccttgggttccaagtcaaagaatggcggttgaacttcagaggaacaagacaaactcagccgctaactgatggagatgcagaaaaagaggctgaagccaaacaacaacaggagatgcttgaatctggaaattcattcaaaattcttcatgcacatcttggaccttag

SEQ ID NO: 49663 - DNA, 327 bp, Glycine max
  Peptide Sequence Number=SeqID_166441
atggaggatgtcactccattagtggatgtttggtttcttggacgagcaagaaacaagcttgaggattacaacttgtttaagagtaaaattcatatcctttgcgataatactgctaccatagatctttctaaaaatcccatcacgcattcacgtgcaaaacacatagaaataaaacatcatttcataagggatcacgttcaaaagggtgttgtggaattacagtttgtatccacagaagatcagcttgctgatttatttacaaaaccccttactgaggacagactaatctctttaagagaaaggcttggcatgttccttgtggaatga

SEQ ID NO: 49664 - DNA, 267 bp, Glycine max
  Peptide Sequence Number=SeqID_166442
atggttggtggtggtagaggtggtttgatggatggaggtgatcattgttgcataagcaaattcatgttgaaaagcacaaagtctttaaaggacttgagtaaagactccaatgtgttcttgatcagtagattggtctccattttcttccaggttggcctgttgaaggcacaacaattcttgaattctctcctcagacacaccagttggggcaaaggtggtcaagggagttattttgtgaggtgtgttggaagtgctgatcgttgctaa

SEQ ID NO: 49665 - DNA, 588 bp, Glycine max
  Peptide Sequence Number=SeqID_166443
atggagtgtagggtcacacctggaagcaaggggccaccctggtcaatgaaagggatgaggggtcctcctattcgcggtagatccctcgtgggtagggaggttaggggtataggggagtttgatttcttggtgtcgtctccctcctcactcccgaattctaagaaagtaaaggaagtgtttgtaggtgaagttgtgaagggttacaattataaaaaaaaattgaagagtttgattgcaaaggaccagaaagaccttggaaagtcaaagaagagaaagcgggtggaaaagaccaattttggtgaagggcctaccgaggaaacgagaatagagaaaggcgcggagatagagattgtgtcaaaagccgttgagaagacaaaggcaatgactttgcagttgaaggccatgaaggctgaggctggtaaatctaagcaacttggcctggaattgactaagagtaggggaacggtgaaaaagttgcaagaggaccttgacaaacatgtcgcctatctatctagtaaggccaaagaaaacaatgcattgagtaatcgagttgttgacctagagcagcaagtgaaggacataggctag

SEQ ID NO: 49666 - DNA, 1451 bp, Glycine max
  Peptide Sequence Number=SeqID_166444
atggggcctcaaggttcaaatcgtgagccgctgaactcgaagagctcgactgaccatgctatcattcatccgacgaggagtgtcgagcttattgtggagtctgaaatggataaatatagcaacaaattggctccaaacgtggcccgagtaaggatgggcgaagtgaaaaactatttctccttttcagtcattctcagcaaaaatcgacatagagctgctagtctacctatcaacttctgtacttccttcaggttttacaggctgcgtatggcaatgactgctttgcatttgtctggagtttgtcaaatatctctgccaagacttttggatgatcgttgggtatgtggcgtcgacattcttcagaccgaaaggcatgactttgtagcaaaagttggcatcttcgttgatgaatgtgttgttgacaagttgatcgatgctaggaagcaggtatatatcctttgggcaagccttgttgaggtcggtgtagtcaacgcacatcctctatttcttgttggatttcttgatcatcacgacattggacaaccatgtcgacttttgtcaccgttgtgccacgggtttggctttgggaaaaatggagattttgtggcatatgaaattggggtatatgtcgagcatgttaggggtgctccatgcgaagagatcagcattatgtgtcagcacgtcctcgatccgtctctgaaggtgttcatcaagtctttccccaatcttggtgcgttggcttttggcataacatttacgggcttcaacttggttggctttgacaatgactatgtcgccactttggttggggaacttcattgcgaggtgtcagtgtcaatgagaacatactacacgagtaacgttcttgataactctcctcttccaaaggtggttgctagatctactacaccatgggactttcctgacatcccaattagcgatgccaactataatcaccattgggtcgtcttgctcgggatcgactcctatgaagtcgacatcatgcctcttccgagccgtcttggtgctacctccgccagcgaagttgcctgcaatggtgttgatgacttcacttcttacccttcatcggctgctaagtctaagtgttcatcaggatcagaggtaccatcatacctttcaatgttcaacggtttccaagttataggattagaggctgctcatagtggttataggaggaaagttgaatgtgactttcttaggtgtgtgtctcggcatgggagggtggaggggatggggagcgaggtgaagatggtggtggtaggggtggcagaggtggctggtggattgcctccaaatcaaccttcattttcttccgtaattgatccatctgctctcgaatttcctatatggttgatgtctcagctcagtgttgaggttaggggaggtatctgcaaaagggactccaacgagcaaatcaatggtgctctgag

SEQ ID NO: 49667 - DNA, 288 bp, Glycine max
  Peptide Sequence Number=SeqID_166445
atggagggtaaaggaacatggttcctcaccaactcaacgatttgtgctacaatcatggaagctccaaaattttcttatacttggtggagtgggcctgatgcaagctcaattggagcttgtaggcctaggatcttcttcatcaatggattcctttgcttcttgaaagatgaatggcagcggaatggagaaaggaagagagagaggagacgccacttcaaggagaagatgagtctagaagaagctcaccaccataagaggccatggataagagcttggaggaagaagtag

SEQ ID NO: 49668 - DNA, 1095 bp, Glycine max
  Peptide Sequence Number=SeqID_166446
atgcttccttgcagtctaaaggataatggaaaggaagaattaacaaaaaccacatcacattttcagacttttttctctttctctgatatttctggcactgctaggcgccttttagctgagagtgagagtgagaatgaggatcaccaaccagcaacaggagaaaaacttggacactgtgctaggaagggcaaggttcctctattatctgtggaggcactgcatcaccttcatacatttatttttgtcctagctgtggcccatgtcacattttgtgttctcactgttgtttttggagggctaaaaatacgtgagtggaaacactgggaagactctattggcaatgacaataaaaatgaaacacaaccagttttggaacccacagtgactcatgttcaccaacatgcttttatccagaatcattttactggtcttggcaaagattctgctgttctgggttgggtgaaatcatttttcaagcaattttatgggtctgtgaccaaattagattatgtgacattaaggcttggtttcattatgacccactgcaaaggaaatccaaagtttaattttcataaatacatgatccgtgcccttgaagatgatttcaagaaagttgttggtataagttggtatctttggatctttgtggtcatcttcatgttgcttaatgtccatggctggcacgcatatttctggatttctttcattcctctcattcttctacttgctgtgggtgctaagttagagcatgtaataattcaattagctcatgaagtagctgagaagcattcagccatagaaggattttcatggatatttattcagttactatgtagctatagtaccctgccactttatgcaatcgttacacagatgggaacacactttaagaaggccgtatttgatgaacaagtgcaagcacgccttgttggttgggctcaaaaggcaaagaaaaaaggacaaagaggtgataatagccactctggccaaggaagttctcatgtaggtgctggaattcaactaggatcagtgttcaagaggccatctgtcccagaagacaatgttattgtcccaagaaatgatggacccgaatga

SEQ ID NO: 49669 - DNA, 454 bp, Glycine max
  Peptide Sequence Number=SeqID_166447
agtgtacatctacttgggttgtaatactgagaacaagagagggtacatctcttgtggatcagttcaagtggagggtacatccacttggttgttcaaagagaacaagggagggtacatcccttgtggatctttgcttgtaaaggattttacaaggttgttggaaatctcaagaaccggtggttgcttggggactgaacataggcacgggttgtggctgaaccatggcaacgaggttgggcgtaagggtcgtgctgatgtcaaatttggaggtggaggcagggcgacatcgaagaagggtggcggggttggtgcgttgatcaagcttgggttccatactcactttgttaactggatcatgatgtatgtgactgttgttagattctttgtcaatgtgattgatgagggactatctactctcattaaagatgctgagaagaggtgtgagcttcatcgg

SEQ ID NO: 49670 - DNA, 657 bp, Glycine max
  Peptide Sequence Number=SeqID_166448
atggcggacacagcctctaaagaatctaaattagatcaagaggatgagataaaagagaccaacctttgccttgagaatgagacagtttccaaagaaaaaattgttcgattggaaaactttcaggagttggaaaacaaattgaaagctttacaaaaggatctaaaagaagtaattgaacttcttgatcatgtgaaaactaaaaggtgtgatttggaaagaatgtgcacattcacacaaagatatgaagatcttgaaaagagtaaacataatcttagagtggaatgtgagaatcataaaaagtcagtgaagtttttgaataaaaaggtttcaaagaatggagctttagaaggttatcctcaagatgttgtaaaacttcatgaggaaattgactttctaaataccacattggccaaatttgttagagggacaaaagctttaaacaaaattttgatgtattgtagatgtctcacaaacaaatctggcaaggttggtcacatgacttcaaaatgcttggatttaactaagaagggaaagtccaatgcatttagatttaacaagatagaacccaaaaagatttgggtacctaaggacaaatatattcatgttgcagatgtctttgatagtaggaagaacacactcgtcatggtacatggatag

SEQ ID NO: 49671 - DNA, 1128 bp, Glycine max
  Peptide Sequence Number=SeqID_166449
atggagacaatacctccttggccatcactttacaattcttacagaccatcgaagcctcaaggagaactcaagagtgaactggccaaacaccctgtattcatagagctccaacagaaccttttgcaccaccctaagaattatcctgactacaacattactccggatttgattatgcaccaagggcgtatttggttacccgcagaattcaaattcattcctttaaaaattacagagtttcattcaacccctatgagaggtcacatgggagtcatgaaaactttggttgctatgtcttttatcagtgacgtcgcgaccatgggagttcctttccttggattttattgtggggctactggcatatcatgtaagccaacttcatggggaaaattcttaaattgggctgaatggtcctataatacttctcagcattcaggaacatgggtttttccttatgagatcacttatggaaagaaatcactcacaattcctcaatatgttacaaggatgtcaaaagtggaggctatggatgattttctggctaaccgagaggaggttatgaaacgatcaactgatgtaaagcacaaagacattgtttttaagtgtggtgattgggtgatggtcaaattaagacttcacaggcaatcatttgtttcaaacaccacacattccaagctcgcaaagaggttttatggtccttatcagattgttgagcagattggtaaggttgcttacaaattggatctgcctatagggtctcgcattcaccttgtctttcattgttccatccttaagccatttaagcaaacttccccttgtatgccattacctttacctgctaatgctggcaataacaaacctcttatttcacctgttactgttgttagtaccaaatgggattatgtgtcctcacctcccaggctgttggtgcttgtgcaatgcgaaggtatgtccccagatgatgccatgtgggaaaactgggatcagcttaagctttacttcaaccttgaggacaaggtcgttttggatgtcgcggggaatgatatgaagagtaaaccacaacaagtggatactacaagcaaacccaagaggaacatatcagcaccaaagtatttagcagattataattga

SEQ ID NO: 49672 - DNA, 129 bp, Glycine max
  Peptide Sequence Number=SeqID_166450
atggagatttcacctggacaatcagtacgtggggtgcttagagataagagatcttcggttgctggtattgatatgaaagctcatactgtgatgttgggaatggccccgaagtctaagtatttagagtaa

SEQ ID NO: 49673 - DNA, 767 bp, Glycine max
  Peptide Sequence Number=SeqID_166451
atggcaatgttggaagcatccatttcaaggacaaacagaattaagaagtcaagtcgtagtaacacaggggtagacaaaattggcatcatcaattggttgaaggcaagtagggccgaggaaggccattcaaaattgtcgcggattaacaagagaccagttctactccttgtgatgagaccatatgacccaaatattccacttgcgtttgaccgaaggaacacttggataactttaggaagaactttccttctagaagtacctaaaatgcttgttccagaaggaggtagggaagtgggctttgtgaaaaggaattcgaatttggctaggagtgaggctattttaaggctccataactcgactggaacagaggaacttcatggtgaggtcattgaagtccgtcaatacgggtcccaaggtcttcaaccattggacaccgagaaccaaatcagcaccgcaaagggttcctcaggtgataatcatttaagggaaggagggggtgagttcttggttgctggggaagaaagggagatgggtggaagtaggcgcggcgcctggacttctcatcggactattgaagacaaccctgaaatgaggcaactcaagagaaatggaaagggaagtccaactatgcgatttacgagtgcttcaaactcaaaaagcgggtctccaacgcttgtagaaaccccgaccatgacaccaattgaccatttcacgacatccaccggaaccgcaccagcgctggcccgtccatgtagaatgatgcattt

SEQ ID NO: 49674 - DNA, 392 bp, Glycine max
  Peptide Sequence Number=SeqID_166452
ataaccactcaggtatttccgcccgtcagcgtgactcaaaagtcagtatgacagatcttgtaagtgcggaagacgatgtaaatctccgcgtgtcaacgggcttgtcggccgcgattgacgaagggtgcagaatgaccataatttgtctctgcgtgccatcggacacgactgtgtctgaatggcaaagggacttgaaaaagtctccaccggaagatgctgacatctccggaaagggcgcagatgaccacattggcctctgctcatcaatcacacttggggctaccagctcttgggtcatggtaacagaaagcggtgtggtcgacaaaagcgaggctcttgctcctacgtatcctccatcgaagaggaactcagacctacgtagttctggataa

SEQ ID NO: 49675 - DNA, 300 bp, Glycine max
  Peptide Sequence Number=SeqID_166453
atggcttcctatggtggtgagcttcttcttgactcatcctctcatcgaagtggcatatccaatcatctttcttccttctccattccgctgtcattcatcttcaagaagcaaaagactccattgatgaagaagatccaaggccttcaagctccacatggagctacatcaatcgtgctatttgcaatcaaaatgttgtgctctattcctagaaacataatgcaaagcggaatggagaaggaagagagagaggagacgccacttcaaggagaagacgagtctagaagaaactcaccaccatag

SEQ ID NO: 49676 - DNA, 342 bp, Glycine max
  Peptide Sequence Number=SeqID_166454
atgcacgacgagatcggagccgtgcgtttggaggctgcgacggaggtcggagacggaatggatgaggaaggcggcgcgataggggccggtcttgtcaaagtcaggtgccgacttgctgtagttggaggggtcgaagcagtagacgcgaaggacgaagagggagtcgttgttggcgacagtgaggcgctcattgtcgaggaggcggaggtcattgcagaaccagacgagggcggcaacgttggaaaggtcgcgagggagagaggggcgtggagggaattggcggagatggtggatctgaaggagaaggagtggtggtggagagagaaaggctcaatcctgtaa

SEQ ID NO: 49677 - DNA, 201 bp, Glycine max
  Peptide Sequence Number=SeqID_166455
atggtgtggcatctccaatcatctttcttccatgttcattttgatgtcattgatctccaagaagcaaaggactccatcgatgaagaagatctaagtcctacaagctccacatggagctacatcattaagaagagtaaatctatattgaggcagccccataaaatcacaggcaaaataatgagagcaaaaagaatggactaa

SEQ ID NO: 49678 - DNA, 1497 bp, Glycine max
  Peptide Sequence Number=SeqID_166456
atgctcggttggatgaagtccctcgatccgaaaatcaacggtatcaccggttcagagtctaacccgatttccacatccaatcccaactcgaatctggttcaattctcggaccagtcggtctatgttgacccggacccaggtcactcgatccaagacatttacgagcaaatcttcggagagccttggagcgaagcctcaacggcaaagaaattgccaccgaccatgcaaggctttgcccaaaatgccgggaggcaagcagtgccaaagaatgcgacggcgacgatgatggagacggtaatgaatgggttcaaaccggatttaattccggtttataaagagttagttaaggaatatgcggtttgtgactgttggttcgcttcggttcccgcttcgacccaaccgaaccggctctatgtgcattctgccacgtcacatgggttgacaagtaatgacaccaataagcttattgggggtttgcctcaaaagacgatatttgattctttggatgaaaatgggttcagttttgggatctattatcagtctccacccgccacccttttctataggaatcttaggaaactgaaatacgtagataacttccgtccattcgatttgttcaaaaagcattgcaaagaagggaaattaccaaactacgtggtgattgagcaaagattttttgacttgttatcaataccagggaacgatgatcacccatctcatgatgtttcggagggtcaaaagtttgtgaaagaagtgtatgaggcactaagaggtagcccacaatggaatgaaacattgtttgtgattgtatacgatgagcatggagggttttatgatcacgtgccaacccctgtggaaggagtgcctagtccagatgatattgtgggccctgaaccattcaagtttcagtttgatagacttggtgtgaggattccagccatcattgtttctccatggattgagccaggcacagtgttacacggaccttcgggaccatccccaacatcacaatacgagcattcttctataccagcaactgtgaagaaaatattcaatttacctgaatttctaacaaaaagagatgcatgggctggaacatttgaaggtcttttaactagaagcagcccaagaactgattgtccagttaaagagagagtgaaattgcctgaacctgtaaaactacgagaagctcctgctcaagaaaaggccaagttgagtgaatttcaagaagaattggtacaaatggcagcaactctgaatggggatcatagaaagagtatataccccgacaagttaactgagaacatgagtgttccggacgcagttaaatatgttgaagatgcattcaatacattcttgaatgagtgtgagaaggcaaagcaaaatggtgctgatgagtctgaaattgtcgattgtgctgatggatgtagtagtgcaccacccgattccaaaaatttcttttacaatgtgctgtcttgtataacatgtaatcgataa

SEQ ID NO: 49679 - DNA, 504 bp, Glycine max
  Peptide Sequence Number=SeqID_166457
atgacatttctaggagaaactagcagtcagacgattgtcaactcaaggttggctttcatttatccaaatggatcgattattcacaatgatactggggtttacttccaaacttcaactccggtgcccattcgagtaccaaataggtgtgattttgcaagcctaaaaaccagaatacacaatacccttcagctatccaacaaacaatttttggatgaaattcactaccggaagccattcaccgatacaggtaaccaaattcgctttgagtgtatcaaattgataaatgatgacgatgtcaacacaatgttaatgtgtaatgatcaattttcttgtgttggtccgattgagttattatgcaccgttggaagaacaccagatggaataataaacttacttgaacgcactatgcctcgtattcatgacgcgatcctgtattacaacgggaaatggaacatgccaccgcagaacaaatttgttggatgcgcacttatgttttttatgtaa

SEQ ID NO: 49680 - DNA, 339 bp, Glycine max
  Peptide Sequence Number=SeqID_166458
atggatcgagttacatcgctgctccgtctactgccaaacacatttaggactgttgatccgctaccagcaccattgctgaggtggacctgcccccccatatggtctcaaccaaataaatcatccaaccccagatatggtaggtctggaaggcaaagagttgggaggtacgagcggccttcatttagtgcgaaaaacaagcatgccttcccaccatatggcttgcctcccaactatacgccacccaatgtggcgtacactcccaatgagaatgtcaataactccactcctatactcattcagagccaacaacctcaatctgatcatgcacatgtctcttga

SEQ ID NO: 49681 - DNA, 414 bp, Glycine max
  Peptide Sequence Number=SeqID_166459
atggcttctatcacggaggccatgctaaagattcaaaaaactatagaagataatgctacggcagccgcttccaatacagctagggaagcggaaccgaggtatagtcctcaagcctacccttatggtttgcctccagacttcactccccgtaccgctctagacgatttgagccaagcccctaccttcgaggggcagctccctcctcatgccgactatcctctacaggaagatgatgaaggagatgcccatttaggccctctacttcccctcaaagaaccggtcccccatgagttgccccaaccaaacatagtccgccacgtcccgtctccatccgcacccgttaaggaactcgttcccattgcaaaagacaagggaaagattgatctacttgaagagaggctgagagcggtataa

SEQ ID NO: 49682 - DNA, 171 bp, Glycine max
  Peptide Sequence Number=SeqID_166460
atggttcagagaaattctaggatgtcacaaagagcgagatcagtgcgttatgcgcaacagttgtcttcagccaggctcaacgcatcactggcgttaagctcaaatccacttactcgtgctaagcgagaggctggcgctaagcgcaatgtcacagattcagagcctacttaa

SEQ ID NO: 49683 - DNA, 492 bp, Glycine max
  Peptide Sequence Number=SeqID_166461
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcagaccatttggagtagtggcagactttgaccaggacgtcttccactactccaaatggtctagcgatggagcgatctgcgagctggagtgtcatcctagtggagtcaatttttag

SEQ ID NO: 49684 - DNA, 234 bp, Glycine max
  Peptide Sequence Number=SeqID_166462
atggaatccaagtctggatgtatcatgatgtgcaattacagagatctggtgggagatgaggtcacatcagatgtgtgggaggtaggaatgaggttagaaaaggaaagaactgatgcaatcctccctaggaaaggaccagtcactagagccatgagcaagaggctccaagaggattgggctagagctgctgaagaaggccctagggttctcatgaacctcagggtagatttctaa

SEQ ID NO: 49685 - DNA, 360 bp, Glycine max
  Peptide Sequence Number=SeqID_166463
atgcttcattccatgctccagagcatccacagggtgcagtccatcatcatgcagagccttcagggcttgggcttgccatccattatgagcatggatgagttcgatgtgcaggtggcctggccaggagcccagccttctccttctggagggggtggagcttctgtagcccaggagcctgttcctgaggagccagcagcagcagcagagggggaggatgagctcacccctcctgagcccttttattttgatgcaggtgtacacatggctctagaggaggagaagtctacagaccagatcccagagccatccccagcacccatacctaatgatgccataccatctgcaccagcatctgagtaa

SEQ ID NO: 49686 - DNA, 411 bp, Glycine max
  Peptide Sequence Number=SeqID_166464
atgggtgaaggaacaaggagagaagcttttaaaaaaataagcgaagggtacaaggttggaggaggaataagggttaatcctaagaggaagaggtttgcagtagtaggcggaataacgattagcaaagagggaatatctttctcctattcgacctacaagaaaccatcgctgaactcaaaagatatcatactctacttgaggaaggtaataaaggacgagaagaccgtgatagtaatggacaacgctagaatgcacggtaatgaagtgagggaattccttgaggaaaatggcgtggagtttgtttacctgccgccttactccccggataagagcccagctgagggaccttgggtggtcctcaagaaaaggctctactcgaatatgtacacggacttcgagaccttaacgtga

SEQ ID NO: 49687 - DNA, 173 bp, Glycine max
  Peptide Sequence Number=SeqID_166465
atggggaattggcgaagagcgctatgcaataacttcctggggctccatactggaaggtggaggatgcatgaacagcacttggcaataacattcatggggctccgaaaaaagtggagaatggagaattggcgaacagcgctacgcaataacttcgcggggctccagactcgaag

SEQ ID NO: 49688 - DNA, 399 bp, Glycine max
  Peptide Sequence Number=SeqID_166466
atgcataccaccacaactccaatctccccctgtcgaagagtcaaggatcgcccctacaagacactcagtgggcctggagaagtccaacagggtcttggggtttccatctctgattatgagcctcttattgcacccccaggcaagcgcagggcgaggcatcacagtagcgggcaacagacgcaccgccaccacctccagagtccacctcagctcatctacaaaggctggagcgttgcctatgacacgtggccgactagtaggcaaccaaccacttgggcagctacgagcaggtactgggcctgtgatcgacaaattgtcatcacgcgtccggctcaagacgttaaagaagcgctactaggaggcaacctagtaccttttaaatttctgcttgttatttga

SEQ ID NO: 49689 - DNA, 222 bp, Glycine max
  Peptide Sequence Number=SeqID_166467
atgactactctagacatttttaagagtttcaaggctaaagttgaacttcaacttggaaagaaaattaaggttgtcaaatctgaccgtggtggcaaacctagcataaacggtgttgcagaacaacaaaaccaaactctgaaggatatagagacaagtatggttagtcattattctttgccagagtcattttggggagaagccttaaagaccgttgttcgctaa

SEQ ID NO: 49690 - DNA, 426 bp, Glycine max
  Peptide Sequence Number=SeqID_166468
atgaccggaaggcttcttgctggttctttggcttttgaaagtcgcatccttcgttatctcattgtgcgtattttgctttcaagatcttcaaaccttgcacaggcatcgcgattaaatgctccattgccatatccacacctaataactctcttccttcaacactttaatatccctcttgattctgaaccttatgttccaatcaagagatccttcttaatcggtgtcattgtgatttcatcttttggttaccgtaaagagcatgatggctcttgggtaaaaaagggtgctcaacccattgatgaagaaggaaacttaccagtaggagaggattcctctcttcttcaaaggattttggataggttcgatggtcttcaaacctttgttggtgaaaggtttgatgctttggagttacaagtggacatgtga

SEQ ID NO: 49691 - DNA, 381 bp, Glycine max
  Peptide Sequence Number=SeqID_166469
ttagtcactcttgttcttcgtcactttcaaattcctcttgatgatgaaccttttgttcaagtcaagagatctttttccattggtgctggagtggtaacttttttttggtaccgtaaggatattgatggacagtggattaggaaacaagatttaccactacggattcctgatgagcgtactccgtctcctctgccacatagagatgcttcctctactcttatgcatgaagtcctttctgaactacgtggccttcgaccgttcatagatgaccatttggatgccatggatgcttattttgaaggcatggatacacagattactcagcttgaagatgacatgggtttcattcgccgttgcttcgatccaccagctgccccatag

SEQ ID NO: 49692 - DNA, 222 bp, Glycine max
  Peptide Sequence Number=SeqID_166470
cgagaattcgctaagcgcgacactcagtggctaagcgcaaggaagaaaccagaagatgatgagttgtcaggttcgctgagcgcaccgctccaggtcatcaagcacaccgcttcagctcattcgctaagcgaaagaagtgcgctaagccacaatccacttatgcatgctaagcgattcaaaattacgctaagcacgcgagcacggaccaacccacctatttaa

SEQ ID NO: 49693 - DNA, 306 bp, Glycine max
  Peptide Sequence Number=SeqID_166471
atgtcacgaaacctcacggattacgcaatcgtcccctctttggcttccggaatgttacggaattttacggattgcgcattaacactccctttcaactcccgacatgtcgcggaacttcacggattgcctaacgatgggtgtcaagtacctcgaaatggtcaagcgaaggtcacatcccaccaaacagatggtcctcggatgaaattaggacttgattgtctctggatagtgaaaaaaggtgcaggaccatatggtttctccgcatgtcattgggctcgtcgcctctggatgacaaaagacgcataa

SEQ ID NO: 49694 - DNA, 126 bp, Glycine max
  Peptide Sequence Number=SeqID_166472
atggtagaggcttgtgtggaattgacgagcaaggacaaaaaggaatcttcaagtgacgcggcgaggaatccgcgagtatgtgatttgtggttgatgtctctattaaagattctaatagatatgtga

SEQ ID NO: 49695 - DNA, 202 bp, Glycine max
  Peptide Sequence Number=SeqID_166473
ggggctgttctgagggtctcggatccccctggtgatgtatttcagctgttttgggtgaaaaaaaattgtttccatgaagaaaatccaagtcgtggtgcttccgtaacgcttccgagatgtttccgtaagcaaatccgtgaaggttttcctccgttcttctccgttattcattgttcttcatccattcttcgttcttcaacgg

SEQ ID NO: 49696 - DNA, 214 bp, Glycine max
  Peptide Sequence Number=SeqID_166474
gccattcgacagggagactcggaagttgcggagtcttggtttaatcaagccgctgaatattggaaacaagctatagccctaacccctggtctctttgtatgtgttgtctggaaagaggaggactcaatgattattcgttcaccggaaccagaagtgaaaattttggtagatagagatcccataaaaacttctttcgaggaatgggcaaaaccag

SEQ ID NO: 49697 - DNA, 288 bp, Glycine max
  Peptide Sequence Number=SeqID_166475
atgaccggaaggcttcttgctgattcattggcttttaaaagccacatccttcattatctcattgtgcgtattttgcttccaagatcttcaaaccttgcacagagatccttcttaatcggtgccactgtgattgcatcttttggttaccgtaaagagcatgatggctcttggttacaagtggacatgcgattcgatgagatggattcaaggatcaccaaggttgaaggagatgtctcttacatccgcacatgctttgatctaccaccaccgccaccaccatcatcttag

SEQ ID NO: 49698 - DNA, 234 bp, Glycine max
  Peptide Sequence Number=SeqID_166476
atgtggcggaaaccaaaaggaggtgttgttacgcaatccaaggcggttgcttctggaggaagcaaccttgctcgcctgggcgagctgggtggaaagctcctcccctattttgctataaatagggggaggagtgaacgggaaaggggttcagccttcttgacacttcgtattctcttgaaattactgaggaaaattgtttccgtgaagaaaatccaagccgaggtgcttccgtaa

SEQ ID NO: 49699 - DNA, 222 bp, Glycine max
  Peptide Sequence Number=SeqID_166477
atgaagtataaggctaagacaagaaagaggccttcgaaccattgggcgattcgaactggtgtatggtcgagtcgaagtcaaggcagcaagatttctggacttagcacaatttctgacaaaacttcacaaaaatcagttcgacttcgagcaatgtggataaccgttctaaggagcagttatgtgcatcatttcgatcctgtcaaacaattttacttcctgtaa

SEQ ID NO: 49700 - DNA, 354 bp, Glycine max
  Peptide Sequence Number=SeqID_166478
atgccaaaatttgtagatcaggcttctaattcagacaaaaacacggtttccgagagacaaattcagttaaacacggtcgacccagttgaggaaaaggcaaaacaaaccaacccagaagcacaaaatccaaacttgaacacttcagatctgtggcgaggtctgctcaagcggtgcgagtccgaaaggaagacttgggtgtggatttataggcataggtgtgagacgggggtgggtggggggtgcgttaaaagacggaaatgcccctatgcagcaagatctgagttagattcatcactcgtacacttcccgtttctagtgtccacttggacggtccagattggatctgggaaatga

SEQ ID NO: 49701 - DNA, 1963 bp, Glycine max
  Peptide Sequence Number=SeqID_166479
ccagtagtactaccacctccaccacaaagtcactgtcccccccttcttcaccctccactacttcctcctctgacgttgagcttctcttgggaaagatcaaagcttcactgcaaggtagtaactctgacaaccttgttttgtcttcatggaactcctccaccccactttgtcagtggaaaggcctcatatgggtcttctccaatggcactcctctctcatgcactgacttgtcctctcctcaatggaccaatctcacactcctcaaagacccttctcttcacttgttttccctccggctcccttctgcaaacctctctggttccctccctagagagcttggagggttccctatgctccaaagtctctaccttaacattaactcattggagggtaccatccctcttgagcttggttatagctcctctctctctgagattgatttgggtgacaatatgctaggtggggttcttccaccttctatttggaacttgtgtgagaggcttgtttcccttaggctccacggtaattctttatctgggttagtttctgagcctgcattgcctaactcttcttgcaagaatctgcaggtgcttgatttgggtggcaacaagttctctgggagtttccctgagttcatcacaaagtttggtggcctaaagcagcttgacttggggaataacatgtttatgggtgcaattcctcaaggcctagctgggcttagtcttgaaaaattgaatctttcacacaataactttagtggggttttgcctttgtttggaggagaatccaagtttggtgtggatgcttttgaggggaatagccctagcctgtgtggaccacctctgggaagctgtgctaggacctctacactgagttctggtgctgttgctggcattgttattagtctgatgacaggagctgtggttttggcttctttgctgatagggtatatgcagaacaagaagaagaaggggagtggggagagtgaggatgagttgaatgatgaagaggaagatgatgaagagaatggtggtaatgctattggtggagctggtgaggggaagctcatgttatttgctggaggtgagaatttgacattggatgatgtgttgaatgcaactgggcaggttttggagaagacttgttatgggacggcttataaggctaagcttgctgatggaggcaccattgctttgaggctgttgagagaaggtagctgcaaagacaaggcttcttgcttgtctgttataaagcaattggggaaaattcgccacgagaatttgattcctttgagagctttctatcaggggaagagaggggagaagctccttatttatgactacctgcctctcagaacccttcatgatcttttacatgaagctaaagctggaaaaccagtgttgaactgggctaggcgacacaagattgcgctgggcatagcgagaggtctagcttatcttcacacaggacttgaagttcctgtcacccatgcaaacgtaaggtccaagaatgtgcttgtggatgacttctttacagccaggctcaccgattttggtcttgacaagctgatgattccttccatagccgacgaaatggtagcgcttgctaagacggacggctacaaggctcctgagcttcaaagaatgaagaaatgcaactccaggactgatgtttatgcattcggcatactgctgcttgaaatcttgattgggaagaagcctgggaagaatggaagaaatggcgagtatgtggacttgccttcgatggtgaaagtggcggttttggaggagacgacgatggaagtgtttgatgtggagcttttgaaagggataagaagccctatggaagatgggttggtgcaggcgctgaagctggcaatggggtgctgtgcaccagtggcatctgttaggccaagcatggatgaagttgtgaggcagttggaggagaatagaccaaggaacag

SEQ ID NO: 49702 - DNA, 483 bp, Glycine max
  Peptide Sequence Number=SeqID_166480
atgcagggttactttatggttactcgcaccattcgtcaaccagggtcaaacgagcccgttgacgcaactagactaacatcgtcttctgcaccttttgtcgccctgacccgtgaatcaattgacatgcggggttacccaatgtttacctgcaccattcgtcaactaggggcaaacgagaccattgaggcccggagactaacatcgtcttctgcaccttttgtcatcttgacccgtgaagtcagcaccgttggtcaaccagtggcaaacaagcctgttgacgcacggagactaacatcgcggggttaccttatggttacccgcaactttcgtcaactaggggcaaatgagcccattgacgcagagagactaacatcatcttctgcacgttttgtcgtcctgacccgttcagtcaggggcaaacgagcccgttggcgcgcggagattaacatcgtcctcgacacctttttccgtcttgacccttga

SEQ ID NO: 49703 - DNA, 756 bp, Glycine max
  Peptide Sequence Number=SeqID_166481
atgtctgcttccactgttgttcacaatttttgttccgtcgcttgttgcatttcaaattgcggccataatacccatcatcagtttcattcacccaattcccttttgaggttaaagaagcaaactttcctcacgaacatttacttcaagagttccagaacccagaaacctcgctccagttttgtagtttccgcagcacaatcgaattttgttaaaggatgttatgaactattttcccatgtcaagcatatgcataacaatgacagtatgccaaggattattggggatagagatggcaccaaactatcaagtctcaagaaattgaatgcatggaaagttggtagggatggaattgaggcaggcactaatctcgttcctaattctgttccaaggccaatagcaaggatttcagtaacaattgtggctttgagtgttacgctttttgtactcaaggcattcctctctacagctttctttatattggcaatttttgcttactaccgccgcttgaatattgagagagacactgagacaggccgacagactgagagtagcggttttgttaatcacatactagccataccaagttatttgaagggaacttgcacaagaaaaagggatgccactataggacttgcatactttgcgtacctagcattcaataaagatcaaggacctagcgggaacggaggaactacctctactcctatggatgatcctgtggaagaagctagaaagataatggaaaaatacaagtag

SEQ ID NO: 49704 - DNA, 321 bp, Glycine max
  Peptide Sequence Number=SeqID_166482
atggactggcccctggggcccacggtccgcgagggtaacggactgatttttttaaacagtccatggttatatagtatttttaggcctgccctgcttaacccgtgggctatgcaggcttgcagcatttcttctcaccttcttctcctcacggttgaagcatttcttctccacatgatagaacgcgactcatgcagtcacgtgacacaccgcagccttgggccaccacgcaagattttaaatatggattctttcgaagttaatgttgatgagaataacaatgagagtattgatgtggatgtgcatgaaaaatgttattcatga

SEQ ID NO: 49705 - DNA, 3408 bp, Glycine max
  Peptide Sequence Number=SeqID_166483
atgccgaggcaagccttgaacaaccaaaaccacaaccaaatgtcgaggcaagctttcatcacaaaccatcaccaccaccttctccatgttcttctctttacacttcttgttcctatttcctttgctgcaaatgatgaagttagtgcattggtttcatggatgcacagctcctccaatacagttcctttagctttttctagctggaaccctttggattccaatccttgcaattggtcctacatcaaatgctcttcagcaagctttgtcactgagataaccattcaaaatgttgagttagcccttcccttcccttcaaaaatttcatcctttcctttccttcaaaaattggtcatttcaggggctaacctcactggagttatctcaattgatattggaaactgccttgagcttgtagtccttgaccttagctcaaatagtcttgtggggggcattccttcaagtattgggaggctcagaaacctgcaaaacttgagcttgaactctaaccatctcactggacaaatcccaagtgagattggtgattgtgtcaatctcaagacccttgacatctttgataacaatcttaatggggatcttcctgtggaactaggaaagctgtctaatctggaggttataagagcaggagggaacagtggcattgcagggaatattccagatgaacttggcgattgcaagaatttgtcagtgttaggtctggctgacactaaaatttctggctcattgcctgcttcactgggtaagttaagcatgcttcagaccttgtctatttatagtactatgctctctggtgagattcctcctgaaatagggaactgctcagagcttgtgaacttgtttttgtatgagaatggtctctctggctccctgccaagagagattggtaagcttcagaagctggaaaagatgctgctgtggcaaaatagttttgttgggggcattcctgaggaaattggcaactgtagaagcttgaagattcttgatgtctccttgaattctttctctggtggaatacctcagagtttggggaagctctcaaatcttgaggagcttatgctgagtaacaataacatctctggttcaataccaaaagctctttccaatctcacaaacctcatacagttgcagttggatacaaatcagctatcaggttcgattccaccagagcttggaagcttgacaaagctaacaatgttttttgcttggcagaacaaacttgaaggtggcattccatcaacattggaaggttgtagaagccttgaggctttggatttgtcatacaatgcactcactgatagcttacccccaggcctgtttaagcttcaaaatttgacaaagcttctgctaatctctaatgatatttctggccccatccctcctgagattggaaaatgcagttccctcattcgcctccggcttgtagacaacagaatcagtggggagataccgaaagaaatcggcttcctcaatagcctcaatttccttgatctgtctgagaatcaccttactgggtcagtaccacttgagataggaaactgtaaagaattgcaaatgctgaatctaagtaataactccctttctggtgctttgcccagttatttgtcttctctcacaaggctggacgtattggatctttccatgaataacttttctggtgaggttccaatgagtattggccaactcacttcacttcttagagtcatcctaagcaaaaactctttctctgggccaattccctcctcacttgggcaatgttcaggtcttcaactgctagaccttagcagcaacaaattctcagggaccatcccaccagaactgcttcaaattgaagcacttgatatttctctaaattttagtcataatgcattatctggagtggtcccaccagagatttcttctctgaacaaactgtcagttctagacctttcacacaacaaccttgaaggtgacttgatggctttttcggggctcgagaatcttgtttctctgaacatttccttcaacaagttcacaggttatctgccagacagcaagttattccaccaactatcagcaacagatttggctggaaaccaaggtttgtgtccaaatggtcatgattcatgttttgttagcaatgcagcaatgacgaaaatgataaatggcactaattcgaagaggtcagagataatcaaactggccattggattgctcagtgccttggttgttgcaatggcaatcttcggagctgttaaagtctttcgagcaaggaaaatgattcaagcagacaatgattctgaggtgggaggggattcatggccttggcagttcaccccattccaaaaggtaaatttctctgtggaacaagtgttcaagtgtttggtggaatccaatgtgataggaaaggggtgttcagggattgtttatcgcgctgaaatggaaaatggggatatcattgctgtgaaaaggctatggccaacaacatcggctgcaagatatgatagtcaaagtgacaagttagcagtcaatggaggggtacgcgattccttttcagccgaggtaaaaactcttggttcgatccgccacaagaacattgtaagattcttgggttgctgttggaacagaaacacaagattgcttatgtatgattacatgccaaatgggagtctaggaagtctgcttcatgaacaaagtggaaactgcttggaatgggacataaggtttcggataatactaggagcagctcaaggtgtggcttatttgcaccatgactgtgctcctcccattgttcacagggatattaaggccaacaatatcctcataggccctgaatttgaaccatacattgctgattttgggcttgcaaaacttgttgatgatggagattttgctcgatcttctagcacactagctggttcctatggttacattgctcctgagtatggatacatgatgaagataacagagaaaagtgatgtttatagctatggtattgttgtattagaggtactaacagggaagcaaccaattgatccaacaatacctgatggactccacattgttgattgggtaagacataaaagaggtggagttgaagtgctagatgaaagcttgcgagctcggccggaatccgaaattgaggagatgttgcagaccttaggtgtggctttgctgagtgtgaactcaagcccagatgacagaccgaccatgaaagatgtggtagcaatgatgaaggaaattaggcaggagagagaggaatgtgtgaaagttgacatgcttcttaatgcatcttctgcaaatgagcaacaagaaagaaatcatctcactgaagaaccaatgtcaatgataagcaccagcagcacaaatctgcatctgcattactctccccatcgccctcaaacaccaaagtaa

SEQ ID NO: 49706 - DNA, 207 bp, Glycine max
  Peptide Sequence Number=SeqID_166484
ctctacgaaggttccatctacagagcaggtggagaaggtcggcgggcttcatccaagtccctatcggaggctgtggcaataggagagtttggccagaaaaaaggtcacgctttggcctatcatgagataattagtttatgcacgtggtggagcgggcagtcttatgccctggaggctagaaccgttgaccttgaggatgaagcatag

SEQ ID NO: 49707 - DNA, 179 bp, Glycine max
  Peptide Sequence Number=SeqID_166485
ggccaaatgcttgtcaagaaggagggaatgatgtgggcatcaaagcccaagcccaagcccagatggaagcccaagatgcaatacaaggcctagaaggacccatgacaagagcaagagctaaaaaggcacaagaagctttggaacatatggtgattattctgagggcagttcaaatgtag

SEQ ID NO: 49708 - DNA, 261 bp, Glycine max
  Peptide Sequence Number=SeqID_166486
atgtcggcttggcagttccaacaaaagacttccctccaagtcacctactactgctcatccgcttccacaaacaaaagttcgagatcatcacaagccccaatcacccggtacaaaaattgcaaaggaaaactaggcagcaagtgtcgaggtcaccctgtcgtgcacaggcaactcccccctacgatacctgagtctcaaggaagttccaaatcaagtgagatgcccccaagtacaagtattttttctcatgaaaaactatga

SEQ ID NO: 49709 - DNA, 2391 bp, Glycine max
  Peptide Sequence Number=SeqID_166487
atggagtggctccaaacactgcctccatcctctcacatctcgccctccgcactctccttcctcgaccacaggctccacacgcagctcgccgttgccgaggctcccaccttcgccgccgagctccagactcagtgctccgagttggatcgctcgctcgacgagttgactcggaggctcggagctggtctctccgcctacgcctccttctccggcgaaatccacggcctcttcggggccgttactgataggctggtcgctctctcctccaccgtcgtgccagatggaggaagaggcgaaggggatggcaagggtttcagagaggaacttgcgactttggccaaggaagtggctaggttggagacggttcgtgtttatgcagagaaagcactgaaacttgatactttggttggtgatattgaggatgctgtatcatttaccatgagcaagaacataaggaaacattctagtcaaaattcacaagaaatgcatatgcttgctattaaaacactgaaaacaacagaagacatattaacttcaattacaaaagcacatcctcagtggaagcatcttgtatcagctgttgatcacagagtagaccgagctcttgctattttgaggccccaggcaattgctgagcatcgggcacttcttacttcacttggatggcccccacctctttctgccttaacctcctctaactcagatgcaagtactgcaaatcaagttgtgaatcctctactgagcatgcatgtggatcttaaagtccagtactctgaaaactttcttgctttgtgcaacctacaggagttgcaaaggcaaaggaaagctaggcaacttgagggccatgacagggaagttgctctacgacaaccactttgggtaatagaagagcttgtcaatcccttatcattggcttcccaacgacatttctcaaaatgggttgataaaccagaatttatttttactcttgtatataaaatcacaagggactatgttgactctatggatgaattgttgcagccattagttgatgaagcaaagttgcttggttatagttgtagagaagaatggatctcagcaatggtaacctccttaaccacatacttggcgaaagaaattttccctagttacattagtcaactagatggagagagtgttacaggaattcagtcatctgctagaatatcatggctacatctcattgatttgatgatagcttttgataaaaggattaagtctttggtagagcattctgggatcttgctatcctttgatgacgatatcatgcagaaaatttcttctctatctgtattttgtgatcgtccagattggcttgatctatgggctgaaattgagctaggtgatgtcctagataagttgaaaccagacatccaagatgagaataattggagaaagaaagttgaaggtgtggttctttcatcctatactgatgatcacaagtcccctctggtttctaatgcctttcttcgccatctagcatctgttattgatcgttgccgatcattgcctagtgtaagtttgaggtcaaaatttctcagattagcaggtattcctattataagaaatttttttgattccatacttatccgctgccaagaagctgaaggtttgactgccttaactgatgatgatgctgtaattaaagttacaatttctgtcaatgctgctcattactttgaatctgttctaaaggaatggtctgaggatgtctttttccttgagatgggaatggatgaggatgataaaacagaattggaaagtaattcaaatagttatggtgaagtgttgccagagagttccagaagggttatctttgatgatgagataaaaaagttggaagagttcagaacagagtgggttgaaaagatttccctagttattttgagaggttttgattctcattctcgagattatgtgaagaacaaaaggcaatggcaaaagggtgaagaaggatgggccgtgtcaaagactttaatacaagccctggattatcttcagagtaaaatgtcagtggtagaagtaagtttgaatggtagggattttattggggtttggagaagtttggcagcaggaattgatcaattgatttttaatggtatcctcataagcaatgtaaaatttcacaatagtggtgttgaaagatttggtagcgacttggatgttttatttggggtatttggagcatggtgtttgcgacctgaaggttttttcccaaaatcaagtgaaggtctgaagttgttgaagatggatgaaaatagactgcaagaatgtatgggaggggggaagagatggttgaaggagaatgggctcaggcgtttgagtgtaactgaagcagaaaagattttgaagagcagggtgttcacaagttga

SEQ ID NO: 49710 - DNA, 201 bp, Glycine max
  Peptide Sequence Number=SeqID_166488
atggctactccaatgagtactgcttgctacttggataaagatgaaaccgtaatcagtgaatttttagctggtacctcaagagaagtctctactctcaagcttctccaaatgcactcaatggcaataatgtttggcatcatcaaagccaaaaaggaggagattgttagagatagggggaggtacatgaagatcaagctatga

SEQ ID NO: 49711 - DNA, 192 bp, Glycine max
  Peptide Sequence Number=SeqID_166489
atggctatttataagaaaagccattttggggcaggggaagcttgcccaggttcacttgaagctcatgcatggtgtttgtcattgccccggtgtagggttcagaggaaacacaatcaatcgaatgtttattcaactttactcgtcggttatggcacccccatcaaacgtgtagaacgtgcaatttctgattga

SEQ ID NO: 49712 - DNA, 483 bp, Glycine max
  Peptide Sequence Number=SeqID_166490
atgagtccataccgaaattggtttgtggcctatgggaagaaatctagtggtaatgttctgatgggtaacaatgctcattgcaagacaattgggataggttctatacaaatcaaaatgcatgatgtaattgttagaatcttaaccaatgtttgtcatgttctagagcttaagaagaatttgatctctgtgggagccatggattcaaaaggcttaacttcaactgtttcacaagctggaagtcttgcgttcagtgataattctctatggcataagtgtctgggccgcataagtgaaatgagactcgaaattatgagtaagcaaggttactttgaaatcacaaggtggaacctctttagttttaatcaaacaacaaagaaagttaagcgtttgaggatgaacaatggcttgaaattttgcaaggatgaagatattgctagacaaaatattgttcaacatactcctcaacaaaatgaggtagcataa

SEQ ID NO: 49713 - DNA, 330 bp, Glycine max
  Peptide Sequence Number=SeqID_166491
atgcccccgactgtccctgttaatcattactccgatcccgaaggccaacacaataggatcagaatcctgtggggttatcccatgctaatgtatacagagcgtaggcttgctttgagcactctaattttcttcaaagtaccagcaccggaggcacgacccggcccagttaaggacaaggagcgcatcgccggcagaagggacgagccgacccggtgcacaccggaggcggaccgatcgacccaacccaaggattgggtaatttgcgcgcctgctgccttccttggatgtggtagccgtttctcaggctccctctccggaatcgaaccctaa

SEQ ID NO: 49714 - DNA, 431 bp, Glycine max
  Peptide Sequence Number=SeqID_166492
atggttgctgatagagcttgtccgcatctacaggtgtgggattctgccaagaaaaaaggatttgagctatattacaaagaagagatgcctataaggaagatgaaggtggagattgtgaacttgccgctgaattggagccctttgtttcatggaaagcagctgatacgtacttcaaacgctcatgatgctaggaccttttggagtcagattgtgtgggtgaagaagtttgacaaagatgttgttgttgttgttaaaaaagaagtttttgcctccatccaagttaaatcatttgctgaagttgttgacgacaccattgtgtgtagggttatcattgatcttacaaacattagtatcatggacaaaactggtgatacatcaaatgtagttgtggttgatgaagttgaaccacatattctagaccctgcgtccaa

SEQ ID NO: 49715 - DNA, 249 bp, Glycine max
  Peptide Sequence Number=SeqID_166493
atgtcctggactagagtgatgattgcttctcttttctttaccggtcattattccctcatgagtttgaacctgggtataaaagaagtggagctggaactggaggttgaactggaggatgaagcacttccagttcccccacttggaggtggcctttggacaggtgataaaatctgttggatgtctatctttggagccattggtatttggagagtggtaataagatcttacacaaaccctcagagaaactag

SEQ ID NO: 49716 - DNA, 225 bp, Glycine max
  Peptide Sequence Number=SeqID_166494
atgacaattactcacgcaatcaacaccattgcatgtcttccatggtggcattggcgaatggttctaccagaaaatgtagaagaactgtcacttgcagacatggagaaatcaagtgaagaagaagaagcaaagggtagaatctttacagacgagagaagttttacaaaccctaatttgaggaacacacttaagaacaagaagggaattcagaggacaaaagcttga

SEQ ID NO: 49717 - DNA, 243 bp, Glycine max
  Peptide Sequence Number=SeqID_166495
atgcctagcgctgttcatgtgtcctccacctacgagtttggagccatgcgtactgactgcttagtgcaattctccgtcctcgcctttttttcggagccccatgaatgtcattgcctagtgctgttcatgcatcctgcaccaacgagtctggagccccgcgaagagccccatgaatgtcattgcctagcgctgttcatgcgtcctccaccaacgagtttggagccatacgtagtgattgcttag

SEQ ID NO: 49718 - DNA, 177 bp, Glycine max
  Peptide Sequence Number=SeqID_166496
atggtgaaacacgttgcagtgttccaatcctacatttggccagcatgcatggtcttcagcatttcttcagtgacctcgtttcagtttttagagaagccatggtattggaggaagggaagaaggaaactagaacctgcaccaggatcattacatagctccatttgttcagtttcttaa

SEQ ID NO: 49719 - DNA, 690 bp, Glycine max
  Peptide Sequence Number=SeqID_166497
ttgcttgattcacacccatatcttgataaggtggttattccagttgctggtactttaactgctaccatattagcttggttcttgctgcctaggattttgaggaaatttcacaaatatgcaacgcaaggtcctgtttctctattgccagcaagcgtgtctgtggagccagttccttatgagaaaagcttttggggtgctatggaggatccagtgcgatatttagttaccttcattgcattctcacaaatttatatgacagctgactttgatttccagtggtgttatggtggctccaacaactataacctcacaatatcttgcacctctttggagggtcaaagtttacttgggcttgataaggagaaagtgcttgctctagacaaaatctcatctattggtctatttgtgattggtataatggctttggctgaggcttgtggtgtggccgtgcaatctgttgtgaccgttggtggtataggaggtgtggctactgcttttgctgccaaggacattcttggcaatgtgttcagtggtttatctatgcagttttcaaagcccttttcaattggagatacaataaaagctggctcaatagagggtcaagtggtggaaatgggtcttacttccacatcattgctgagttcggagaagttcccagtcattgtgccaaactcatttttttctagtcag

SEQ ID NO: 49720 - DNA, 471 bp, Glycine max
  Peptide Sequence Number=SeqID_166498
atgacgaacgacgaagaacggttgaaaatcttcgcgaggtccccacggaaacgttttggaaacattacggaagcgcctcggcttggattttcttcacagaaagaatttttccctctaattttaagtgatcccgaaacaccagaagggaaaataggggaggagcttgccacccagctcgcccaggtgagccaggttgcttcctccagaagcaaccgccttctggaggaacatcctaggcccaaagatacttgttttctttccgtaaggttacggaaccttacgggtcacgtaattacttcttttttggctttcggaatgttacgaaacctcacggattgcgtaacaatgcttccttttgatttctggcatgtcatggaacttcacgtattgtgcaacaaagggtgccaagtacctcgaagcggtcaaacaaaggttatatgccatgaaacaatggtccccggacaaaattag

SEQ ID NO: 49721 - DNA, 246 bp, Glycine max
  Peptide Sequence Number=SeqID_166499
atggaagaagatggagagaaaggagtattagagtcatgggagaaccttctacactctaggcatgagtggaacttgcaaggggattggctccctcttcatgatgaagttaagtctttcacaaagacatatcttgtgatcgccattagaaagaaccttcattcaaagaggttctcctttgagctgagggctccatctctaacaactagtttctggtggagcttaaaggatcttaaagaaagcttttga

SEQ ID NO: 49722 - DNA, 228 bp, Glycine max
  Peptide Sequence Number=SeqID_166500
atgactacattgcatcaaagacggcgaagaagaaggagaaaattattaattgaagtttggagcggaggtgcacgggttcggggtggaggtgggggcggcggagtggagcatttcgccgtacgagtggagcattacaacagtctcacgacacttatagatcacctcaagagtcttgttctgaatcaggatagtaagggaaatggattccttgtgaatgggaatccctga

SEQ ID NO: 49723 - DNA, 540 bp, Glycine max
  Peptide Sequence Number=SeqID_166501
atgataggaagagccgacatcgaaggatcaaaaagcaacgtcgctatgaacgcttggctgccacaagccagttatccctgtgggaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtctttccgccccggatcgaccggccgaagccgaccttgggtccaaaaagaggggcagtgcccccgcttccgattcacggaataactcccacttatcctacaccctctcaagtcattttcacaaaagtcggactagagtcaagctcaacagggtcttctttccccgctgatttccgccaagcccgtttcccttggctgtggtttcgctggatagtagacagggacagtgggaatcttcgttaa

SEQ ID NO: 49724 - DNA, 172 bp, Glycine max
  Peptide Sequence Number=SeqID_166502
tgctctgaatgtcaaagtgaagaaattcacccaagcgcgggtaaacggcgggagtaactatgactctcttaagcgaaaccacagccaagggaaacgggcttggcggaaatcagcggggaaagaagaccctgttgagcttgactctagtccgacttttgtgaaaatgacttga

SEQ ID NO: 49725 - DNA, 510 bp, Glycine max
  Peptide Sequence Number=SeqID_166503
atgcggagacacttcataagcccaagtctaagagccactaaaagggaggaagacgaagaggtccaagcccttaggacggaactcaagcaagctcaaatagtcaaagaaaggttcaaatcagcagctcttaaaatccgaaaggagaattctgaactgagagatataaatatagctaccaccaaggctttggaacaagagaccaagagggctcgtagggaagagcacggccggaacaagttccgaggggctctgtggggtagtaacaacgagcttaaactccggagggaggaaagggaccaatcgcgagtagacagtttgatcttgaaagatgaattgaaggcttgctcgaggtccaaaagaagtttgtctcagtggttatgcgagacagagaccaacatgttagctatcatcaccaagtaccaagaggaactaagtctagccacggcccacaaacatagagtggtggacgagtatgcccaagtgtacgcggaaaaggaggctagaggaagg

SEQ ID NO: 49726 - DNA, 251 bp, Glycine max
  Peptide Sequence Number=SeqID_166504
atggctcaggagcggacatggatgccttgtgtcttgttagaacaagtgcgaaaccaaccaaacacagagggcgggcaagcaacagatgatccgaaagcatcgattgctgctaggtccaccaaaccatccacgtaccttcgtggtaggcctgctatgccgttccgagtctgttttatgcggtccaaacctcttgctgaatccttgaccacaattgcaattctgctcaaagaggggagacacccggaggaaag

SEQ ID NO: 49727 - DNA, 237 bp, Glycine max
  Peptide Sequence Number=SeqID_166505
atggaagcaaaagcgcaaaaatggtggcctagggatgaaaaactgcaaatcccgtgggtgtttgcgtttttgaatgagaaaggagagttttgggtggagagaaactccccctccctcatttttatgtttctaggctgcctcccagttgcgctttccgcttgtccagagccgggcatgagacgacgatctattgatcgtgatcctggcctctacttgcgtccttccctaagtacctaa

SEQ ID NO: 49728 - DNA, 156 bp, Glycine max
  Peptide Sequence Number=SeqID_166506
atggaagcccaagacccaatacaagacataggaggacccatgacaagagcaagagctaaaaagtcccaagaagccgtggaacataagggagaggccaaagacttggaggcccacaagagagagttgctagtcctatatgttgaatgcttggaatga

SEQ ID NO: 49729 - DNA, 532 bp, Glycine max
  Peptide Sequence Number=SeqID_166507
gggggaggaggagcttggtcgtccgtccgcccgaggcacacacctagggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtg

SEQ ID NO: 49730 - DNA, 204 bp, Glycine max
  Peptide Sequence Number=SeqID_166508
atgtcattgcctagcgccgttcatgtgtctccattatcaagtgcgaagcttctggtgactgggaagcacgttattctgttgttttccagatcggctccttcgccaaaagaaaaaagatggagtggagacgagagtcgtcatcacagaaagggcaggacggacgaaatcagtgtcctatctttgctttcctcttatctccgatga

SEQ ID NO: 49731 - DNA, 318 bp, Glycine max
  Peptide Sequence Number=SeqID_166509
atggaagatgcactcgtgagtctcgcatcgccctcccgccgaagggtaggttgcgacaagtgccaaatgtacttaccaaaatctagagccgatctgatgtcaggattgactgtcgttggaatggactccgacaatctccaacgtcaaactcccaggtatcatccgtttgaggaatgggatagggtacctgcaaaagggactccaatgctcaatgaattcgccgatatcctctgtttgaggaatgaggaaggtacctacaaatgggacttcgatgctcaaatgctcgcgtatcagaatcatcacggcctaactgcctaa

SEQ ID NO: 49732 - DNA, 633 bp, Glycine max
  Peptide Sequence Number=SeqID_166510
atgatagaagtattggtagttgatgatgaaaagcatgttagaaatttaatttctaaaatgatttcaatatctttcgaatgtactcctgatgaagccgaaaatgtggaagaggctctccaagtgtgtgagaaaaagaagttcgatttgattacaactgacataaaatttggggataatgaggaattggacggtatagagttcattaaaagacttagacttcgtggaatttttacccccgttcttatcgtttcagcttacgctactgctgaaaagatagtagaagtttgcagatatttccctatagattatctttccaagccttttacacaggatgaactaaagaaaaaaataagaggtttgttggaagtaagaaaggatagtttcgaaagatatttgagagaagcggaaggatttatccattctaatttccctggagatttagaaaaagctgagcagattgtgagacatatgttttctataatgccatcttcacctatgccacactatcttatggctgaaatcttggaaaagagaggaaataccgaacttgctcaaaggcacagagaagcaggactagctcttgacgttaataaaaaaggttacagaagaggtgaaaacgttgagaacgattaa

SEQ ID NO: 49733 - DNA, 203 bp, Glycine max
  Peptide Sequence Number=SeqID_166511
atgaagcagtgacgccacatcatccagcattgtcgcaacgtgccttttgcggtcgagcgagggcgaggctcgcgggtgcactttccaaaggaggaaaggtcgacaaaagcggggcttttgctcctacgtaccctccatcgaagaggaaatcagacctacgtagttcttccttaagcgtgaatcaagcgattcttttactttga

SEQ ID NO: 49734 - DNA, 345 bp, Glycine max
  Peptide Sequence Number=SeqID_166512
atggcggtttccaaactcagaataatgcaaagccgcgagccaaaacggacggttccactccgatcaacgggttcctctcgttgtggagtttcaatagggaacaatggcggtttgtggtggttaatggtggctatgggtgatggagaaagagcttggaacattggaaatggttttggaagaaagaaggagaagggagtggcgtttttccaaagctacttggactacaaggctcaaaacatacaagtgactaatgccctcgggaaacggaaacgtcgcgcacactcctgccgacttctcaaagatcccaacgctcagatcgtgagcaactgttctgtcaagctgtag

SEQ ID NO: 49735 - DNA, 905 bp, Glycine max
  Peptide Sequence Number=SeqID_166513
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcagcattgttgtcgggagtttcatccctagcattatatcctgcgctggagatacacgagatgacggatggtttcctggcgctgccataaataccattgctatgaagaaaagatatggacggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 49736 - DNA, 773 bp, Glycine max
  Peptide Sequence Number=SeqID_166514
gactacacgtcctcgtcatcaaggggctacacgcccctgccttcgtagggctacacaccctcacttttcgaggactacatgtcctcaccttcagagggctacatgccctcaccttcatagggctacacgctctcaccttccgaggactacatgtcctcatcttcagaggactacacgtcctcaccttcagagggctacacgccctcaccttcagaggactacacgtcctcgcctttagagggctacaagtcctttccttcagaggaatacacgtcttcaccatcagagggctacacgccctcgccttcgtagggctacacgccctcgccttcgtagggctacatgtcctcaccttcaaagggctacacgccctcgccttcatagggctacacgccctcaccatccaaggactacatgtcctcaccttcagaggactacacatcctcaccatcagaggcctgcacgccctcaccttcagagggctacacgcactcgccttcgtagggctacacgccctcaccttccgaggactacatgtcctcaccttcagagggctacatgccctagccttcgtagggctacacgccctcaccttccgaggactacatgtcctcaccttcagaggactacattccttgccttcagaggacaacacgtcctcgccctcaccttctgaggactacatgtcctcaccttcagagaactacacgtcctcgccatcaaagggctgcacgccttcaccttcagagggctacacaccctcgcctttgtag

SEQ ID NO: 49737 - DNA, 413 bp, Glycine max
  Peptide Sequence Number=SeqID_166515
agcttcaacattcaatttcgagcgtctcgatatattacgagcctcaatcagacatccgagtaaaaagttatggtcgtttgtattggctcagagcttcaacgttcaatttcgagcgtctcgataagttacgggactcagtcagacatccgagtaaaaagttattgtcgtttgaatttgcacagaggttcaacattcaatttcgagcgtctcgatatgttacggggctcaatcagacattcgaagattcaacattcaatttcgagcgtctcgatatattacgagcctcaatcagacatccgagtaaaaagttatggtcgtttgtattggctcagagcttcaacgttcaatttcgagcgtctcgatatgttacgggacttaatcaaacatccgagaaaaacgttattgtcgtttga

SEQ ID NO: 49738 - DNA, 192 bp, Glycine max
  Peptide Sequence Number=SeqID_166516
atggtagaggcttgtgcggaattcgacaagcaagggacaaaaaggaatcttcaagtgacgcgacgaggaatccgtgggggtagctctactatagggtctttggcactagcttttggccacgttcatacgttggatgttgtgtatgatcgtggggggcactgtgcactgaccttccagggtctttggcactag

SEQ ID NO: 49739 - DNA, 431 bp, Glycine max
  Peptide Sequence Number=SeqID_166517
atgatccgttgcgtggcttgataaagtacagttgtgatatttatgacaagccagttgaaatcaactttgctgggagctgctttggaattgtagatgcacctacatcgatattcataacatattcagatgttagtaaaataatagctggagacaaaagtctgaacatatctgtcttacaattatggttaatgtatatgcatgagtggagtcagatattcagtcaaggttccatgtatgcattccttgagccacagtcgttggtggtttcaaaggatacacgcagcgaatgccaacaatatcttaaaagatggcttaaggaatctgaccgagaggtgtacattggaccttacttccatcatgtaatgacgaaattaaagacgaccttgtctcctgaaactaaggcagttgcacctaagtggattgaagttaag

SEQ ID NO: 49740 - DNA, 153 bp, Glycine max
  Peptide Sequence Number=SeqID_166518
atgaataaagaaaaggcacctaaaacgaatggactgaagcggtgcgcattacgggatgacccttcgctcaacgaacatgcacaactcatccttcttccagattcttccttgcgctcagctgaggagtgttgcgctcagcgaatggctcgctaa

SEQ ID NO: 49741 - DNA, 461 bp, Glycine max
  Peptide Sequence Number=SeqID_166519
aactcgctaagcgtgcctatctcgctaagcgagttcatcttttaaggatgaacactcatcctcttgctgagatgcctgtggctaacgcatttcgtcgcggcatccgttgggctaagcgagccccgctcgctaagctcccatacttagtgtattttgtgaactgcatggtgccgcttagtgcaacctatgaggagctgagcgcatatccttgcggcagacgtcagctaagcgaactatgtctcgctaagcgcataatggcttcaagaaagagggctagaaccgatgacatcccttcatcatccatcccagctcctcagtcagcatccataggaccagatttggctcacaacaggctaatcatacctatggagcattttcttgagcaagtagcctggcctgaagctcaacttccattggtgagacccaatgaggctgctactcttgagcccgcaccggcatga

SEQ ID NO: 49742 - DNA, 312 bp, Glycine max
  Peptide Sequence Number=SeqID_166520
atgaagctctggtccaccaatgaggttcgcgccaagtccaagttctggtattttatgaggaaattgaaaaacgtgaaaaagagcaatgaccaagtgcttgctatcaacgaggaaacaagcataatggccttctataataaggttggaaatgtcttgaggcagagtgttgctcacagcataaaagcacctgtttcatccatgcttaattgcattcgctgcatgtcttcaagcaagcttttcattggagctattcattgttgttggaaaaatagttgtggatacaaaccacgcacctggtcgccagttttctga

SEQ ID NO: 49743 - DNA, 1872 bp, Glycine max
  Peptide Sequence Number=SeqID_166521
atgtcatctgagttcagatttgtgtttgatgctagtttgaccatcacaagtttttatctgaatgatgaagatgatttaagtcctacacatgggaattcaagtgctgtacatgttgaaaatagaagttgggagtacattggcaattcccacataggggcaaactatggctcattcttctatagtgaagctaatttctctagcctggttcaactgtttaagtgtcagaaacaatacgttatggtagacaccaagaaaaacattgtttatccaattggacaccaaggttcaatgaacttgatgaaggaaaaggtttttccatcttggttaaaggaaaatacagtgtattgcattgatcgtatgaaatcacagaccaaatcattagattgcttggtgaaggatatgctcatgagttgggtttgcagattgcaaaaactatccattgaaaattttattgtgtatgcccttgataaggaaacttatcaattctccatcttgcagggaattcccgttttcacagatccaatagctccaagtaacgtcagttttgatgactgccactttggcacaaagtgcttccaaagggtaacaaaggtgaagtcaagaattgttctgaagattctcaagctaggttacaatgtacttctcagtgatgttgatgtatactggttcaaaaacccagttcccttgcttcactcttttggtcctgctgtccttgctgtacagtctgatgaataccaaaaacaagatgcttatttcacacctgaaattcataaacttcaggcttatgagggaatggaggatccaaccgtgttggtgacaacaaatcgggaaaaaaatgtcaaagaagcaggtttgaagaagggtagttacatcatccacaacaactggatcagtgggaggctcaagaaacttgagcgccaagtcttgtctggtttatgggagtatgatcctgccacaactatgtgcctgaggtgcaggcatgcttctaaaagagatggtgaaacattcagagtgcataacaactttgaggtgcaggctatgctgaaacgtgtggttcactccttaggcctggtagagcatagagagagaggttccagaaggcaaaaccatctgaaaggacacgagccaccgtcggaattgaactcgcaatcaaaggactttgatgtgcgggtaactcatgcaggtggacatcaggaagtgtatcgacatgcagttcctgcgtcccagttgatgagaaagtatccagggatgtgtgttgcgcggccagaagtgttcaaagttcctcatcaatcagtgttgtggcatgaagagattctggtgccaggtcacaggtatatcctaatctcgtttagacatgtcgagaagctgaaacgtaaacttttagaggaagagaagaataaagaggctactggggtggtgctggagacaaagaccaggtctcctagtggacacaaggacaaagtgaaagtgccgaatggtgtagcaggccatgagacactggagacaaagatcacaaatggactgagtcacaaagagaatgagaaaatgaaagagacaaatggagtttcaggccaaggtgtgttggaaacaagattaactgtgtctcccaaagacaaagtgaacactgaagagacggtggatacaaacatggaaggttctctaggtgagggaggtgtagaggaatctttttcctctgcaagggacttctatgtccctaaggagaagtccacaagtacaaccacaagacctccaagaagaaaaggaataaaagggaagaagccttttgaggcacctcttccaaagcaaagactatataatagaggtttgggatggcaacccagcctcccatctgtgaaggaactctctccatga

SEQ ID NO: 49744 - DNA, 465 bp, Glycine max
  Peptide Sequence Number=SeqID_166522
atggctctgaagacgaaggtgctctcttatgcgacgctgctgttcgggttctacatggcgtggaacattggggcgaatgacgtggcaaatgccatggggacctccgtggggtctggcgccctcacgctccggcaggccgtgctgaccgccgcggtgctcgaattctccggggcgctgatgatggggacgcacgtgaccagcacgatgcagaaggggattctcgtcgccaacgtgttcaatggaaaggattctttgctcttcgccgggttgctctcgtctcttgccgctgctggtacttggttacaggttgctggaaaagtctctggctgccggagatttttgccgaaaaagcgggcagcaggcgacagatcaaagtggcaaactggacaaggaaggaattgcgccagaaaagtcatgacacagcagcaagaagtgaacagtgaccagacaagtcacggaggatag

SEQ ID NO: 49745 - DNA, 963 bp, Glycine max
  Peptide Sequence Number=SeqID_166523
atggtggggtttggtctagcttatggaggtgccggagctgttttctggggttcactggccagggtgatctcttcgtgggttgtctcaccactaatgggagcagctgtgtcatttcttgtctataaatgcatccgaaggtttgtgtacagtgcacctaaccccggcctagcagcagctgctgcagcaccaattgctgtatttctgggtgtaactgggatttcatttgttgccttccctcttagcaagaatttccctttagctctggcccaagctttagcctgtggaactgttggtgcttttctggtagacagaatcatcagaaaacagcttggacatcttcttgtcaagtcaaatacaccagagcctgagccaaaagaagactctgtccaccaccacaatataggattcctcgatgatgttgcaggcccaaagggtgctcaactggaaatagtttatggagtctttgggtacatgcaggtcctctcagcatgtttcatgtcatttgctcatggcggaaacgatgtctccaatgccataggtccattggcgggtgcgctagctattcttcaaggtggtgccgcaggaactgagattgtgattccaactgatgttcttgcttggggaggatttggcatcgttgcagggctaatgatgtggggttatagagtgatagctacaataggaaagaagataacagaacttacaccaactagaggatttgcagctgagtttgctgctgcctctgtggttctgtttgcttcaaagctgggactacccatctctgcaacccacactctagtcggtgcagtaatgggcgttggatttgcaagaggacttaacagtgttagatcagaaactgtgaaggagattgtggcttcatgggtggttactattccagttggagctactctatcagtcctctacacatggatcttgactaagattttgtcctatattttatga

SEQ ID NO: 49746 - DNA, 411 bp, Glycine max
  Peptide Sequence Number=SeqID_166524
atgcagatttttgccaatcacgttgagctgcttaaagccaattgtcgcgcgaccccactgggcccatttagacccatcaggaagcttcaacaggaagcaacctgctcgcctgggcgagcatgttgcttttggaggaagcctccagctcgcctgggcgagctgggcggcaagctcctcccctattttggctataaaagggcgtgggaggctgaggggaaggggttcagcacccttggcaagcatatttcacttaaaattagtgaaaagaaggagaaagaagaagaaaatcaaggtcgaggcgctttcgtaatgctttcgtggcgttttcgtgatcaattccgtgaacgttcttcgccgttcttcatccgtacttcgttcttcattcggttagcccttgctttaaggatttga

SEQ ID NO: 49747 - DNA, 522 bp, Glycine max
  Peptide Sequence Number=SeqID_166525
atgaaggcgaggactttgagtcctgtgaaggtgaggaccttgagtcctctaaaggctaggactttgagtcctatgaaggcggagactttgagtcctgtgaagatgaggaccttgagtcctctaaaggctaggactttgagtcctatgaaggcggagactttgagtcctgtgaagatgaggaccttgagtcctctaaaggctaggactttgagtcctatgaaggtgaggactttgagtcctgtcaaggcgaggactttgagtcctgtgaaggagaggactttgagccctctaaaggcgaggactttgagtcctctgaaagaagccaatagattgactgtccctttttcgaaagatgtgataactcatccaacctcatcctatctttttgcaaatctcttcgaaagctccctcagagtgtattcgtttgatgaatggtggcaacttttgatagaagaggatgggtcatcggttcgtggaaggagtttgagtgtggagcttggttggttgccaaattggatttag

SEQ ID NO: 49748 - DNA, 2466 bp, Glycine max
  Peptide Sequence Number=SeqID_166526
atggattgttggaccttatatgttttttggcacctcactgccttacatgtaaatattaccacatcttcatctatttgctcaggacctagccaaggaatgataaacccatctcccattgtttatgctggtttatttgcagcccttgtgataagtagtaaagaggctcttgatcagattcaactatcatactcagtctttcctttgtcaagttcctcatcgcaagaacgccatgtgcaacaatcaatgcatgcaccaccttttgtgtctggcagccattcagttgactccactatcagtcttgctgatcaaccattagattttgcacctaggtttaatcgtgatagtgacttgcaaatgcaatcaacttataatcatcacgattccagttcttcaatgaataactgggcttctccagtgacacctggtgttagttatccatcagtaccaccaaatctttcttctgggcaacagcatgacccttctatcaccactcctggtcatgtggccccgccatttggaaggtttgctggacctggcctcccttcgaccattccaccaagtggtgcaccgtttactcttagcacaggaactacacttcatcctactgtggctttctcagctgatgcgtatggggcatctggtgttcctgatcgtcctaagaaggcttctgtccctaactggctgaaagaggaaataaagaaaacagtcatccctgctcctgcagagaatctgaaggaagaaacatttgtaaatgatggcattgacaagtcatatgctagaggtgatgaggcagatagtaaaagcattgattcgtctagatcagctgaggatgaggatgaagaggatcaagttgaagcagctagaactgtagcaatcaaccaagaaataaaaagagttctgactgaagttcttttgaaggttactgatgaattgtttgacgaaatcgcaaccagagttcttgctgaagatgatcttactgctgaaggttataacaatgtgttttctgtagtgggccacaaggttgccacctcaaatcataaggcatcagcatctcctccctcagctacagttcctaaggcatctgcaaaagttttagttccaatcaaagagaaggtagaaaatgaagacaccagtgaaaactctaattccagctctcctggagatgttttaggtcttggaaattatggttctgatgctgatgatggagacaatgaaattgagagttccagtgtgccaacacctgcaagagatgctgcctatcagtcagggattaagaaacctttgtcagatagacatgatctacctgttaatggcattgcacaacttgatgagcatgatagaagtgaaactaatttgatgaataatcaggtcaaaaccatctctttaccatccagaagtagcaatgatgctgctactgatctgttgcatgatgacaaggtgaccaaggaatccaatcattcacattcttccaaggtggtgactgaagatcttaaggataatgggcttaattccattgaaagaagccttgatagatttaatggttttagttctaaagattcttcaggggtatcaagatctgaactgcctggaaagaacatcagtgtggaaaaagcaacagatgatctttcaggtagggaaagcagaaaaaaatcagaaaaaaatgatcggcctgacaggagtacttctgagaaagactttgtaaaggaggtacacagtagtaagactaggatagatgaaaaaggtaacgagaatcaaataagaaaggatgaaagaaaccagaaaagggaaaaaacagattatggcagtgaggcaaaagaaagagtgaaagagcacagtttaaggcatggggagaaggcaaaggaatcagactcaaggaaaagatcctctcatgttgatgtcaaggatgataaaaaggaagcagaaaaatcccatagaggtagtgccactgacgatactagccggaaaagggagcatgcaaaggataagggggaacataaatcaaggcaaaaagatgcaagtaatcatgacaggcacagaagaagacgttcatcttcagtaagcagtagaggtagaaccaagaaggatcgtattaatcatgctgatgattcaagtggtgaaggatcagatggctcaaaaagtgtctcatatcatttttgtaatgcaggaagctgcattcaagaaagcatgacttatcaccgtctccggtcagatctaaaagaagaaattatccataattgtaaggatatctgcaccctgaatctaagatatgtagacaacttttgcggtctcctcatagcaagcattctcagcgcaggcattctccctatacttctcttgattcttccaggggaaggaggtcaagatccagatcacctgttcggcggcagaaatgaatggatggggacagagatggttgactttgcatttaaggggttcgttcaagaggacataaattcggaggcgtag

SEQ ID NO: 49749 - DNA, 324 bp, Glycine max
  Peptide Sequence Number=SeqID_166527
atgggggagacacatgaaatatcccatcgcaatctagccgacttcgagccttgcctcggatatgccactgaagggcaagcagttggtgatctacccctgcaaaacactttggagggccctcaatttcgcccccaaccacaacccttgcattccacagtgggtaagatccctcctgctacggtagaaatgggaaagttggatcatctagaggaaaggctcagggccattgaaggaggtagaggttatgcctttattgacatagaagagttgttcctagtacccaaacatggtcgttcctctgaagttcaaagtgtcggagtttga

SEQ ID NO: 49750 - DNA, 213 bp, Glycine max
  Peptide Sequence Number=SeqID_166528
atgctggcatctttgaaaaaggtgcagatgaccacattggcctctgcttgtcaatcgaacttggggtctccgaatgacgaggtgcggataaccgaaaggtgtctccgcatgctaccagactcttgggtcatgagagcaaaaggtggggtggtcgacaaaagcgaggcttttgctcctacgtatcctccatttgtgatgaagaactcagactaa

SEQ ID NO: 49751 - DNA, 318 bp, Glycine max
  Peptide Sequence Number=SeqID_166529
atgaccaaacttggtctctgcgtgtcatcggacacaactgtgtctgaatggcaaaggggtgcggataaccataaggtatctccgcgtatcatgggtatcttcgcgtatcatgggtgcagaatgaccaaacttggtctctgcgtgccatcggacacaactgtgtctgaatggcaaaggggtgcggataaccataaggggtgcgagtcacataactctcaaggtcagtatgacaaagattgtggggcggccgacaaaagcaaagctcttgctcctacgtatcctccaatgaggaactcagacctacgtagttctggataa

SEQ ID NO: 49752 - DNA, 726 bp, Glycine max
  Peptide Sequence Number=SeqID_166530
atgaatggaaatttctatctgaagctggtgaaagtcttctatacttgtgcccgtgctgatttggaaggtaatatgttttctattgttaatgctggagttatgaaggcagtagctggactagacatgggtggagtctgcaagtttgaagaatctactgatggttacaacaagatgcagacttacaaaggtatgctccttgacccaacgaggaatcggaggaatcacctaggtgtaggaggtttaactgctgaagacaaaatggtcgtgtacctcataacctacattctcacaccgaggtctagtaatcatgcacaagtgacggatgatgatttacaaattgtattaattgattattttaatatcgatgtttctaatgagatagtagacttcaccaaggcatctattgagatcaccgaaaggcatctcaagaagcttgggatgaggtttgttgattatgaatggatcatggatggagagccaccagcaacagcaaacatggaccatatggaagaagaagcggaagctgaagctaagcaagagcctgtgcaccaatggagtccttttaagtttcttatgattcaaaagatggatgccatgcttcacctctaccaaaagcactcagctaatgttcacagtaccttaaaaaatatcacaactcagctggagaacatagaaactaggctaacccttagtaacctccttaacccgaatgaggatgaagcatag

SEQ ID NO: 49753 - DNA, 616 bp, Glycine max
  Peptide Sequence Number=SeqID_166531
agaccccttgtgggaggatgtgcggaaaaaggcacaggccatacaaaagcaaaacaccaccccccacgtgttgtctcgtgggggttatgaatatttagaacataagctgatggctaagaagacaaagaaaaaactagaggaagctgctcaatccagaaacactaagggcgtgattgaccctccatctcccatcaaacgacacatgaagtggaagatggcccgcaccaagaaaactgggcagatgacgtctgaggcaacaaaggaaattgctgacaagattgagcaagcgtcacatggttcatttgtcccccatggacgtcaggatctcctgactgctgccattgggcaaccagaacaccctagccgtggaccagctggaggagtcgattacagaaaaagtgactcagcagctgatgttatccttcagccagatgtagtcccagttgaaatcacagatccaatcataggacttgcattgcctccaaagcctgaggttggtccctcagctgctcgtgtcagcacaaaggggagttgtgttgatccctcaccgaccaatctagacataggtgacgcagacaaatgcgggttgtacatcgaagaaaaatcttcccgcctg

SEQ ID NO: 49754 - DNA, 408 bp, Glycine max
  Peptide Sequence Number=SeqID_166532
atggatgcccaactctctctctctctctctctctctgagttccttttcttttcaatttttcttgtgccttttaggcttatagagggtaacaactatgcggcaacatggagtgataaatacaaggacaaggataaaaaaattagtggatcagtcacgaatcagcttccatcatctaaagattaccttggggactttcttgtatggaaacctcccattggattaaggagaaatcgagctttctggcttgccgcagttgccaatggcgatataccctcaaccgccattgccactagcgagggagctgcttacatggacatgtcgccattgatgttggcgagacacgctgacgtggccagcatgcagaggatgccgccattgacaatggcgagtctggtgacatggagctag

SEQ ID NO: 49755 - DNA, 276 bp, Glycine max
  Peptide Sequence Number=SeqID_166533
atggatggatatctactccgttggcctaaaaaatctcctctcaatctggcagatttcaaagctcatttggagcacaaaatttcgtgctcttctcttcctctcccttcattcatctccttcttcctccaagctcttatccatggcctcctatggtgtggcgtctcttctctctcttccttctccatttcgctgccattcatcttccaagaagcaaaggaatccatagatgaagaagatcctaggcctacaagctccaatggagcttacatcaagtag

SEQ ID NO: 49756 - DNA, 573 bp, Glycine max
  Peptide Sequence Number=SeqID_166534
atgaggggtggaggttgcacaggagctcgcccaggcgagctgcttgcttcctctagaagtaaccttgctcgcacaagcgagctggtcacctcagccctaagcttcctagtaggaccaggggctgaaaaatgccccaaaagtgtcccttttgccctccttttgaatattttgcacatttccttccgaaacgtcacaaaaccttacggattgcacagattgtgtggattaaatttaaagaagaaaaaactgtgttttttctttcattctctcacaactctatccctttcccatgaactagtggagcatgcaaatggacctcctccaatcatgaacagtcaagcttcatctcccgttctttcaaaaaagcatgatgtgaaggatggagcagacgtggtcgtcagtgcggcgatgggtggcaaacccgatcttatcgtcggacgcaaatccacacgtggtcacactgattctgaaagagtgtgtcgatcaccacgacttcaacgagcacaacgatgtgatagaggagaacatttcttggattgcagttggtggtcggagaaaggaacattgtattga

SEQ ID NO: 49757 - DNA, 849 bp, Glycine max
  Peptide Sequence Number=SeqID_166535
atgccctacctaaccccgttgcaggatttccgctttgcgctcaaggagctggccggcctggacgacgtcctcaagctgcccggtttcgaagaggtgacccccgacctggtggacgccatcctggaagagaatggccgcttcgtcgagcaggcgatcgctccgctgaatgtgccgggcgacacccgccccccggtctggaatgatggccacgtgaccgcgacgccgggctatgcccagggcttcaaggactacgccgccggcggctggcagggcctgcagcatccgcaggcctggggcggccagggcttgcccaagctggtcgcggccgcgcccggcgagaacatccaggcggccagcctggcgttctcgctgtgcccgatgctgaccgacggcgtgatcgaagccatcctgacggtcgggtcggaagaacagcgcaggaagttcgtgcccaacctgatcggcggcaaatggacgggaaccatgaacctgaccgagccgcaggcaggttccgacctggcccaggtcgccacccgcgcggtgcgccaggaagacggcagctaccgcctgtcgggccagaagatcttcattacctacggcgagcacgatctggccgagaacatcatccacctggtgctggcgcgcacgccggacgcgccccccggggtgaaaggcatctcgctgttcatcgtgccgaagttcctggtcggggccgatggctccctggggccgcgcaacgatgtctggtgcgcgtcgctggagcacaagctgggcatccacggcagtcccaccgccgtgctgctgtacggatccggcaagggcgaggcgggcgagggcgcggtcggctacctg

SEQ ID NO: 49758 - DNA, 371 bp, Glycine max
  Peptide Sequence Number=SeqID_166536
aagagtacttcctagtacccaatatcatcacccctcctaagttcaaggtgctggactttgacaagtacaaggggactactttccccaagaaccatctaaagatgtattgtcggaagataggggcatacgcaaaagatgaggaattgctgatacattccttccaagaaagtcttactggggtagctgttacctgtgtcagtataatggcttcggattggatgcaactacagaacatgtgcaaaaaggggcatgaatctttcaaagaatacgcccaaaggtggagagatctagcagcccaagtggcacctccaatgatggaaagggagatgataaatcgtgatggtggacacattgtcagtattctactatga

SEQ ID NO: 49759 - DNA, 312 bp, Glycine max
  Peptide Sequence Number=SeqID_166537
atgcagagttcgaaatgcgatgtctaccttggagccttcctgaatggcgggcactggcagatggtggtcatcatgcccaaggaacacctagttgtctggttttgttcattgtataacaggccagacaactaccttaaggggataattaacagtgctttaaaagttcttgatgatgcttcacagcctcaatcaaaggctcctgctaggtggattgtcgtcaagtgtgatagacaaaaaagaagtactgagtgcagctattatgtcatgtactggatgtccaccatcattttaggaagtttcaggaataactag

SEQ ID NO: 49760 - DNA, 364 bp, Glycine max
  Peptide Sequence Number=SeqID_166538
agctttcatcaagaagtactgcgtccccaggcaggcacagggcgaaacaccacaacaacctgaggatggccggcagcgggcaacagacgcaccgccatcacctctagagttcacctcagctcatccacaaaaaggtagaaagataccttggatatgcatcaaaaatacttcacaaaatgtagcaaaatacctcgtgaaaaaaagagagcaaaaagcatatgttgctctgatcggttggaagttttgtctctttactaaagcatgttcgcattttggtgaagaaaacaccgagactatttttagtctcacaattatcaagaactacgtaggtctgagttcctcatcacaaattgaggatacgtag

SEQ ID NO: 49761 - DNA, 279 bp, Glycine max
  Peptide Sequence Number=SeqID_166539
atggcaatcaattcatggggctccgaatatgacttgatggtggaggatgcacgaatagcgctaggcaatcaattcgtggggctccgtactcgatggtggaggatgcatgaatcgcaaggcaatcaattcgtggggctccgaataatatttgatggtggaggatgcatgaatggcaatgaattcatggggctccgaataagatttgatggtggaggatgcaccaacagtgctaggcaattaacttgtggggctccggactcgatggtggaggatgcatga

SEQ ID NO: 49762 - DNA, 336 bp, Glycine max
  Peptide Sequence Number=SeqID_166540
acttatcaaggtaatccttgtggcgtctatcctgacttatcttccttcaccggaagtggcatctacccagacttatcttccttcaccggaagtggcgtctacccagacttatcttccttcaccggaagtggtgtctacccggacttatcttccttcaccggaagtggcgtctaccctgacttatcttccttcactggaagtggcgtcatccaaaacctccgtagcctgtatcaaacgatccgctcctactcaggttcgcatcacacaaatagagatgcatatactcaccgattgtcaattgttgtcagtgtcgaagatattcctaatcagcactaa

SEQ ID NO: 49763 - DNA, 147 bp, Glycine max
  Peptide Sequence Number=SeqID_166541
atggtcattttgctccctttgtcattcaagagcagcaagttgagtgataaacgcgcagagacaagttatggtcattttgtgccctttgtcattcatggacggttctactggcagggagattcaccggctaaatggtgtttcgcttga

SEQ ID NO: 49764 - DNA, 195 bp, Glycine max
  Peptide Sequence Number=SeqID_166542
atgtgggtgcaagccattggtctatttgctcaagcgacttgtgctcctgagttttggacttccaagactgttcaatcagagattactcgtcttgcacgttggtgggggtgccgtaaaacaacgaagagaagtgagttatcaagaataggatgttggacaaatggcctcagttaccttaagaaaaaggggggttga

SEQ ID NO: 49765 - DNA, 486 bp, Glycine max
  Peptide Sequence Number=SeqID_166543
atgccgatctcctcctgtggaagtatcagttggtatgtgccgtcacgacatagggatcgtgccccctacaaggagtcccttagacccggagaagtccaacaggttcctagggttccaggctctgatcatcaggcccccattaaccgggatttcatcgagcagtactgcacccccaggcaggcgcagggcgaggcaccacagcagaatggggacggccagcagcgggtaacagacgcaccgccaccacctcaagggtccacctcagctcatctacaaaggtactgggcccatgatcgacaaatcgttatcatgcgtccagctcaagatgttaaagaagcgctactaggaggcaacctagaattggctgcaaagaagctccccacgaagaggtccaggaagggcaccattgaagagggttccaatgcgaccccgcaagccgacacaggcttcgacaaacaccgattccagagcgtggaacatcagtag

SEQ ID NO: 49766 - DNA, 447 bp, Glycine max
  Peptide Sequence Number=SeqID_166544
atggtttgcaccaatcaagccgatatgatcggaaggcttcttggcggttcattggcattcgaattatgcatcatgcactacttgattatgcacatcctactccctagatcatccaaccttgcacaggtttctgaggaagatttgataattatgtgggttttcttaaccggtcatcaaatcgactcagaccatcttgtgagatatcgcatgcataaggcattgcgatcaaatgctccacttctatatcctcattcgatcaccttgttcttacaacatcttaatgtccctcttgactctgaggcttttgttaaagtcaagagatctttctctatcggtgcgaatgtgatctcctcttttggataccgcaaagagagggatggttcttgggtgaagaaagacgcaccagcacaggccgcagaagaccgttctccatcaccacatccttag

SEQ ID NO: 49767 - DNA, 153 bp, Glycine max
  Peptide Sequence Number=SeqID_166545
atgacaatcccaaactcgttcaccattagatcatcgtcaaatttgaaaaccaagtctagaactaattttgggacatccttaccgttggaatatgcgaaaaaaatgtctgagacaagtggcctcagatatcttaagaagggggggttgaattaa

SEQ ID NO: 49768 - DNA, 216 bp, Glycine max
  Peptide Sequence Number=SeqID_166546
atgggaaacaaccatagggcgaagacgatggcagaggcacttattggcgacgtgacgtggacagagggacaaacaacagcgtttgacgacacgattgtggagaacgcagaagtgaaggacaagagaggcggcgagcccgatgacatgcagagataccttatggtcattcgcgcctttcgtcaattgagaggactgaatgcggcagtatcaggatga

SEQ ID NO: 49769 - DNA, 264 bp, Glycine max
  Peptide Sequence Number=SeqID_166547
atgcttacctcgaaaattccaacgcgcggagggagaaacaccaccgtcaatttggctgggatactcaacaccgacgacagtgcggtcgcagagcgaaaggtcgacgaagacgctctcgggagaagaaacacggctcggaggatgacgaccacggtggctgaagcttttttgaaggaagaagaacgcagggtgaggtgtaggaggaagaagaagaacagaggggagaagaagtcgaacgcaggggagaagaagaaaaaatggtga

SEQ ID NO: 49770 - DNA, 162 bp, Glycine max
  Peptide Sequence Number=SeqID_166548
atggttagaatcaaaggattgtgtcgggctttaggcagggttataggaagagccttaggaagagaacatagtggtgatgcggatgaatcccctcagcaacgaaggccaacaacatctgcacacctgacgaagtccctaaacagccttagcagacaaccttaa

SEQ ID NO: 49771 - DNA, 291 bp, Glycine max
  Peptide Sequence Number=SeqID_166549
atgaacaaggccacctatttaagcctgaaatcagattttagaaagagagtttggactggtgattcagagctttgcatgtctagggtttctagagagagaaaggtccaagttccagagtgttttgagagattttgttgtgtgaagatctgcagagaccagagcatgaagcaggagccgatgcatgctgtgttagagccattcaacagtggaaactggtctaactctaaagtccttgatagagcagggctgggttgtcgtgctttcacgaggaattggggtgcgataatttag

SEQ ID NO: 49772 - DNA, 1974 bp, Glycine max
  Peptide Sequence Number=SeqID_166550
atggcattcagcgataagcaaaagcaagaagaagaagaagaaccgcacagaatggaagaagacgacgacgaaagcgaagaagaagaagaagaagaagaagaagaagaagaagaagtgtgggacgattgggaaggagaagacgaaggagagagagaatctgaattcgtgtgtctattctgtgactcccggtacagttcgtgcggttccttgttcgaccactgcgcctcccttcaccgctttgttttccacacgatcagaacaactctcagcttggatttctatgcctccttcaagctcattaacttcatccgctctcgggtggcagagaacatatgttggagttgtggattaacatgccagtccaactgtgaccttcagaatcatttgcatgatgtagttgactttaatgagataaagactttgtggaatgatgataggtatctgatacctttcatgcaagatgattcactgttgtacagttttggtgattgtgacgaagacggggaagatgaacatattactcgaattgatgaagatcttataaaggatctaatgaacattgaagagagtatccatgacgatcaagatcttgtgaaaaaagtggtagttgatgatgacaaacatgagattgattctgtctctaataatcatttgaacaaggctagttcttcaaagaaacttattaatggtaaggactcaaaaggacatgttttgtgcagtgataaggatccagaaggacatttgatggttaattctcaaaatcacattgcaaagcatattaagaagatcaatgaaagttattttgggtcttacagttcatttggtatccatcgagagatgttaagtgataaggtgagaatggatgcttatggccaagcgattttgaagaatccctctctactaaatagtgctgtggttatggatgtaggttgtggaactggaattctcaggtgtcccacattggctaggaacatggctagaatactccttataagacttggacaaccctcctcccttgagctaacttttgggagtagtccctcaaaagctggcgcttcaagggttattgcagttgaggctagtgccaagatggcagcagtagcatctcaggttgcaaaagataatggtcttttgctgagtaaaagccaaaatggagttgatggcctccaaaagggagtcatagaagtggttcatggtatggttgaagagattgataaaacagttgaacttcaacctcgcagtgttgatgtattgctaagtgaatggatgggatattgcctgctgtatgaatccatgcttggttcagtgctttatgcacgagaccggtggttgaagcctggtggtgccattcttcctgatacagcaactatttttgttgcaggatttggaaaaggagccacaagtcttcctttttgggaaaatgtgtgtgatttcgacatgtcttgcattgggaatgagcttgtcatagatgctgcccgaattcctatagttgatgttgtggactctcaagatttagttacctgttctgctattcttcagtcctttgacttggcaaccatgaagcctaatgaagtggatttcactgcaactgctactttggaattgaaaccaagtacttctggaacatgctgctggtgttatggtgttgtcctatggtttgatactggattttcaagcagattctgccgagaaacaccagccgtgttatccacatccccttacatgccaagaacacattggtcacaaacaatcttaacctttcaagaacctattgcgatgggatttggaaaagaaaacaggggtaaaccagaagcaattggcactgaggtgtatcctgctgtgaagattgatttacgtgtcagcattgtccgttctactgagcatcgcagcattgatatatccttagaagctgctggtgttggtcctgacagtcacaaacgcagttggcctgctcagctttttaatctgcagtag

SEQ ID NO: 49773 - DNA, 360 bp, Glycine max
  Peptide Sequence Number=SeqID_166551
atgacgagtccaagacttgaagaaagattgttgcttccgatgataccgaagtggcaaattggcaatagttctaaacctatgtcatttcaagctcagcatttccagtatggaatcctgataggcccattatgcaagactttgaagcgtaagaaggtgaaggaaaaggaaagtgggcctaagaatcaattcctgggggcatatgagaaagggcaaaaggtgacacaagagtcattgggaggagaagcgagtggaataacagaatggacaagtagcaaggagagaataaaggaggggaaggggaagcgggaatcaagcaaggagagagaaaataattatttagtggaaggtatagccaaatag

SEQ ID NO: 49774 - DNA, 138 bp, Glycine max
  Peptide Sequence Number=SeqID_166552
atgccgcaggggcttaaaaacttcaacaaacatgctagggaactctttactcgccttcagaagattgacaaggacaactatccagagtgttgtaacttgtttgaattctgtttggtatctgacaagaatatcaagtga

SEQ ID NO: 49775 - DNA, 252 bp, Glycine max
  Peptide Sequence Number=SeqID_166553
atggaagtgttggtggaagaggatggctctaaaatcgattatagcatagtccttcaacactcgtctgcagttttgatgatgagcgtcaagaaggatttccacttgtgggttagcatctttgagtgtgagaggatcccaccaagagttcttcaccggattctcattgtgggttcactttcgtctggcacgtacaccttcttgatggcatggttattgcatagggcttggataaatgactgctctaagacttag

SEQ ID NO: 49776 - DNA, 570 bp, Glycine max
  Peptide Sequence Number=SeqID_166554
atgcttggcgttaataacaaccatgctgtgatgaagagaaaagggcagagcaaaaggggtcacaagaagaacgttaaagtcacatatatttcaagccccatgaaggtgaagactagtgcctcaaacttcagagcacttgtgcaagagctcacaggccaagcctccaatgttgctgaaatgttcgtggaagctgattattattatggtgtgcatcatgatgatggagttcacaagggcaatcaacaatggagtagtgaggaggcatattttcccgagtctacttggttgaaacatgatgattatagccacttgaattcgaggtcctccatggagctactaaccgaacatcttgaacttgaacttttgagctttgagacggtggctacctgcgttctggaattcattccaaacatggacttatacataggccactgcaggccaatatcttgccagtcgccacatacttcgctccttgctgcggacgatgacgacagattcccaaaatctgtcgaggtagcgggtcttttgattcaagggtttagagtgaataactttggcattaagatgtag

SEQ ID NO: 49777 - DNA, 297 bp, Glycine max
  Peptide Sequence Number=SeqID_166555
atgtctgctcctctagtttattcctcaaagcacattccaacaaagctagaaactttcacacaagaagaggtggctcttcaatttccaatccaagacacagttcaagttacttcccaattctacattgtatctctccatgcagaaaagaagaaagagggaatgacaagagatgttggtactcaaagtacacctccttatattagttcacatcaaaagccatcttcaggtatgcatgtgaatcagttgtctccttcagttcttaaatctgagggggtgcctgtacatcgcactgtctag

SEQ ID NO: 49778 - DNA, 288 bp, Glycine max
  Peptide Sequence Number=SeqID_166556
atgatttttgttgtagacgtggttatgtcaagcatgctcgtcgccgtgaatgcatactgttggatggattttagggtgaagtattttgcttcatccctcaccgtgtaccaccaaactgacaggcaattgcagaatgaggcaaaggtaggggcgcaattcaaccgggagctgaaaagtgacattgatttgttgtgccaaaagctttgcgcaatgggttgctacacatgcagtggcacaaccatttttggacaggttatggcagtgttgactgctttggacaacgcgtga

SEQ ID NO: 49779 - DNA, 274 bp, Glycine max
  Peptide Sequence Number=SeqID_166557
atggcagaacttgttggctcgtggagtaaagacccttccacgcaagttggggccgtgattaccaaacagaaccgtatcgtctccgtcggctttaatggctacccacatggcatttccgatagtgccaacaccgaccatcgtgatatgaaatatctcaaaagcttgcatgcggaagagaacgccatcttgtttgccaagcgcgatctaaatggctgtgaaatctacgtcactcatttcccttgtcccaactgcgcagccaagatcattcaaattg

SEQ ID NO: 49780 - DNA, 276 bp, Glycine max
  Peptide Sequence Number=SeqID_166558
atgaagaagaataaggttgcagcagctggtgtcttgctaagcgaggcatatgcgcttagcgagcgagcctttgaggacaaaaagtccttaaaagttgaagttggcaaaaggaggaaagagttttttgaagaaagaaatagaggaatacgtgagagacgcaacagaggaaaaacaagacaacaaagcaccaaagatcttagctttcaagaggattctaggtttaggagtgattattacgttcttagaggtggaggagacatgcccaccactgtgtaa

SEQ ID NO: 49781 - DNA, 447 bp, Glycine max
  Peptide Sequence Number=SeqID_166559
atgggttgctacacatgtagtggcgcaatcacttttgatcagcataggtacaggatgggatgcaggtgctgcacagggtgcaagtacgcatgtgagggcaaacactcttccaagaggttccttcttccttcttccctctccggtgtatttgatatggcaagttcatcatcctcctcatccagttttgatgtggccaccatcacactacaagatgtgtctgtgttgctaggtcttcctgtggatgacaatcctttaattggcagcacaaatattgatgggattgatatgtgtgaacaataccttggagtcaggccaaatactaatgcattggctatcggaaacacaatgaaattaagctggttggcttcagaatttgcaaatatccaggactatgtggacgacgaatttgcattctcgttccccaggggccaccacggtggagagtaa

SEQ ID NO: 49782 - DNA, 732 bp, Glycine max
  Peptide Sequence Number=SeqID_166560
atggggttggaggagactgaatttggtgaaataggtcgtggctttttcttggtggctgtgggtttcgatgggtttgaggttgacctaggtggtgagcacaatagagagaaggacgaaggagagtgtgaacttgtcaattatggatccagtcactccagaagcttcactcatgatgaagctgtttgctttttgatggtgtttaaggtgaggggaatgggggtttatgcactgtggtttatatgtttatttagctttccgggtttagaaaagcttcttgctgaaaacatcatgaattttgcagcatcattgtgcagaagattgaatatcaaggaacttgcgacaaatgttcctgtgtataaaagcaccagtgatgtttctggagaaggtttgagtttcacgttcaggcgttgggcttccaaaaagactgctggttccacaaagaatggacgggattcaaaacccaagaaccttggagtgaagaaatttggtggggagagggtgatacctggaaatatcattgttcgacagcgtggcactcgttttcatccaggaaactatgttggacttgggaaagatcattctctgtttgcattgaaagagggatgggtgaagtttgaacggaacaagttgactggtcgcaagtgggtgcatgttgagcctaaggaaggtcatgttctccaccctctgtatgcagcagatgcttctgcatctgaactaaaagttgctgtctaa

SEQ ID NO: 49783 - DNA, 438 bp, Glycine max
  Peptide Sequence Number=SeqID_166561
atgttgagtcctatgaaaaataaaggcgaggacgttaagtcctatggaaacataaaggcgaggacattgagtcctatgaaaggtaaaggcgaggacattgagtcctatggaaacataaaggcgaggatacaaaggacgttgagtcctacaaaaaataaaggtgaggacgttaagtcctatggaaacataaaggcgaggacattgagtcctatgaaaggtgaggacgttgagtcctatggaaacataaagataaaggacattgagtcctatgaaaaaaaaagacagaggacgttgagtcctatgaaacataaaggcaaggacattgagttctatggaaacataaagacagagggcgttgattcctatgaagaaaaaggtgaggacgttgagtccaatggaaacataaaggcgaggacgttgagtcctatggaaatataa

SEQ ID NO: 49784 - DNA, 537 bp, Glycine max
  Peptide Sequence Number=SeqID_166562
gcctcacttggcattcttgactacaacggagctatatccatgcctgggaggcttagtggtagtgttgggtccaaggaccagatgacgagcctagtgttgcatctcccattctatattaatgctattaagaccaagtgggaacatgatgaccctatgtcatcctataatcgcttcgtgatgcccgtgcctgaggttgtcattccgtctaagtcgtattcatcatctgccagcattaagatgtcttctactagatctaacttatcatccaaggatattgatgcgacttttccttttctgatgtctccttattcggtgttgcttgagtcttgggtaccactgattgaggccgagaaaatgatgacacatcaaccacccagggtggatatggtggatctcgtgtcgacaaatgaaggacaggacttgaaggaggatgcatcgtatgaggaggatccatttatggacaaggaggaccttatcacgaagccaaagtttataaaggaggattcctcgcaggattcatttgaggagtcccattag

SEQ ID NO: 49785 - DNA, 189 bp, Glycine max
  Peptide Sequence Number=SeqID_166563
atgaaggcccagaggaacttttggcatttgataaaatttggtgagagcttctctctgggttccttgttgaaccaatctcagacttatcaaggtaatccttgtggcgtctatccagacttatcttccttcactggaagtggcgtcatccaaatctccatagcctgtatcaagcgatctgctcctagttag

SEQ ID NO: 49786 - DNA, 612 bp, Glycine max
  Peptide Sequence Number=SeqID_166564
atgccttctccctccttctccattccaacagactctctgacaacctcgtctgcagattcatcaatgctcttggccactgtgatgacattaggggtgcaattcactagttccacaaagctaatacctttacaagaggaagatgcattttctccaacgcaatgccatattggcatccttgtgagggccaaccatgtcaacattgccaaggcaatctatgatcaagttctcactgaagctattttggaatcggatgtttacacttacaccaccatgattcgggggttctgcaaagtgggcaaggtggagaatgcgtgcaagaaaggtgacatggatggtgtcaggaaggtttttgacagattggtggagagtcagagttgcaagccagatgtggtgagttttaccactttgattgatgggtactcgaagagaggtggattccgagaggcactggagtgcttgaaggagatggtgaaacgaggatgtctcctgaatgttgtgacctacaatgctttgattgaatgtctttgtttgagcagtgaagtggacgaggccagaaagatgatgagtaggatgtgtttgaatggtttgaaagacattcctacccccacctaa

SEQ ID NO: 49787 - DNA, 183 bp, Glycine max
  Peptide Sequence Number=SeqID_166565
atgatgcagttagtagaagcatacaaatccttgacattgaagaaatcaattcaagaaaccactacaggcaatcattggaagctggtgatcaaagtatgccatatggtggtggtggtccagagaattctcactctcaaggcttcttccaaccattatacatcaaagaagtatccaaggtactaa

SEQ ID NO: 49788 - DNA, 612 bp, Glycine max
  Peptide Sequence Number=SeqID_166566
atgagtgttaagtacctcgaggcggtcaagcgaaggttgcatgccaccaaacaatgcaaagtaattgaccctcgacaattggatgatttggagaatgaggcttccattgtcctttttcaattggagatgtattttcctccatcattttttgacataatgattcacttaattcttcatctcgtgagggagatctggttgtgtggtctgatttttttacaatggatgtatccagttgagcgatacataaaggtgttaaagggttataccaaaaatcaataccaaccagaagcttccattgttgaaagttatgctgctaaagaagctattgagttttgttctcaatacattgaaacagttcattctattgggcttcctgaaagtcgtcatgactggacacgaggagtgttgggatttgcgataaaatattcaatgagagagaaaactgaatcgacgaagacagtacaaaatggaggcttcaatcctttctccttctttctgacgtttgggaaccctatcagagcagtcgaaggaaaaattggaggaatctcaggaaaccactggagatgcctctattgctgtcacaatgcacaagtgagcccacttagaggttag

SEQ ID NO: 49789 - DNA, 557 bp, Glycine max
  Peptide Sequence Number=SeqID_166567
ttcccaaaattccattcttcaactcgcgactcttccctcacgccgatgaccctcttcttcaagaaacactgtccgagctcacggagcgtcgattgggtgcggacatagggggacacgtagaactgcacccgccagttaggggagcagttatcgctggcctatcctgtggtcgaggtgctcgtcggggtggagggcctgagtcaggccttgcgccgttgactgaatgctgtggtcggtgtgcttcagctgcactgataccgatcatgtggggacctttcaaagcttattgctatcagtcatttctggatgggattgagcatattgcaatggttaaaggtaagataggtgatgggcaggacgtacttgtgagagtacattcagaatgtctcattggtgacatttttggggcaacatgtcaatgtggaaaccaactagaacttgcattgaagcaaattgaagcagcaggccacattgtccgtgcttgcccattggaagatgacaagcaagaggaattgcagttacctgctgattctagggagtacggtattggagcacag

SEQ ID NO: 49790 - DNA, 258 bp, Glycine max
  Peptide Sequence Number=SeqID_166568
atggatgaaggggtatggtcaaaggatttgaagtcacggagaaaggttgaggcgtatagctttagattggataactgccacatacaactcaacctcaacaagactgtggagaccaaagatgggaaaaagaagaaagaagtggcagtgcaagggagaatgcgaaagaatgctatcaactcaagcggtggtgaggacaatagacatgacggcgacgatagacacgtgttcagggttttcgaatggaacaaattgagatag

SEQ ID NO: 49791 - DNA, 279 bp, Glycine max
  Peptide Sequence Number=SeqID_166569
atgaaggaagagaggtcagcaaagttagaaagaagtaaagtaaatggaagatggaggtactggctagagcagtgggtaaatacacaactttcaaagagtaaagagcttgaagatttagactcaatttttagatcacattctagagctggtgaggaatatggaggaaggaaacttaagccgagaagtagtattcaaagaaaaaatccagttgaaggattcttagttccaaatatcttctcaagacgttggccacaagtagttcctactacatcaggttga

SEQ ID NO: 49792 - DNA, 609 bp, Glycine max
  Peptide Sequence Number=SeqID_166570
atgaggggcaaccctcaccctagagcattgttgcttccaatatttttaaattggaagtggaagttactgaaagttgaagttggaagtggaagttggaaatggaagttattggaagttgaaagttcaaaatggaagttcgaagttggaaatgaaagttattggaagttgaaagttgaaaatggaagttggaagttgggaggggaagtgattgtcatcataaaaaagggagagaatgtaaatcatgcaggttttgatgatgtcaaagagaatttgcttgataatgagcgtcatcataaaaaaggggaagaatgtggatcatgcattgttttgatgatgttgaaaagaaatcacttgattgtcattatcaaaaagggggagaataagggtttcaaagtcatgcaagactctggtaatcgattactagaagggaaggttgaaaaagagttgttgaaaagagttttgaatttgaattttcaacatgtaatcgattaccatatgtctgtaatcgatttaccagcaacagaactttggaaattcaaattcaaaggtcatgacccttcaaattataactatgtaatcgattacataaacattgtaatcgattactag

SEQ ID NO: 49793 - DNA, 291 bp, Glycine max
  Peptide Sequence Number=SeqID_166571
atggaatcgtccactgataagaaaaaaaagcttgatcatccaataatgataaagaaatttttcacaacagtttttcaagtaagcacttgtgctaaaaggagcagtcgtgctaagtggaccctgtgggctcagcgcgcatccaccactaagcacaacttcaacgtgcttagtgtgacaaaggaatctggaagagcacaagaatcaaggctgcgtgctaagcgtgagatctcctcgctaagcaagacttttaactttagccaggctcaacgcacgactagcgccaagccctaa

SEQ ID NO: 49794 - DNA, 561 bp, Glycine max
  Peptide Sequence Number=SeqID_166572
atggagacaaaagctgatctgagacatccttcaacccaaagtgatccagagttggaacaagctattttagggaatgatttgaacaaattgcaggaagttttacgattgcgtcatcatcaaagagatgaattaaagtgtcagaaagaagaagagcttcacaaaagaagcaatcgtgggctcgttgcaccgttgccacaccttaagccttatctcgacgcgtcgtcacaatcattttccctctcacccagcttaaccaagtgcatttggttttactggcgacaacatgtagaactagtgatcaaagcgcataagttgcagcgtttcatcgtcaatccggtcgttttgccttgctatctcatggaggataatcgtattgtagattgtgtgaatcctgagtatgaagcttgggaagttcaggaccaaacacttcttgtttggctgcactccacactctcgaaatcagtcttgtcgtgcatgctgggcttgaatcattcatatcaggtttgggacaagatccatgagtatttcagcttgcacaccaaatctcgtgctagtcaatga

SEQ ID NO: 49795 - DNA, 2498 bp, Glycine max
  Peptide Sequence Number=SeqID_166573
atggagttggcttcccactgggatcgaggattatgcttcaactgtgatgaaaagtttcaccgtgggcacaaatgctcctctatggttttcttgctgatttcggatgaagatgattccccttttgaagacaatgtgactttggatcatccacccggcccacccgatgacctagacctaaccccggcccaaatcagctttcattccctttcgggccacctagcacctgagatgctgagcaaggttgttgggcctgccttcgcgcaatacaaacccactgagtgtcatggtggcggtgctaacctggtgctaggagtccaatggcttaaggctctcggacccattctcacagactacaacaccctttccatgaagttcttccatgatggtcatttagttgaactaaagggtgatgatgtgtctactttgggtctcctttcacacccccaggttcatcgtcttctccgaaaggatggcacgagtgcgtgtttccatatagccatcaccaccatagagctcccctcaagcccaaccactacaatcatcccctccaaaattcaaccccttctagccaaatgcaactccttgttccaaccaccccaatccctgccaccttcgcgtcccacagaccatcacatccaccttcaacctcattcagagcctgtgaattcctttttcttcccctgttctgttagtcaagaagcacgatgggtcgtggcgtctctgtgtagattatcgggcactaaacgtgataacgacaaagaccgttatcacattcccaccattgacaagctgttagacgagttgggaggtgcaagctggttttttgacctagatcttttgcagggttaccaaattcggatgcatgaacctgatgttgctaagactgcatttcatacccaccctggtcattatgagtttaaggtgatgtcgttcgggttgtgtaatgccccctcttcatttcaagccacaatgaacgacatcttccgaccttacctccagcgattcttcattgtcttcttcgacaacattttaatatacagtcgaactttgctggaacatctactccagttaaagaaagcttttgagacccttcttcacaatcaattcgtccttaagttttctagatgcttctttgagcaaccacaagtggagtacttgggccacgttgtttcgggccaaggagttgcaccagtcgcttccaaggttcaagcaatagatcaatggcctattctgaaaaccatgaaagctctacagagctttctaggactcgccggattttactgtcggttcattcgtgtatatgcctctatcgttgctcctctaatcaaaataagcaccagggaaccctttgaatggacatgcgatgttgatcaagcatttaggatcctaaaggaggccctaacatctgttcctgggcacccaattgcattttttagtaagccattcactcccaaattgttgcaagcttcaacttatgtgcgtgaattatgtgtgattacgattgcggtcattcaaaccccagagcaacatatgtatttagccagactcatgggttatgattattgcatccaatatcggtatggtaacactaatttagtggctgatgctttatctcgaagatctgagaaaacagaaggcatccctttcattcagacgcttttaacagagtgccgctcaactctgacagggggccacatgggtgtgccgaaaatactagcaaggctcactaaaaacttatattggcctgggttaaggaaggatgtaaagcaatttgtggcgacctgtgtaaattgtcaacagaccaagtacgagaccaagaaagtcgttggcctcttatgtccattaccggtgtcatttctcgaagggagtgcacctgggcatgctgctaacacaacattctacttactcagccgttatcttgttcatggacattgccggaaaactccatggcatgccacggagcttggtctccgacagggaccctatctacgtgcgttccttcacaagaaaccttcctcatggggcaagctccttaattcggcagaatggtcttataatatgtcgtggcactcaagcatcggtgtctcgccattcaaggttactttcgaacaaaaaccgccagattggccacaatacatcacagagacctcgaaagtggaagcaatggacgaattcctctcttatagagaatctattttcctcgaattaaagaaaaatcttcaaaaggctcaattggccatgaaacactcaactaacaagaaacacaaagatgttgaattcaatatcggagacttggtcatggtgcttgatcgaattgggccaattgcttataagttacaattacccgatgacagttgcatccatcccgtttttcattgctccatgcttaaacaatttcaccaaccagctctggttaatgcttctcctgcactttcactaccaccggtagtaattgacaatgaaccagtggtatcccctcttgccattataagcaccag

SEQ ID NO: 49796 - DNA, 474 bp, Glycine max
  Peptide Sequence Number=SeqID_166574
atgtggttgcaatctaatccttctgaccagaacaacactgatgaactcaaacaattttctgattggctactagacataggtgatggcaaacttgaccaacctaacaatggatatagtgaaatcatcatcccagaagagtttcttataatggattttgatgattctatccaagcaattgttgatacaacatatccagatttattacaaaactacaacaacgcagatttcttgcaaaagagagctattctagcctcaacaaaagatgttgttgacaaaataaatgattatgtcctgtctttgattcccaatgacgagaaagagtattgtagtgctgatactgttgacaaatctgatgaactactcaatcctgcttttggagtactaacacctgagtttctaaactccttgaaaacatcagggatacctaatcacaagctaagaatcaagattagtactcccatcatactactatga

SEQ ID NO: 49797 - DNA, 345 bp, Glycine max
  Peptide Sequence Number=SeqID_166575
atggatccgatccaagctaccaacgagctcgcttttcgggtcgggttctccggccacagttgtcacctccgtctggagccgctctccacggcggaggagtgccgtaacccgctccgctccattccggatttcatttcggtcagtcacctcattgttgacccctacactttctccctttactctgttttcgtactctctagcatgctgggttttgatatcatagatgtcgttgatctatttgtgattggatttcttattgtgtttgtttgtttgatgctaacctgtgcatatgagaagacaagtgtggctcttcaacaacaacagcttctgtttaacaggaagtga

SEQ ID NO: 49798 - DNA, 174 bp, Glycine max
  Peptide Sequence Number=SeqID_166576
atggattgcaaatccttaagcattaaggcggtgaggcatagttcaggttccacttcttccatccttgaaacaaaacctttcagttataagttccacgttcctttgggtataaaccaaaaaaagtttccaagttccaaagtgatatataaagagacaaggagaggatggtcttag

SEQ ID NO: 49799 - DNA, 555 bp, Glycine max
  Peptide Sequence Number=SeqID_166577
atggccccacctaatttcttgggatgcacagtcatatatcaatttcaggaggcattccatgttgatagaaactacattgaggtaccttcaaaatatcattggcaatgggctcctcattacccacctcaggtgctcttcgattacaatggagacaagcactttataaaaattagaaaagatggtgacagatactattttgccgatgggcttaaagagtttagaagactcatgggcattcatgaaggtgtcatggtccattttatggcacccgacagtaatataacatttcagtccaccgttggaaagacaaacatgtggaaggcctcgcacatccaccagaaattatgtcttcatggtaataatggtcgtcgttatatatggaggatctctatgcataatggcgtacaatgtttggctgggccttggtaccgatacttaatggacaatgacctaatggctgttgatgaggtcgtcttctattttcgtcccaaccaacatgtatgggaacttatcttgaggaagcatctcatatgggatgaagatcagcccaattga

SEQ ID NO: 49800 - DNA, 131 bp, Glycine max
  Peptide Sequence Number=SeqID_166578
tgggggagagtatggagaatgctttgagagcatgctgtaaaggtataaagattgggaaaattttaattcacagagaaggtgacaatggtcagcagggaattcggctgttcaagcaatttctttcctcataa

SEQ ID NO: 49801 - DNA, 669 bp, Glycine max
  Peptide Sequence Number=SeqID_166579
atgcctcaatgtaatcttggattcgctcgacctccaacaaaattttgccactcaagattcttcccctcagcctctgaggttcttgctcctgcagtggatgagtttcttgtcattcttgctcccgccaatgaggttcttgctgctcctgcccctcttctcgatcctattcttgctcctgcacctaacaggatttatacttatgttgattttgttcctattccgcctgctcgggttcctaccaagccattggaggaaacattctatagcattgcatctaagcaggtccatgtgccgagcagctacccacaccacttgctgtcacagaatacggagtccaatcacgtcatgttatccagtggctcatcccagtcgattcatagcaagaaatacatacattggacaaaagaagaacataggtcgtttctccttgggcttgaggaatataaagagagtagatgggaaaagatttcagagaaatttgttccatcaaaaactccaactcaagtcgtcagtcatgctaaaaacttcttcaaatggaagaatgccccaaagaaagagaggaaaagaagaagcatccatgaaacaactttagacgacattgatatgatcgttactcctcatattgatcaacataattggcttccacctcctccaaattttgcagtgtag

SEQ ID NO: 49802 - DNA, 1894 bp, Glycine max
  Peptide Sequence Number=SeqID_166580
aattgtggttgagatggcaaggagtatgatcaaagctagaggtgtgccaaacagattctggtatgaagctgtagcaactgcagtgtacattttcaatgtttctcataccaaagctgtcatgaacatgacaccacttgaagcttggagaagaaagaaattgtctgtaagtcatttgagaatttttggttgtacaacatatgcattagttgatttatggactaagttggatgataaatctatcaaatgtgtatttattggctatgctactcagtcaaaggcatacagactgtataacccactaactggcaagataattgtcagtacaaatgttgtatttgatgaagatgcaggctgggtttgggaggaatgtgaaatcagtcaaagtgttcagcagaaatcagtcaattttgatggtttagaggaggtctcaaatgtgccacaaaatgatcacactccaagccctccttcaatgccatcaagccagggatcattaactccttcaagccaggtatcatctagctcatcaaaagtggagtggaaaaatgcaatgaaagaggagatcaagtccattgagaagaatgcaacgtggcaattgctgaatcttcctgaagggaagaatgtcattggactgaaatgggtgttcagaacaaagttcaaaacagatggaagcatccaaaagcataaagctaggttggtggctaaggggtatgcacagcaagaaggaattgattttgaggaaacattttcactagtagcaagatttgagacagtgagagtgatgctagcattggctgctcaatggaagttgaaggtgtttcagttggatgtcaaatcagcattcctcaatggagacttgcaagaagaggtgtttgttgagcaaccactggggtttgtcaaagctggtgaagaaggcaaggtatacaagctgcaaaaggcattgtatgggctgaaacaggctccacgagcctggtatagcaagattgattcattcttccttcaaaatgaatttgagagaagtgagaatgaaccaactctctatgtgaagaaaggtacaaatggatttatagttgtctgcctttatgtagatgacataatctattttagctcatctccaaagttgctagaagaattcaaagctgccatgatgaatcaatttgagatgactgaccttggattacttcagtactttctcagtttagaagtgaagcaaggagaagatggaatctttctctgtcaaagaaaatatgcagaggatttgcttaagaagtttcatatggagaaatgtgaagcaatcagaactcctatgaacacaaatgagaagctgcaacgtgatgatgctcgtagtgtgagtgtagtttcaagatatttgcactctccaactaagcaacacttaggtgcaacaaggagggttcttaagtatgttgcaggttcaatcaaacttggagtactttatgagagtgtggataatttcaagttggttggctatagtgatagtgattggagctccaagaagcaagacacagttgctttatcatcatctaaagttgaatatgtagttgttggtgcagcagcaaggcaagcaatctggttgaggaaattgctaaaggatttgtactgtgagcaagaaggtgcaatcgaattgtggtgcgataacaggtcttctatagccatgacaaagaatccagcgttccatgcaagaaccaagcatattgaagttcagcaacacttcataaggcagctagtggcagaagagaagttagtgctaaaattctgtggcacggatgaacagaatgcagatctgtttacaaaagctttagcacaagcgaaacatcagttctttttggagaaaataggaatgcacgagcttgaattaagaggaggtgttgcaatataa

SEQ ID NO: 49803 - DNA, 456 bp, Glycine max
  Peptide Sequence Number=SeqID_166581
atggagagaaagaagagagaagtgggagagaacaataagatgggagaggaggaaaatgaaaggccttgcattggtattggtactgcctcggtaacgccaaagcatcgcgggaaattggataactggttgtgcgacacgttagccctgacaatgccacgtcagcattgtcagggccttgtttgtatcatgatagatgaaaagggtgtacctaagtccaacattatattccttaatctgatatcctttaaatggttctcatttgatgctgcaccttttcaggcagctaaaggtgtgcatgtggtatgcaaaagttttccaagaataaagatagtgacatccgagattgagattggtttgaatgaagatttccgtgtcatacctggcatgggcgagtttggagatcggtactttggaacaaatgatgatgatgagcaagtggcagtttcttcccagtag

SEQ ID NO: 49804 - DNA, 1227 bp, Glycine max
  Peptide Sequence Number=SeqID_166582
atgaaatctctcttcaagtcacaagagctgtggagcagtgttgagagtgggtttgaagatgatggaactgaggagccagaccaagccttgagggagaaaagaaagaaagatgcaaaagcacttttcatcatccaacaagctcttgatgatgaggtgtttccacgcatcgcagcagcttctacaacaaaagaagcatggtgtattctcaaccaagaatatgtcggagacaagaaagtggtcaatgtaagattacaatctctgggaagagaatttgagtcattccaaatgaaggaaaaggagaacgtgcaagaatgtttgtcaaggatatctagcacagttcaacagatgagaaccttgggtgaagagatcaaggaaagccaggttgtgagtaaggctctcttcattcacatgaagaaagaatatgcaaaggtgatgacaagaaagaagagaaggcttttcaggcaaaaggagagtcttcaaacaaggagagagcaaagtaaagttcaggcagaggcagaggtagaggctccagagggagaggtcgtggaagagggcagagtaatgagtaaagggatcaatcttctcaaaattacaagggctcattcaaatgctactactaaagaggaggatgaacagaaaggacgtgatcaaaaatccaactttgtggagcaagaagagaagttgttcttggcacaacatatatcaaacaatgatgctgaaggtggagtatggtatgtagacagtgggtgctcaaaccacatgtcaaatgccaagtcaatattcaggaccttggatgaaacagcaaagaccaaagtgagactaggagatggaaagcagcttgaagtagaaggaagaggcacgattgcaatcacaaccgagcaaggcatcaccaagctcttatgtgatgtgcagtatgtgccaaggttggctcacaacttgctaagtgtcggccaacttctcaactctggctattctgtgctatttgaaaatggagcttgcttgatccaagacaggagctctaaagagacaatagtgaagattgccatgggaaagaacaagatgtttcctctagatttttcaagccatcgttggcatctaagatatggtcatttgaatatgcaagggctgaaattgctacactccaaagatatggtgcaggggctgcctaaaactgaaaagcttgagctgtgtgaatgttacatttatgggaaacaatcaagaggataa

SEQ ID NO: 49805 - DNA, 285 bp, Glycine max
  Peptide Sequence Number=SeqID_166583
atgcaattccaactcggccagagaatcaaagggcagatgactatcttgcttggatcaccgctacctcactccctatccgattcttctcctcaggatattctatcggcttattctccgacaatagatattcggagtatcccctatgagtggatattagttacaaaggaactagtcttaggacacttgaagaggcagaataacaagcagaagcaggcaaaaggctcaaagccaggctttaggaaagattcactacgtatcactatgaatattcagtatgtattttaa

SEQ ID NO: 49806 - DNA, 2982 bp, Glycine max
  Peptide Sequence Number=SeqID_166584
atggctgccaacaagtttgcaaccatgttacatagaaacaccaacaaaatcacccttgttctagtctatgccatcctagaatggattctgatcatcctcctcctcctcaattctctcttctcttatctaatcataaagtttgccgattactttggcctcaaaaggccttgcatatggtgcaccagaatcgatcacatcttagagcctgggaagtacaagagttcttgcaaagatcttgtgtgtgaagctcatgcctctgagatttcaaaacttggattctgctccaatcaccacaaactggctgagtcacaagacatgtgtgaggattgctcatcctcatcacaaccagattatgtcaaactctcccagagttttggtttctttccatggatgaagcagataggtatgattcagggtgagggtgcggatgctggtgacaaggcaattgtgaaggtggaagaggctttgaggtgttcttgctgtggtgtcaacttgtacaacagattctaccctccttgcattttgatcaagccttctctcaatgttttggagtatgaccagaagcagaattcggtgacggagcgcggcgttggtttggagattgatgaagatcacaccggatctgatattgtgcttgatcatcatcatgatgaaaaggagagtgaagaaaacaagggaagccacatggtgtttgaggttgatcagggtttggatagaaaagatgaggaggcagagaagagttgtgattgttctgtgtgtgatgctagtgtggagatactgtgtgatgaaatttgcaagttggatttgggtgtggagaaaggaaaagaaacaattgaagaggaaagtttgaatgtccctaatcctaaggttgatgatggtgatgatgatgttgttgttgctgatgatgatgatcaagcttgtgagaaatccagtgctcaagttgattgcactagagagataactgtggagactccacccatacatcttgaatttttcattcatggtgatgattgcagattgattcctattgaattggttgactcccctgccccagaaaacaggaatcaaagcagatataagttgggaggtgaagacctcaacagcaatgaagattttattctggactttgataagagtgctgatgcagaagctgaaccggttgttgagaattggcacatttctggggatgttgtggcagaatttccaacacaagggaatgaaaatgtttccaagtccaatgggggtgaatcagttcaattaaggaccagaggccagtcttcagagttgttacaagtagaagaagaaagtttggagcagaattgtgaagatgtgagatttgttcaaaccgctgatgacttgaccaatgatgataatgttgaagccaacatggaaagaagagttgcagaactatgttcagatgtttctctagcatctgaagatgcatcacaaatgcaaggtgaggaatatgaagcagaagtctcaatagggactgaaattcctgatcaggagcaaatggatgagtatgaaagccaagatgttcttttgtatacaaaccaacaaatacaagaagatgcatctactagcgcagtcagatttaatgtgcaagatgaaattggtgatgacaaaggtgaagattttgtagaatttaaaaccatgtcacttgaagtgaaaatgccaacagtaaataaccatttgccatctttattggagcttaatgagaatgaggaagaaaaggttccttacacacccacttctttggagagtctacatcagctacacaagaaactacttctccttgagaggaaagaatcaggaacagaagagtcattggatggaagtgtgataagtgatatagaaggtggtgaggtaacaattgataagttaaaatcagcattgaaatctgaaaggaaagccttaagtactctatatgcagaacttgaagaagagagaagtgcatctgctatagcagccaatcaaacaatggcaatgataaataggcttcaagaagagaaagcagcaatgcagatggaagccttgcagtatcaaagaatgatggaagaacaatctgagtatgatcaggaggctttgcaactcttgaatgagctcatgatgaagagggagaaagagaagctagagctagaaaaggagcttgaagtatatagaaagaaggttcatgaatatgaggtaagagaaaagatgatgatgtcaagaagagatggtagcatgagaagcagaacttcatctccctcttgtagcaatgctgaagatagtgatggattgtccattgacttgaatcacggagcaaaggaggaaaacgggttttatagtcatcaagatcaagaatgcagcaaccagaacacccccgtggacgcggtcttatatttagaggaatcattggcgaactttgaggaagagaggttacaaattctagaacagctcaaggtattggaagaaaagctagttatattgaattatgaggaagatcgctgctctgacgatgctaaattagtagaacatctttgtgaagagaatggaaatggataccatcatgatcatgatgatcacaatggtcaagtaaatggattttcaaatggtcatgcaaagaaaataaatggaaagcatcaagggaggaaactcatgggtgcaaaaggaaagaggcttcttcctctttttgatgcaatgagttcagaagcagaagatgtagagttgagtggagacgagttagatttccctcacttgcaaaacaattcagttgaaaaggttaatccggataagaaaaatattgctttagaggatgaggtcgataatttttacgagagactacaggtgctggaggcagatagagagtttctaaagcattgcatcagctcattgagaaaaggggataaagggttacatcttctccaagaaattttacaacatcttcgcgaactgaggagtgtagaactcagggtcaagaacatgggagatcttgcagtataa

SEQ ID NO: 49807 - DNA, 270 bp, Glycine max
  Peptide Sequence Number=SeqID_166585
atgagggttcactgttatcaagcaagtcggagacccagcaggaccacagattcacctccactccttatgttcccatggaccattagacgatcttttgattttgaaaggagagaaacgttaaggcgttggaccattaacgatctcttggtttttgaaagcagagaaacattaaggcattggaccattaacgatctcttggggtggttgacaaaagcgaggcttttgctcctatgtatcctcaattgcgatgaggaactcagacctacgtag

SEQ ID NO: 49808 - DNA, 137 bp, Glycine max
  Peptide Sequence Number=SeqID_166586
tcagggactacggcgggtccttgttctgcaacaacatcgacgaaagcccactggcaaccttggcggagttcaccatgggcaatgagtataacttctatgacatgagcttggtggacggagaagatgaagaaagttag

SEQ ID NO: 49809 - DNA, 306 bp, Glycine max
  Peptide Sequence Number=SeqID_166587
atggcatggaaggtggtggatatgacagctgcaaggatgaatagcagccagaggaggaaagttcctcatcattctcttatttgtgatgtttattgttggaaaggtcttaggctttcagcacgacaagacttggagggattttctaagtttactgatcatggcattgaaggggttgtccctctagaacttttgccacctgatgtccgatctaaataccaagctaaaccaaatgacagaagtaagcgtagtaaaaaggaagaaacaaaaggcactgcccatcaaattgaggaaaatcaggtttattga

SEQ ID NO: 49810 - DNA, 393 bp, Glycine max
  Peptide Sequence Number=SeqID_166588
atgcagttagcatggaaagaagagattacatcatgggaggaacgtgttaaaaaacttcttgaactgacaccaccaaaagggacagaatttcttcacaaaattgagcatatattggaacgagaaaaaaattgggtgtggtggaaacgtgatggctgcctcccatatgaaaaacaacgtatagagaagaaagcagtaccagatgggcccaagaaacggtatgattattattattataccgatgcttttgtcaatgctatgattgtctcgcttacattgttctatcttgctatctgcagtaggccaagatggagattgggtaataaagaactgtctcagttgtggaaatgggcagatcaaaatccgaagttggtgattgtggatgctgaacactag

SEQ ID NO: 49811 - DNA, 234 bp, Glycine max
  Peptide Sequence Number=SeqID_166589
atggcaataatagtcctcatagtagtcatcttagccatcggtgcaaaggaacaactgctaaagttgctgtcaaagataaaggttaagaaaaatcatacttttttggtggtttacgaatgtgagtactgcgacggatcagcaggatcagcagccagagaaaatgattgggagggggccttggagggattgaagggtgaattggtggaacagtcagacgtctttggtaaatcatga

SEQ ID NO: 49812 - DNA, 357 bp, Glycine max
  Peptide Sequence Number=SeqID_166590
atgtccgattcgaaggtcgaaaccatcgccagattagcccaatggaaaatcgacaacttcggaccctgctccttcaagagatcagatcctttcaagctcggaatttggaactggttcatgtccatagagaggaacaggtacctctacatacacatctttccagagccttctcggctttctaaggaacagccacccgtggcgcgcttcatcctgcgagtctccaatagctctggccctacccgcaaagtttacatttcccctgtatttggctctcagcgcaagatactctgggcacataaaaagaaattgcagacaaatgtggctgatggattcagggatttggttattggtgcctaa

SEQ ID NO: 49813 - DNA, 366 bp, Glycine max
  Peptide Sequence Number=SeqID_166591
atggttaaaaccaggggactgcgtcaggcttcaggcaggaatataagaagacggcgaaggcccacagcatctgcacgtaggcaacgggcagttgcacctgttgttaaggatgttgagcatgtggatcatgcagctaatgagatccatgaacaacctcaggaggtagttgctgattatgtagttgttgatgcccaaggttttctaagcggaccctatgatacatcaattttgatggactatgttcatcatgtggtagtcacagtttggaatggagaggaacgtcctgagctgaagttgtcctcccatggaaggaagatagagaaatttgacaggcctgctccagagattgaaggcttaaaggcttaa

SEQ ID NO: 49814 - DNA, 516 bp, Glycine max
  Peptide Sequence Number=SeqID_166592
atgaagtctttgatggctttcacaagttctgcccaaacctcatcatttctggatagggtagtctatgtaggtttcaatgctgtttctgcagagagcagcatgaagatggctagtgaagtcagggcgagtatcctctcctctaaagctgatgaaaacatcatattttttggtaacagcaagagtggaggaagaagcagaaccaacaatagcagaacaagtagaagccatggatgtgctattgctaggggtttgcagatgaaaatgctcttctctgctgtaaatattggaaagaatcacaaaaatgcagaaactcaaatagcagtgataaccaaaacgagggaaatatacaaggcattgcaagtaaaagaaacaactaaacaagaagggatagaccatttgcccgttaatcttcattccttgatatcagcagtacataacttcctaaacatgtatttcccttttcttcaacagcaatctgatcatgttagcttgagtgttcaaactttggagccatag

SEQ ID NO: 49815 - DNA, 1251 bp, Glycine max
  Peptide Sequence Number=SeqID_166593
atggaatgcaagaaacaaggagaagacattcatgttattcctgcgttctacaaaatagacccatctcaggtacgcaaacagagtggcagttatcatgcggcattcgcaaaacacgagaaggataggaaggtgagtgaagagaagatgcaaaagtggaagaacgctctctatgaagcaaccaatttatctggcttccattctaacgcatacaggactgaatctgacatgattgaagaaattgccagagttgttttgcaaaaactaaatcacaaaaactacccaaatgacttcagaggtcatttcatatcagatgaaaactgttcgaacattgaatctttactgaaaattgagtcagaggaagttcgagtcattggaatttggggcatagggggtattggtaaaacaactctagctgctgctatttttcataaggtttcttctcattatgaagacacttgtttctcagaaaatatggcagaggaaacaaaaaggcatggcctaaattacgtatacaacaaacttctttctaagttactaaagaaagatcttcatattgacactcctaaggtgataccctatattgttaagagaagactcatgaataagaaagttcttgtcgtaacagatgatgtgaatacctcagaagttcttgacaaattggtgggagtgggccgtgactgcctaggcataaatgcctttggcaaaacctaccctaaaaaaggttatgaggagttatcaaaaagagcagtggagtatgcgggcaatttttctgcagatatagggacaagaagtcttttagacaaagctcttatctctattacttcagatggtgatcacgtagatatgcacgatctaatacagcagatgggtagagaagttgttcgtcaagaatcaatcgaaaatcctgggcaacgcagtagattgtggaatcctgaggaagtctatgatggaaatggtgcagttgaaggaatatgtttagatatgactcaaattacatatatgaatttaagctctaacgcattcagaaagatgtcaaaccttagattacttgctttcaaatcctatcaagactttgagataattaattcagtgtaccttccaaagggtctcgaatgcttacataaaagcttaagatattttgagtgggatggatatccattggaatctctaccgtcaactttttgctctgagaagcttgttgagttttccatgccctacagcaatgtgaaaaaactttggcatggagtacag

SEQ ID NO: 49816 - DNA, 360 bp, Glycine max
  Peptide Sequence Number=SeqID_166594
atgcgtcaaagagaagcgttagacaacttgcaggacatatcacacttttacagtgttgcatatacgagcattttttttactgttgcttcttctattgctgctgaagattatgatgagaggaaaccacatgcttgcagttggaagtctaggaaggcattaccaatgtcgacgtatcgtaaacaattggatagattgacgtctaatgttatttgtgttgctcctagaaagtgtgcagcaaactacatcaagtggttctgcttcacatctcatcccttcatgagtccaacacaaccagaggatcctcctagaaatccacctgtggtgcacgatgatacgtttattgaaccagatcctccttag

SEQ ID NO: 49817 - DNA, 294 bp, Glycine max
  Peptide Sequence Number=SeqID_166595
atggaaaccctagcacgagacaagaggcgtagcgtaggagatggtgcggagcttgtgaaatcgaatatcaaaacccctccaaggccaaaacggcgtcgtcaaccactcaaatcatggcctgttactttctccccctttgctcgcgctctcgctctctctcgcatcacctctctctctccaccaaaccctaccccaaccctctctgctaagaaaccgcaaccctctcatatttatcccaaccggaacactccgagtcttccgacgaggacttcgatgtacgacctctcatcctaa

SEQ ID NO: 49818 - DNA, 177 bp, Glycine max
  Peptide Sequence Number=SeqID_166596
atggtaaggactaaagctgaaagagtaatagctgggagaatccataatcctctacaagagatcaaggaagtggttgatcccgagtttgattctttggtaaagaaaatgagtgaccaatcagagattgaacaactcattgttttgaatcctagaacttgctcccttgctttttggtaa

SEQ ID NO: 49819 - DNA, 189 bp, Glycine max
  Peptide Sequence Number=SeqID_166597
ctcaagaatgtagaacagaaaagaaaacagagcaatggtagtgatgaggcaataatatacataaagcttgaggatgaaatttttcacaagttaagctcgtggtccttctgttttccattgcaaactcagcagcttgcacctcatgaggcaagttttatgtttcttcaatctcaattaccatttttgtga

SEQ ID NO: 49820 - DNA, 168 bp, Glycine max
  Peptide Sequence Number=SeqID_166598
atgggaaatgagagaaagtgcagtttgcgccttgacttgacttgggtcattatactctacggtatgatcttttgcttaaatgctacattggagcatttgattggttatctagactccacgtgggagattgagagaatgtttttcattttcgaaacttcttttgtttga

SEQ ID NO: 49821 - DNA, 267 bp, Glycine max
  Peptide Sequence Number=SeqID_166599
atgagccatgggtgcctatatcaacaaaggataaagaacgcgttcgacaagaaggtgcgcccgcgcaagttcaacgagggggaccttgtgctgaaaaagatatcccacgctgttaaggataatcgaggcaagtgggccccaaattacgaagggcctttcattgtgaaaagggctttttctgggggtgctttgatactcaccaacatggatggcgaggagctaccctcgctcgtgaacttcgatgtcgttaagcgatattacgcttga

SEQ ID NO: 49822 - DNA, 570 bp, Glycine max
  Peptide Sequence Number=SeqID_166600
catcaaattgccaaggaaatcactgccaagcaagtccagcattggccaaagaaagggaagctttcagcagggaagctaagtgtgaagtatgcaatcctgcataggattggcactgccaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagactctcctctatccctgcattacaaactgtttgaggggacacatgtcccagacattgtctcgacatcagggaaagctgctgcttcaggtgctgtgtccaaggatgctttgattgctgaactcaaggacacatgcaaggtgctggaggcaaccatcaaagccaccacagagaagaaaatggagctggaacgcctgatcaaaagactctcagacaatggcgttgatgatggagaagcagctgaggaagaagaagatgcagcagaggatacagaatcagatgatgatgattctgatgccaccccatga

SEQ ID NO: 49823 - DNA, 681 bp, Glycine max
  Peptide Sequence Number=SeqID_166601
atgggtgaatgtgaaagcttgtcttttgttgatccatcaattttctccctcccaaagctttcctatttagatttgcgtggatgtaagccgcttatgagccttagcagcaacacttggccacaatctctccgagaattgtttttggaagattcaggtttaaatgaagtgcccccgtcaattttgcatatcagaaatgtcaaagcattttcttttccaagactcgaatttattacagttggtgaatgcaaaatgcttcaacatatatctgcacttccaccattcattcagtcctttgacgtctggaactgccattctcttcagacagtgttaagcaaagttggagactggttccattgccactttacacaacctttggtcaatactaaggatctcccccctaacttgttaggtttcattttctacttggttgtttctcaaatccaatcatgcaacattggacaccgtggaagtattggatgtgaatgctacttggaaactaaccgggatgaatggatcaatatatcaagtttctttgaaaaagaaaacgtctgttttattcccgatcctccacttgaatttatggaagatcatataatggaagtaattaaagagaggaaagccgttaatgacaacaccaccactcatcatccaaagcttatatttaaattctgcattgggtaa

SEQ ID NO: 49824 - DNA, 3168 bp, Glycine max
  Peptide Sequence Number=SeqID_166602
atgaatctgttattgcataatgcttctcaacctcatggaagttctccgaacaatggctccctgatggtgcaaccgattaatgcttcgttgcctgctaaagagatctcacatggatttcctcacttcgatggaacgacgccagtgatggagtggatcttcaagatggagaaatttttcacttattataatactcctgatgcgtctagagtggatattgcggcgatgcattttgataaggatgtagtggcatggttccagatgtcacagaaattatctctggtgtctacttggtctgagttgactcgtgctctaaagtctcaattcgttccttcaccttttgattgtccaatggctgagctctttaagcttcaacaaacaagttcagtatcagattattacctcaagtttgtgtctctagctaatagatctttgggattaagtaatgaggctctccttaatggtttcattagtggtttaaatcctgatattagaagagatgttgttgctatgtgccctcctaccttattgcatgcagttgctttagctaaactttttgaagaaaaatatggtcttggtacacaagaagatgaaatagtagaatctgaagatcatcatttgtctttcaatgctttgaaaggtggtaggggagttggtactatcaagttcatagattatattgaaaatttaccagtgaccgtgttgattgatggtggcagttttgataattttttgcagccaagggttcatgctcaaggaaatacctttcaattaccaatatttttgcttcctatttttggtgttgatctcattttaggagctagttggttgaagactattggctctcacattgctgattatgatgctttgcaattgaagcttttgtggaagggtaaatttactactttacaaggagattgtataagaagaatggtggccactaattccattgctgaagtttatagcctgcagttgatggagtcagatgttgttcttaagtctatgcttgacttaccagttatgatggagcctgaattagccttattattgcacacttatagtgtggttaagccttacagatacccctatagtcaaaaggaagaaattgagagattggtgtcacgaatggcgtgtattgattataaggctcttaatgcaattactatcaaggacaacttccttattccgactgtggatgagttgattgatgagttttttggagcttccttcttttctaaattggatctaaggtctagttatcaccaaattttgttaaatctggatgacaaacataagacaacatttagggctcatcatggccactatgagtggttgattatgccatttgacttaaccaatgctcctgttacttttcagagccttatgaatgacatttttgctggaatattaagaaaatttgtactgattttctttgatgatattctgattgattacttgggacatacactgtctggttcaagagtagctatggagggaactaaattggaagctattcaaaatgttgctgcatcagaagcatttcaacaactcaaaatttccatgacatctgctcctgtattggttattcctaatttcaaggaaatttttgtattggagacggatgccctaggaagtggagttggtgctgtccttagccaaaataagcatccaattgcttatttctctaagaaattgtccttaaggatgagcttcatgatggctgcatctactcttatacattcgtggattaatcaagtgatggatttgactcaaactgattctcaattatccaaaatttatcaaaactgtttgcaaggcaaaattatgttacctcatgatgttgggctgcttaatcagaccatggaagaatttcatagttctaaaattggtggacattctggaattaatagaacaacagctagaattggtgctcaattttattggaatggtatgagaagtgatattagtaaatttatgagagaatgtgtcatatgtcaacaagctaaagttgatcatgttttgccagctgggttgttacagcctcttcccattcctcaacaaatatgggaagacatagcaatggactttattgttcaattgccttcttcacaaggatttacaaccatttttacagtagttgatagattgtccaaatttgggtactttattcctttgaagtctgagtttaacagcaaggttgtggctgaagttttcattaccaacattgtcaaaattcatggttttccaaaaaccattgtttctgacagagatagaatttttattagcactttttggcaacaatttttcaaagctcaaggcacaacattggtcatgagctcttcatatcaccgtcagtctgaaggccagcctaagaatcttaataagaccattgagatgtatctaagacctccactagcggtgatgcactacgaggttgatcctaaagatcctgatccactcaaggatttattacaactacgtgatcaacttttgagcaagcttaaaagtaatttactaaaggctcaacaatatataaatatgcaagctgataagaaaataagagatttgcaatttaaggttggtgatatgattttagttaagctacagccttacaggaaacaatcagtggctttgaggaagcatcagaagctaggcatgcgctattttggtccatttctagtgattgaaaaaattggtacgattgcatataaagtacaactgcctgagtctgctaaaatacatcatgtatttcatattgctcttctaaaaccatttcatggcaaaagttctccaccatatcttccttttccactcacttctagtgaattgggaccaacgctttgcccatggaaggcgttggatgttcgagttatcaaacgtttagaagctattgtgtcccaattattgattcaatgggaagcaactaaagctaaggatgctacttgggaagacttgcgggatatatgtgaatcttatcctcagttcaaccttgaggacaaagttgttttctatgagaagagtaatcacaaggttgaggagggagaatataaggctggaggattacacgttgtaggattattcggaggtgattctgttgccgataacggccgaggagtgtgtcgtgatcatcgttcttcctctacttcgttgcctcttgtttttgtaccttga

SEQ ID NO: 49825 - DNA, 1641 bp, Glycine max
  Peptide Sequence Number=SeqID_166603
atggatccattacctagcatagctaaggttttctcatatgttgttcaacaagaaagacaatttaacagtaataatgtaatgggaaatacaagtctaattaatgcagttaataccagttcatcgaacgcaggaaattcgtgcacctattgtggcaaagataatcacattgttgggaactcaggaggaagaggaagtaagttgtgcacacattgtggtctcactaaccacactgtagctgagtgttacagaaagcatggttatcctcatggacacaagctttacaagtctcagagttcaaacatcaacaacatcagtaatgtgaaagaaaaaggtgataactcagttcaagagaggaatcaagaagcagaaaatgaagatgtgaagctaaccactcagcaatataaagatttgatggcactgttgcaacaacaaaacacagttcataacaactcacatgtgaatcaaattggtacagttaacaaaaagggtagtatatccattacttgtagtataagcaagaccattaaagatgagtggatctttgattcaggtctttacagactcaagatggttcctctcaagcctcatggagagtacaactctaattccatctttgtccctatttgtcctagtgtttctagtatttcagctttgtcatgtactagtctctatcctcttagctctatcttttcctataacagattatctccatcttatcacaacgttatttcatctatcacacaagatgttgaacctcagtcatataatgaagcatctaaggatcctaattggattcaggccatgcatgtagagatcaaagcattagagcttaatgatacttggattcttattgatcttcctaagcacaaaactacaattggttgtaaatgggtgtacaagatcaaacacaaatttaatggttcaatagagaggtataaagccaggatagtggctaaaggctacactcaagtggaaggacaagactatctagatgctttctctccagtggctaagttaaccacacaactagatgtgaacaatgctttcttacatggtgatttaaatgaagaagtgtacatgactatcccccagggcaatgatttgtctgaaattcaaaggattacacatcttttggataatgctttcaaaataaaggatttaggagatttaaggtactttctaggtttcgaggtagccagaagttctactggtataaacctctgtcaaaggaagtatgcacgagatattatcaatgatgctagcatgcttggttcaaagccagtgtccacccctggttgtattgatactaaaagatctatctctggttatgttgtgtacattggtgattcattaatcttgtggaagtccaagaagcaagctattgtatccagaagttcctctgaagctaaatattgggctttagcaaatgccacttggttaccgcaagagttgcggcaggtgctgaaatctggtgtgggcaagtgcacgtgctgcgccaacaaccgcgtcgatctcgtcaactacgacaaggttctcaaactcttcttcgttcctgccgcccggaaccgccgccgattcggcgtcggcgaaggttcccggcgccttgcgctgccgtttatgcgaccgcgcggtggaggctga

SEQ ID NO: 49826 - DNA, 144 bp, Glycine max
  Peptide Sequence Number=SeqID_166604
atggagagagaaagagagtacggtgtaatgatgctgaccacgcagccaggaaaaggaaaatcaaacggagggaaaattagggttaagtctgagggcattttgggaatgagaattcaaactggtcgatgggaaagggccttctga

SEQ ID NO: 49827 - DNA, 1413 bp, Glycine max
  Peptide Sequence Number=SeqID_166605
atggcttctctccccaattcccccgctctttcattctcctcatctctctccaccaccgccaatctcctcccatgtcgccgcttcaccgcattcccccgccgccgcgcctcttcattctccgtgcaagctaagatccgcgaaatcttcatgcccgcactcagctccaccatgaccgagggcaaaatcgtctcctggatcaaatccgagggcgacatgctctccaagggcgacagcgttgtcgtcgtcgaatccgacaaggccgacatggacgtcgagaccttctacgatggcatcctcgctgccatcgtcgtcgccgacggcgaaactgcccccgtcggagcccccatcggtttgctcgccgattctcccgaagaagtcgccgaagccaaagccaaagccgccaaatccgttccctctggctctcccgcccccgcctctccctccgacccttctccggcgactcctccgccacctcctccgccggccaagtctgtttcagaaggtccggcgaagatcgtggccacgcctcaggctaagaagctcgcaaagcagcacaaggtcgacattgcaacggtcgccgggaccggtccgttcggtaggattactccggcggacgtggaggccgccgccggaatcgcgccgtcaaagagaaatgtggctccggcggcgattcctgctccggcgactccagctcctccatcgaaagctgcttctggttctgctgcaccggctccgattccgggttctagtgttgttcccttcactactatgcaatctgcggtggcgaagaacatgatggagagtctatctgtgcctacgttcagggtggggtaccctgtgactactgatgcgttggatgccctgtatgagaaggtgaaaccaaagggtgtgacaatgacggctattttggctaaggctgctgcaatggcacttgttcagcacccggttgtcaatgccacctgcaaagacggcaagaatttcgtgtataacggtaacatcaatgttgctgttgctgtggcaattaatggtggtttgatcacccctgttcttcaggatgcggataagttggacttgtatctattgtcccaaaaatggaaggagctagtggaaaaagctcgtgcaaagcagttgcaacctcatgagtataattcaggaactttcacgctttccaatttgggtatgtttggagttgacaggtttgatgccatacttccaccaggccagggtgctatcatggctgttggcgcatcaaagcctactgttctggctgataaagatggattcttcagcgtgaagaataaaatgctgaacaatggacagaattcaggtgaatacagactcttttttgtggaaatagatccttttagcaaagcaccagagtcatcatatgtagcaattaggcataaaccttag

SEQ ID NO: 49828 - DNA, 672 bp, Glycine max
  Peptide Sequence Number=SeqID_166606
atggatgagcgcgtggttatacagcaacctctttcggccatagcagagacgtttgaggaactttccaagaggaacaacgccaacgagattcgcttggacactttctgccaggctgcgtctctcgtctccgttctcttccgttctctcggtctcgctttcaaattcgctgaattggaatacgtcgccaagcgattgaatagtgagcctcagattaagtttgctaccaaacgtgttaatgtacacgaactacatggactattggaagcatcaaagacatgttccactctaccggatattcttaaccttgatgtcgccagtgacacagtgaaaacatccggaagtttttcacgtaatctgcgtagagttcggcagggtcttgatcttgtcagagctatattcgaacaacttttgtcaactgatgatagttctctaaaagaagtggcttcaaccgcttacggacaagtttgtgccccatatcacacatgggcagtaagaacagctgtatatgctgggatgtatacacttccaacgagagatcaacttttgatgaagctcaatgaaacagagcaatcagctgacaagaagatgagaaggtacattgctgcctcgcttccaattatagaatacattgataaactgtaccttgctcgaaatattacgttggactggtga

SEQ ID NO: 49829 - DNA, 2991 bp, Glycine max
  Peptide Sequence Number=SeqID_166607
atgaatatcatatcttttatgccttctcctggaaataaatttgtgatcctggaggcattgaaggaatctcctagtagaagtaaccactcacctgatgtcacatcaaaagctaggggctatgctgaagatgttaaccatagttcatttatcaatgaacaattgcctgaagaagtcacctctaaatctttacctgctgctggcattgcaagtgatggttcatcagagaatgatgaaaatggagaaaatgaaaacataatagatgtaaaggaaggtgatctgaatgatgggttgaggaatatgtcagagaagctatctgctgcactagtgaatgccaatgccaaagaagacttggttaagcagcatgccaaagttgctgaggaagccattgcaggctgggaaaaggctgaaaatgaagtggctgttttaaagaagcaacttgacaccgtcattctcaggaattcagttctggaagatcgagtcactcatctagatggagcacttaaggagtgtgttaggcagctaaggcagacaagagaagagcaggaagaaaatatctatgatgctgttggaaaaaagacacaggaattggaatcagctaaaattaaacttgagaacaaactcactgagctccagaacaaattagatgcttcagaagccaagtcttcttctattgactttgatatgtgtcaaaaggttgaatatttggagaaagagaacctggctctcaggcatgagatcctagttcaatcagaagagctagaaatccgaacaattgagagggatctaagcactaaagctgctgagacagctagcaagcagcatttagaaagcatcaagaaagtagccaagcttgaggccgagtgccggagactgaggagcatggcttctagaacttccttatcgaatgatcataaatccattgttcagtcctcatttagtgttgaatcgctaacagatagtctatcagacagtgcagatcgacttactgcagtggagactgaagccaacaagatcaatggctcagaaccaaacaagtgtgagccaagttgttctgactcatgggcatctgcactaattgccgagcttgatcagttcaagaatgaaaaatgcagacaaacgccatccaattctgttaaaattgatctcatggatgatttccttgaaatggaacgacttgttgcattgcctgaaagtgagaaggaaaccatggtccaagagtcagttgttaccaatcaatgcatgaacaaagaaagctctctcagagtagagtttgagatcatgaatcagcaaatggatgagctaaaagaaaagttagagaaggtggaagctgataaagctgaactagagatagctttgatgaaaagtgaagggtgtattgaggagtcacagcttcagttgagggaggcacaagagaaattggaggagttgcaaagagaggtagaaaatgcctacaaatcaaagcaaagggtagaaaatcacctactggacatggtggctgaggctgaaacattatctgtgaaggttgaattcttagaagctgaggttgataaggagagggctgtgtcatgtgaaattgcaatgaagtataggaacctggaggaagagttagaaagaaaatctgcaaaggttgatatactagaagctgagcttgataagaagaaggatttgtcaagtgaaattgcaatgaagtgtagggacctggaggaagagttagaaagaaaatctgcaaaggttgacatactagaatcagagctagataagaagaaggatttgtcaagtgaaatagcaattaagtgtagggacctggaggaagagttagaaagaaaatcagcaaaggttgacatactagaagcagagcttgataagaagaaggatttgtcaagtgaaattgcaatgaagtataaggacctggaggaagagttagaaagaaaatctgcaaaggttagcatactagaagcagagcttgataagaaggacatgccaaatgcaattgcaatgaagtgtaaggacttggaggaagagctagaaagcaaatccacaaaggttgacttgttagaagccaaggttgccaaggagagggttgtgtcagaaaaaattgcaaaaaagtatatggacctggaggaagagctagaaagcaaatttgcaaaggttgagttattagaagcacaggttgctaaggagagggatgtgtcagataaaattgcaaaaatgtgtaaggacttggaggaagagctacaaagaaaatctgcaaaggttgagttattagaagcagaggttgctaaggagagggatgtgttggataaaattgcaaaaaagtgtaaggacctggaggaagtgctagagagcaaatccgcaaaggttgaattattagatgcagaagttgacaatgagagagctgtgtcagatgaaatttcaatgaagtgtaaggacctggaggaaaagctagaaagaaaatcagcaaaggttgacttgttagaagaagagcttcataaggagagggctaattcagaagaaattgcaatgaagtgtagggaattggaggaagaattgctcaggtcaacaactagctcatacggagaaaagaagattaagcaggaggacctagcactggctgccggaaagcttgccgagtgccagaaaacaatagcatctttggggaatcagttgaaatccctggctacactagaagatttcctcattgacactgcaagcattccagcaagtccatcactcattggtcaagctggtggggagttgtggaagtttcattcaaatggcactttttcgcctaaaagagattccatttcttcaaggttggctgatggtagctcttgtccatccttaaacaaaaatgaggaaacctcgtcgctttcatcgtcttcatcaacatcatcgccggccttgccaaatcatgtcagttctgagaggagtagaaatggctttgcaaagtttttctctagaaccaagagcgggatccggctagaaatttag

SEQ ID NO: 49830 - DNA, 255 bp, Glycine max
  Peptide Sequence Number=SeqID_166608
atgattcaagttagttctactgcacccccaatggttcaaattagttctattgcacctcatgtgagtcgagcttcttctgcacgtcaagcttcatatgtgtcatctcctgcaccacttggtagccaagcatcatctcctgcaccaccaatcagccaaacttcatttggtagatcaaccaatcacaatgtagttgaatttgcaccacagactatgcaccagtctccaatgaaaagaatttgcttggatgtggagtga

SEQ ID NO: 49831 - DNA, 852 bp, Glycine max
  Peptide Sequence Number=SeqID_166609
atggtggtgggggtgaggctacagtcatttctgggactggtgaggggtgagactttgtcatcgttgtctaaaggaagatcaacggttggtgatggtggttatcgtgggcgtgaaacaaacgcatggtacacaagtagaaagaaacacaagacaacatactttttaagggaaaaacatgggcgtgtggagttatttttggggttcctaactggaggaagtgattttgttgtaattaatgacaattacaatggaaaggagggtgatgtacaaaggaagggtgagggtgatgtttttgatactaatgcacagggtaaaggtgatcatgttgctactgctgatatagagggtgagggtgatgtagttgttgttcatgtacagggtgaaggtgatcatgttgatgctactgatgtagagtgtgagggtgatgtagatggtgttcatgtacaaggtgaaggtgatgtacaatgtgagtgtgatgtacagggaaagggtgatgctaattcttctgaagatgaaaattatgttgctaaagataattctgacaatgagtacacatttatggaaaatagtgattatggggatagtgatgttttggacacaccaccaagcaatggagatgaagggagaaagacccaaaagtttccaaggtttagaatgcctgaggatgatgttgaaattcgcattgaaaaggggatgattttgaactccaaaattgatataaaggtggttattaaaacacttgcaatggtgaacaagaagaatctgatcattcagcaaaatgatttgaagagggttgttgtgaagtgtatacatggttgtccattccatttacggtttagtaagtcaaattag

SEQ ID NO: 49832 - DNA, 141 bp, Glycine max
  Peptide Sequence Number=SeqID_166610
atggctctacagcttcatcgacaaggcaaacacgatatacacacactaaagaggtgtgaggatatcagagctacattctttctgcaacccaagcttgttcctcagaggaggaaagttaatcttattcaccgtcaagtgtag

SEQ ID NO: 49833 - DNA, 2925 bp, Glycine max
  Peptide Sequence Number=SeqID_166611
atggctactgatgcccgtgactcgcgtcgcaagtatcgccgatcatcctctccggaggacgtggacagatcctcgaagcgccacaagcaccgccaccacagccaccgccaccgccacgggagcaaaaaacgcgacgaagagattaaattcgatgatcgaacaattggtgcggttccttctccaactccgcacgggcatctccctgacgacgatgatgtggaggagggagagatccttgaagatgaggctctcgacggcgaggttgggaaaaaggagacggaatctgatgctgaacccggtgaaatcaaggtgacgggagatcgagatgttcgatctgataatcaaaattcgggacaccttactaaaatttcagtaactagaaatgaggacattagggatgataaatttattagtcctgcaatcaatgcagaagatgatgtctctcctaattgttcaagttctgagactcgggatggaaagcatgctcaagctcgtacagatggcgtgggcaatggttttttggatcctaaatcttccaaaggggataagtggcacaatggggaacttggacattttaaaggtaatgagaaactaaaaggagactttgatgatgaaacactggaggctaatgtgaggaaagcacattacaataggaattcatcctctgaaagtggagggggaaaatatagaatgtcaggaagttctccttctcatggtagatatagaagtcgatcaagatcaattggtcatactagagacaggtctcgctctcgtagtatcatagatgaatatgctcattccaagagaaggcgctctgactatgaccatgatgaggaaagagtgagggtacgtggaagggagcatggtcatggcagtgtggtagatgatagaagggaatacagtaccagatatcacaatcgagaggccagggatagagataggagtagggatagagatgtggatagagacttgcacagagaaaagaaacaagaggaaactagcaggggtaaagagattgagtgggaacacaaaaggggaaaggaacgtgaaaggagccgtgagaggtatagaagggatgcagaaaaagataggagcagggaaagggaggaggatggggacaggagacaagaaaaggaaagagataggagctgggatacagtgtttgagagggataggagaagggaaaaggaaagagatagaagtagggacagaacaataggtggcaagagagatagagacccggagaatgaaagggatgataagaatcgggaaaggcgagatgatagatatgggcacaaagatagagacactgcaaatggtaaggataggcatctgcgtcatgaggatggtaatgacaacggagatagatatagaaaacattcaaggcatgaagaaaatgaataccattgggaaagaaaaagaaattctgataatcctgtaaaggtttataattcaatgggaagtactgcagaagtggatgaaagcaaactaacaagcagtgaggttgaaccagatgacttagaggaggatacattgcaattacctgagcaagaagaggaagatctcaacaggattaaagaagagagtagaagaagaagggaagcaataatggagaaatacaagaagcagcatcagcaagtagaagcagtggttggaaatgaaggaaatgacaaggatgcagacattcctaatgacatctctgaagcatgtgatggtaagactgatgatgctgattatgtggagccatcatttgctgttgggaaatctcctgaaaatgtgaatgttgcttctaagaagatatctcctgctggaggcctgggtgagggtactccaaagagtgaaaggtcagaggacaagttttgtgatgatatatttggtgagacgccaacgggagttcggaaatcaggaaaaggagatggtttgctgattgagagggttggcctacatgacaattgggacgatgcagagggttattatagctatcgtattggtgaaatacttgatagccgatatgaagtcacagctgcacatgggaggggtgtcttttcgacagttgttcgggcaaagaatctaaagatgggaaatggtgagcctgaagaagtagcaataaaaattattcgtagtaatgacaccatgtacaaggctggtatggatgaattggtcatattgaagaaattagtaggtgcagatccagatgataagcgtcattgtgttcgtttcctttcaagttttagatacaggaatcatctttgtttagtttttgaatctcttaatatgaatctgcgtgaggttttaaagaagtttggtcgcaatattggccttaggcttacagctgtgagagcatacgcaaaacagctttttattgctctgaagcatctccggaactgtggtgttcttcattgtgatataaagccagataatatgttggtaaatgaggctaagaatgttttgaagctttgtgactttggtaatgccatgtttgctggtaaaaatgaagttacaccatatcttgtgagtcgtttttatcgtgccccggaaataagttgttgtttgtatgagttgtatatagggaaggttcttttcccagggtttacaaacaatgacatgctacggcttcacatggaactgaagggcccttttccaaagaagatgctgcgtaagggagcatttactgaacagcattttgatcaggatctgaattttcttgctactgaggaggatcctgtaacaaaaaggaccataaagcgactgatactcaacattaagccaaaagatattgggacactcattactggctctcctggggaggatccaaaaatgttagccaactttaaggatcttctggaaaaagtttttgtcttggatccagacaagaggctgacagtgtcacaagctctgaaccacccattcatcactggcaagtga

SEQ ID NO: 49834 - DNA, 1662 bp, Glycine max
  Peptide Sequence Number=SeqID_166612
atggccgcgagagtggggtcattcagacacagtttcttggagaaaagcaaagagaggctcctttccaagaaggaataccaagattttgttggcttcaacggcgaccacgatgcctcccccaagcgttccttcctcgacgcgctctctgatcgtgtcgttagctttcacaactggtccagagactttgcctccaaattgtacgagatgggtcgctctgaccgacgcaaagtcctcttcgccgtcaaagctggcttatccttagccattgtctcgcttgtcatatacattgaggaggaacaatttagcaagtactctgtctgggcaatcctcactgttgtcgttgttttcgaattcagcataggtgctacccttaacaaaggtttcaatcgtgctttgggaacattttctgctggagttcttgctctgggtattgcacagttatccgtgttggttggtcgagcttttgaagagcttattattgtggtctctatttttattgctgggttttgtgcgagttatgtgaagctgtaccccgcgatgaagcaatatgaatacggttttcgtgtattcttgctgacattttgtattgtgttagtgtccgggagaaccgggttgcaatttttcagcacagctttttacagattggttctaattggtattggtgctggtgtaagtttgtctgtgaatatttgcatttatcccatctggtctggggaggatctgcacaaattggtggtgaaaaatttcattggagttgccgcatctttagaaggttgtgtaaatgggtacctacaatgcgttgaatatgagaggatcccatccaaaatacttgtttatcaagcctctgatgaccctctttaccgtggttatagaacagcagtgcaatcgtcaactcaagaggagactctggtggactttgcattatgggaaccacctcatggtccatacaagatgttcaattatccttggagaagctacgtcaaagtcagtggagcattgaggcattgtgctttcatggtcatggcaatgcacggatgcatactttcagaaatacagtcacctccggaaaagaggctggttttctatgatgaacttcagaaggttggtgttgaaggagctaaagtattgcgtacacttggaagcaaagtggaaaggatggagaagctaagcaccggtgacatcctcttagatgttcatgaggcagctgagcaattgcagatgaagattgacagattgtcattcctcctagtgaattatgagagctgggaagctgcaagagagcataaggaaaaagaacaacctgagaatttgattgatgttaaggacaatgagaacaagccaccagagatcacttccctcaatgaaataggggatgatccaaaacttagtgtaagaatagagccctccatgctagaatccaaccttccacagactgcgaacaagagctttctggggaagtcacatctttcttttttcgcagatggtatagtaaatgagcctgaatccaaagtgtatgaaagtgcgagctccttgtctttgggaacatttgcttcgaatttaatcgagtttgttgcgaggcttcaaaatcttgtggatgaattccaagatctcagtgagaaggccaaatttaaagacccccttgaacaacctttgctcaagtag

SEQ ID NO: 49835 - DNA, 664 bp, Glycine max
  Peptide Sequence Number=SeqID_166613
caagcacgagaggccgaggaaggatcgcaaaggatggttcacgatctttccggttcgccggtggccgcagcttccatggtcatgcctttcaccgcttcgctcggtttggaccgatgaattcatcgggaagggtgcgatagggcaggtctgccaggtcattggtgtcgtcgtcgatgtcaaattcgacgagggtttgcctccgatcatgaccgcgctggaggttctggatcactcgttgaggcttgtgttggaggtggcgcaacatttggatactgagcattatttgcccattcatagagaagctcctgcttttgttgagcaagaaactgcacaacagattcttgttattggaatcaaggttgttgacctgcttgcaccatatcaaagaggaggaaagattgggttgtttggtggtgctggtgtaggaaaaattgtgcttattatggaacttattaacaatgttgcaaaagctcatggtatagtggtgtcattaagcttgatgcagactgaaagcaagtgtgctcttgtgtatggtcaaatgaatgagccccctggtgctcatgcccgtgttggtcttactgggcttactgtgggtgaacacttccgtgatataaaagatgcgatgacagtacctaagtgctatatttataaagctaattcttaa

SEQ ID NO: 49836 - DNA, 342 bp, Glycine max
  Peptide Sequence Number=SeqID_166614
atgttccagaagagttgcaaaaacaattacggacggttcagtttctgcgaagaagaaggtcgaatcgcaaaccgattcgatcacgactacaacaaagagatcgagttcaataagaggagaaaaaccgatgcggaatctgccaccggagctaggagtggcgcttcgtcggggagcgagcttgtgcaaaggtcgctatcgaagttctggcgaagttcgatgacttcttcacgcgttgctgtgaagccgactatggcctcgccggtggcttcggctttgagaacttccaatgcgagtaaggtggaggtggcaaagaagttggtgagtaagccaacattgtcataa

SEQ ID NO: 49837 - DNA, 318 bp, Glycine max
  Peptide Sequence Number=SeqID_166615
atgttgatccccgaacgcctcaatccgttaagctcaaacgttgactgtcacgtgtcaacgtctgagaggctcttgaaaatttttagccatctatggcattggggctggggaggaagcagtggtgttggtgcgaaagaaagggccaatagtaggccttgtgtctacggtggagaaaaaagagcggttggaatagcgaaccatgcactcgtcgtaccagatcacagcttgtttggacaaggaacactaagcagaacctcaagaccaaatttagcagagcttcatctccaaatttctgcttcctctgttttgggatattaa

SEQ ID NO: 49838 - DNA, 228 bp, Glycine max
  Peptide Sequence Number=SeqID_166616
atgtctcatgctgtctatgctctccatcaggccccaaaggggcagcaggaccagcgcccctgtgttcaacttagtcatactctacactcagaaaatgtctttaagtcatgttacattgatagcaacaacaaatcagagaagcaggacaacaccacaggccctataaaagaagctaacaataactataacaggccaacaagaaatacaacgaaggccaattacctttga

SEQ ID NO: 49839 - DNA, 136 bp, Glycine max
  Peptide Sequence Number=SeqID_166617
gggcaggatcatcttgagctaccttctggggtggggaccaaacatgaacaacagaaaccaacccaaggtacacggggacggatgcaagtggggacggggtcaaaaccgactgatcgtcgccccttccccgcgctaa

SEQ ID NO: 49840 - DNA, 1005 bp, Glycine max
  Peptide Sequence Number=SeqID_166618
atgcgtgtttataaaaaggatagtgacggcactgcgcaatttgttggtgaagaccagatcgaccatacgcctaaaaacgaaactgttcgccttaagctcggcaacgcgtttgatgtgactgctgagcgcgtacaaactgatttcaagaacctaagcaagcaaaaccaggctcagatttatgaaagtgcttataccctcaccttgcacaacgcaaaaaaagaagcggtgaccgtgaccgttcaggaaccgattaacggtgactggaaaatactgaacgaatcacaaccacacaaaaaaacaaatgctcatcaggccacctggaaaatcaatgtgcctgctgaagacagtgatatccaactgcgcttgaacagaaagcctgcaaacatgagtgctcattgctgtccaccacccacccctcaaccagaacactcaccacaaaaaagctatcgtcgagtgctttggattgccctgatcgttaactttagcatgtttatgatagaggttgcttcaggcttgcacgcaaactctgtttcgctactggctgattcactagacttttttggcgatgccgccaactatggcctgagtctatgggtattaggcatgcatgtatccgtacgtgccagggcttcactggtaaaagccatttccatggggctattcggcttgtgggttcttggcagtgccgtttcccatttcatttcaggtattgtgccctccccagaaaccatgagtgctattggcttgctggcccttctggcaaaccttggggtcgcatggctactgtatgcttatcgtcatggcgacagcaatatgcgtagcgtttggttatgtactcgcaacgacgccataggaaatgtggcagtcatcctggctgcggccggtgtgtttggtacaggatcggcctggccggatttaatggtagccgtcgtgatgtcttgcctggcattgcatgcagcatggcaggtcatagcccaggcaaaaagcgaattacaccgtcattaa

SEQ ID NO: 49841 - DNA, 575 bp, Glycine max
  Peptide Sequence Number=SeqID_166619
atgccaggttaccatctggtcggttcatgtaatgggttgcactgtggggttagcgaagtaccagaaggatactgtgtttgtttatggaacaaggcgacaagggtgatatccagagaatcgccaacgctgtctttttccccgggcattggtcgtagaataatgtttgggtttggctatgatccgtcaagtgacaaatacaaggttgtagcaattgcgttgactatgctctcacttgacgtatctgaaaagactaagatgaaagtttatggcgcgggtgacagtagttggagaaaccttaaaggttttcctgttctttggactttacctaaagttggtggagtgtatctgagtggaacccttaattgggtggttattattggaaaagaaaccattcattctgaaatcgtaattatttctgttgacctagagaaggagacttgcatatcactgtttcttcccgacgatttttgcatttttgatacaaatattggagtttttagagactcgttgtgcgtttggcaagatagaaacaccaatcttggcttgtggcagatgaggaagtttggagatgacca

SEQ ID NO: 49842 - DNA, 306 bp, Glycine max
  Peptide Sequence Number=SeqID_166620
atgcctgcaggtcgactctcgagggtcccacttatattacgggactcaatcagacatccgagtaaaaagttattgtcgtttgaattggctgagagcttcaacattcactttcgagcgtctcgatatattacgggactcaatcaaacatccgaagcatcaacattcactttcgagcgtctcgatatattacgggactcaatcagacatccgagtaaaaagttattgtcgtttgaattggctgagagctccaacattcaatttcgagcgtctcgatatattacgggactcaatcagacatccgagtaa

SEQ ID NO: 49843 - DNA, 621 bp, Glycine max
  Peptide Sequence Number=SeqID_166621
atgtcctcgccatcagaggacttcatgtcctcgccatcagaagggctgcacgccctcacctccagaggactacctgtcctcgccttgagagggctacacgccctcaccttgggactacacgtcctcaccatcagagggctgcacgccctcacctctagaggactacatgtcctcgccttgagagggctacacgccctcaccttggagggctacacgccctcaccttgggtactagttaccctcacctttagaggactacatgtcctcaccttcgtagggctacacgccctcacctttagaggaccacacgtcctcacattcagagggctacacgccctcgccatcagaggactgcatgtcctcaccttcgtagggctacacgccctcacctttagaggactacacgtcctcgccaacagagggctacacgccttcacctttaaaggactacacgtcctcgccaacagagggctgcacgccctcaccttgagaggactacacgccttcacctctagaggactatacatcctcgccttgagagggttgcacgccctcacctttagagggctacgtgtcctcattttcagtgtgctccacatccgcaccttaagagaatttaag

SEQ ID NO: 49844 - DNA, 546 bp, Glycine max
  Peptide Sequence Number=SeqID_166622
atgtggtttgccgcctatgtactgcactggttaaaggttgattggcgccaagcggcggactggtttgaacaacacttactggatggtgaccttgcctctaatcatctttcatggcaatggatagcctccagctttagccataaaccctattatttcaacaaagaaaatatcatcaaatttggcggtcaacgctggtgtcagcaatgccgggtgcgctgcccgtttgatgccagctacgaagcgttggaacaacaattatttaccaccacctccggagctaaagcaacgcctcctaacgcagtcacgagagccgcacctcctcaacaagcggacgatttgttacaagtgaccaaggccgatacgctggtctggcttcacgatgaaatgctctccccggaacatccgttgctgactaacaacaagtctgtggcctttgttttcgatcctgcactttatgggcaatggcccttgaaacggctgcaatttatggctgactgcctgagtgaaattccacaggcagaaatatggatggggagcacaaacgaa

SEQ ID NO: 49845 - DNA, 444 bp, Glycine max
  Peptide Sequence Number=SeqID_166623
tcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 49846 - DNA, 225 bp, Glycine max
  Peptide Sequence Number=SeqID_166624
atggctcaacctccaatcttgaggacttatcagatgaatacgagacttgttgggtcaaaatccatgatagtgatactaactccttttccgggcctgaaggaagtaacatgtcttcatcccacgaaacaatattcagacgggattgttatcactttacgtattgaatttaaattagcaattttcaatttacccacttttactacaataggtgacatggtaacataa

SEQ ID NO: 49847 - DNA, 345 bp, Glycine max
  Peptide Sequence Number=SeqID_166625
atgtatatttatgtactagggacctccagtaaaattttcgagtcgatccaacggttaacgaactggaacggagagaatgttactgggcttggggggattgatggggactcggtgttgagaggaacgaggataaaggctacgtgggagtacgtgagctcaattgaaggtgggcaactggggatggtggaattatgtgtgatttgtggacgtggaaagtcgacttgcaccatcgcccgaccgccacctagaaccacatgtgacggagtggtacctggagatatgtcgcgggggtcaggagaccttggggacgtcaggtgggatgctattgcccaaaaccaagcttga

SEQ ID NO: 49848 - DNA, 240 bp, Glycine max
  Peptide Sequence Number=SeqID_166626
atgaaactcatatccaagcgatttcaagagcttgatgtttgtggcaaagttactctaaacagtaaacttcggaaaattgtttaccctgatctaaactctatgtgtgctcctccagaaaaggtgaaaacaaaaggtatgtgtgaagattcttggtctttggttcgcaaccatttgcttaaagaacttgcaaaatggtctaatgagtatatcaatatgcttggtggcatagacaggttttag

SEQ ID NO: 49849 - DNA, 270 bp, Glycine max
  Peptide Sequence Number=SeqID_166627
atgaggactctctgcttcccacaagggatagtggaagacttattgatcaaggtcagaaaattcattttccctgtggactttatgattctggatatagaggagaatgaagtcacaccaattattttgggaaaactcttcctcaacacaataggaacattgattgatgtcaaggaagggaaattgacttggtggctaggtgatgaggaagaagtatttaaggccactaacaagataaaagtcattttctcctcaaatacccataaaccctaa

SEQ ID NO: 49850 - DNA, 432 bp, Glycine max
  Peptide Sequence Number=SeqID_166628
atgaataggaggaagcattatgttctggtgcatggggcttgccacggagcttggtgttggcacaagctgaagccacgcttggaatctgcaggccacaaggtcacggtgcttgaccttgcagcttctggcatcaacatgaagaaacttgaagatgttgacactttctcacagtattctgagcctttgttgcatctaatggccacaattccccaaaatgagaaggtagttctagttggtcacagttttggggggatgagcatagcacttgctatggacaaattcccagaaaaggttgtagttggtgttttcttagctgcttttgctccagacactgaacacagcccatcttatgtcttggaacagttcactattgctgcaaaaatattccggatgagaggggcagaaatccaactttcccagtattctacataa

SEQ ID NO: 49851 - DNA, 648 bp, Glycine max
  Peptide Sequence Number=SeqID_166629
atgggttcacaaaattgtatggataggaagcactatgttctggtgcatggggcatgccatggagcttggtgttggtataagctcaagccacgcttggaatctgcaggccataaggtcacagtacttgaccttgcagcttctggaaccaacatgaagaaaattgaagatgttgatactttctcagagtattctgcgcctttgttgcagctaatggccacaattccctcaaatgagaagttagttctagttggtcacagccttggagggctgaacatagcacttgcaatggagaaattcccagaaaaggtagcagttggtgttttcttaacagcttttgctccagacactgaacaccacccatcttatgtcttggaaaagctcgaaatgacatcgtttcaatttcaagccatgttaattttacaaaccctatccttcctcacgcagtttcgctctatttcgtcgcttcgtttgctaacctcttcttccttcctcacagtctctttccttcctcttgctcatagtctctttctcggtctctcacagccccaccttctacaccattactggccaacagccaacctctcctttcttcctctcgcccttcctctcgttgtgccaaatatcggttttctttctccagtgaactag

SEQ ID NO: 49852 - DNA, 453 bp, Glycine max
  Peptide Sequence Number=SeqID_166630
atgaatttgccccaagtggaaacaaaacatcatttctctttggtcccaagtacttgtccaagaagcaataccagcgctctcccattgagttacattactatctggagaatatgttggaaactcatcgaagttttcaataaaaacaaaaataataaggaatggattttgcaggaccttgaattggccaagacattggtaaggccatcatcactctttattgaagacttgtctaagcagaagaacttctccaaacatggatatgggtcagttccacgtgcctatattgtttgcactgaggaccttgcaattccattggaatttcagctctggatgattcacaatgctgggatcaatgaagttttaaagatcaaaggcgcagatcatgcagctatgattagcaagcctagagaactatacaattctctccagaagatagctacaaaatatgcataa

SEQ ID NO: 49853 - DNA, 324 bp, Glycine max
  Peptide Sequence Number=SeqID_166631
atggtgaagggcattttagccctttcaccaacgttgctgggtgccccaacaaaactgttgggtgcccaaaattttccaatgggggactgttttgtacatggaaaaggccaccatgcatgcatggcgagatgcatggcaatttggcacgtcgttgtcgcaaaaggacacaggctttggtgcagagggcaaggctttgtgcagagggcagagggcgcagactttaatggaggtcacgggctatgctggtgtcgccaccatggttggcgatttgtggagcataaatcgccacttacattggcgatatgtgttgttgtgtgcctttaa

SEQ ID NO: 49854 - DNA, 174 bp, Glycine max
  Peptide Sequence Number=SeqID_166632
atggggttgttttttatgagagtggatgcatggaagaagaaaatcgccagtcctattggtagcagggctcctcagctttttcagggttgcagctcatctttttcaggattgcagcagggttgcaggcacgcgtggaggcaacaggagcagcagttgaatcgcaggctccattag

SEQ ID NO: 49855 - DNA, 279 bp, Glycine max
  Peptide Sequence Number=SeqID_166633
atgctaagcactaaagtagttggaactattttacgagcacaagcaccaaccctaaactttggaaaaagtgggaaaacatcgttgtccaagtatcaaagatcaagatccaaaagggtcccaaagacgaagggtaccgcaaagcctttgggagcttcatcaagcaaaaggagatcagaggaggaggaatgtgaaaacatcaagaaacgccttggttggggtgtaaagagtgattgcaaaatttctagttgcaaaaatggagcgagtgtgaagagtgattga

SEQ ID NO: 49856 - DNA, 117 bp, Glycine max
  Peptide Sequence Number=SeqID_166634
atgtcccccagtatggcacttacgacgtcgtttattcacgtagcgctcgatatggatagatcacccgaggcaaatcggacagtggtggtcgaggtcgaaaatacgttggagttatga

SEQ ID NO: 49857 - DNA, 249 bp, Glycine max
  Peptide Sequence Number=SeqID_166635
atggggggtacggaggaggaatctgatgcggacatgacgcgtccgaaatcagaggtgagacccaattattgctacccacgctgcccgacactcattattttgtcgcttctgttcgcacccactcctccctctctctcactgtctcaatctcatgctatactatgctactgttgctatgctatcataaaaaatcgaacttcgatgcttgtagatggcatagatggggtagctaatcaccctacggcctag

SEQ ID NO: 49858 - DNA, 328 bp, Glycine max
  Peptide Sequence Number=SeqID_166636
atgttggaaagttttaaacaacaagaacaaatgtcagttctggaattgtacatagaaaaggatgtggttggtggttcaatgtttcattctgcaaattcgcttacatcatgtgaaaattatttatctaatgatgagacacaaccgacaacaaatatgagcaatttacatattgacgaagacgatgatgatgatgatgatgattatcttgtgtctaactcatacgttgaagagtctttagacgaagatgacagtgttgacggtatatctgataccgacgatgaagtcaccaacattcctcaaccagtaaggattgttcacccagcagaag

SEQ ID NO: 49859 - DNA, 1122 bp, Glycine max
  Peptide Sequence Number=SeqID_166637
atggccttcttgaattgtttcgacatgttggtccttctgcttttgcttgtcaatatgagcttttatggaaatgttgatgctcagaaaaatggcttaggagcctctttcatctttggggattccttggtggatgcaggaaacaacaactatttgtcaactctttctaaggcaaacatccctcccaatggaattgatttcaaagcctctggaggaaatcccactggtcgctacaccaatggaagaaccattggtgatttagtaggagaggaattgggacaaccaaattatgctgtaccatttttagctccaaatgcaacaggaaaaaccatactcagtggagtgaattatgcttcaggaggaggaggaatactgaatgctaccggaagaatatttgtgaatagaataggaatggatgttcaaatagattacttcagcattacaagaaaacaaattgacaaactgctgggtaaatcaaaagcgaaagagtacataatgaagaaatcaattttctccatcacggttggggccaatgactttctcaacaattaccttctcccagttctctctattggagccagaatttctcaaagtccagattctttcatagatgacatgattactcatttcagggcccaacttacgagactttaccaaatggatgctagaaagtttgtcataggaaacgttgggccaataggctgcataccttaccagaagactattaatcaactgaacgaagacgagtgtgtggatttggctaacaagcttgcacttcaatacaatgctcgattgaaggatttggttgctgagcttaacgacaacctcccgggagccaccttcgtccttgccaatgtgtatgatttagtgctggaactcataaaaaattatgataaatacgggttcaagaccgcaagtagagcttgctgcggaaatgggggacaatttgcaggaataattccatgtggacctacatcgagtatgtgcacagataggtacaagcatgtgttctgggatccttatcacccaagtgaggcagcaaacctaatcctcgccaagcagctactagacggagacaagagatacatatctcctgtgaatcttaggcaactcagggatctttga

SEQ ID NO: 49860 - DNA, 447 bp, Glycine max
  Peptide Sequence Number=SeqID_166638
atgatgacctactctacaagcaagttcataaaccaggactccatgaggtatgttttggggtggattgtgctggtggtattgggtggtttgtcgaaggtggagcacgatggtattgagtggttaggtcggaggggtagttttgtctgtttaggtctttttgaaggtgaaggaagcacaaaaagaggtacaagaagtaattgtctcaaatctgtaatggttaatttcattgagcccacacctttatggatgcgcctaaaccattgtggctactcccccatccctaaaaggcaattgcttcctgcatcttatctaaaatgtaaaaatttacattctgaattacattccaaaaaggctaatctggaatatgcaaaaagcatttatgaaggtgcaagtagcaattggcctcaaaaaaagcacacacgagagttgaagcctgaaggagtttaa

SEQ ID NO: 49861 - DNA, 234 bp, Glycine max
  Peptide Sequence Number=SeqID_166639
atgacacgtatgaagcagacatcgtacattattggacatggccctcccatgaaggagtggctagagcttaagctcccaagtgctagcactgttactcatccgcagagaggtggtgaagatcctgctggtggctcatctgggcattttgacaaagatagaggctacaacagcgacaaacgcaagcgcaagggtgaggttgacatggctggaagacccttatcactgctatgttga

SEQ ID NO: 49862 - DNA, 321 bp, Glycine max
  Peptide Sequence Number=SeqID_166640
atggcggaaaacgatgaaggtgtcaccggcgagctgaagaatgtgaatgtgaatgcaatggaaagtgtccaccatgacgtggctgccttaagtaatagtgtagtggagagcatcttctacacgaggaaggaagcacaaaaaaacttcaagtgccatatctacctagaagccttgcccgatagcattcccaagcacgtgtgcagcaagattaaatcccttgaagtgaaagtcacaaatgctggcatgttcttagctgtctttgcttatgacaagattcgggatgttctccgtgcccctgaatggaaatttgctccaagttga

SEQ ID NO: 49863 - DNA, 765 bp, Glycine max
  Peptide Sequence Number=SeqID_166641
atgctacaacaactacaacagccttatctgtctaagacaatcccatttgcctggaatctcatcacagctggttatgttgaacaatctatatatggggtagtggtcagcacattaagtctcctgtttattgggaagctgcttgaaccaatatggggctccagggaattctttaaattcatctttgtggttaatcttctaacttcagtatgtttattcatcactgctattgctttatactacattacaaggctggagacttacctttacatgccactttctggatttcatggagttgtatctggtttcttggttggcgtcaagcaaattataccagatcaagagcttcctttcattaagataaaaacaaagtggttgccatctatcactgtattgctttccattgctattagcttctggacgctagaggctacagcatatcttccaaccattatatctggcacgtatataagctggatttatcttagatactggcagaggaaaccagaaactaaacatagaggtgacctgagtgaagattttgctttctccacattttttccagaatttttaagaccggtcattgaccctatcgcttcaatatttcatcgaatgctctgtggaagatatgatgcttctaatgatgatggctacagtctggaaaatgagcctttaccaggttcagactcaattgaggcatccaggagaaggtgttcatcaactcaagaagcatgctatgaaattttccatgtgctattgcaacactaa

SEQ ID NO: 49864 - DNA, 585 bp, Glycine max
  Peptide Sequence Number=SeqID_166642
atggcttctacggtacctcaacctcatggcttgcgagaagttgtcaatcttcaccagcttcggacactgcccccgccggagaaacatcaagaattcaagttccgcgataaggtgggtgcatttcacaacgacagcttgtgggagggtcacatcactcaaaaattagggaatggaaggttttgtgtgtatttcccggtctcagaggagaacatggtgttttccaagaacaaactcaggactcactacaagtggatcaatcacaattgggttctcccaatcacaaatcacaaggtatgggtgagagctctagacgtgttcatcgagtatgttatgttacacaatgtccagcagttgacaatgcatataggtttaagcagcagacccaatttggattccctccctttggtcttttgcagatctctcatatcccaattcaatgatgcttcaatcccgtgcttttttagattggagtcgttgaaagtgaaaaatcaattacgccaactatctgatggggacataaacaaagtaatggagtacttgcttcaaaattctccaaaggccagagttgatatcataagtgcttaa

SEQ ID NO: 49865 - DNA, 444 bp, Glycine max
  Peptide Sequence Number=SeqID_166643
atggctgaaaatacccaagtttatgaacgaactctggaggaaacaccaacctgggctgttgcggttgtgtgttttgtgctgctttcggtttcaatcgtcatagaacatattattcatggtattggaaagtggttcaaaaagaaacacaaaaatgctctctttgaagcgttggaaaaggtgaaaggagagcttatgctgctaggattcttatccttgctcctaactgtgttgcaagatccaatttctaagatatgcgtatcaaaaaatgttgcatccacttggcatccttgtgctaacccaaaggccccaaaaacatctcaatctgaggatgaatctgaagactttcagatcaattctaggaaactcctacaatattatgacatcataccaaggcgtgttctagctacaaaaggatacgacaagtgcgatgaaaaggcaagttga

SEQ ID NO: 49866 - DNA, 1122 bp, Glycine max
  Peptide Sequence Number=SeqID_166644
atggatcctgagaggttcaggtttgcaagggacacaacatttggaagaaggcacttgaactcttggagccagtcaacaatttcgttatccatagttagcttcttccgacaattctttggatctgtcaacaaagttgactatttaacattacgacatggattcatcacggcgcatctggcaccgggaagtcatgcaagatttgatttccaaaagtacatcgaaagatcacttgaggaggattttaaagttgtagtggggataagcccaatcatatggttcttcgcagtgctattcctgctgactaatacacatgggtggtattcctattattggcttccattcatcccattagttataatcttattagtgggtgctaagttacaaatgatcataacaaagatgggactgaggattacagacagaggagaagttgtcaaaggtgcacctgtggttgagccaggcgatgatctgttctggttcaaccgtcctcgcctccttctctttttgattcatcttgttctgtttcagaatgcttttcaactcgcatttttctcttggagtacttatgaattctccgtaaagtcttgcttccacgaaacaaccgaagacaatgtcataagacttgtaacgggggttgtcatacaagttctgtgcagctatgtgacattgcctctatatgctctagtcacacagatgggttcaaccatgaggcccaccatcttcaatcagagagtagcatcagctctgaagaactggcacaacactgccaagaagcatgtaaaaaacagtaagcacaccacaccattctcaagcaggccatcaacccctcaatatggtatgtctccaactcatctgctacacaaacaccttgctggaagaagtgagagtgcacaaacttctccaagaacatccaactatgaaaatgaacagtggggtgttgaaggatcaccttccccgagccaccatgcagtagctgctgatgaaacccagatgcaagttttggagccaggctcaggctgctcaggttcagcaccagaattgcctattagctctcaacttgatatcagagttagttcatctgagttttcgtttgagaaaagacacattcctggaagtgattag

SEQ ID NO: 49867 - DNA, 243 bp, Glycine max
  Peptide Sequence Number=SeqID_166645
atgtcaggtattgttgccaatggaaattcatatccaacgtataggatactacaaactttcaagaaaactctaggtttgaatgtgagcatagtttgtgagtcagatagaagtggcaatgtttacattgcagaggtgcatcaatgtgttgacatctcgggaacaatgcaaaaggatgtgacgatgaccccatctttccctatatgggatttcaaccagataaagatcccaagtatgatgtgttga

SEQ ID NO: 49868 - DNA, 789 bp, Glycine max
  Peptide Sequence Number=SeqID_166646
atggccgaagacaaaatttatgaacgatcgctggaggacacaccaacctgggcgtttgcagttgtatgttttgtgctgcttgctatttcaatcatcattgaacatgttattgatgctattggaaagtggttcaaaaagaaacacaaaagtgctctttatgaatcattggaaaaggttaagggagagcttatgatgctaggattcatatccatgctcctagttgtgttccaaggtccactttctaagatctgcatatcacagaatgttgcatccacgtggcatccttgctccaaccccaagaaggccttaagtaaatctgatggaaaatctgacagtgataccaatggtaggaaactcctcgaatatttggaccccataccgcggcgtgttctagctgcaaaaggatatgacaaatgtgctgacaaggcaaaggttcaggcttgcaaaggacacaacatttggacaaaggcacttgaatacgtggagtcagtcatcaatttccttatggatattaatttcaaagttcctaatgcttttgtgctctgctcaaatcaggttagcttcttcagacaattctctggatctgttaagaaagttgactatttcgcattgcgacatggatttatcacggcacatctggctccgggaagtgatgcaagatttgatttccagaagtacattaaaagatcacttgacgaggattttaaagttgtagttggcataagcccgatcatatggttcttcgcggtgctcttcttgctggctaatactcatggtaagccggattga

SEQ ID NO: 49869 - DNA, 4303 bp, Glycine max
  Peptide Sequence Number=SeqID_166647
gaggaggcatgaagtaaacgcattaaaccttgttgagctttctcacggacaatgtgacaatcaatatccaaatgcttgttgtgttcttgaaagatggggttgtgatagcataacagggactcaggtgcaattagcagattcaggtgcagagcaagctaaaattatctttgttagcacctatcatcttggtgctctcgttgcctttgccgccatggtcgaccctcctaaaacctcaaacccccttgaagatgccctccttaagctcactgctcagaaccttaccttaggtgagaccctgcaaacagttaccttacaattaaatgaaatccttcatcgccttcccttgaccacgacgtccaccccagttccgacacccatcctttccacagcctcatccccacctgcattaacacacagaatcaaattagatgttcccaagttcgacgggactgatcccttgggttggatctttaagatcacccaattctttgagtatcatggtacccctgaaatagagagactcaccgtcgcctccttctacatggagggtcgcgccttgtcgtggtttcaatggatgagtgggaatgaccagtttacatcgtggcccgcattccttcaggcgttgcagacacgctttgctccctcgcagtatgaagaccccacgggggctttgttcaagttgacgcagcggggcacggtggcgcagtatcttgcagactttgaggaccgggccaataggatcattggcttaccagcgcccttcttgccgagctgcttcatatcgggactcaacgccaacattcgctacgaggttcaggcccaccaacctctcaccctcgtccaggcggcgggccttgctcgcctccaagaggagaagttcttggattcccgacaaaaccctcaccctccacccccgagacctcgacataaccccccacctccttccaccccgataaccccaacccctcatgtttcgtccctttccattcaccctgtttccactccttcccttttacccctaccccctcgtaacccaggcccatccgtcaagcgtctctcccctgaggagattgcttcacgcagagagagaggcctttactttaattgtgatgagaaataccaccgcggccataggtgcgcctctcgggtatttctcatcgtggctgaagatgatgaaccctacccatctattatagagccagctgacccgaaacccgacccgatgccgcccgacccaatagatccatacccgacccaaattagttttaattcattggcgggccaggttgctccggagacactccgtttcatgggtgtcatcgttgatcatcaaattatcttgcttgtggatgccaccacacctctgcgggttatggttggtaatggccaacaattggagtgcaattccttgtgcgaagccattaccgtcaccattcaagccacctcatttgtggtcgacttgcatgtccttccaattgcgggtaaccttgtggagctgaacggagacacagagtccactttaagctctctgtcatcctcacaactcctttgtcttcgccaaaaacaacctgatagcttatacttccacgtggccatcatccctgatcctcctgattccaccaccaatcccgatacttcccctttagtccaagccttaattgctaagtttccctctttgttcaaacctccccaaaccttacctccacccagagacactgataaccgaattcaccttataccccaagccactcctgttaatgtacggccttaccgatatccccattaccaaaagcaggagatagaggcccaagtagaatccatgttgcagaaaggcctcattcagctcagcaatagcccattctcatcacctgtattgctcgttaagaaacaagacacctcttggaggttctgtgtggattatcgagctttgaatgctctgaccatcaaggataggtttccgatacccaccgtcgatgaacttctcgtcgagttagggggcgcaagttacttctcgaaattggatttactccaagggtatcatcaaatttgcatgcactccggcgacattccgaagatagcttttcgtactcaccacgaccattacgaattttgtgtaatgccgtttggtttgtacaatgcaccgtcttcttttcaggcaaccatgaatgttgtgtttcatccatatctcaggcgcttcataattgtcttctttgacgacattttggtctacagtgcgtccatggctgaccatctcactcacttggaagctacctttcagggagtgcaaccagttgcttccaaagtggacgtcgtcctacactggcccactccgcaatcatccagggctatgcgcagctttctcggccttgccgtattttataggtgtttcattaaaggttacgcaacgatcgcggccccactgggagctttatcatctgccccagtcttggccctccccgatttcgacattccattcaccgtagaaacagatgcctcgggcatcagcatgggtgtcgtcctaactcaaaagggccaccccattgccttcttcagcaagcccttcaccctgcgcctcctgaatgcatctacttacgtgcgtgaactatttgcaatcactacggtcgtcaagaagtggtgccaatacttacttggccaccgcttcatcatcattattgaccacaggagccttaaagagctgctaacgcaggtgattcagaccccagagcaacacacctatttggcaaggctaatgggttatgattaccagatcatccaccattctggtgctcaaaatcaggctgtggacgccttgtctcggattcctgaaccaacatcatcctcttgcttgaccctgtcggtaccatgcctcacattcttggaggaattacgaagacaattggaggcctcctcagcttatgtagagcaccgcgatgccattacacaatcaccatccactcattcggactacaccgatgtgacagacttcgttacaaattgtctcccctgtcaacagaccaaatacgaaacaaagaagatcgcagggttgctttgcccccttcctgttccacagaggccttgggaggacctttcccttgactttatcttgggactgccctcattccatggcaattctgttatactcgtcgtagtggaccgcttctcgaaaggaatacatttgggcatgttaccggcagcacacacagctcatgtcgtagcttccctattcattgaaatcgtgggcaaaattcatgggctacaaaggagcttggtttcggacagagaccatctgttcctcagtctcttttggcgcgaattgtttcaattgagtgggacgcaactgaggatgagttcgacttaccatcctcagagtgatggacaaatcgaagtcatgtatagagttgttgaacaatatcttcgtgcctttgttcatcacaggccacacacgtggggcaagcttcttccttgggttgaatggtgccataatacttcgtggaatgtggccatcggcactaccccgtatgagatcacctttgggcgtaaaccgtttaatttccctgactacatcgttggttcctcaaacttggatgcagtagatgacatgcttaaggaccgtgaggaaaccttccaggtgattcgcaaaaagctcctcaaagctcaggcagctatgaaactatttgctgactacaaacgccgagaggccacgtaccaagtgggagactgggtattgctcaagctccggccacgacgacagggttctgcaaaagggtcatctgcgaaggagggcaagttagctaagcggttctatggtcctttcaaagtccttgagcacataggatcagtggcttatcgattacaacttccacaaaccgctcgcatacatcctgttttccactgcttagtgttgaagcgctttcatggatccccttcagagcaggagacttctgttcaattgcccacaagtttccttcaggatcaacccgttatttcaccattggctattctcgatcaaaggaggtctaacccaatagggccatggcaagtcctggactgggaacagatacgcagagactatcaccttgaaggcaaggtgaatttgaaagggtccccggatgatagcataacagggactcaggtgcaattagcagattcatgtgcagagcaagccagaattatccttgttagcacctatcaggttggtagcaatgtgaagtgcactttgattgtcactaaagaaatgcaagacgatgacatgagacttaaagatcaacaagaagataaacaagccattgtagctcacaagtaa

SEQ ID NO: 49870 - DNA, 816 bp, Glycine max
  Peptide Sequence Number=SeqID_166648
atgcaacgtttcagcaacacagtgatcggattcttgaactttttcacgctcttggcatcaatacccatcattggtgcgggtctatggatggcaaggagcaccctaacatgtgaaaatttcttccaaaccccacttttggtcataggctttgttgtgcttgtgatttcgctaacgggtttaataggggcatgctttcatgtggcatgggcattgtgggtgtacttggtgatcatggtgttcattatagctaccctcttagggtttaccatatttggctttgttgtgactgaacagggtgggggagtggaagtgcctggtagggcttacaaggagtatcgtctcgagcgttattcgccatggctgaggaataggattcaggatcctcagtattggagcaccataagaagctgcattttggggtctaacacttgtgcaaagcttgccttttggacccctcttgattacgtgcagagggacatgtctcccattcagtcaggatgttgtaagccaccaacagcgtgcatgtacaacgaggaaacagtggtagtgaccccagactcggattgctaccgttggaataacgccccaactctgctttgctacgactgcaactcttgcaaggctggtgtgctcgaaaacattagaagggactggcacaacatctctgttcttaacgttgtcgtgcttgtgttcctcataggcatatattccattgcctgttgcgctttcaggaacgcaagaagagctcaaactgattaccctcatggcgaaaaccgcatgaccaaagttaaacctagatgggattattattggtga

SEQ ID NO: 49871 - DNA, 453 bp, Glycine max
  Peptide Sequence Number=SeqID_166649
atggagaagtctgacaagaaaaatttcaaagacaagaaagcaaagaaagcttacatcacttgggaagataatgatatagattcatcaggagattcagaaaatgaagtcgtgaatctgagtctcatggccaaaaactatgatagcgaagaagaggatttcttgaagaaaagttggtacattgataacggatgctcaaaactaatgatgagagatgcatcaaaatttactcatatatctcctaagaaaagtggacatgtgacttatggagagaacaacaaatataaaacatcaaatcatgctcaatgttttcttagtaaatatgatgatttttggttatggcatagaagaattgctaatataaacatgaaacatttaaataaactaatttctaaggatttagtgattggttttccaaaactcaaatttgaaaaagatagattatgtgatgcatga

SEQ ID NO: 49872 - DNA, 357 bp, Glycine max
  Peptide Sequence Number=SeqID_166650
atggttgcattaaaccttgacatcctaataagaaagcttcgagcaatattgatggttgttcagtttggaatggtggtgtgggacaatggtttaaacaatgatcgatgtgtgatgaaggttcaagtgagaaagatcatgactagctgcaatcatggagaagaggaatggtgcaagaaacaatatcatcccatttatcttcacatcaaaagtttgcttgatggaaccaaaacaatggcaaatcacaagaacaactcaaatttgacattaggccccggtgacttggacataacacacaccttctttaagtccatcatgaacgctacaccttttcctcccacaaagcaccttaataattaa

SEQ ID NO: 49873 - DNA, 189 bp, Glycine max
  Peptide Sequence Number=SeqID_166651
atggcggcaagcatggtaccgccagtgctattggcgagacagcctggtaccgccaatgttgttggcgagacagcagcttacgtggaaggtgccgccagtgaagctggcgagacacctccacgttggatctgcttcttctgctggcgatacagcatcgtgaagggcgtgttgcagatatttgaagattag

SEQ ID NO: 49874 - DNA, 396 bp, Glycine max
  Peptide Sequence Number=SeqID_166652
atggtgatacgacatcatcctagtcccctatgcaaggttgataatgtcattgttactcatgatcttcccttgttatggaatgccaacatcaaagggttcaagttcatatctactgatatattgtttacaaaggctgactcagagatgatggactatgatggggccaacaacagtttggattctactaagaaaattgttgatcatgagaagatggtctccatgaaagatgttgagaatgaaaagcttcttaaggccattgaaagtcttaacaagaattttggcactgttgtcaaggacttagcagagaccaaaaatattgttaaagcattgaacgatcaaatgactatcaaagaagagaagaagaaagctcttaagatagaaaaaataatttgctaa

SEQ ID NO: 49875 - DNA, 186 bp, Glycine max
  Peptide Sequence Number=SeqID_166653
atgtcaatgaaaaacctcatcgggcgcctaggagtacatgacaagacagaccacacactgggataccagtcagggtcactctgttttgagagaacactccaaccatatgagagtgtatttacccccaaggcctacactccgaagagtccatcagggcttctccctcctaattcaggtccaacctag

SEQ ID NO: 49876 - DNA, 411 bp, Glycine max
  Peptide Sequence Number=SeqID_166654
atggtttacttcatggtagagcttccatctaaatcgagtagtagtgacagaggtgattggtggatgctctatgttgttggagctagtaaccccaatggtagtggaacaggaatcacccttgaaggacctggagatatctcactcaagttaaaattagcaaaagaatttagagtgaagaaaaacaggtgtagaattgacttcaagcttgtcactggttgcaaggaaaaaccacttgccaaaatcactgctcataaagtgaaaaaatttacatggagatcattgatctgtaggcatggtctcccatttgccatagtcacaaataatggcatacaattcatggagaaaggatatgaacagttcctaaggctgctcggcatcaagcacttggtgtcttttatggaacatccataa

SEQ ID NO: 49877 - DNA, 619 bp, Glycine max
  Peptide Sequence Number=SeqID_166655
ccttttgtttgaaaatttcttccacgacccaaagcttcttcttcctccttcgatttcttcttcttcttccacgacccaaagcttcttcaccttcgagttcttcttcttccgcgaccagagctccacgcgtccaacagtcttctccccgcgtccaggtcttcttctccgtgcgcgtcgtcctccattgttggcatttgaagctttgaaacattcgtgttatgccctacagggtagaagaaatgtttggtctggtttggtttttcatggttttggttgcgcgaggttgaagacgagctttcttccgcggaaggttcgtttcttccgcgcgtgtctgggtgtcgttggaggtcgggcggaagattgtttcttccgcagactccaacggaagatggaagatatggcacttccgtgggattccgcggaagaaccatcttccgcgtgtgtcaaagacgttccatttccttctcgcggaagatggttcttccacaaactctcacggaagagccatatcttccatcttccgatggagtctgcggaagaaaggttcttccgtgggagtgtgtttccttcctgcggaagaaccttcttccgcaagatgattaatgaagctaagttgtga

SEQ ID NO: 49878 - DNA, 177 bp, Glycine max
  Peptide Sequence Number=SeqID_166656
atggagttcctaaaaggcatggtgaagctagtgcttgccactgcagtggtgtgtttggttgtggccttgtccttctaccagaagctggggctagagctagagatggttgttgctattgtgagggcatatgatcagaatcctttggcaaaattatttttgcctcaaaacaagggataa

SEQ ID NO: 49879 - DNA, 234 bp, Glycine max
  Peptide Sequence Number=SeqID_166657
atggaagacatgaaagttggggctgtgaaatataaaggcatgggttatcagaaaaatatgagaaaaagccttgaacaaaaattgaaagaattggatagcttgcttagcgcgcaacccaggcttagtgctcatccttgctatgcgggaacactcgggcttaggcaaagaaggcctatgaggaagcctaaaggctcgcttagcatgaaagctcgcgctaagcgcgaggtcgcatag

SEQ ID NO: 49880 - DNA, 171 bp, Glycine max
  Peptide Sequence Number=SeqID_166658
atggttaacgaaaccgggatcgtagttttaccaagacagctttgggtttctacgggaaagaaaaatgctacaatgcgaggggtatttctcttagctcagacgtttgattacctacgggaaaaagagagggttttgggagaggaagagagaaaaaacgaaattggtaggtag

SEQ ID NO: 49881 - DNA, 255 bp, Glycine max
  Peptide Sequence Number=SeqID_166659
atgttgaatccaactcagtttcaggccaaagaagagaaggttcaagctgctgatgactcgcttagcaaggcagatccgctcaaagaggataattcaaagatgtgctcgcccagcacacagccagctcgcccagcaaggttgttgtctcttctcgtgcttagtgcacctagtcttgctaagctaagattcacttactctcgcttagcgggctcgctaagcgatccttcagaagctgaaaggtccaagagcctttaa

SEQ ID NO: 49882 - DNA, 705 bp, Glycine max
  Peptide Sequence Number=SeqID_166660
atgacaaaatcatccaagaaacgtaagggttcatcttccttcaccaccactacaggccaacgccgccacggtgcttccaatgactctccaacaccacttaatccttccttttcctcaccatgctcactaactctgttttcctccgatgatcaacgtcagaggtattactcctccttttcaaatcgtgtcattcttgattctaaatttctgaattttgatttctttgagggagaaacctttgactgttatcaagtattccaaaactctgaattagtagatattaggactctaaaattgtcttattatcctgaattagttcgagtcttgtataataatttggaaatttgtgatggagtcatattctctgagcacttcaatattcctctggttaatgaaccttttgtcaaggttaaacgttcctttgccattggagccgctgtcgttgcatcctttgggtataggaaggatctagatggtcaatggattcataaacaagacctcccgtctaatgctcccgatgaacacactccatctccaccaccaatggatccctcttcttcattgttgaatgatgttcttagcgagcttcgggatcttcgtacctttgtcgaaggccgttttgattctatggattcatgtattacgcgatttgaggacgatatgatctttatttgttgttgctttgatcctccaactgatccttag

SEQ ID NO: 49883 - DNA, 519 bp, Glycine max
  Peptide Sequence Number=SeqID_166661
atggagattcatgttggcaagagctactccatggaaaattgtcagtgggagcaagagttacaaccctacaatcaatatgaagaagaaagaatttgtaatcttgataattttttgatgcaacacaaggaatcatctgaatctactcaacacacaattaaaaatctggaaattcaatttgaggttgaagctcatgaggaaagtcttgtagaagaacatgatttaagagaaaaagatgaagaaagaagtgagaagagaacacaacaacaatgggagaagtgctcacaagtaaaaaataaacaagaaagtattctccaagtcaatacccctcctcatcaactaattgtcaaggaagaaaggcatggaaaacatgatatggaagacattctctccttgatcaccagcactactcttgcaatgatatggaaggcattttcgggatacatgagttttatggagtctctagctaagaggcaaaagtgcaaggaaaatatgttctatgtgaacttcatgacaccttga

SEQ ID NO: 49884 - DNA, 173 bp, Glycine max
  Peptide Sequence Number=SeqID_166662
atggcttcagggagaaatgttgtctttgttgttcctcaattttctagagaaagttatcacatatgggtagtcaaaatgagatcatgcttgaactcttttggcttatgtgagtatgtagatcaagataaacaagttccaacattgggaactaatcctacaatggctcaaatcag

SEQ ID NO: 49885 - DNA, 261 bp, Glycine max
  Peptide Sequence Number=SeqID_166663
atgtcttcctttaaagcacctaaaaaattctttctttgggcttatgttacaaatatatttgatgcaattgaagtggccaataggcttaaaggagacagcatgtatacggataagaaactggccataccagacaaagactacagattgattgtaatataccagtcaacgaatagtagttacgcaagtgcgttaatccagaacggattgattgtcgtttctgggcgaaacacaagtgcgttattccagaatggaatcttgtaa

SEQ ID NO: 49886 - DNA, 135 bp, Glycine max
  Peptide Sequence Number=SeqID_166664
atggaacttgatagtcctttaatgcttgtatttgcagggggttgggtgctttctgctccagatgaaaatatgcatcttccaactcctaacaaattcattccaattgacttgccacttaaagttgtgcaagaaaaa

SEQ ID NO: 49887 - DNA, 641 bp, Glycine max
  Peptide Sequence Number=SeqID_166665
atgtctcgcaggttgtttgaggcctgcacttctgagagacatgagaactggatggcacagtatggtaaggtttacaaggatgctgctgagaagaaaaaacgtttccaaatattcaaaaacaatgtgcacttcattgagtcattcaatactgctggggacaaacccttcaaccttagcattaaccaatttgctgaccttcatgatgaggaatttaaggctttactaactaatggtaacaagaaggtacgtagcgtggtggggacagctacagaaacagaaacatcgtttaaatataacagggtaactaagcttcttgctacaatggactggaggaaaagaggtgctgttactccaatcaaggaccaacgcagatgtggaagttgctgggcattttcagctgtggctgcgatagagggtatccaccaaattactacaagtaaattggtgtctctctcagagcaagaactggtagattgtgtgaaaggtgagagcgaaggatgcaatggtggttatatggaagatgcctttgaatttgtggccaagaaaggtggaatagcaagtgaatcatactatccttacaaaggaaaagataaaagttgtaaggttaagaaggagactcatggtgtatctcagattaaagg

SEQ ID NO: 49888 - DNA, 347 bp, Glycine max
  Peptide Sequence Number=SeqID_166666
gaaagtgtggaactaatacagatcatgctattaccgtagttggttatggaaaatctcgtggtggtaccaagtattggctggtgaaaaattcatggggcgctggatggggtgagaaagggtatataaggatgaagagagatatacgtgccaaggaagctaggtttcaaatggatcgagaaggatctagaaacaatgtggggaggttttgcatagagagggtggtggttggtagtggcagaagcaggggcattgaggttgttcatggtggccattggaatggatctgctggcaaaatcacccactccaaaggaaaaaataaggaccaagcaagaaagagaaccagttaa

SEQ ID NO: 49889 - DNA, 564 bp, Glycine max
  Peptide Sequence Number=SeqID_166667
atgctgatcgaagatggggtgcctccgctagaatgggaggtctccgacgaagagaagaaggttcagccgaagctagagctcggaagggcggctggggggaaggatgcagccgcagcggtggactgcgccaaagagaaaagacgtaacaagcagctgctttgcggactgctcttgctcttactgctgcttcctatgcttcctgcttctgactacctgcctttccctcaccgtcactgtcttccctaccagatcaggttttcccagacgcgagtcgagtcattcatcttcttcatcaggcttccttctcgcagtcgaagcggtagcggtactggaacgagttccctattcgatatggtttcattccaccagtcccctaacatagatagcacagggtcggcttcacttcggaaccttttcttgctttccttccgtgggcatgaaatgaaccctgagggtgccgccccctactacccaattcctgtcttcggaactacggggataggtgactttctgcgatggccctccacctcgttgggaaaagtgaaaggaaataacaagccctaa

SEQ ID NO: 49890 - DNA, 654 bp, Glycine max
  Peptide Sequence Number=SeqID_166668
atgccttccataatggaagaccatgaagtggatgatgtacatgcaaatcataatgatcatgatgaaagtttatgggagaacattcctacagtcatggcaacactcccagggtccccttcccattcatcagatccttcggagtctatgtctaggaggagtagacaatccacacgactgagaagcgtgactgtaagaaacttggatcaacccaggccaatggttaatgtcaatcctaccattgggaaaggattaggcctacataaaaagaagttccacaactatttgggggtagtagctcaagaaaagatttctattgtccatttcaattggaaagttgtaccggaatctctaagcaatctaatatgggatgacattttgggtcaagataatcaggctcctagtaaaaagtatggtttggatccagaaacttgggaggaatttgatgtaagccgcaaaaccccgaattggcagaagctcatggagaagaaaaagaagaaaagacaagaggaagcaatgctaattgaggattcagcaatggtcgtcgaccctctatctcccattgcaagacatgcatcacatgcctccaacaatttctttgcattgatcagcccacaacagttggttgagataatcaaaaaccttaaggaagagtga

SEQ ID NO: 49891 - DNA, 633 bp, Glycine max
  Peptide Sequence Number=SeqID_166669
atgccaacagtctcttacactgagtcagtggatgtagacattggagatcatatagaagacatgatacctgatcttggacaagagcgttttcggcaagatgacgactatagtgatgatgcaataacaaccaacggtcgtccaacaaaggtgttatggtatcttccaataattccaaggtttaagcgattgtttgctaacgaaaatgatgcaaaacaccttagatggtatgcagatggaagaaaaactgatggattactacaacatccgattgattctccccaatggaatacaattgatcgtttatatccagattttaaggaagagccaagaaacctaaggcttggtcttgcttcggatggaatgaatccttttgataaattaagcactaaccaaaagtacactaaaatagtgaaacctgttgggcttcctcaaactcgtcatgattggagacggggagatgcaatcttgggtgatgacaatgcttctaaaacattaagattgttagttgttgggccaaatctcaataacagtggggtgagccttgaggctgattccgaacacttttgtagtgcatcaaataacaacccgattcaagagttcatgccttactttggagtgattgaagaaatctag

SEQ ID NO: 49892 - DNA, 666 bp, Glycine max
  Peptide Sequence Number=SeqID_166670
atgatccacaagaaaggtggcaggattcgaacctatggccggcccgcccctgacctgctgggttgggtggccgggttagcacccctcgtcgcccctgtacccgaaacagatgcgctgcgctacccagcgcgtaaccttgtctcccctactcctcttctgggtagtcctcgaaaaccttcttcttttactggcttgggaaagacccgtaggctatggatcccactaatggaatgggactataaccatacttccatggctttccaactagccattgtacctgagattgcgataagtccttcttcttctttggagcttgttcttggtcccaagggaaacgggggtaaacggatatggatgatagttgggatcccaggtaggagagccagccaggagaaagaggtagccgcccacccattcttcctttccgaccttagcttagctgctcacgccaatgctcatgggtatggggccataactgctgctactgttatactcccacactctaagagagtcctaccgtcggctcatcttctatctaagacctcctcaatgagaggatgcctgaaagtcttttctcagcaagaggatgcgcgaaccattgttccaaagatcggagaatctagggaaccggaaaagcgaaaccttgtcaggaagaacgtgaagcag

SEQ ID NO: 49893 - DNA, 537 bp, Glycine max
  Peptide Sequence Number=SeqID_166671
atggatccggaaggagctgctgcatcgtccggcggatccaactccatctcagtgggagggagaagtgaaatggggggtagcagtaggggctccgggtggacgtcttttgatataaacgtcctgggcgaaccctttcctaatgaggagggtgaagaggttgcccaacccgacgcccaaaacgcccccgctaatccggtcgcttccccggggggggctcaagagcaagcgccgttaccgcaggcgccagccccggcgcaggaagctcaccctgctgaagtatccgaactaaaagcggaaattaaagccttaatcagcgaccaagttcgagaagaatcggagaaaggagtaggtcctttgaccatactttttcccgagcaaagggagataaactcctcagtagcccttctcattatggaccaactagaaattacctcggagatagatgttgaaaatcttcgggaatggattaacagaatcaaagaagacaaaagtcttctgaaaggactaataagggagtaccttcccccaaaaaaatga

SEQ ID NO: 49894 - DNA, 468 bp, Glycine max
  Peptide Sequence Number=SeqID_166672
atggcagagtcagatctagagcctcacccatgtcccgtaagcattaataacgccaacgaagcaaaccctgatgattcggaagaagtgtttatggacaatgttttcttagaaaaaaccctcaattctaaaaccttaaccctctcccccatcccactcaccctaaactcgcccctgactaggccatccctaccactaagttccctaactttcttcgtagtggatgtcctcacatccttcttaggactccaacttgatgacgttggagtccaagtttgtaatacatttcatcatatctgtgatgggacaattatatcttttgctgctttcactcaaccggagatagtagaaaaggttgaggttgcaactcttctatctccaatatcatacttggatcatgtcggtgcacctcttgtacttagaatggttaagatgcacattgatcagatgtttcttacattgttctattaa

SEQ ID NO: 49895 - DNA, 180 bp, Glycine max
  Peptide Sequence Number=SeqID_166673
atggggtgcatagcttcaacaaagaaggggtgcagagcttcgatggagaagaggcgggagagaggaagggagattcaagtgagaagggagctaggttcgagtagtgagagcgatggaaaccaagtgaacttcctcccaacaaccggtgcatcttccaactccatgtctccaatgaaatga

SEQ ID NO: 49896 - DNA, 210 bp, Glycine max
  Peptide Sequence Number=SeqID_166674
atggaagaagcacttgttcatattttaacccctaggtgttctattgacatattgtgggatgttcatgctaccaaggagcaaaggaaaccatgtgttgttatgtttgatggagttaatggggttggaaaatctcctgatctaactaaagttgcttactggcttctgcaacacaacgtcaatgtcatgatggctacttgtgatacattttga

SEQ ID NO: 49897 - DNA, 162 bp, Glycine max
  Peptide Sequence Number=SeqID_166675
atggtgcttacgtcagtaccatctttgaaaaatgtgtactttcaaagatggtgcttacctcagcaacgtcttagaatgcctactttcaaagacgttgttgagtgcacttcgcatccagtgggcattttaatgatgttagaccattggaaacagagagattga

SEQ ID NO: 49898 - DNA, 912 bp, Glycine max
  Peptide Sequence Number=SeqID_166676
atgtggagagagggagcgttattggtggtcctgctgctgctgctcctcctagtccagcaaaattgtgctaccaaggatgagcaagagcatggttgccctccttcttcctgtggcaaaatcaccagcataacttatccatttcgattaaaaggtgacccaaaaagttgcggccacaacaggtacgagctagcttgtgaaaataatgttacagtgttatatttgtactccgggaaatatcatgtacaggcaatcaactacaacaacttcacagtccgagtggttgatcccggagttcaacaacaaaactactcttcccttccacgctatttcttgtcacaatccaatttcagtgattcctatagtgacgccacggatccataccaagccggtctaaaaccaattaacaattgggcatggctcattttccagcatgtagtgtttatgaattgtagccacccagtgacctacaatcgtaaatatgtggatactgctccctgcgtcaactctgactccaaaggctattacatatactctattgctggtgacttaaaagcacatgactttgaagttggttgtcacgtaaagctggttgctctcacatcttggtggggtttcgacacaaacaatcattcctacactgccatgcacacggggctagtctacggattcgagatttcatggatgcacctcgcctatatggatatggaaatggaaatagatactgctatttcgactattccatccagaaccttcgatgccctctgtgtaatcgccaacgttcccgcattatatgtggaatactggaaatactgctattcgttgccggtggaatgcaaggagttgaaacgagatgaccctttgtcggtcctctttttctccttggattttcacttcgtattcttgccacattga

SEQ ID NO: 49899 - DNA, 897 bp, Glycine max
  Peptide Sequence Number=SeqID_166677
atgaccggaggttttaaagaaaagttgggtgaaggaggatatggctatgtgttcaagggaaaattgtgtagcgggtcttgtgtagcaataaaaatgttaggtaaatcaaaaggaaatggccaagattttattagtgaagttgcaaccgccggaagaatacatcatcaaaatgtagtacaattaattggattttgtgtccaggggtcaaaacgtgctcttgtctatgaattcatgcccaatggatctcttgataaacttattttttccaaagatggaagtatacatttaagctatgacaaaatatataacatatcaattggagtggctcgtggaattgcttatctccaccatgggtgtgagatgcagattttgcatttcgatatcaagcctcacaacatcctattagatgaaaacttcaccccaaaggtctctgactttggattagcaaagctatatccaattgataatagcattgtcacaatgacaacaacaaggggtacaattgggtatatggctccagaattattttataataatattggaggaatatcccataaggctgatgtttatagctatggaatgcttttgatggagatggcaagcaagaggaaaaatctaaatccccatgcagagcgttcaagccaacttttctttcccttttggatttataatcatattggagatgaggaagatatagaaatggaagatgtcacagaggaggaaaagaaaatagcaaagaagatgatcatagttgcactttggtgtatacaattgaaaccgaatgatcgtccctcaatgaataaagtagtcgaaatgcttgaaggagacattgagaacttggaaatacctccaaagccatctttatatccagcttctacaacatctaacaatgtttaa

SEQ ID NO: 49900 - DNA, 267 bp, Glycine max
  Peptide Sequence Number=SeqID_166678
atgggaaaaatattgggtgcagaaagaaaatcaagtgtgaatgaggagggtttggttattagggttttcgctgaccggtgcgcagtcgagcctccagaagacgaatcgaaaatgccgtcgcacaagacattcagaatcaagaagaagttggcgaagaagatgaggcagaacaggcccattccctactggatccgcatgaggaccgataacaccatcaggtacaacgcgaagcgccgtcactggcgtcgcaccaagcttggattctga

SEQ ID NO: 49901 - DNA, 234 bp, Glycine max
  Peptide Sequence Number=SeqID_166679
atgaccttgttattcatatgggtgagtgggttgaacgggagtggaggtggaagtcctttggcgtatgaaatggttggcgtgggaagaggaagtactggaaaggtttctgttggtgttgaggggagtgtcgttatcaatccgggagctattcagctagagctaaatacttggccttgtgtgatggccatttcggttcatccattgatgatattttggctcaaacttggaatctaa

SEQ ID NO: 49902 - DNA, 252 bp, Glycine max
  Peptide Sequence Number=SeqID_166680
atggcttggccaccgacagagtgggtctttgatctctacaaacgatgggtagttcgttctacttgcaatagacagcttgaactgctcctgatggggaagaacaagggtcgtcaatcgcactcagctgcaaagcaaattatggtgaagagtattacctcaggttcaggtaaatctcaaacatttgctacttctggtctagctggttgcttggatgttgtccaagcaaatcagaatgcttatactgcttcatag

SEQ ID NO: 49903 - DNA, 261 bp, Glycine max
  Peptide Sequence Number=SeqID_166681
atgtctgagagtgtcactgttgattgtcttaggaagatggaagtgtcttttgtttgcaagttagtggcgctgagcgagaagcgggtgctaagcgcgagatccagcacccacgctgagcgagcagcacgcgctaagtgcgcaaaccagaacactagcgctgagcgagaagagctcgctaagcgcgatatccagtccgcgctgagcgaggaagagctcgctaagcgagcttacgaaggcccaagtccacttcagcaactataa

SEQ ID NO: 49904 - DNA, 444 bp, Glycine max
  Peptide Sequence Number=SeqID_166682
gcttggggacataatcttattggctatgtggctggccgcttcccaggaaagaaagttctgttggattgttgccaaaaatggggagtcaagttttcatactcagctcatgaaagtggttggctgatgtataaatttgagtctgaggatgatctgaaccaagtcctctctgtaggcccttacttcatatttcaaagacccctactgctgaaggttatgccaacattctttgactttggcaatgaggagctcaacaagatccatgtctgggttaaactcagaaatcttcctctggagctttggaatcctcaagccttagggaaaatcctgtccaagattggttcacccattcaatttgaccatcttactgcttctaaggggtctatttcttttgctagaactttagttgaggttaatgcttctttggagctcactgatgaagtgtga

SEQ ID NO: 49905 - DNA, 369 bp, Glycine max
  Peptide Sequence Number=SeqID_166683
atggaaggcgtgcaaccccttgttcctggcgttggcgctagcgctgtcctcgccttccaattcaccggtgaacaccatgcaaaagaagaagctctccatgggcgcctttgtcgcaacgttgttgaaatcgttgttgttgctgctcttcttgtgcctttggcagcggttgaaggggaggctccactactaatcatgcataccaactatttgagaaaattccccaaccgaatactgttttgtataacagtgcacagttcccgtggtttcttttacaggccaatgaaggatattattgcatcgtggaacaccacgattttgggttatgcccaggttggactaataggcgaggttcgacttggaacaccataa

SEQ ID NO: 49906 - DNA, 1136 bp, Glycine max
  Peptide Sequence Number=SeqID_166684
atggcgtccaagaagaagcactcagagggcatcgccttgttgtccatgtacaacgacgaggaagacgacgaaatggaggacgcagaagacgaagacgacgaagaagaaggtgatgcagggatgcggatggaagaagatgccgccggagatgcgagatttgcagcggaggaagattccgccaatagaacagccatcgttgattccggcaacgagggcggcgctgatgaggggttcattccggcggagaagagtagggttgggacttcgacgccgcagacgaacaatttgatctctccaccgctggagcaaccgaggattggtcggaaaggggcgcttacgatagtggattatgggcatgatgaagtggcaatgtcacctgagcctgaggagggagagatatatggtagcgttcgagtcgtgattggggatcagcttcatgccaccaacggtgattttcaagacagaacacctttgggaacagtccaagttttgacacctagcaatcaagctaacactccccagttctctgagccattgaaatctgataccatgaacaatgatgctgtgatcagatcagaggatgcagaacttggagaagctgatcaagaagagcaaaaatatgtagatccattggataaatttctccctcccccaccaaaagctaaatgctcagaggagctacaagctggaaaaagctttaatgcagaagttcgcaacaggaaggactatcgtaaccctgacttcttactgcatgcagtgaggtaccaggatattgatcaaatagggtcttgcttcagtaaagatgtatttgaccctcatggatatgatcaaagtgacttctatgatgaactagaagctgatatgaggcgcgaaagtgagaggaaagagcaagagaagaagaaagcacagaaggttgaatttatttcagggggtgcacaaccaggaattgtagctagtgctcctaggattagcatgcctgttgcaggtgtttctgctgtgactgcaggtggtttgcctttggtgcctgctacttctgattctattaatcgggatgggcaggattctgtatctactattggggctcatgcagcaattttatctgctgctaatgccggtggtggatacatgcaatttgc

SEQ ID NO: 49907 - DNA, 1226 bp, Glycine max
  Peptide Sequence Number=SeqID_166685
atggcagctccaaagccagaggagataagccacccaccaatggatcaacttcaaggcttagagtactgtatagactcaaacccttcctgggtggagacaatagttcttggtttccagcattacattttggccttaggaactgcagtcatgattccttcatttcttgtgcctttgatgggtggaagtgatgatgataaagtgagggtggtgcagacgctgctttttgttgaaggaattaatacacttctgcagacactctttggaacccggttaccaacagtgataggagggtttttcagtccacttggaatggttccagtaattgcattagctggttttgggttatttgaccgaggattccctgtggttgggcattgcgttgaaattggaattcccatgttaattctgtttgttgtcttctctcagcacttagagctgttgccaatgactcttgaacatgttgcctacaggataaagattccataccctcttgagtggggtgctcctacatttgatgctggtcatgcctttggaatgatggctgctgttttagtctccttaatagagtcaactggggcatacaaagctgcatcacgactagcaagtgcaacaccacctccagctcatgttctgagccgtggtattggttggcaaggaattggaatcttgctgaatggcctttttggaacactaaccgggcttctaggaagcactcgtgttgggagtcgaagggtcattcaaatttcagctggctttatgatattcttctcaatgttaggaaaatttggagctttatttgcatcaataccattccccatttttgcagctgtatactgtgttctgtttggccttgtggcttctgtggggctatcattcttgcagttcactaacatgaactcaatgaggaacctctttattgttggtgttgcccttttcttaggtttttctgttcctgagtatttcagagagtacacttcaaaggcccttcatggtcctactcatacaagggctggatggttcgatgatttccttaatactatattcttctcatctccaactgttgcattgattgttgctgtgttcttggacaatactcttgattacaaggatagcgccaaagataggggaatgccatggtgggccaggtttagaacatttaatggagatagccgtaatgaagagttctatacacttcctttcaacctcaaccggtttttccctccacg

SEQ ID NO: 49908 - DNA, 1143 bp, Glycine max
  Peptide Sequence Number=SeqID_166686
atgttgttgctctctattccttgcctgatattcttagaagagcttaagaagaaattatccgatgaccctattttcatcgaattccggcagaatattgttgctaacccggataactaccctgattgcactgttgtgaatgacttcatcctcaaatggggtcgtatttggctaccacaaggatccacaatcattcccatgttgcttacagagtatcatttgacacccatggggggacatatgggggtagctaagactttggcaaggctgacgaagaattttgactggccgagactacggaaagatgtggcggactttgtggtggcgtgtatcgattgtcagcatacaaaatatgaaaccaagcgagttgccaggttgctatgtccgttaacggtaccatgccgaccatgggaagacctctccctcgatttcatcactggcttaccaccgttttgcgacaacattgtcattctggtagtggcacttttcaaagggcattcacttggaaaactccatggaatgcctcggagtttggtttcagatcacgaccctttattcattagccgtttctggcgagagctattccgcctcagtggtatccgtctgcgaatgagttctacttatcacccgcagacagacaggaagtcagagccaacaacatgggggaaatttctcagttgggttgaatggtcttataatacatcacaccactccaggactggtatttctccctacgagattacctttggcaagaagcccattacctttcctcaatatcttactggaacttccaatgtggatgtcgtcgatgacctgttgactaatcgggacgctgtttttaagcaagtccaacacaagctgttaaaggccccacaagttatggaacaatatgctgataacaaaaggagggatattcacttccagattggcgatctgtggacggacctatctccggatgacacgtcatgggaagattgggatcaattgaaagttgcttaccaccttgaggacaaggtgctttcggaggtactcggaaatgatagtaaccagcagaatacacaagcacatcagaatacacaagcattaaccagagcaagaccaacgagacaaagcatttcccatgcatacttaaaagatttcgtttaa

SEQ ID NO: 49909 - DNA, 345 bp, Glycine max
  Peptide Sequence Number=SeqID_166687
atgactttgagcaggcgagagaaaaaaatgagagagagtggtaggaacttaatgttttcatatggtggcgagattgaaagtgttgggaatttgaactctgagggtggttcttttgaggttggagtggaaggaggcaaaagagattggaagaaaattgagggtaaggatgatcaaaatgggaaaaccatgactatggatgttccaattgctgatataagtgaaaacaaggatgtgtatggacgcgtaccagaagagaatcgtagcattatatcggccaggaaaagaaaatttgaggtagagacaagcaacccatctgttcgagcagaatcaagcacccatgcctaa

SEQ ID NO: 49910 - DNA, 1146 bp, Glycine max
  Peptide Sequence Number=SeqID_166688
atggaggtgtggcctaaagatggcattcatggtagcctgaaaagaagagggagcattgctcagtccgaagggcatcactttgaattcatagtggccctggtgcgtgcgaaaggcagttttaccaatatcctgttcatgcatgcgaatttaatgatagccctgaagaaggtccaatttggagaactagctagcgccaccaagttcatccagaagttcatcaatggtgggaataggaaagcaatacttgatgggaggacattgacaagttcggagttagggaggagatgtatatggtggttagtcggtcttgatggtggtagggattggggtggttggaacaaagactggtattttgtgaggatgtgggaaatcgcgggaggaggttgggtaaatagtttctggtctaatggaggttctatggggatgatcgaaatatggaacacaaatcgcactcgcgacgagaagctaaatccttgggtgacagcgtttgaggggtatcggggtctggagtttcggaaggctaggcaacaaggggggctcaccgatgatcgaggaatttttcctcctgaaggcgagctaagcctgccgcttgcgccaacatcaatggctgaagagcctggacctcccgtcggtgcaaaacgcatttggagggcttggatgaaggacgatcatgacgtgaattggccgttgctgagtcgagtggtactaaaaaaattgctgaatcttgaagatccaaccaatggggtccgtgcctacaaagtgaggaacgtccagtttcaggcgatggttgataagctcgtcaagtttgtgggtcatgtgctggagggtatcactcagggaaagctgatgggtggtgagcttggtgatggcgtcctcaagcctattggaattggctctagaacgggccaaaacctccataacaaaaggaagaaaggaggaaaaagggctaagtggcagacaaggattgcaattggccaacaagattgccagctcaacactaaatctgttaaacgaaatctttcaagtatgcaggggaaatgctttgtctccttggtcttgctctggttaatgcttgtgtattctgctgtgcttgtgtattctgctggttactatcaaattacttttttggaacgtttgacacaatga

SEQ ID NO: 49911 - DNA, 244 bp, Glycine max
  Peptide Sequence Number=SeqID_166689
atggctgcagttgatccgtcagtatatgtattaccttttgattctcttttgccaactggtggatccttatttccccagaatgcttctgtaatggggaaaactaaagccttggctggaaggaggggagggtcgagaagagtttttttgatggtgggggttgttggttgggttttgtttcctcatgttaatatgtgcctcatttacaatgttgcacaatgctcagcagttcctttccttgtgaaat

SEQ ID NO: 49912 - DNA, 273 bp, Glycine max
  Peptide Sequence Number=SeqID_166690
atggatcaacatagaagtgaggtattggatccggttcatgatgggaatttgagccattcggctgaaggggttgcaattgcaagagataatataagtggagaagctggtacttcaggagaggtgggtgaggatttgggatctgataaggagccaaaggaggaagttaagggtcaagacaagcgtgatcaagaaaatattagtgataatttacctggggttgatcagggaactagttataattcaaggcatatggctaaatcaggaagtgattga

SEQ ID NO: 49913 - DNA, 285 bp, Glycine max
  Peptide Sequence Number=SeqID_166691
atggaaacctgggatgtcacctatgagatggatgacctcactcaccaaggaaacaagccgcaaagagatggggtttacctcaaaatattaaattccactgaccagttcaaacctgatatgtttcaatctaaccctcgccaaaacctagaattttttcattcaagggtatcttgtcattcaaggttatctgggaaaacagtttgtaatgagcaacacaagtggtgccgtaaccagagcctccaactcaaggctgtgctgaagtatgagaattttcatggaccttaa

SEQ ID NO: 49914 - DNA, 183 bp, Glycine max
  Peptide Sequence Number=SeqID_166692
atggcctggcctcctttctccttccaagtatccatctctaacaaggtgggattcagatggaggaaaacaggaaccactgcccgcattaggtctgctggtttcatcagaacttctccttctgaactacgatcagatgcaaagatgatttgcacgaagatgttagagccttacaggggggtttag

SEQ ID NO: 49915 - DNA, 345 bp, Glycine max
  Peptide Sequence Number=SeqID_166693
atgcagggaaagattctgaggctggagtttgctcattatgactaccaatctcgacaaaccatatcagccaaggactttgcgctctccatggttgcttctgccgacatgagtcatctaggcaggttgcttgaacgggttgatggattgaatgatgatccacgccttaaggatgcacgtctcacatttgaggacttaaaaaactttgcagagctacggaaaaagttactgccattttctttggcccttttcagttttggagaagtaaatggcctgttgacaagagacgattttcagagagcagcatcacatgtatggcatttatctttgattttgtgctcaacatag

SEQ ID NO: 49916 - DNA, 252 bp, Glycine max
  Peptide Sequence Number=SeqID_166694
atgtgtgaaacacttttcatatcttttaacaaagcgattatgagaattttcattcgatgctccaactacggcaaatgttgtcctaaggctttgactgaacctgactatggaagtgatgctagtgctttgaagaccacaacaacaaagaaatattccattatgtcaattgttccaattttcaataatgtattccttctttgcattgaaatgggaggtggttggatccttgatggccaaaagagatggatatga

SEQ ID NO: 49917 - DNA, 897 bp, Glycine max
  Peptide Sequence Number=SeqID_166695
atgtaccaagttgatgttaacaatgccttccttcaaggcttactcaaggaagatgttttcatggctcaacctcgtggtttcaaggattcccaacacccagattatgtttgcaagcttcataaggctatctatgggctaaggcaggcacttagagcttggcatgatgctctcaaatcatttataacatcatatggtttcacaaccagaagaagcaacccttctctctttatctacatctcgggtaacataactgtctattttttggtgtatgttgatgacctccttctcacaggaaataacactacattcatagacacattcattgagttcttatctaatcggttgtcactcaaaaacatgggggcaccatactactttatgggtattgaacttatacccatgaactcaagcatgttcctctcacaacacaaatacatcaaggatgtacttgagaaatttgagatgcaggatgtgaagtcgtcacccacaccacttgcctcgacgactacactcatgttgcatgatggtacaccaaccaataatgctactcaatatcaaagaattattggtgcattacaataccttaccctaacaagacctggcctctcattctccatcaacaaactctcaatattcatgcacaaaccaacctcccttcatcttccacatctcaggcgccttctcgaatacttgaagtcaactattaactttgctattgtgataaggaaaccccactccttcaatatgatagcctacacagatgcaaactggggagaaatcgttgatgacaacaccttaactttagcatacataatcttttttggaggcaacccaatctcttggctttccaagaaacaaagaactatggacaagtcctcctctaaggcaaaatattga

SEQ ID NO: 49918 - DNA, 285 bp, Glycine max
  Peptide Sequence Number=SeqID_166696
atgacgctagaggactactctagttctgctgcacctcagtacttcaccaacatagctaaactagacgttcaagtggccaacatcacgtatccacattccctcatccagttgattcaggggaatctattccatggcttgtcgagtgtagatccgtatgcgcaccttgccacatacattgagatctacaacatggcggttgtggctgcaaggcctaagactaagcaaaaggctcaagattatcttcagtttgctcatttacagattgttccgacacttcttctatga

SEQ ID NO: 49919 - DNA, 384 bp, Glycine max
  Peptide Sequence Number=SeqID_166697
atgacatccgagggcaagtgtgaggatgattttaatagtttaaggcctaacaacaggtgcaaacatctcctgaaagtcgatactaggacactttgtaaagcccttggccacaagttgcgcctttaccaaagatcaggttctattttttgtaactgcatcaaactcatcaaagatttcttaatgccaatgtgcatgttgcatggtttgcctgacattggaaggttcaaggtgggcatagcttctactgaaggaggacacgtaggagatgacactacggtcgatgtttcttgtggtacgataagtataatgtcaggtgggggaggtgatatggttgtactatatcgatttttggtctacgagataaggactaatatgggacgatag

SEQ ID NO: 49920 - DNA, 1635 bp, Glycine max
  Peptide Sequence Number=SeqID_166698
atggaagcgttgcgcgtcgcccccacaaccccacctctcctccgccgccaccaccctctccgccaaatggcgcgccaccccctcacagcgcgcccccgccgcgcgcccctcatcgccgccaccctctccacgccgccggaggccgctcactcttccgtcgccgccgccgtcgccgaagatccctcggaggcggctcctcctccgcgcccccgcgtcttgccggattccctccagtacccgcccggcttcgtcggcgcgattcccgcccgctcccgctccgacggtggcggcggcgggattgatgccatgacttatttgacgaacattctctcttcgaaggtgtatgacgtggcgattgagtctcctctgcaattggcgccaaagctctctgcgagactcggggttaaggtttggctcaagagagaggatttgcaacctgttttctcatttaagcttcgtggagcttataatatgatggcaaagcttccgagggaattgttggaaaggggggttatatgctcgtctgctggcaatcatgctcaaggagttgcattggctgccaagaggttgaattgcagtgcggtgattgctatgcctgtcaccactccggaaatcaagtggaaatccgtggaggcgctgggtgctacagttgtgctcgtgggggattcatatgatgaagcacaagcgtatgctaagaagcggggggtagaggagggtaggacattcgtacctccttttgatcatcctgatgtcatcatgggtcagggaacagttgggatggaaattgtccgccaaatgcagggtccaatttttgcaatctttgtgcctgtgggaggaggtggtctcattgctggtattgctgcttatgtgaagagggttaatccggaggtgaagatttttggggtggaacccactgatgcgaatgcaatggcattgtcactccatcatgatcagagagtgattttggatcaggttggaggatttgcagatggtgtagctgttaaagaggttggtgaagaaacttttcgcatatgcaaggagttgatagatggcgttgttcttgatatgttcgaggagaaaaggaacatattagaaccagcaggtgcacttgcactagctggagctgaggcatactgcaagcatcatggggtccaggggaaagatattgtagtaataaccagtggagcaaacatgaattttgataaacttcgggttgtaactgaactcgctaacgttggccgtaaacaagaggctgtgctggcaactgttttgccagaggagccgggcagtttcaaacagttttgtgaattggtggggcagatgaacatcacagaattcaaatacagatataactccaatgagaaggctgttgtcctttacagtgttgggattcacacagtctccgaattaagagcaatgcaggagaggatggaatcttctcagctcaaaacttacaatctcacagaaagtgacttggtgaaagaccacttgcgttacttgatgggaggccgatcaaacattcagaatgaggttctctgtcgtttcacctttccagaaagacctggtgctttgatgaaatttttggaccccttcagtccacgttggaatatcagtttattccattaccgaggggag

SEQ ID NO: 49921 - DNA, 495 bp, Glycine max
  Peptide Sequence Number=SeqID_166699
atggcttccattgtttccagacacagctctacaatgtccaaaattttatgttacttttttttagaaacaaacaaacaaaatcaccgccgtataattttctttcgaaacagcccctactatggaatcgaactcaacaacgccgcaaacctccccttaccaccggaagcaccagtggctcttcctctcctatgtacagttccgctctcagcagcgagtgtgggaaacacgcactgggttagagtcatattcgttagagaacaaaatctggtttcggcgagagccacatttgtcggcggttttcatgagcgcagagctcgccttgacggccaatgcagccttctcgtgcggctgcaaagggtgcctcaagagactcaatggaagcgagaaataggttgcaacacttggtcctcgtcgatggccgaaatgacatcgtggaattccatttcgtcggagttggatatgaagcacgccagatacttctacaagagaaattga

SEQ ID NO: 49922 - DNA, 2196 bp, Glycine max
  Peptide Sequence Number=SeqID_166700
atggggaagccgacagggaaaaagaaagatccttcgactcctccgaaggcgaacggccaccaccacaacccgtcgaaatccttggatgacagcaacaacaacaaacgcgcggcggcgctggacgacgacacggcgatgttcataaacatgtcgcaggagcttcgcgaggaagggaataggctcttccagaagaaagaccacgagggggccatgttaaagtacgaaaaagccctcaagctattaccgaagagccacattgacgtggcgcatctccacaccagcatggccatgtgctacatgcagctgggcctcggcgagtacccgcgtgccatcaacgagtgcaacatggcgctgcaggtctcgccgaggtacaccaaagcgcttctaaagcgcgcaaagtgctacgaggcgctgaaccgcgtcgatttggcgatgcgggacgtgcgcgtggttttaaacttggagcctaacaattcgacggcgctggaggttttggatagtttgaggatgacgatggaggagaaggggattgtcgtcgatgagacggagatcgcccttgccgcactgcagcaccagccggagccggcctccgcgcggctgaggaagattgtgagggagaagattaagaagaagaaggaacacaagggtggagaggatggagggaaagcgaaaaagattataattgaggagaaggttaaggttgagaatgttaaaaagaaggataataaggacaaggatcacaaggttcataaggataaggagaagagggtggtgaaggaagagaaagagaaattggggaaggaggagaaagagaaagataaaggggttgttactaggactgtgaagttgatatatggagaggatattagatgggcacaattgcctgtgaattgtgggatgaggttggtgagggatgtgataagagataggtttcctgggttgaagggtgttcttgtgaagtatagggatagggagggtgatttggttactatcactagtactgctgaattgaggttggccgagacttgtcatgtgcttggatctattcggctttatgttacggagattgagccggatcaggagctatgttatgatgatggtgtggcgggggtggaggatggtgggaggatgaggatgaaggtggttgagaatgggggtggggatggagggaagggtgtggggaaaggggtgagtactgtggaggattggcttgtgcagtttgcgaggctgtttaagaatcatgttgggtttgattcggatgcgtatttggatattcatgggattgggatgaagctgtattcggaggcgatggaggatgcggtgacgagtgagggtgctcaggagctgtttgacattgcggcggataggtttcaggagatggcggctttggcattgtttaattgggggagtgtgcacatgtcaagggcgaggaagcgggtgagtattccagaggatgggtcgagggagtctgagtttgaatttgttaaggcagggtatgagtgggctcggaaggagtacatgaatgcagagaagaggtttgaagaggctgtgaagattaaatcggatttttatgaagggctgcttgctcttgggcatcagcagtttgagcaagcaagactctgctggtcttatttgattgcgaacaataaggatttggaagccggcccttccgatgaggttctgcagttctataacaaggcggaggatagcatggagaaaggcatgttgatgtgggaggagattgaggagcagcgtttgaatggactgtccaaatcggataagtataaagagcagttagagaaaatggggttgcatggtcttttcagggatgtttcttctgatgaagctgatgaccaggctgcaaggatgaggttgcaagtatatcttttatggggaaccttgttgtatgagcgttctgttgtggagtataagctaggcctgccaacatgggaggaatgtttagaggttgcagttgaaaaatttgaactggctggagcttctacaactgacattggggtcatgataaagaatcattgttctaatgaaacagcaatggaagggttcaaaattgatgagatagtacaagcatggaatgagatgtatgatgggtggcagtttgatgttccatcatttcgacttgaaccattgtttcgtcggcgtgttccaaaactccattacatcctggagcaattttga

SEQ ID NO: 49923 - DNA, 279 bp, Glycine max
  Peptide Sequence Number=SeqID_166701
aaaaaagtcgaattcagagcttgctccaaatgcaagctgctcccgttgctcctcacacatcacactcaagagttctgttcttcacgctgctctcaagctcttataatgggttctgtcggtgctattggattgggaccatcttcctcttatagccaccatttgatgggtgtgaaagtgaagaaattgaacgtgatttttgctgtcgccggcagaatccaaggaggcaaggaccacttcagctctcccattggtgctttgttctccaagaatcctttttga

SEQ ID NO: 49924 - DNA, 294 bp, Glycine max
  Peptide Sequence Number=SeqID_166702
atgtgtgatcctattgatgctacctctaggagatttatttggggaaatgcttctaaccattgggttaattggaacacaattacgcagccaaggaagaatgaaggcctaggagttaggagggctagagattctaatgttgtcatgctagggaaaaaggctactcctattcctgattggctgaaacatgagcttgaaagtgttgtgctaaatgataatgtggaggatattgtcatttgggataatgcttgtgatggagaatactcagctaaatctgcatactgttgtttgacttga

SEQ ID NO: 49925 - DNA, 579 bp, Glycine max
  Peptide Sequence Number=SeqID_166703
atgcgtggtttcaagctaactgaacgtttcaagagcaccgaggttcatgctctcagttcttcttcatcagaaacaaatcatggcaatagcagcaaagcctcagtggctgctaccaccaaacctcacaactaccttaacagaaacaaaatcatgttaccatcatggtcaaaaaccaaatccagaactaccaacaacaactcaacctcattagtagcaaaccttgcccctagtgatgtatgtgtggttgagacttttgatgagcttgaagaagagatgcctcaaggccagaaattgcagggtgtcttaactgcacaagaggttcatgaggttctaactcatcgcagagcagttgtagggcacgacaactctgaaaagggaaacaccgtagcttgcggtggcgcgacaagacgtgacgcagagaccaaggacgcgcgacaatgtatgctaccttcctttagccgaggtcacggtggtgcgatggagatgcaggcaaacggtaaaggtcacggagaggtcacagtagaaatttcagacaaacggggagggagctcgagcgaggtaggagtgttcatcacttag

SEQ ID NO: 49926 - DNA, 1572 bp, Glycine max
  Peptide Sequence Number=SeqID_166704
atggtgggtagtagcagatggattaattgttgtgcatggtggggttcagaagcatcttcaacaatgaggatcttcttgttcatggtgcctctcttagtgcttgcgggctttgcttctataaagggttcaagcgtttacaacggaagagattctattgcaaaacgttatgccttgtcgagctctctaataactcgttcaaatttctcttcacaaacatttcttcctcctccaaattcctctttacaaacaatttatccttcttcaaattcctctttacaaacgcttcatcaatctaatgaaactgaagttaatgtctccatacccaagtccaattcagctcctgcaaatgaatctgatgaatctcacccaagagagaagcagaaaagaaaacccagtttcttagatagaactgaagttgttctagcacaagctcgagctacaatcagagaagccaaaaattggaatcttacacaagattcagattatgttccaataggtccgatgtattggaatgctaaggaatttcacaggagctacttagaaatggagaaacaattcaaagtatttgtctatgaagagggggagcttccagttttccatgatggaccatgcagcagcatatactccacagaggggagcttcatccatgctattgaaatgaatgagcattttcgaacaagagatcccaagaaagcaaatgtgtttttccttccttttagcatagcatggatggttcgatatgtgtacataaggaattcatacgattttggccccataaaaagaactgtcagggactatgtcaatgtcattgctacaagatacccctattggaatcgaagcctcggagctgatcacttcatgctctcttgccatgattgggggccagagacttcaaaatccataccttacttgcgtaagaactctattcgtgtactttgcaatgccaacacctctgaaggattcgaccctataaaggatgcttcatttcctgaaattaatctccaacctggtttaaaagatagcttcgttggtggaccgcctgcatctaaacgttcaattttggccttctttgctggggggaatcatggccccattaggccaattcttcttgagcattgggaaaacaaggatgaagatattcaagttcacaagtacctcccaaagggtgtttcttactatggcatgctgaggaatagcaagttttgcctttgtcctagtgggtatgaggtggctagccctagagtggtggaggcaatttacacagggtgtgttcctgtgctcatttcggagcactatgttcctccttttagtgacgttttgaattggaagatgttttcagttaatgtttcagtgaaagaaattcccaacttgaaggacattttgacgagtatttctccaaggcagtatataagaatgcaaaaaagagtgggacaaattcggagacactttgaggtacattctccacccaagcgatacgatgtgtttcatatgatacttcattctgtgtggcttaggagactcaacttcagagtccatgatgatatcaatgattttttaagtggcaataattga

SEQ ID NO: 49927 - DNA, 817 bp, Glycine max
  Peptide Sequence Number=SeqID_166705
ccctggtgcagcggtaaagttgtgccttggtgacttgttggtcatgggttcgaatccggaaacaacctctttgcatatgcaagggaaacaactgcccaatatgctgtttcagattaagcccaatgtgtcaatccagaacaatatgcatgctttaagcgtagttgcttatgtcaaacatgatgatcaaatagaccaccatgagtccctaatttcatcgtttaagaagaacttatatcctgctcttaaagaagacattcaccaaaatagcagtcatccgtcagcttttacatcaggaacacctagacgctctgataaccaatggacctctagctggtgggagaaattcagggtgcttcttaagagggggaaaatgaggcctattttctgtggaaattttgaatatgatgcccgacagtcagagctcgagcgactttttagccgatatgggaaggttgatagggtggatatgaagtctgccatgaatccatttgcttatttttgttggttggattgggattcggggattatcctggagcagatatttgagattgaacttggacttctagttcgtcatgtgtttcaaaactcattgcttttgcagatgattgcatcagaggatataggaaggcaggtattgacttatggagaaaggggaaagcttgatggtttcaaagatgcaggcaccaatgtatctcctgctctttcaaggagggacatggccatgcagatgagcccagagggtagctcatgctcctctcccagtttgaggccttctttatggtgtcgttgtagcatgcttttgcttgctaatgcttga

SEQ ID NO: 49928 - DNA, 462 bp, Glycine max
  Peptide Sequence Number=SeqID_166706
atgactcgttcacgatcaaaccggccggtccaatccgattttcaaaatagtgctttcaagtcaccaggaactgatggatctcaacttgtcttctttcaaacttattgggatgttgtgggttcggaggtttgggagatgatagctcaaaatttcaacataggtaatatcaattcagccttggtggaaactcttatttttctgattcccaagattgatagcccagtgagccttggagattgtaggccaatcggtctatgcaatgtcttgctcaaagttatttcaaaagccaagacttctaaggtgaagatggtccataaggttttggatattttttgtaaggcttcaggtcttaagataaatgttcaaaaatccagaattatggtttctaaaaacatccctagaagaaagtctaataagtttgcagatgttcttggttttcaagctaccaagaatattgattga

SEQ ID NO: 49929 - DNA, 168 bp, Glycine max
  Peptide Sequence Number=SeqID_166707
atggagagaggcagaaaagaaaggcctaaggaagtaaaatattatttctctcctctttcaaggaaatcaaagtgtactggagagaagttcctatggagaaaggtacaagtctttctatggaaaaagagcatgtgttatgaaatttatgattctccaagaatgatttaa

SEQ ID NO: 49930 - DNA, 255 bp, Glycine max
  Peptide Sequence Number=SeqID_166708
atgacggtcagatggagaacatacaacttcaaggtagatggagaacaaagagagcaagaaaacatggatggagaagaagacagagagaaggagaagacaacgcgaaggagacgaaacatacctaggtatggtggcgaaggagaagaagcagagacttgtgacgatgctcgagtgcgacgaacacgatgctcagatgcagatagggacggtttcgctagacggagattagaagaagaagagagcgcgaaagcttag

SEQ ID NO: 49931 - DNA, 444 bp, Glycine max
  Peptide Sequence Number=SeqID_166709
atggatgctcatcaaaataaatcatgtttatattttgcaaactttggtatgtttctcgcatatagagataagaatgaaactaaagttttcaatgtctccaagcccgggttcaatttagctgctgcaaatgaatcggatgaatctcacccacgacagaagcagaaaagaaaactcagtttcatagatagaaatgaagttgttctagcacaagctcgagctgcaatcagagaagccaaaaatgagaatcaaacacaagattcagattatgttccaataggtccgatgtattggaatgctaagacatttcacaggagctacttagaaatggagaagcaattcaaagtatctgtgtacgaagaaggagagactccagttttccacaatggaccatgcaaaagcatatactccatgggagggttacttttatacatgctattgaaatga

SEQ ID NO: 49932 - DNA, 1350 bp, Glycine max
  Peptide Sequence Number=SeqID_166710
atggcgtcgaggcaacaaaaagaggatcgagctgaggcagctgcgaaagttgctgcgaaagaactcgaacaactcaaccgagaaaaagaccgtgatttcagtgttggtgttgcagaccaacaccaacaagaagaacatcagttagatcaacaaaagcgtggtgtaatcggatccatgttcaaggcggtgcaagacacctacgagaacgccaaggaagctgtcgttggcaagaaagaaccttcgacgacgactaactcgtacagtaccagagaggttattcacgacgttgacattcaacccgatgacgcggctgcagcgagggaagtgagagacaaatcagcctcaaagtcaccaggtatctacaattctgccactgctgacaacaaaaccggttccaaggtcggagagtacgcagattatggttctcagaaggcgaaagaaacaaaagatgcaacgaaggaaaaagctggagagtacacagattatgcttcgcagaaggcgaaggaaacgaaggacaagacaatggaaaaggctggagagtacactgattatgcttcgcagaaggcgaaggaaacgaaggacaagacaatggagaaggctggagagtacacagattatgcttcgcagaaggcgaaagaagccaaggacaagacaatggagaagggaggggaatataaagactatgctgcagagaaggctaaagaaggaaaagatgctactgtgaataagatgggagagtataaagattatacggcggagaaggctaaagaggggaaagatacgacgttggggaagcttggggagctgaaggactctgcggctgatgcggcgaagagggcagtgggttacttgagcggcaagacagaggaaaccaaagagaaagtctcggagacggcagaggcgacggctaataaggcggcggagatgaaggaggccaccagggagaaggctgccgggactgcggaggcggccaagaacaaggccgcagaggtaaaggacagagctgcagaaaccgcggaggcggccaagaacaagactgccgagactgctgaggcagcgaagcagaaaaccgcacaggcaaaggacaacgccaaggaaaatgtgagtggtgcagatgaaggagcaaggaggaaaatggaggacctaaggcttcgaggtaaagggtatggaagtcatgaatctgcaggggggcgtggagataaggtggtggtgaaagtggaagagagtcgaccaggggcaattgcggaaacactgaaagcagcggatcagattgcgggacagaccttcaacgatgtgggacgcttcgatgaagaagagggtgtcgtcaatgtggagcgccgcaagaaataa

SEQ ID NO: 49933 - DNA, 831 bp, Glycine max
  Peptide Sequence Number=SeqID_166711
atggttcgatttgtgtatcaaagagactcacgtgactttggccccattagaaaaacagtcatagactatatcaatctcattgctgcaagatactcttattggaatcgaagccttggagctgatcacttcatgcttgcttgccatgactgggtgaacaccttagggccagaagcatcattgtccttaccttacctgcacaagaactctattcgtgtactttgcaatgccaatacctccgaaggtttcaagcctgcaaaggatgtttcatttcctgaaattaatctccaaaccggttcaataaacggtttcattggtgggccatctgcatctaaacgttcaattttggctttctttgctggaggagttcatgggcctattaggccaattctccttgagcattgggaaaacaaggatgaagatattcaagttcacaagtacctcccaaagggtgtttcttactatgacaagttgaggaatagcaagttttgcctttgtcctagtgggtatgaggtggctagccctagagtggtggaggcaatttacacaggttgtgttcctgtgctcatttcggagcactatgttcctccttttagtgacgttttgaattggaagtcgttctcagttgagctttcagtgaaggacattcccaacttgaaggacattttgatgagtatatctccaaggcagtatataagaatgcaaagaagagtaatacaaattcaaagacactttgaggttcactctccacccaagcgattcgatgtgtttcacatgatccttcattctgtgtggcttaggagactcaactttagaatgactcttaacttgtaa

SEQ ID NO: 49934 - DNA, 447 bp, Glycine max
  Peptide Sequence Number=SeqID_166712
atggcagctcgtggtggccactggtggtcgtgggtgatggagaataaagtgttagggtttaggtgggcgtttagcgaggaggagaggggaaaaatcgtgtttttcacgctgaagaacactagcttaggcggccgaggtcatgcggtgagacctgttagtggtgtactgcgcactcaatcattcgacgagggtgtcaaagatgtctatggacctaggtgggagtctatcgtaccaggtcgatgttgctcccttgagagatgtagggaagacgcgacacaaggtcgcattgtcgttggtgtaaaggtttacctgtgtcaggaaggcgtccaaatgctcgtttggatcggttgtctcgtcgtaccgctcgaggttgagtggcttccaccccaagggcaaggtgtgggcggattgctcgtcgccttggggacatctgacatgagcctctag

SEQ ID NO: 49935 - DNA, 1089 bp, Glycine max
  Peptide Sequence Number=SeqID_166713
atgttccctgcagttatgtccaattccaattccttgtccgaagaggccactgtctcctgtggtacaagaatcgctggactcaatcacgttatcacaacaaccatttctccagaacaacctctaaagatcaagaaaaagagaaacctccctggaaaccctgacccagatgctgaagtgatagctttatcaccgaagactcttctggctaccaatagatttgtgtgtgagatctgcaacaagggtttccagagagatcagaaccttcagcttcataggagaggacataacctcccgtggaagctgaagcaaaggagcaacaaagaggtgaaaaagaaggcctacgtttgccctgagccttcatgcgttcaccacaacccttcaagggctttgggggacctcactggaattaagaaacactactgcagaaaacatggggagaagaagtggaaatgtgaaaagtgctcaaagatctatgctgttcagtcagattggaaagctcactctaaaacctgtggtactagagaatatagatgtggttgtggaacccttttttccaggaaggacaacttcataactcacagagcattctgcgatgcattggctgaagaaagtgcaagactctcagcaaaccaactagccaccaacaccacaaatccattagttcaatccctcttccttttcccaacccaacaacacaacaacaatttcatcaatccatgggaccctaaccctaaccctaaccctaaccctaaccctagcaaccttaccactctccacaacaacatcaaacctgaatctcacaacttccacatccccaacaccaccaccacctccactgccaacaacaacatttcttcttcattccttcatcatcatcaacaccccaataagagcatgataacctcacccttccgtgacctccacgagcgcacgcaacccccctccaacgctgccacgtcagcacacctctcagccactgcgttgctccagaaggccgcgaccgtgggtgccgccgccatcacgggacccactcacgtgactcagctcagcatggccgagctaggaaccgagacgactcatctggactca

SEQ ID NO: 49936 - DNA, 336 bp, Glycine max
  Peptide Sequence Number=SeqID_166714
atgttggattttgaacctgtgctaaataaatttgttcgggaacatcctccaaggccaaataagcatgttgtgtatcatcatgagtttgtgtatgtgaggcaggacaatgatcaaggcattgttggtgcttactttacatctgcatccgcttcttacaaagatcaaggaagacacaacgaaatgaacaatgcagagaagacaaacctgcaagtagtcgaggccaccgttggatggattcagtgggagaaggccttccaacgagactcgaagtctttagccgttgttggaagcgtttcgtatcttcggattcgaatggaccaagactccatcgcttga

SEQ ID NO: 49937 - DNA, 192 bp, Glycine max
  Peptide Sequence Number=SeqID_166715
atggaggttgcgcaaaaggttatttttcaggcaggcgatgcacttttcattcctgaaggctggttccatcaggccgatagtgatggtttgaccattgcaattaatttttggtggagatccaacatcatgtcttgcatgttggaacacatggatgcttattatttgcgcagaatattgagaaggtattggtga

SEQ ID NO: 49938 - DNA, 237 bp, Glycine max
  Peptide Sequence Number=SeqID_166716
atgaacagtgatagtcaggcaaatgttcaattagaaaccctgagggaagacattcagatgcctcagattttggcatcaaaagaattatcctcaataaatttgtggatgaacaatgcccaagctagatcaagtactcgctatgatccacagtccacaccacaatcttctgtgcatagtttctggctgcaaacaagtgatggagatgctactcttcaggatatgctatcagttacatag

SEQ ID NO: 49939 - DNA, 855 bp, Glycine max
  Peptide Sequence Number=SeqID_166717
atgggggagggatgttgtacgcagccttacccttgcatatgcaaagaggctgtttccggattcgaacccatgaccaacaagtcaccaaggcacaactttaccgctgcaccagggttcgccctcaatccacttagaaagtatattctagaaaaaagaaaaaggctgagcaggatagatgcgagacaggaccaactactgcttaagttggggatggggaaaactaagctgcctaataatggacaagcagatcacgctgatgaaaattatggtcagatgttgaaagggatggatttaagagagaaaaagcttaaagaaaggaacacattgctagaattagaacctgctgcatcccaggatgggcaatcaccatctacttctataactgattatgagcttgcagggaatgataaatgtgagaaaatagtgactgctgacttgaaagatgatccacttgctaaaattctctgggacgttgaaccacaaacactccaatgtgtttttcttgctatggcgcataacctcccaagaactttagaggctcttgtactgcatgtgctttcgccagttggggtcgaagtcctcactcggaaattcgatgagatggagcaacaaactctcgaggaagatcggaatagattctacgaggttttctacggtgcatttgatgaccaatctgcagcaatgaattcaattctaaaagggaaagagttgttcactgaacagctactgttgcttgttgctagtttcaacatttctaagatgatttttcattcattagaacttttgccactatttgattgtccggggctacttattatgacttatcttgatggagtagtgctaggatcactttga

SEQ ID NO: 49940 - DNA, 240 bp, Glycine max
  Peptide Sequence Number=SeqID_166718
atggttcaaagatcgaaagggaaaacgatgaaatgggttacattgcttaaggacttcaaagagaaggttggcctcactcaatcgccaccctctgctcctcctcctcctcctccttcctcttcttcccgcgacaacaacaacaacaatgccttttcagcttcgcaatcctcttcttcttcccctaccagattttggttaatgcaaagtgtagagttaggtggagttgcaagatcctattag

SEQ ID NO: 49941 - DNA, 6600 bp, Glycine max
  Peptide Sequence Number=SeqID_166719
atgttggtggggaacagagcatttgtaacagatatagaaaagttaaaaatcagcagcaaaacaagatctttggatgttgctccagttttaaagtttttctcggaagtcacaaagatatttccttctatgcaggatggaatcagtcctggagcaaatttattaacttcagtggaaatccttgtctctgggcctattgacaagcaatctctacttgactctgggatattttgctgtctcattcaagttctcaatgcccttctcgatcctgatgtaaccattcaaaggccaaatagtactactgatcatgaagataatctcgtattacaaaaagtttatgatgaagttgggccaaaccgccggcttgaggtagagggaagtgttgtgcatatcatgaaagctctagcaagccatccatcagcagcacagagtttgatagaggatgattcacttcagttgctttttcaaatggttgccaagggatctttgattgtcttctcccgttataaggaaggacttgttccattgcacagcatacaacttcacagacatgctatgcagatacttggtcttcttttggtaaatgacaatggaagcacagccaaatacatccgcaagcatcatttggctttggctcaaggggtaggttggtgtggttttaggatttattgtgacaaaaggatctcctttgggtttcttctctttcaatctcatataaaagttcttctattgtctgtgaaagattttgatcctgattgtggagatgctgcctttaccgtaggcattgttgacttgttactcaagtgtgtagaattgtcatatagagctgaggctgccagtgtcagacttagagaggatatacataatgcccatggatatcaattcctagttcaatttgcactaactctgtccaatatgacaaaaaatcagggctttcaatctactcattatgatacgtttgatgaacaagagattgcttctgatggatccaaaaatagcagaggacaaaattccaatgaacaagaacattcctccattcagtatctttcacccacattatctaggttgctagatgttcttgttagtctagctcaaactggaccaaacgagtctccacgtaattatggaggtaagggttctaaatctactcagaacaagggtggtggtcatagcaaaagtcgtacctcatcttccgattggctcggtgatgaattatgggagaaggaaaatgataaaattaaagaccttgaagcagtccagatgttacaagatattctcatcaaagctgatagctggaagttgcaggctgaagtattaaatagactgtttaaaattttttcaggccacatagagaattatagtctgtgtcagcaattacgaactgttccacttttaatcctaaatatggctggttttccttctcatttgcaagagataatcttgaaaattcttgagtatgccgtgactgttgtaaattgtgttcctgagcaagaactactttcactttgctgtttgttgcagcaaccaataacatcagcattgaagcagacaattctttctttctttgtaaaacttttgtcctttgaccaacagtacaagaaagttctgcgagaagttggtgttttggaagttatgttagatgatctgaagcaacacaggattttgggtccagatcaacagactgttaactcggaccagttggagaggaaaaatagctcaaacaatttcaagaaacacctggacaacaaggatgttattattacttcacccaagcttatggaatctggttcagggaagttccctatttttgatgttgaagctacaattgctattgcctgggactgcatggtatctttattgaagaaagctgaggttaatcaagcttcattccgctcagctagtggtgtgactgtgatgttgccttttctggtgtctgatgtacatcgctcaggggtcctcaggatattatcatgtcttataattgaagatacctcacaggctcatcctgaagaattaggtgtgttggttgaaattttgaaaagtggaatggttaccagtgcttcaggatcccaataccggctcacccttgatgcaaaatgtgacactatgggagcaatgtggcggatcctgggagttaataattctgctcagaaggtttttggtgaagccactggtttttctcttttacttacaacactccatggcttccaaagtgatagtggggacttggatcaatcttcattgaatgcttatattaaggtgtttacgtacttgttgcgtgttgtaactgctggagtttctgacaatgctgttaatagaatgaagttgcatgcaattatatcatcacaaactttccttgatcttcttagcgagtctggcttattgtgtgtggatcatgaaaaccaagtcatccagttgatgttggaacttgcccttgaaatagtgattccgcctttcttagcatcagagggtttgacaaaatcaaatgctattgagaatgagtcatctcataatcttttattgactccatcaggtccaattaatcctgataaagagcgggtatacaatgctggtgctgttagagttctgatccgttcattattgctttttactcctatggtgcagttaaaacttttagacttgattgaaaagttggcccgtgctggtcctttcaatcaggaaagcctcacgtctgtaggttgtgtggaacttttgctggaaacaatccatcctttccttctgggttcatcttctttactctcttatgcattgaaaattgtggaagtccttggttcttacaggctatctgcatctgaacttcgtatgctcattagatatgtcctgcaaatgaggatgaaaaattcaggtcatataattgttgaaatgatggaaaaattaattctgatgggagatgtagcctcagaaaatatttctctggcaccatttgtggagatggatatgagcaagattgggcatgctgccattcaggtttccttgggtgaaagatcatggcctcccgcggctggttattcatttgtttgttggttccagttccgtaattttttaaaatcacaatcaaaagacacagacgtttcgaaatttgcctcttccaagaaacgctctggttcaagtggattgcatgagcgacatatcttaagaattttttccgttggtgctactaacaatgataatgcaacctatgcagaactttatctccaggaggatggtgttctaacccttgcaaccagcaactcttccttcttatcattttctggtttagaacttgaagaaggaaggtggcatcaccttgcagtcattcacagcaaaccaaatgctcttgctgggctgttccaagctagttttgcgtatgtttatctaaatggaaagctaagacacactgggaaattgggatattcaccatgcccacctggtaaacaattgcaggtcactattggtacatcagttggaaatgctagagttagtgacttgacgtggaaactacgctcttgctatctttttgaggaagtgctttcaccaggctgtatttgttttatgtacatacttggtagaggatacagggggctcttccaggacacagatcttctgcaatttgtacctaaccaggcctgtggtggtggtagtatggccatattagattctttagatgctgatgtgactttggctgctaatggtcagagactggatgctgccagcaagcagggagatctaaaagctgatgggagtggaattgtctgggatttggagagacttggaaacctttctttacagctttcaggaaagaaacttatttttgcatttgatggaacttctacagaattcattcgatcgtcaggtagcttttcaatgcttaatctggttgatcctatgtcggctgctgcctctcctatcggaggtattccacgtttaggacgtctctgtggagatatttatatctgtaagcaaggcgtgattggagagactatccgccctattggtgggatggaacttgttcttgctcttgttgaagcagcagaaactagggatatgctgcatatggcccttactctacttgcctgtgcgcttcatcaaaatcctcagaatcttaaggacatgcaaatttataggggctaccatctgcttgcgctttttctgcgtcgtagaatgtcattatttgacatgcaatctcttgagatcttctttcagattgctgcttgtgaagcttctttttctgaaccaaagaagttggagactagtcagactactttgtctcctgcttcatccctgctggaaaccagtcttgaggataactttttgtcaaagtttcatgatgagaattcttcagttggatctcatggggacatggatgatttttctgtacaaaaagattcatttagtcacatttcagagctggaaaatactgatgttgctgctgaaacttcaaattgcattgtcttgtcaaatgcagacatggttgaacatgttttattggattggacattgtgggtaactgccccagtttcaatccaaattgcattacttggattccttgaaaatttagtgtccatgcattggtacagaaatcataatcttacaattttgcggcgaattaaccttgttcaacatttactagtgaccttgaaaaggggtgatgttgaagttcctgttctagaaaagttggttgtactgcttggggtcatcttggaagatgggtttctaccttctgagcttgaaaatgtggttacatttgtgattatgacatttgatcccccggggttggttccacagcgtccaattatgagagaatcaatgggtaaacatgtaattgtcagaaatatgttactagagatgtttattgatctacaagtcactattaaatcagaagagttacttgagctgtggcacaaaattgtctcctctaagttaattacatattttcttgatgaagcagttcatccgacaagtatgagatgggtcatgactctacttggtgtgtgtcttacttcctctccaacatttgcatttaaatttcgcactggtggaggttatctaggcttagttcgggtgctacccagtttctatgattccccagacatctattatattttattttgtttgatatttggcaagccagtttacccaaggttgccagaggtccgcatgttggactttcatgcccttatgccaagtgatgggagttatacagaactgaagtttgtagagttgttggattctgtaattgctatggcaaaaactacttttgatagagtaagcatgcaggcaatgcttgcccaccaaactggtaatctttcccaggttggtgcaagcctcgtggctgagcttgtagagggaaattcagacatggctggtgagcttcaaggggaagctctaatgcacaagacatatgctgctcgccttatgggtggagaggcatcagcccctgctgctgcaacttcagttctaagatttatggttgatatggctaagatgtgccccccttttactgctgtttgtagacgtgcagaatttcttgaaagctgcattgacctatatttttcttgtgtgagggctgcacatgctgttaaaacggctaaagatctctctgcagttccggaagagaaaaccttgaatgattgtgatgatacatgcagttcacaaaatacattttctagcttgcctctggatcaggatcagtctgtcaaaacctccatcagtgttggaagctttcctcaagggcaggtaagtacaagttctgatgatatggctgcagcaccgaactctatggctggtgagagaccacagaataatcttactgtatctgagctggagtcaaataaatctgtccgtgaagatatgcaaactgttcagagcttggatggtgataatgctgatcaaggttctgttgcttcctgtgcacacgaattcagctttcaaagtatcaaaggcaatttggaccttctcccaccaacggattcccagagttcagcatcttttgctgcgctggattctcctgtattttcagaaaagtccagttctagagttccccttacgccttctttgtcacctgttgttgcattaacttcttggctgggaagtgcaaaccataatgaagcaaagtcttccttaactgccactccttcttttgattcttccatgtctgctgcagagtttgatacatcttcaaatctaaagtctagttctcaagggccatcttctacaaatgcttacttcgctgtaacctcaaagctgcttttggacgtagatgattctggatatggtggtggtccatgttctgctggagctactgccgtgttagatttcattgctgaagtcctttctgattttgtgacggagcaggttaaggcatcacagctcatagagaacatcttggaaagtgttcatctatatgttgatggtgagtctgtgttagttttccaaggtctatgcctcagtagatttataaacttccttgaaagacgactgctacgtgatgatgaagaagatgagaaaaaattggataagattcgctggtccacaaatttggatgctttgtgttggatgatagtggatcgggtatacatgggttcttttcctcagccttcaggg

SEQ ID NO: 49942 - DNA, 2419 bp, Glycine max
  Peptide Sequence Number=SeqID_166720
gagagccgcattggaagacttgcttgtttctagacctaatcaagggcagcaacttgatgtgctccatggtggttttgataaattattgactagaagtttatctgagttttttgaatggtatcaaaatattgaacaggttgtgaataaggtattggagcagtgtgctggcattatgtgggtgcagtatattgcaggatcggcaaagtttccaggagtaagaatcaaaggcatggaaggtcgtcggaagaaagaaatgggacggaaatctcgagaagctgcaaaattggatttaagacactgggagcaggtaaatgagcgaagatatgcactggatttagttcgtgatacaatgtccactgagttgagagttgttaggcaagataagtatggatggattctacatgcagagagtgagtggcaatgccatctacaacaacttgtgcatgaacgagggatattcccactaagtaaatcctctttctcagaagagccagaatggcagctttgtcccattgaaggtccgtatcgaatgcggaaaaaacttgaatgctgcaaacttaaaattgataccatacagaatattcttgatggacagtttgaattagagaaacccgagttgtctaaaggaaaatttgaaaatggtcctgattcatcagagtcaaaaccttattttcaacttttgactgatggtggcaagcagaatggttctgatggtgagccgtttgatgaacctttctttgataagttggatagcgtcaaagatgctgtttctgctaagaatgagtggaatgatgacaaggcaagtagcataaatgaagcaagcctccattctgcacttgagcttggtgccaagtctagtgcagtatctgtcccaatagaagaaagcacacaaggaagatctgatatgggatctccaaggcaatcttcaatgaaaattgatgatgttaagattgccgatgataaatctgataaagaactgcatgacaatggtgaatacttgatcagaccttttctggaaccatttgagaaaatacgatttaaatataactgtgaaagggttataagtcttgacaaacatgatggcatattcctgattggtgaattctctttgtatgtgattgaaaacttctatattgatgattctggttgcttttgtgagaaggaatgtgaagatgagctttcagttattgatcaggccttgggtgtcaagaaagatgtttctggcagtgtggattttcagtctaaatcaactttgtcatggagcacaccagctaaatcattggttgggggaagggcgtgggcctatagtggtggtgcatggggtaaggagaaagtacatagcagtggaaacttacctcatccttggcgcatgtggaagcttgatagtgttcatgagattttgaagcgtgattatcagcttcgtcctgttgctattgaaatatttagcatggatggatgtaatgatctattggttttccacaaaaaagagagagaagaagtttttaaaaatctagttgccataaatcttcctcggaatagcatgttggacacaactatttcaggatcatcaaaacaagaaagcaacgagggtagccgtcttttcaagataatggcaaaatccttttcaaaaagatggcagaatggagaaataagcaatttccagtacctcatgcatctaaacactttggcaggacgtggatatagtgatctcacccaatatccagtctttccatgggtccttgcagattatgagagtgaaaatcttgatttgtccaacccaaaaacatttcgcaggcttgataaaccaatgggttgccaaacacccgaaggtgaagatgagtttagaaaaagatatgagagctgggatgatccggaggtcccaaaatttcactatggatctcattattctagtgctggaattgtcctattctatcttctccgcctacccccattcagtacagagaatcagaaacttcagggtggccagtttgaccatgctgatcgccttttcaatagcattagggatacttggctaagtgctgctgggaagggaaatacatctgatgtgaaggaattgattccggaatttttctacatgcccgagttcttggagaatcgattcaatcttgacttgggagagaaacagtctggcgagaaggttggggatgttgtcctacctctatgggccaaaggtagtgctcgagagttcatcagtaagcatagggaagctcttgaatcaaattatgtctcagaaaatttgcatcattggatagacctcatttttggatataagcaaagagggaaggttttgctctacaatctaatgtcactttctttaattgtttacatgcatttatttatgtggaaaagtctgatctggttagttgtaggacatggccattatggactcccacgatga

SEQ ID NO: 49943 - DNA, 3972 bp, Glycine max
  Peptide Sequence Number=SeqID_166721
gctgctgaggaatcagttaatgtgttctatcattatacatatgaagggagtgtagacatagactcggttacagatccagcaatgaaagcatccattttagcacaaattaatcattttgggcagacacctaaacaactgttcctcaagccccatgtgaaaagacgaactgacaggaaacttcctccccatccccttaaacattccagtcatcttgcagcacatgagattcgcaaaagctcttcacctatcactcaaattgtcactcttaatgataaaattctcatagctggaactaacaatttgctgaaaccaagaacgtataccaaatatgttgcttggggttttcctgatcgtagcttgagatttattagctatgaacaagataaacttctttcaacacatgaaaatttacatggaggtaatcaaattcagtgtgctagtgttagccatgatggtcacattctggttacaggggctgatgatgggctagttaatgtatggagagttagcaagtttgggccccgcgccttacgacgcttgaagttggagaagccactttgtggtcacacagccaaaattacatgccttcaagttagccagccttacatgcttattgtgagtggatcagatgattgcacagttattatatgggatctcagctccatggcatttgtacggcagctcccagaatttccagcatcagtttcagcaatttatgttaatgacttgaccggagagattgttacagcagctggtattcttctggctgtttggagtataaatggggattgcctggcattgatcaaagcatcacaactgccatctgattccattctctcagtgacaagcagtacattttctgattggttggacacaaagtggtatgcaacaggtcatcagagtggagctgtcaaggtgtggcagatggttcactgctccaacccagatagctcccttagcaagtcaggttttggtgggtcaggagggttaaatcttgatggaatagaaccagaatacaagctggtcctacgcaaagtgctaaagtttcataagcatccagttactgcacttcacctcacgaccgacctgaaacagttattgagtggggattcaggcgggcatttgctttcctggacactgcctgaagagagtctgcgaggttcattaaatcaggggttgttggcttgcatgagatctttgtttaggtgcggcacagtgcaccttcacgcatgcaccatcaccatgtccacttcaatcctcactcctcttcctctcaagcccatctctgtcaacaccctcaataaaggaacactcaaacccgcttttcaatccttgaccctcctttctactcacccactcgcaaccccctcacgtctcgaacacgcgcattctctcctcctcgacctctgcgtcgccgccaaagccctcccacaaggccaacagttgcatgcccttttgctaaaatctcacctttcggcgtttctggccaccaagctcgtgctcatgtacggaaagtgtggctctttgcgcgatgcagtgaaggtgttcgatgaaatgagtgaaagaactattttcagctggaatgccctgatgggtgcgtttgtgtcaagtggcaaatacctcgaagctattgagctgtataaagatatgagagttcttggggtggcgatagatgcttgtacttttccctctgtgcttaaagcgtgtggtgctcttggtgaaagccgcttgggggctgaaatccatggtgtggcggttaagtgtggatatggtgagtttgtgtttgtgtgcaatgcacttattgctatgtatgggaagtgtggtgatcttggtggggctagggtgttgtttgatgggattatgatggagaaagaggacactgtgtcttggaattctattatttcggcacatgtagcggaagggaattgtttggaggcattgtcgctttttagaaggatgcaggaggttggtgttgctagtaatacgtatacttttgttgcagctcttcagggtgttgaggatccctcgtttgttaaactgggtatggggatacatggtgcagtattgaaatctaaccattttgctgatgtctatgttgccaatgctttgattgctatgtatgcaaaatgtggtcgaatggaggacgctggaagagtttttgaaagtatgctttgcagggattatgtgtcgtggaatacattgctttctggtttggttcaaaatgagctgtatagtgatgctctaaattacttccgggatatgcagaattctggtcaaaagcctgaccaggtgtcagtgttaaacttgattgcggcatctggccgatcgggaaatttattgaaagggaaggaagttcatgcctatgcaataagaaatggattggattctaatatgcagattgggaacacgttggtagatatgtatgccaagtgttgttgtgtgaaatatatgggccatgcttttgaatgtatgcatgaaaaagacttgatttcttggactactatcattgctggctatgctcagaatgaattccatctggaagcaataaatttgttccggaaggttcaggtgaaagggatggatgttgatcccatgatgattggaagcgttttgcgggcttgcagtgggttaaaatctagaaacttcatcagagaaatccatggttatgtttttaaaagagatttagctgatataatgctacaaaatgccattgtcaatgtatatggagaggttgggcacatagattacgcaaggcgtgcatttgaatcaattagatcgaaagatattgtgtcttggacaagtatgattacctgttgtgttcataatggacttccagttgaagctcttgaacttttctactctttaaaacaaactaatattcaacctgattctatagcgatcattagtgcactctctgccactgctaatttatcttcattgaagaaagggaaggagattcatggatttctgattaggaagggtttcttcttggagggaccaattgctagctctctggtggacatgtatgcttgctgtggaactgtggagaactcaagaaagatgtttcattctgtaaaacagagagatctaattttatggacttctatgattaatgctaacggaatgcatggatgtggaaataaggccattgcgttattcaagaaaatgactgatcaaaatgttattcctgatcacattacctttttggctttattatatgcatgcagccattcagggttgatggttgaaggtaagaggttttttgaaattatgaaatatggatatcaattggaaccctggccagagcactatgcctgtatggtcgatctcctcagccgttctaattccctggaagaggcttaccattttgtgagaaacatgcctatcaaaccttcttctgaaatctggtgtgctcttcttggggcatgccacattcattctaataaagaattgggagagcttgcagcaaaggagctcttacaatcggatacagagaattcaggaaagtatgcactgatatcaaacatctttgcagcagatggaagatggaatgatgttgaagaagtgaggttgagaatgaagggaaatgggttgaagaaaaacccaggatgcagttggattgaggttgacaacaagattcacaccttcatggcaagggacaagtctcatccacagactgatgacatttatctaaaattagctcaatttacaaaacttttggaaaaaaaagggggctatatagctcaaactaagtttgtattccacaatgttagcgaagaagagaaaacacagatgttatatggacatagtgaaaggttggcacttggttatggtctgcttgttacaccaaaaggttccatcattttgaaagaggactctgttcatgtggagatttctggtgaataccttgattatgtgaaaatagattatagcacacttctctggttccttcctgttactggcagtcactga

SEQ ID NO: 49944 - DNA, 2400 bp, Glycine max
  Peptide Sequence Number=SeqID_166722
atggaactctcagaagaatggaagccattcttcccaactggcgcatccaccgtatctcctattcttcaatcccattcccgtaattctctccctctcggtcccctcgtcttcaaccctaaccctaaccccaaccctaattccctctcccttctcttctcttccccctccctcttgccctctctccatctccctccccatctcttaccctcccgcttcctcctcacttcccaccctcattccattcccccctccaccgcttcctctgtcgcctccctcttctcttcccccaatcaaaacgacgccgcttccctcctcctctgcaaccgcctccacctcctgcattaccctaacagtccaaacgccatcgttttcttccccaccggcgccaacgacgacaaactcggcttcttcattctccgcgtcaaggattcgcgcctcgacattcagctcgaagccaacggcgacgttttttgtgtttacaccggctccgcgcatcgtatcttgaacatttcggtgaatcccgtcgccgaattcgatcgcttagatgattctaatgttatcgggtatttgttggcttccactctctattccgttcattggtttgcagtgaagcacaattccattttggatcgacctagcgtgttttatttgggtggtaaaacgtttaagacttgccctgtggctcatgcttgttggagtcctcatgtaatggaagagagtctcgttttgttggaaaatggacagttattcttgtttgatttggagtctcatgacaccacaggtactgctttcaagggaactaggttgaaagtaccttggaatggtttgggtttttcgggaaacaacatggtgtggttgagttgtgagtttagttggcaccccagggttttcgtcgttgcgcattccaacgctgttttcttggttgatttgaggctgaaggagtgtagtgtgagttgcttgatgaagattgaaatgctgcggatgtatgctccgggtgcaaatgagcgatttcttgcactgtcaagggctggtcctgacgacctttacttcgctgtggcttctaccagtttgttgcttctctgtgatgtgaggaagcctttggtgccggtgttacagtggatgcatggtattgaaggaccttgttttgtgtctgtattgagcttgtctgatttgaggtcccactcgagggatgatgcttttaagttggcttctgaatctgggttttgtattatgttgggatcattttggaattgtgagttcaatatcttctgctatgggtctatattgccgtttcgtaaaggatccattacttcgaaggttaacccaaacgtctgtgcttgggagcttccatttgaaatcaatttatctggtcatgagtgtcattgtgggagttgtctcttaaggaaagaattctcaaaggatgctcttcctgagtgggttgattggcagctaaagaaagagatagttttgggatttggggttttaagcaatgaccttgctgcgttactgtgtgaaccagatgaaaatgggggttttacacttataaggctaatgtcatcaggaagccaatcaaaatcatgtccagcagttacttctgtttttaatgatgtcaagctaccagcaagcttacatgaggttgctttgagaagattgtgggctgacttacctatggaactattacagttggcatttttgagttatgttgaatgtcataaagttgttggagacctgcaccaaaataaggtagctttggaattcttagctgttccagaccttcctcaattgcctccattctttttaaggaaatcatcaccccacagcaatgatgacattgtgggtccagttattccttttcctgttctacttgtgcttaatgaatttcgcaatgggtactcaaatttggaaggagatgaattttcagtagaagcagagcttggcctcaaatacaaagaagtcatgcaggtggctggtgagatcgctgattcagcttatggccctgcacaccttgatgatcatgtagtctcccttgccgaggatggagaggaaacctgggttggttcttcgaaaccaaaatcttttttgttataccatccagttgcattcaactcatctgccaccgaccttgcacaggaaaagtttgtttatagcaatacaatttatgatacattcatttctcatgttccagagaagaagtccaatgagaagactgagtctgttggacaagagatatttgatgatctttgccctgttgagttgaggtttgatgcttctgtgaagaagcttgaacctcaaggtttaaaggcatgcaatctattgaagagacagatgtctaaatggcaaaatagttttgattcgtataaggaattctgtattcaatctagatttgaaaaaagtagttaa

SEQ ID NO: 49945 - DNA, 450 bp, Glycine max
  Peptide Sequence Number=SeqID_166723
atggcaaatgcatggacagaagatcaaatagctatattccatgaagcgtttgacgttgttgacaaggactccgacggtttcatttcggtggacgaactcttatccattgtgcgatcattagaaggaaactcaacaaaagaagaaattcgagaaatgattagtgaagttgacattgatggaaatggccggagtgtaaattttgaaaacttcttgaaaattatgggaaggacaatgaaggaaaatcagactgaggagctaaaagactcgttcaaagtattcgacagggataatgatggatatatatcagcaactgagctgagacaagtaatggtgaaattgggagagaggctaacagacgaagaagttgaacaaatgattagagaagctgatttggatggagatggtcgagttagctatgaagaatttgtgaggtttatgacgttaaattga

SEQ ID NO: 49946 - DNA, 564 bp, Glycine max
  Peptide Sequence Number=SeqID_166724
atgccgatagatatgtatccgcaggaaggaggtgattatgatgagcttttgtttctcagtattgagtactggccggatccacagcgtggcatcaaggaggcatacagggttttgaaacttggaggcaaagcgtgtctaattggtccggtctacccaacattttggttgtcacgtttctttgcagatgtttggatgcttttccccaaggaggaagagtatattgagtggtttcagaaggcagggtttaaggacgtccaactaaaaaggattggcccaaaatggtatcgtggggttcgccgtcatggcttgattatgggttgttcagtgaccggtgttaaacctgcatctggagattctcctttgcaggctgttgtgcacttgtgcttgaagatgactggtcatatactgcttggtccaaaggaagaagatgttgaaaagcccgttaatccttttgtctttgcactgcgcttcgttttgggtgccttggcagcgacatggtttgtgttggttcctatttacatgtggctgaaagatcaagttgttcccaaaggtcagccaatctaa

SEQ ID NO: 49947 - DNA, 477 bp, Glycine max
  Peptide Sequence Number=SeqID_166725
gctcatcctgaagaattaggcatgttggttgaagttttgaaaagtggaatggttaccagtgcttcaggatcccaatatcgactttcccttgatgcaaaatgtgattatgggaatattggtggatcctgggagttaataattctgctcagaaggttttatgtgaagccaccagtttttctcttttgcttacaacacttcatgggttccaaagtgatggtggggacttggaccaatcttcattcaatgtttacattaaggggagacatgaaagcagtcaaaattctcttccattggttcacagttttagcaacacctgctatctgtcatggagagacactgaacataagatctgtgaaaccaaatacagttttacagccaggaatctttaagaacttcaatgtcctaaaccaactaagattgaatttgagaaagtctccctacaacagtcacatcacaatcctttcagggagtacttga

SEQ ID NO: 49948 - DNA, 162 bp, Glycine max
  Peptide Sequence Number=SeqID_166726
atggcccataaaaagaccgttgcatcatcttcgtcagcatctacattgttgaaagggggagtcattgaccataatcacgagtctttgtacgagcatggactatggagtgtgcatgaagcatgtagccatgttttgaatcctccaatgaagtgcccccaataa

SEQ ID NO: 49949 - DNA, 135 bp, Glycine max
  Peptide Sequence Number=SeqID_166727
atggctattacccacatctttactttgaatttcattttgcctgtagacttagtccatggaccggtgaacctcttatgggatagatggtttgaagggcctcaagatccacaagcatgtagatgttggatactttga

SEQ ID NO: 49950 - DNA, 234 bp, Glycine max
  Peptide Sequence Number=SeqID_166728
atggaccacaattttgatgacatgagttgtgagatgatatttggcgaggatcccccagaatcaactgatgatccagcactgaatcaaccgtgttttaaactatggtttgaggtcagcaaggaagaaacaataatggcccacctttcatatgctgacaaagctgagactcatcacgcatcatttttttatctcattattattaggaaaacagctaagtggtccaatgcactttaa

SEQ ID NO: 49951 - DNA, 2217 bp, Glycine max
  Peptide Sequence Number=SeqID_166729
atgacgacgggtatcgtacgcgaccagaatctggagaaacatattcacaagcagatggggtgcatggctggtttccttcagatcttcgaccgccaccagatgctcaccggaaaacgcatctactcccccaaacgcctccctccggcctcgcctgagccggagaatcccgcagtctcaccggcgcgttcaacgccgtcgccggcgagagaggtcacgagttcggagccccaggcgaatgttcccacgcttcccgttctcgaattcaaggaaggcacgcggtcctcgtggaagttctcgagagaagctccgaggttgtcgctcgacagcagagccatcgtggacgcgaagggaactctccaccttcacccgcgcgagatccctcccgaaaacgacgccgacaaacagcgtcgttccaccagcgtcattgccaagctcatgggcctcgagcccctaccagattcggagcccggacctgggcccgggcccgtggcgaagctccagagatccgcgtccgagtccagagtccccagagatccgcctctgcccctaacaacgcagtgtcgtttcttcgaccccaacaatttcttttctgctcagttcacaaccaatgtggtctacgagaataacaacaacaacaacgctgccatcgaatcacgattcgttaatagcagagtcgccgcagatccaccgaaacagaggttaaagaagagtttctacgactccgcggatttcttccccgagccgaaacacaccgtttcggtgtacggagagattgagcggaggctgcggatgcgtgggattaacgagccttccaaggatctccacactctgaaacacatcttagaagcattgcagctcaaggggcttttgcattccaacaacaagcccaaccaatctcccattgtggttatgaaaccggttcgatctgtgaaccggaccgggaatgattattctccccggtccagtcctcgccggagccccagagttacaaacgaggctcggaggagtgaacaaaatgagcggaatgtaagggggcaaggcagaacactgagttcgagtccgaaccggaggaaacaagaaccgcagaggagagtgggtgttgattcgagaagggtgtctccggttaattcgcccaaggtgagtccaaggaggaatgcaaatgcaacgtgtcagcacgtgccaagtggatcaccaagaatgatgagaaaaaatattgagcgtaaggagaaggtgctgttgggtggggcagaggatgaatcgtccaccgtttcagacaacagcttcagcacttgttcatatcccgatacagagaggtacaggtcggaagagtacatggaagggaaagatctgctggataggtgcgataagcttctcaacagcatcgcagaaataacagcggccaacgagttgcaaccaagtccagtatcggttcttgactcatccttttacaaggatgagtgggcttcaccatccccgataaccaaacgctgcattgattacaaagtggatagtttgtcttctccctctccgaaaatcccaccaatgtggaccaatcatttgatcccagggatgttgacatggcatgacttagttgggctcattcacttacctcaaaactgcactgcactgcactgcgatcatgcggcggaatcagaagatgatatgtggagtgcagcattgtgcagcagcgaggaggcagcgtcggaggattgtgatttcgcttacgtgtgggagattctgcgagcttgcacttacttgccggaagagagcgacatttttctgttactggagaagcagcaatgtctgaaggggaaagacacctcgaaggcttcgacgctgcagaggaggttgattttcgacacactccaggagatcttgaaccggaaccagcaattgccgccgtggaaggcggtatcgtgcggcgagcagaggcagcagatctggtcggagtttcggaggatccgagagagggaggaagcggagtcggaggacttgtttaaggtgatatgcggagtgttgaagaaggacatggcggatgagatgcgtgggtggggagaatggccggtggagatgggagatgtcgtgttggacatcgaacgtctcgtgtttaaggatcttgttggcgaaaccattcgagaactcgcttcgttttcccctcaatctcaatgtaacaacaagctacaactacccgcgcttcgtaggaaactcgtcttttga

SEQ ID NO: 49952 - DNA, 354 bp, Glycine max
  Peptide Sequence Number=SeqID_166730
atggtgttcatggaccaaacggtgtgtttgctgagatttcatactgtaatggactacactcatttttcctgctttcttgcattgatcactttcattgttaactcttacaaggtgcaaagattggtaccactctttggcaataactgtttgctgaatttgagtcatagttgcgttgtggttctgcatatgtcattcagaacattaaggttgttgagaatcattctgaatacaaatgatggtgagatgatcatgactgtctgggaggaatatgctcttcagcttgatgatgctatagagaagcatcatattgatagaaagccattggtggttatgttaacacttgctaagatctaa

SEQ ID NO: 49953 - DNA, 1260 bp, Glycine max
  Peptide Sequence Number=SeqID_166731
atggagatggaggaagcagagacgatagatctatacgagcttcaatattcagacttatcttcaccttcaacttcatccatagtcgattccattatggaagccctaggacccactggcccaggcctcctcgccgtcaccaacgtccccaacgcttccaacctccgctcacaccttctccccctcgctcggaacctcgcccttctcgaccgcgaatcccggaaactcgttctcaaggagcataacttgggtagtgacgtccctttaagaaatcctgataggacggtgtcctcctttgctatgcaactcaaatatgccaaatcacaacatgttcaacaaacggtgagtgagtgctatggaatggaattcgagaatcttggaagctctttcaaagagctagggttatgcatgatggagcttgggctttgccttgctcgaatatgtgacaaggctattggtggcaatgagttagagcagagtctattggattcatgtgcggctaaagggagactcattcattatcattcacatttagatgctctcctcctaaaacaacttgagaggagtaaggcaactagcaagagacgtgctggtaatatcaaaccgttggaagggttagagtcgaattcaattgcccatgacgcgaattcgggtggaattcattcgaatttgtggcagcagtggcattatgattatggcatattcactgttcttacaactccattgtttattctgccgtcttatttggagacaagcaaaacagaagatccgtttcctgcatcttgttttgatgagtgtccatcaccaactaggcatacatgcttgcagatatatgatcccaataagaaaagggccattatggtgaatgcccctccagaaagttttatcattcaagttggggaagctgccgatataatctcaaaggggaagcttcgctcggccctgcactgtgttcatagaccttccaagtttgaaaatttgagcagagaaacttttgttgtgtttctgcagcctgcatggactaaaacattctctatctcggattatccgcatgcaaactccagcttcaatggtcagtgtttagtggctactgatgaggagcagcagcaatctgggcaggatagtgataatctaagtcaagaaattaacaaaatagttccccctctttcgtcacggttgaaggaagggatgacttttgccgagttctcacgtgaaacaacaaagcagtactatggtggtagtggtttgcagtccaatagatga

SEQ ID NO: 49954 - DNA, 1695 bp, Glycine max
  Peptide Sequence Number=SeqID_166732
atggagcagtacgaaattctagaacagattggaagaggttcctttgcctctgctctacttgtcaggcacaaacacgaaaacaaaaagtatgttcttaagaagatccgtcttgcccgccagactgacagaactcgtagatctgctcaccaggagatggagcttatctctaaagttcgaaatccatttattgtagagtataaagattcctgggtggaaaagggttgctttgtatgtatcgtcattggctattgtgaaggaggagatatgacggaagcaattaaaaaggccaatggcgttcattttcctgaagagaggctctgtaagttgctggttcaactgctgatggcacttgattacttgcatgcaaatcatattcttcatcgtgatgtcaagtatcctatacttatgctgtgtatgttggatgtaggtgactttggtcttgctaaaatgttgacatgcgatgatcttgcgtcttcagtagtggggactccaagttatatgtgcccagagcttcttgctgatataccctatggctctaagtcagatatctggtctttgggatgctgtgtgtatgaaatggctgctcacaagccagcttttaaagctcttgctgcggagttactaaatcatccgcatcttcaaccttacattcttaaaattcacttgaaattaaataaccccagaagaagtacttatccattcccgtggtctgactcaaactatgtaaggaggactcagtttgtcgagccaggatctgtttctactctgtctgacagaggcaaacgattctcattcagcaatgacagggccttgaatcctagtatttctggaactgagctaggttctgtgtgttctactcaaagagcactaggattctctacttgttcaaaagagaagcactatgaactatctgttggccgtgtccacaaagaatgcaattctaacaaatcaagagacacaaagtcctcaactgttgataggatgccaagattgagaacagctaaggaatatgccactccccgatggcagactataccatcaaagatatcccatactggttccaagcgtgagttacttccatccactccaggttgtaaattcaccctaccaactagaagagcttcccttccactgcctaccagaaccacgggcatgatcacctcttatagagctaatgttggtcttcttcgaggtgtggactctcctgatatttctgtcaatgcaccgcgaattgacaagattgctgaattccctctggcttcttgtgaggattctctctttcctgtttgtggaacttcatcaacctcagctcagtgctcttctggttcgccaaagagtgctgactgcttaatcacacaggacaagtgtacaatccaagttgtggacaaggccagtgtcccttccagtggcagtgatgcttgtcctgctgctccagtttcacatggcaatgaatgctctgaacatgctatttcaagccactcctctgctgagtctcgtaagcacagatttgacacctcatcttaccaacaacgcgcaaaggcattggagggtttgcttgagttttctgcacgactcctacagcaacagaggtttgaagaacttggggtgttgttgaagccattcggtcctgagaaggtttcccctagagaaactgctatttggttggccaagagcttcaaggaaactgtggcctaa

SEQ ID NO: 49955 - DNA, 930 bp, Glycine max
  Peptide Sequence Number=SeqID_166733
atgagtggtgctacagggaatgccactccttgctccggacctaaaacagttggaagatggttgaaagacagaagagaaaaaaagaaagaagaaaacagaacccacaatgctcaactgcatgcttcaatttctgttgccgcggtggcagctgcagttgcagccgtcaccgcggcaacagcagcctcatctgcagctgacaaggatgacaagatggccatggctgtggcttctgcggccacgttagttgctgctcagtgtgtggaggctgctgaagcaatgggagctgagagagatcaccttgcttctgtggttagctctgctgtcaatgtccgttctcatgatgatatcacaacacttacagctgcagctgccacagctctacgaggggcagcgaccttgaaagcaagagcattgaaagaggtgtggaatattactgcagtgacgccaattgagagtggcatagggattggaatatgtggtaaaggcaataacagtaattctagtaccagtgatagtggggagattatcaatggtgaaatttttttgggtgcctgcagccaagagctccttgctaggggcactgcattactcaaacggacacgtaaaggcgatcttcactggaaaatagtttcagtttatctacatcgaacaggccaggtgatgctgaaaatgaagagcagacatgtagcaggaaccattaccaaaaagaaaaagaatgttgtgttagatgtgtgcataaatttaccagcgtggccaggaagacatctgtttgatgacagtgaagaaagaaggtattttggattgaagacagaagcaagggggattgtggagttcgaatgtagaaatcaaagagaatatgatacctggactcaaggggtttctagacttctttccatggttgcaagcagacaaaacataaatggggtttga

SEQ ID NO: 49956 - DNA, 282 bp, Glycine max
  Peptide Sequence Number=SeqID_166734
atgttctttttgtgtactgtagtttatcatgatacggaaaatcaagcaaccgatgcttatcgggtcctcagggtcatggttcataggattttggcacctgttagtagtcagtttctgtatttttggcacaatcagttattttggcctcatcttgtcaggcttgatacacgaatgtcaatgtatatacacaataacacagtaattttttgtgccctttcactccaacatctgcttctgttcactaggacaagttcagtaacagaagacacagaatcagagtaa

SEQ ID NO: 49957 - DNA, 270 bp, Glycine max
  Peptide Sequence Number=SeqID_166735
atggaattgtgcattttaatccctggaatttccaggtccagcagttcctcaaaaaagtatcaaaaggttggagtttcacctgcatcttggaaatgctccgaagaattcttctctcgtcaaattaggaatcgagatcccctaaaaataggtttttcaaacatctgggcgttacggttagtgcgccatctgttacattgggatccagaggatcggccaagtattgatgaggctctgcaacatccttatttccaacatcccccaagagaatga

SEQ ID NO: 49958 - DNA, 2661 bp, Glycine max
  Peptide Sequence Number=SeqID_166736
atgaggactttcttcactgcagaatcatgtaaagaaacacagcctaatgctttaaatccacagtcctggctccaggttgaaagagggaagcttcccaaattgtcatcacagtcctcttctgcatcaatagaatctctaatcaaggtcccacagtcacctatactcccgttcttcaaacctgttgattatgtggaagttttagctcaaatccatgaagaacttgagtcatgtcctcctcaggaaaagtcaaatctgtttttgttacaataccaggtctttaagggcctgggggatgtcaaactaatgcgtagaagcctccggtcagcttggcagagagcaaacactgttcatgagaaaattatatttggggcatggctgaagtatgagaagcaagaagaattagttgctcagttgctcacagcttgtggtaaatgtgaaaaggaatttggacccatagatgtagaatctcagattccttttgatgagaatgtaagatcccaggatagagcttcgatgaatgggaacaatgcttcagaatatgttatctttaaaattggagatgagaagatagtctgtgatagacaaaagatttctgaactttcagcaccatttcatgcaatgctaaaggggtgtttcagggaatcactttctgagactatagatttgtctgaaaacaatctctctccttcaggtatgagggcaataagttattttagctcgacagggagtttacttgatgtccctccgaatcttttggtggaaatattagcttttgcaaataagtattgttgcgaaagactaaaacaggcttgtgatagaagacttgcatccttagtttcctccagagaagatgctctggaactcatggaatatgctgttgatcagaattcagctggccttgcggcttcttgtttacaagttcttttacgtgatattcccaactgcttgagcgacaatcaggttgtggaattatttattcatgctaataagcagcagttggcagtcatggttgggcctggtatatttgcacttttctgtttcttaagtgaagtttctatgaacctaaattctagttcagacacaacagctcatttcctggaacggttagttgattttgctgaaaatgacaagcagagactgctggcatttcatcaattgggatgtgtaagactctcaaggaaagaatatgatgaagcctattgtctttttgagagggctttaaatgtaggtcatgtttattctgttgcgggtttagctagactggactctataaagggtgagaaacttttatcttatgagaagatcagttcagtcatttcttcagatactccacttggatggatgtaccaggaaagatcactatactgtgatggtgatttgaggcagaaagaccttgagaaagcaactgaactggatcctactcttatatatccctatatgtataggactgcctctttaatgaagacagggaatgttcaaggtgcactggctgaaatcaaccggattcttggctttaaactttcgttagagtgcttggaattacggttttttatctatctggcccttgaggactacaaagcagcagtccgagatgttcaagcaattcttaccctgtgtccatcttataaaatgtttgaagggcgtgtagctgcatctcagctctgtactcttgtgcgtgagcatgttgaacattggacaacagcagattgttgggcccgattatatgactgttggtctgctgttgatgatattgagtctctttctgtcatctaccagatgcttgaatctgatgcagcaaaaggtgttctatacttcagacagtcattgcttctcctcaggttaaactgtcctgaggctgccatgcggagtttacagttagcttggcaacatgcatcaagtgagcatgaaagacttgtatatgaggggtggatcttgtatgatacgggtcattgtgaggaagggctccaaaaagctgaagagtctattagtattaaaaggtcttttgaggcctacttcctgaaggcctatgcattggctgactctagtgtagattcatcatgttcttcaactgttatttctcttctggaagatgccttgaggtgtccttctgataatctgcgcaaaggtcaggccctaaacaatcttggaagtgtttatgttgattgtgggaaattggacttagcagaagattgctatataaaggctcttaaaatccagcacacccgagcgcatcagggtcttgctcgtgttcattttctcaaaaatgataaggctgctgcttacaaagaaatgaccaatcttattgagaaggcgagaaacaatgcatcagcatatgagaagaggtctgagtatggtgatcgtgatctcacgaaggcagatttggagatggtgactagattggatccacttcgggtgtatccttatagatatcgcgcagcagttttgatggacaatcataaggaagaggaagccattgcggaactctctagagcaattgcatttaaagctgatttgcacctcctgcatctacgtgcagcattccatgaacacaatggagatgtcttaggtgcgctaagagactgtcgtgctgcgctctcagtggatccaaaccaccaaaaaatgttggaacttcattgtcgtgttaatagtcacgagccatga

SEQ ID NO: 49959 - DNA, 2388 bp, Glycine max
  Peptide Sequence Number=SeqID_166737
atgattccgaaaactccgtcacggcacctgttactcgcgctagggtttctgctttgcgccacaatccccttcgttcacggcgagtcgtctacgtgcctgactgtctacaagaacggcggtgctccggcggtgttccaatccccaaaatgcccccgctggaagctctccgattacgattcccctccccaaaccaccgcgcgttgccaaaccgccatgctccaaggccgcagaaactcgcaagaggatcgcgctctctgcgtcctcgatgttcgcattcccttccccggtccgaacgggatcaaggaggttgcggtcgggattgtggcagttttcgatggtcataacggtgcggaagctagtgagatggcgtcgaagcttttggtggagtatttcgttctgcacacttattttcttctcgatgccgccttttctgttatttcaaagacgtcgacagagactttgcttcacaagagagatcgtgatcatgtaaacctactgcatagatggaaggagattctagggttggaatggcatgaactgcattttgaaaggtttcagaatacattttctccaaattttgatgattcttttcacttggaaattttgaaggaagcattgttgagagcagtccatgacatcgatgcaaagttttctgaggaagcctctagaaataatcttcactcaggatctacagcaaccgttgttttggtagcagatgataaaattttggttgccaatattggagactctaaggccatcttgtgctctgaaaattttcagtctcccagagaggctaaaggtgagaaagattatgaattgcagaaagagcatgatggttctgtttccgtgtgggatcgtgaaaagtacagattggtttcctcccatggtctcactcattttgcagtaaaggaattgaccagtgatcatcatccagacagagatgatgaaagaattcgggtggaaacagctggtggtcaagttcaaaattggggtggtgtgcctcgcataaatggtcagctggctattacacgggctattggtgatgtactctttaaaagttatggtgttatatctgcaccagaagtgactgattggcagcctctgactgctaatgatagctttttggtggtagcatcagatggtgtatttgagaagatgagcgtgcaggatgtctgtgatttgttgtgggaagtacaccgtttcagtaacatgagatctgagtgtacccctgcatcttcctattctttggcagatttaattgttaatactgccttcaaaaagggcagtatggacaatgtggcagcagttgtcattcctcttgagtctgccaaatcttctgcaaactcgcttaggggaagctatagtggaaagagggatgcagattttccattgtttggtcagcaggaaactgcttccaaaagctcagtaaaagatggtgattttggatgtttttatttatctgaaaatctcgatgaaccagaggactctaagcagattgccaaaaaaactgactgggaagactatttgtatgaactacctcagcctctaccagatgcccttcatcaacatgccactcctggtggtcctgtaaatttatacaatagccaaaacttttgctttcaccttggtccaactattagtgaagccgaagaccaatgcataaatcctgaaggctttgccagtttcattggtcttcttgaatcaattcctttacatgatactggttccagtaatgggtctgctgattattcaatgcccgatttaaggtatgtattgaagaagagttttggacgtggatcatatggtgaagtatggttggcttttcattggaattgtaatcaagatagtaattctgcaaaaatgagcaaggatgacaaaaatacaaccagcagctcaactgcttctgattgtcaggatggttctactaactacaccctaactgcttttaatggtttcagtggattaccattatgcatatgtaagcatgtagcagaaataactcttaaatgcactacacaggtggagagggggtctgctgtttacttaagtgggctgagggagaagtattttggagaaattttcttaaatgcctctacatgctttgaagatcctctatcagctggcaaatcaaactgtgtcttagaaacatcacagtttggtcctgagaaatcatttccaaacaaatttcggctacaacgaaccacatatgaagaaggtttgtcattgtcaaaacttttatatgccgtggaagatgcgtatggtactgctgagaaagaaagacttgagcaagctaaacatgttcagatactacgtccatcaaagtggtggcattggttaaaaacagcagaagaagggcaagcagaaatgcgcaaccttatctggcagctg

SEQ ID NO: 49960 - DNA, 378 bp, Glycine max
  Peptide Sequence Number=SeqID_166738
atgaatcaattgtttaaacttatcttgttctactttgaagtaaccacactgatagaggtagcaggtgagagtcgcgatgatgacaataatgaaaataatggtggagtcaatggaatggtgatggtgacaatgacgacagtggtgggagtggaagaatgtcaacaacaatgtgctttaaaacctggattgaccctgattggttggatcaatttaactatgaccgagaggtttggccagtacgacccaatcgaatttgtagttaaaccagcaactgacccagggcaagtcatgcctaagggaggaaacacgctaggtcatgcggttcaattaagtgacaactgtgatgacaatgacgatggagggacagaacgatggtga

SEQ ID NO: 49961 - DNA, 2442 bp, Glycine max
  Peptide Sequence Number=SeqID_166739
atgaatttgatgaattctgtgaactggaaggtattgtgcatgatgttgacacgtccctacactccccaacataacggtgcaacagaaagaagaaatcgaacaatgatgaatatggtcagatgcatgcttaatggaaagaagctaccaaaatttctttgggcagaggctgtctccactgcagtgtatgtgctaaaccgaagcccaacaaaaaggctcaataaaatcacacctgaagaagcatggtctggacgcaaaccagtggttagtcattttaaaattgttggctctatttgttataaacatgtgcctgatcagctgagaaagaagttagatagcaaaagtgagataatgatactgctgggttatcatgccactagtggttacaaattgtttaatccagtaaccaaagaagtgctcgtgagtagagatgtggtagttgatgaatccaaggactggaattgggataaagagatggtagaggagcctacaaaagttgtgattgaagcttctattgatgagccaagtgattcttctgctgtagtaattgatgacagtgaccaaggaggagtaaggaaatcacagagagttagacaaccctctagcaggttacaggattatgaattgatacatgattcaacaataggggaggaaggtgagctagtacacttagctctatttgctgaatctgaatcagtgagcttggaggaagcaatgaatgacacaaagtggactgatgctatgaaagaaaagctgaaagctattgaaaagaataatacatggcaacttgtggctctgcctgctaagaaaaaacctattgcagtaaagtgggtttataaggtaaaaaagaattcgaaaggagagatttccaagtataaggccaggctagtggcaaagggattcttgcaaaaggctgacattgattttaaggaggtgtttgcacctgttgcaagaatggagacagtgagaattattactgctataacaagtcaaaaagggtggcatatgcaccatatggatgtgaaatcagccttcttgaatggtcctctagaggaggaggtttatgtgagtcaaccacctgggtttgaaataaaaggaagtgaagagaaggtgtacagattgaacaaggctttgtatggcttaaagcaggcgcctagagcttggaacatgcgcattgatggctttctagtgaagcttggattcctcaaatgtacaactgagcatggtgtttatataaagggcagcaatactactaacttgactgtagtgtgcctgtatgtagatgacttgcttgtgacaggaaataatgagattgaaattgccaactttaaaggagagatgatgagagaattcgaaatgactgatttggaccttatttcttattttcttggaattgaattcaagagaactgatgagggagtgatcatgcatcaagggaggtatgcaagagatgtactgaagaagttcagaatggttgactgcaattctgcagacacacccactgccactggtgtgaacttggtgaaagatcctaatgaagaagaagtagatgtaactttgtatagacaaatggtgggctcattgaggtatctttgctgtactagacctgacttattgtatgatgttggcttaattagtagatatatggagaatcctaaactttctcacttccgtgctgccaagagaataatgaggtatgtgaaaggtactctcgattatggtattatgtttcccagtgctgccaaaaaatgtaatgttctgggatatagtgattctgattggtgtggagataagagtgatgggaagagcacaacatgttatgtgttcttctatggtgatgccccaatctcgtggagttcaaagaaggaacaagtggtggctctctcctcatgtgaggcagaatacattgcagctgctatggcagcatgtcaagctcaatggcttgataatatttttggtgaactgaagatgaaggaaaagggtgctattacactgatggtggacaataaatctgccatcaatctagctaaacacccagttgctcatgggaggagcaaacacattgaaacacgatttcatttccttagagagcaagtgacaaaaggcaagctaagtgttaagtattgtccaactactgtgcaagtagcagacatattcactaaaccattgaagattgatcagttcaaagagttaaggagcagattgggagtgattgaagtcacgttctttcaagcagccaccaaacagaagtgcaacaagcgccgagaaggatgtgtgtcgggttcgcattctgagtcttggatggtgaggatggcgtcgcattttggtagtgtggcaaacctccgcgttctcgcaagtggccaccagatgaagcacatccggcaacaaaaatggtgtgtgtcacgacaacaaggagagaggagtgaggcatggtttggtgggtag

SEQ ID NO: 49962 - DNA, 1689 bp, Glycine max
  Peptide Sequence Number=SeqID_166740
atggaaccattaccatggctactagctcatgccaaggttgaatctgtgaaatcaaaggtagcagctgaagaaaggaagatcaagaaaaagagctggttttcatttaaatggcgtgatagtgacatggaagaatcctccttggatgatgcttctgaagagcaacagcttagagaagaatggcaggctattaataagttactaagttaccagcctgaggaggagttgatgttacgatctgcaaaagatatgcagaatatggtccagtttctggtaactgtatctgttggtcaggcagctgccaggataatgagtgtgaatcaggaggaaattgtctgtggtcgatttgagcaacttcacgtgtcaaccaagttcaagcatcacagtgtttactgtgatgtgttactaaaattttatggtttatctgctccagaaggttcacttacacagagtgtctatagtgagcagaaggtgaatgcattagtggctagttttgtgcacttaccaattggggagaatattgactggagattgtcagctacaattgctccctgccatgttacggttttgatggaaagtattgatcgtgtcttggagtttttaaaacgaagtaaggctgtcagtcctactgttgcattggagacagctacagccttgcagggatatgccgagggaccagagtctatagagtctggagtgatgagtatattttgttttattgatttatatttttgctttgctgtttgtttgggagttattttttctttctcccatatgaagtttgagaaagtgactcgtagagcacaggagcaatttcaaatggttttagaaaaacaaagcagatttgcatttgatattgatcttgatgctcctaaagttagagttccactcagaaccagtggttcagacttatgtgatagtcattttcttctggattttggtcattttactctgcacactgcagaaagccagtctgatgagaagaggaatctttattctcggttttacatatctggacgagatattgctgccttttttacagactgtggctctgattttgggagttgtagtatggtgaaatcaagtgttgacagtcaagtaatgaattcacctattgccaaaaaagatgaaaatgcctattatctcattgataggtgtggaatggcagtacttgttaatcagattaaagtgcctcatccaagttatccatccactcttatttccattcaagtgccaaaccttggcattcacttttcatcagagagatattttagaatcatggaacttctgagcttattgtacgagactatggaaaattgtagtcagcctacaactgataatttccaatctaaagttgttccttggagtcctgttgatcttgccactgatggtagaattctaatttggaagggaattggcaattctgttgctacatggaatccttgtttcctggtgctctcaggatcatatctttatgtgtttgaatctgcaaagtctcagaattaccagcgatacctaagggcatctgtgttatgtatttttggactcatgttcctggagactttatctcctacttatcttgtagtaccactggaatttaatggacttaggagtgagttggtaactgaaacatggatttacaacaacacatgggaaaaatcagagtccaatctctcttgtatggattggtag

SEQ ID NO: 49963 - DNA, 267 bp, Glycine max
  Peptide Sequence Number=SeqID_166741
atgattgcaagatattttctagcaattcctatctcaactattccttctgagtcttcatttagtacatttggtcgtattcttgctccatatcatagcagattacatatagatactttggaggcattgatgtgtctccaaggttggctttggactgacatgaaaagctcaactaaattgaaagtggacaaaatgctactccaagaagtgtcagaggaaatagaagttgatgatgaacaagtgaccaaagtgaggttgtttgaagagtaa

SEQ ID NO: 49964 - DNA, 126 bp, Glycine max
  Peptide Sequence Number=SeqID_166742
atgaagttgtattgttgtgtcagtatggtgcagattgcggtgacacatggagaggttatggatgtcatggagtggatggtaaatgtacaagaccacatggtggttgttcctcctccagtggaataa

SEQ ID NO: 49965 - DNA, 420 bp, Glycine max
  Peptide Sequence Number=SeqID_166743
atgattgtgaggaaaaacaagccaagtgcaaagtcactgcttgtactttttattatggttcttgcttttttctttgtcacttataatttggtatttatgatcaaacaccataagggtggaagttgggtagcagatgagttggggtttcttgatcctctgatccggaatattcctggaaaggtgatggtattagcaaattccaattcaaaattccatgttgcagtgactgcaaccgatgcggcttacagccaatggcaatgccggattatgtactactggtataagaaggtaaaggacatgccaggatcagacatgggaaagttcaccagaatagtgcattcaggaaggccagatcagttgatggatgaaattcctacttttgttgttgatccacttcctgcaggcttggatagggcttga

SEQ ID NO: 49966 - DNA, 585 bp, Glycine max
  Peptide Sequence Number=SeqID_166744
atgaaggctgaatggggaattgatcaatttattcctctgagagacttcaaccttgcctctaaaggttatctggtggacgacacgtgtgcttttggagcagaagtctttgtttgcaaagaaagaagcacaggcaaaggagaatgtttggtaatgatgaaggaagccattctatacaagcacctctacgagtttgacaacctctctaagttggatttagagtgttatgattctaaaccattcaatgctggaaactttaagtggaagataaaactatatcccaaaggaaaaggtgctgaattgggcaattatctttctctgtatctagccttagctgacccatcagccctttctccttgttccaaaatatatgcgcagataacattacgcatacttgaccaaaagcaagccaaacatcactttggaaaagctaactactggtttagtgcctcaagccatgaaaatggtgcagccatatttatgcctatcaataatttcaccaatcaaaactttggttatgtggtgaaggacagttgcttcgtagaggcagaggttataattcttggagtggttgatgcattgtcctaa

SEQ ID NO: 49967 - DNA, 648 bp, Glycine max
  misc_feature (517)..(517): n is a, c, g, or t
  Peptide Sequence Number=SeqID_166745
atggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccaccaaggccaacgttgactacgagaagatcgtgcgtgacacctgcaggaacatcggcttcgtctcaaacgatgtgggacttgatgctgacaactgcaaggtccttgtaaacattgagcagcagagccctgatattgcccagggtgtgcacggccaccttaccaaaagacccgaggaaatcggtgctggagaccagggtcacatgtttggctatgccacggacgagaccccagaattgatgccattgagtcatgttcttgcaactaaactcggtgctcgtctcaccgaggttcgcaagaacggaacctgcccatggttgaggcctgatgggaagacccaangtcctcacggtgatgctggtctcaccggccgcaagatcatcatcgatacttacggaggatggggtgctcatggtggtggtgccttctccgggaaggatcccaccaatgttgataggagtggtgcttacatt

SEQ ID NO: 49968 - DNA, 252 bp, Glycine max
  Peptide Sequence Number=SeqID_166746
atgtctcatagagtttctaagcttaaaggactcaagcttgaactatctgaagacctcactgtgcatttggttttgatctctcttctcgtgcaatatagtaaattcaaggaaaggagaaaaagagaaagagatttgaggctgcaagtggttcaaatcaaaagaaacatgtcattgacaaggataagtgtttcttttataagaaatctggacatcaaaagaaggattgtcccagatatcacacctaaggtttaa

SEQ ID NO: 49969 - DNA, 213 bp, Glycine max
  Peptide Sequence Number=SeqID_166747
atgaagaataaaaagatgaaggaaggtgccaaaactacaatatttcagaccatgcaatgcataacagataacttcatacttgatcaaaagcaggctgtggtttccctctacagaaatttgatagtgtccaggaagcaaagctccatgaccgagaacaagatcatggcatcactgggtgaacagttggggatttctaaggaacagttgatgtaa

SEQ ID NO: 49970 - DNA, 396 bp, Glycine max
  Peptide Sequence Number=SeqID_166748
atggatgatagagatagggtggacgaaagtggccatttggtccagtactcttgtctaatgtataggttgtccaatcctctatattctagcggagcgtccagtcacaagatgatcaatacaatcaagattgagaaattcacttggaataatagcttcaaccttaggcgtattaagatgaaagccttgttgaaagaacaaggcatttgggctcctccctccagtcaatctttcaagattgataagtcagtgcttgagttacaagagaaaaagacacattcactaattctcttatctctgtttgatgaggttctttatgaagaactaactactattaggctttggctcaaattggagaaactcttcatgacgaaatcaatttgcaaaatttgcttatga

SEQ ID NO: 49971 - DNA, 216 bp, Glycine max
  Peptide Sequence Number=SeqID_166749
atggataccattttttactttgatgatatcatgttggaagagatggagaagcaaagggaggataaggctgtcaaggatgttgacaccgatcctctacaaatggtgatcccttcatctccccaaaagaggaagaaaactaagaagcttaagtctaagaaaaggatcctcaatgctactatgaccataggttcctctcatgggaataggctccattaa

SEQ ID NO: 49972 - DNA, 495 bp, Glycine max
  Peptide Sequence Number=SeqID_166750
atggtggtgacatcctctctctcttgtttgtgcttttttggccttgacctccttgtcgaggcactaagggagttgatgctattgctgctgaaagcgctacttagggccaaatttggggagcagtggaggcttgcccttgaaggaggcatcattgtcaaaggaggtggggaaagagttaccgctagcggacgtgaggaagggtctgacaaagagaaaaaggaaaggaagaaagagaaaacaaagctaatatatgtcttgcttttagtggaaagcatattccatgtaggtttggaatcacccaacccttacgccaagccaaaaaagttgtctactgaattaaaaaagcttgatgaaagcagaagttgtgaggaacaaggcaaggttagtgaagtagctccatgtggagcttgtagtccttgtatcttcttcaacaatggattcccttgcttctttaagatcaatggcagcggaatggagaacaagaaagatgattga

SEQ ID NO: 49973 - DNA, 2262 bp, Glycine max
  Peptide Sequence Number=SeqID_166751
atgggttctagaaaccttgttatggtcaaaactcacattggttcaatcaatgtgtcttttgctaatggttttgtctatgaaaacgtgctttgggcattgccttctctttgtgttttcttctgcagctatgtgctgtattccttggggttgattctcagatacatcttcagatttcatgtagaagataggaaaagtgagcaccttgttccacatgatctgcttgatcaaaccaagagatatcggattgaagattctaaggttgatgggttcgcagaggagttagcaaatttgttttctgttttaaaggaactagaagaagaaatagagttctctgttttagaggagaaagactctgatatgcatgaagatagtaacgaaagagaaggagaagcatgcgagtctgttttcttggagactgttgcatatgttcatgaagatgttaagaaaattggtgaaaatgaaacagagagctttgttttcatggaggatgattccaatactcctcaagataataaggagaaagtagaagaagaaaaaacagaagagtctttcttcacagatactgactctgttgaagctagtagtttggtagaagaaccaaggatcttgaccttctctttccaacaaaattatatagctgcaaatgattctgataatatattttccagaactgaaaatattgctaaaatggaatttccagagaagaatttggagaaagcccttgttgctcaagaagagaaagagcaatttgttcaagatgagagaagcatcacatccaattccactttcggtcaaatctttcaaattaatgcggtcggtggaagtgattcatcaaatgatgaccaccttcaacacgataacacacttcaatatgattttgggtcagaatcatgcagcagcggcattgatgattcggtaagtcataaagatgaaagagttgaagacggagaggaaactcaatattcatgggacagtgaagtctcatacaatcacaattttcatcttgatgaaaacaaggatgtaatggaaggttcttcatattgtggagaagaggaatgcaggggaagcatggagaaaacaaaagaaaccatgtgggaagataacttggatgaatcagattttgatgaagaagaggatgaagatgaggatgattttgagtgggagcatgatgaggtactggaacaattgaaaatggagcttaaaaacgcaagacaaggagggcttgccactattttggaagaggaagaagaagaggaaacagagtctccaaaagttgttgaggatcgaaagccattgaagattgaagagaagaaagaattcaaggatcacattgttgaaattcaaaaggtttatcggtgctatgcagagaaaatcaggaaactggacgttttgaattaccagaccatgcatgcaatagggcttcttgaactaaaagaccctctaaaattaatgttaatcccaaaatcaaccgtccaaagtgccaagcctctatctcagaatttgtggccacggaaaacacaaaagcaaatatctgacccaatgttgaagtttgttcaagaactccatggagatttggaattggtgtacgttggtcaggtttgcctctcatgggagatcctgtgttggcagcacaagagagttcaagtgttaaaacaatgtgattcacaatggcctcgtagctataatcttgtggcgggtgattttcaactctttcaagtcctcatgcaacggtttttggaggatgaaccatttcaaggcccaaggattcggaattatgtcaagaaccgttgtcttattcgcaacttgctccaagttccagtcattaaagatgataatacaaaggacaagaaaataattaagttgggtgaagagcatgcaattgatagtgaaaggttggaacagatcatcaaagagtccatgcgggtgttctgggaatttgtcagagcagataaagattatgggaatgtaatcaaagtttttcatcaaacaggaattcatgtcaaggacccagcaatttcagatcttcttgggaatgtccgaacccaattgcaaaagaaggagagaaagctcaaggacacggtgaggagtgggaattgcatagtgaggaagttcctaaagcacaatgaggaacaaattcaacttgatcaagagcagttgcttgctcaagtgggattgagattggtctcaagggaaggtccaggtggagccttcttttttgttttttccttgttgattgattcatctggacctgccacagtatag

SEQ ID NO: 49974 - DNA, 1077 bp, Glycine max
  Peptide Sequence Number=SeqID_166752
atggacctaacctccatcagtacccacaacacaaacacaacacaaaccttagatgctgctaatactactactaaaaccaccccaccaacgccaatccccaccaccaccccaaagtctctatctttcgccaacggcacactcaagcgccatcccaccaccaccgttgctcagccgccgtccatggtggtttcctacaaagaatgcctcaaaaaccacgccgccagcatcggcggccatgctctcgacggctgcggcgagttcatgctgtcttcttccaccgtcccctccgacccccgctccctaaaatgcgccgcgtgcggctgccatcgcaacttccaccgccgcgaaccccaagaaaacaacctcaacaacaaccttaaaaacaacaaccccacatttttaaactgtatctataccctatcagcgccagcaccactctcacaccgagccatgagccaaagcacatcaccgagcctgagttcaagcccgagccacagccagagcccgatatctagcccatcaccgccgccactctcgcacgtgccaccctaccacgcttctgcacctcacatgcttctagccctcggcagtgcctattctgccgaaccctccgacgaacaccaccaccaccaacaacaacaacacaaaagcttcaatttgtcgatgatgaggagcgagaaccccaccaagaagaggtacaggaccaagttcagcaaggagcagaaggagaagatgcatagcttctcagagaaattggggtggagaatgcagaaaggggatgacgggttggtccaagagttttgcaatgacattggggtctcaagaggggtcttcaaagtgtggatgcataacaataagaacacttttaggaagaaatctgaagatggaaatggaaatgcaaatgctcctcaaagtaatgatgatgacaatgccaatggtggtggaggaggatttgatagtgatatcaacaacccctacaacccaaatagcaacaacaacgatattcacatgaaagaagtagatgatgcgtgtgtgaacaatgttgttcatgtttctcttaatgagatgtcatcttag

SEQ ID NO: 49975 - DNA, 270 bp, Glycine max
  Peptide Sequence Number=SeqID_166753
atgctgacaaacaatggtcctcagacgaaattagggtatgacactccaaatgagggaagaagtcaagtccaacctgtcaagtccagcttctattctagaaagcttcgactaaaggcgtatggggatggtgatgaagcctatgcatcaggattatcggtgactagttttgctaaaaggaagaagaagaagaaaggaaatgctggcaagaagaacaaagttgatcctaaggatatctacaattactgtaaagaaccgggtcattggaaatga

SEQ ID NO: 49976 - DNA, 480 bp, Glycine max
  Peptide Sequence Number=SeqID_166754
atggactttaaacaaattactttcaaagagggtgcttctcttaatcggccaccattgttcgatggcgggcacttttcattttggcaaaagagaatgaaaatctttattcagtcaattggtctcagtgcatggaatgctattgttaaaggatcatttatatcgactaaagtagtcaatggtgaattggttcctaaagaatgggatgagatgaaagatgacgaggaaagaaaagagatatgggaaatgcttgaagtaactcatgaaggcattgcggatgtaagaagagaaagaaagcaaactcttgtatctaaatatgaagctttccaaatgcagaatagtgaacccattttagaacttcaaacaagattcacccatatagtgaatcacttgcttgatattggaaaaatgtttgaatatgatgagctaaacatcacgatcctcaactatttacaagaacttgggaatcaaaaatcacaatga

SEQ ID NO: 49977 - DNA, 612 bp, Glycine max
  Peptide Sequence Number=SeqID_166755
atgttggtctccaagaatgtcaattcttcttgggttgtggagttgagtgagctatctgggttatctcctatgttagacttggggaagtacctcggtgcagtgattgagacattaccaacatacacaatgcatgtgactcttcttcctatgagtgtgtgtactaagttggaacgaatggccaaagattttgtttggggtcatgatagtgagagtaggagatggcataccattgcttgggagtccttttgtcatcctaaaaaggatatgaggatgggcctcaagcatggcaagtatgggtatagttccttaggtctccctgaggtgaaaggtgtggctggttgttcagagggttggagatctatgccttcaagtgttgttatagaaaagcttgtccctaattttctttcgaggcaacaacttggccatctctgttcgctaatcttgtgtatcaagtttggatacagagaaacaaggttgtcttccagggggagagattttgcgacaatccttgtcattgtgcaaagccagtctgtgggttggtctttggtggtggacaatagaatggttaatgttgtccttatggcgtgttattctaatggcagtatcatgtaa

SEQ ID NO: 49978 - DNA, 354 bp, Glycine max
  Peptide Sequence Number=SeqID_166756
atgaaaccctatactccagagagtatcgtcaatgaaatcccatcgaggtctgtcatatgccttcttcaaatccaccttgatagctacaaaacctttctgctacttcatcccacgcatagaatgaaaaacttcttgagcaatgacaactttattcaaactatgtctccccaggacaaaactacactgatgtggagaaaccaactcgtccaaaacacccttcacccttttagctatgatctttgttactattttggaccaatcactagaaccatgagcaagaggctccaagaagattgggctaaagctgctgaagaaggccctagggttctcatgaaccttagggtagatttctga

SEQ ID NO: 49979 - DNA, 633 bp, Glycine max
  Peptide Sequence Number=SeqID_166757
atggttgtaattccttgccgctacgttgacgaggacacgctattagcggcacgtggcggttctgatgacaaagaagttgtgcttgatgatgacactttagataatgttgaatccatagtggatgaccctttgtgccctacagtggttatttctagggaggagagaaggaaaatgtatgaaccttggaagcgggtcattatcattaaggtattagggaggaaggtgagcctaaatttcttgagggcgagactagcgaggatgtgcatcccaaagggagtaatgaagggtttctccatgggtatttggttgctttgggattccttcatggtggatatgaaaattgttggttcacatcatcagtatattcatactaggataagacttaaacttttctatacttttgtgtatggtagtccgaatataagctctatggatgagctttgggaggaaatgattcaattgagtaccgacagaaatgatccttggcttgctattggggactttaatgtctatcctcatcctcatgagaagagtgagggaggtcctgttaatgtatatcatgcaggttttgatgatgacaaagtattacttaaagatggttgtcatcatcaaaaaggaggagaatgcgaatga

SEQ ID NO: 49980 - DNA, 864 bp, Glycine max
  Peptide Sequence Number=SeqID_166758
atgaacgatcatctggtgctgttcgtggaccatctggtgcggcccgtgccggtggtcgagccgctggcccaacaaccccccgagcccgtgacgcccgtcaatgaggccgcggtggcgggtccctccgggtcgtctccgtctgcggaggacgacggagacgacgacggggaggacgcgccgctgctgcagctggcggagtgtcgcatttgccaagaggaggacagcgtcagcgatttggagaccccctgctcctgcagtggtagtcttaagtatgctcatagaaagtgcgttcagcgttggtgcaatgagaaaggagacataatttgtgagatatgtcataagtcctatgaacctggttatactgccccgccacctcgtcctcagcctgaagaaactaccattgatataggtggaggctggacaatctctggcatgccattggacttgcgtgatacccggctcttagcaattgcagaggctgaacgtcaattcttggaagctgaatacgatggatatgctgcttctcatgccagtggagctgcattttgtcgttcagttgcattgattttaatggcccttttactcttaaggcatgcactttctgtcacagattctgaagctgaagatgatccatccacttttttctctcttttcttgcttcgagctgctggttttcttttaccttgctatatcatggcttgggcaatcagtattttgcaacgccggcgacaaagacaagaagcggcagcactagcggcaacccaagttgcttttgttctacaaaccgggcagcgtaggggtctgcagtttgcaataggaccaggaccaccaacaatgaatacacaccaaccggaacaagtgtaa

SEQ ID NO: 49981 - DNA, 690 bp, Glycine max
  Peptide Sequence Number=SeqID_166759
atggtgggctgtagtaggaagcaaactttcaattacataaaggatagaatgtggaagaatatgaattcttggagggggaagaagctatctatggaaatgagggaaataattctgaaatttgttgctcatgccattctagcctatgctatgagcatctatttgttttcccgtctctttggtagattggacattaaggtcttagagactagaaaatggacctcattacaaaatgatgttgatgtagaagcaattttggcaaatcccttgattaattcaagcatggaagatatgcgaatttggggagaagcatctaacaagaggttttcagtcaaatatggttacagagtagtcatggagaggctagcggatatgtcgaattcaaggatccttttcattatctggcacataaaagttccccatctggaaggtaagaatcacaatgctaaaggaacgaccacacttgctaaacaatctttggtagattggactgtagctaggaatgtgatatggtctaagccaactgaaggttacttcaaatgcaacattgacacaggttttcatagccaagaccagaaaaccagctgggcttgttgtgtctgtgacaatgttggcagattcttggtgggcaaaacttcatggtcaaggccttctccttctatcattgaaggagaggcttgtggaatgctttag

SEQ ID NO: 49982 - DNA, 555 bp, Glycine max
  Peptide Sequence Number=SeqID_166760
atgttgaggagtggttggaatgagcattctatctccaagttcaatgaggttaacgctaggctcacagagctgatggtgcaagacgacacttactggaggcagagatctaaaactttatggttaaaggatggtggggactttaacatgaagctcttccatgcctcaacaaccactcgaaggaagaggaaccacattgataaattgttgaaagatgatggcattgaggtgacttctcaggaggatataaaagaagtcgtggcttattactttaggcatattttcaatggccaagttggcctctatgagcctgttactaattcagttcaatcatttctggaacctttgttgctcagaaatctcacaggcctactcgaagtggttgcaggaagattatgttcaaagctttggcaacacaaggtgagaggctttattgggaagtgtgttggggaggagcaatctgctttcaccgaagggagatcgattctggacaatgtgctcattgcagtagaaatcattcactatcttaaatccaagaccagagggggaaatggataa

SEQ ID NO: 49983 - DNA, 543 bp, Glycine max
  Peptide Sequence Number=SeqID_166761
atgactcaggctatcatgaagcaaggagaagaaacaaagaaggagttaagagcttatgttgagcaacaacacattgagaataaccaatacaagctatctatgcaacaagctatctcttctcaattcacaccaatctatctcagatgcttctccaaaatctttaaatggctcaaaatcatagaaactcttttgtttttgaaagtccaacagtggctagcaaaagttgtatccagtggtgaagttggtctagcagcggctaagaatgaactggtgaggataatgcttgaatcaattcagcattgccaacatggtagccaaaatcatgcaggaacaggaaaacaagaagacaagctcaacatcaagaaaaggaggaagaactgctcaaatgagaaaaaaaaacgaagaagaaacatgagacagttcttttgtcaacagccacctctatcttcaaccaacttatccaagtttgtggactcgcgtctaacacctggagaccatggagttctttgcctaacaaagatatatctgaagaagagaaactaa

SEQ ID NO: 49984 - DNA, 1809 bp, Glycine max
  Peptide Sequence Number=SeqID_166762
atggcagttactttggcgttcttatggcatatggtggcctgcaagatgagttttaaattctgccatttcttacagtttttgagggagcaagagcctgaatttgtaacaagccttgttcgtacccggattttgccactgtatgcaatagctgtgtccctaccatacctagttgctagtgcaaactgggtacttggagaactaggctcctgtctaccagaagagatgagtactgatgtatattctcaattgctcatggcattggtcatgccagataggcagggtccttcttgctatcctgtgcggatttctgctgctggggcaattaccacactacttgataatgactacttgccccctgattttctaccccttctccaagtaatagttggcaacattggaaatgatgagaatgagagcgagagttccatcttatttcagcttctcagttctattatggaagctggagatgaaaaagttgcagtccatatcccacttattgtctcatcaatagtgggtccagtctcaaaatggttaacttccaatctggaaccttggcctcaagtggttgaacgcgcaattgctgctctggcagttatgggtcagacttgggaagactccaggcctgaagaatctgagtcagatgagtctcgtgaaaaatgggctacgggtaaagtggcaattgctagaacttttgctgcactcttgcagcaggcttggcttacccctctgtgcacactggatcaacaagatcagcaggctccctcctcctcatcatgcatagaagatttgtcaactttgctacagtctgtcttgctatctattgatggaaatcacatgattcaagagcttaaagtatcagagctggtgtcagtttggtctgaaatgattgcagagtggcatgcatgggaggaatcagaggatttatcgatttttgaggtgattaaggaaattgtgaatttagattgcagatataagctgaaaaactttgttgtaaaagagatgccacctcctccagctccgcctgttcctgaacgttcaattgtagagggcattggtgctttcatcagtgaggcaattaagcaatatccttctgcaacattgagagcttgctcatgtgtccatatattattacattgtccaacctactcacctgaaactgaaggtgtaaagcagtcattggctattgtttttagtcaggcagccttctctcgatttatagaagttcaaagcacacccagtgcactttggaagcctctattgcttgctatatcttcctgctatttgtgttatcctgatattgtagaaggtattctggagaagggcgaacacggaggcatcaaaatttgggcatctgctttgtgtcatgtatccaatagatcttttgagcctggtctgacagcagaggctgagatgaagttagttgtgatgacattgggccgattgattgagcaacttctcaaacaagggaactcaggcaatgaaattcaaaactgctttacttcactgttggaggtatccattcaattgaaagaagcacatgatgggaaagaagatgaacaaggatctgatgatgatgaaaatgaagatgatgaggacgaggatgaggacagtgacaatgatgattatgatgaggattctggaagtgatgaatacgaagaaacagaagaagaatttcttaataggtatgctaaagctgctgaggcattggaaaatggttcagctattgaagagggggatgatgaagatctggaactggagctggaattaggtggttgcatcacagcaaccaagaacaagtgtttggtttaa

SEQ ID NO: 49985 - DNA, 768 bp, Glycine max
  Peptide Sequence Number=SeqID_166763
atggcggaggaccttactcatatcgctcagttgctcgaccaaaccctcagccccgacgctaccgccgtccgcactgccaccgccgcactcgatctcatctccctcactccgcacttccctttctacctcctttccatttccaccggtggaggaaatcaaggtcagaaaatcgctgctgctacctatctcaagaacctcactcgtcgcactgtcgatagtaccggcgtcaagccttccaatgtgagcaaggagttcaaggagcagctgatgcaagcgttgcttcaagtcgagttgtccgttctcaaaattttagtcgaagtgttccgtgccattgctgctgctgattttgttaagcagaatttgtggccggagcttgtgcctaatttgcagtctgctattcagaatagccatcttaccagtggttcgaataccaaatggagtactgtaaatgcacttcttgttctccatgctcttctcagacctttccagtattttttgaatcctaaagttgctaaggagccggtaccaccacaattggagcttatatccaaagaagttcttgtgcctttgcttgctgttttccatcaatttgttgaaaaggctttagcaacccatggcatagcagaaaaagaaactgagaaagtcctcctcactatatgcaaatgcctacattttgcagtgaagtcctacatgccatcaactttgggctcctctactgccttcattctgtcgggacctaatgagcattttgagctctctgagctttga

SEQ ID NO: 49986 - DNA, 630 bp, Glycine max
  Peptide Sequence Number=SeqID_166764
atggtaatctatgacccttcaatgtccacctgctccattctccaacctcaccacgacttcgaaatgacccaagttcaatccgccataatccccccatcacaggacacagttttcgtgctgctaaactgctccatagactctcccgttctaaaccactacaagtacctctgcttcaacttcgccggtcacacgtgtgacgagctttatggttcgtgcaacgccttcagggtctttcatttgctgacaaacagttctccaccgtgttgtttcaccagttatagcaccgtgaagttcatgagcatgaacatattggactgcacgcactataccagtgtgtttaacacggataatttgaagggtgttggccctttggactgggtttatgggatcaagctttctttcagtgtgcctgatactggatgtcaaagttgcaaagaatctggtgggacatgtggctttgatactgatacggaaggtttgctttgtctttgctcaagtttcgctaattcaacaagggaatgtgctgctggaagcataatatcaaaaggacagaacaatgctccttggacacacttcctactggttttgcttgttgtagctaattttctcacgaaagtgaggctcgtttga

SEQ ID NO: 49987 - DNA, 228 bp, Glycine max
  Peptide Sequence Number=SeqID_166765
atgggtcatcgcaaactacagaggatagctggaaaaaatctacaactgaagggaccaatatccagggtggtgggtagaacaagggatctagttcaaacactacttctaaggactggggtcaatcaagtactgcagacaagggtcaagcatctagttggaaagaagcagcagatggttgttaccctactgtgtgtatcatgcctcctcagtgatgattgcccgagttaa

SEQ ID NO: 49988 - DNA, 1440 bp, Glycine max
  Peptide Sequence Number=SeqID_166766
atgtcagaggttaaggaccctgcgataaagctttttggaaggacaatttcgctgacacacacacacatcaatgattcttcttcttcttctgcacctgctcgtgccccttcatcttcctcttctcctcgtgaagttacctcttctgcaacacaacaacaacatgaacctgaggaaccatcaaggaaagaacttacctcatcacaagatgatgatggctcacatcaaaccacagaggatttaaaatcccccacgacatcttcaggcatatttgagaatcctaagactccctcaccagaaactgagacatcagtcccgaaatcctccacaaatggagaacaaagcgagacaagtgcttctgatgaaaaaacaccaaagaaacccgacaaggtgcttccatgcccacgatgcaacagcatggacaccaagttctgttactacaacaactacaatgtcaaccagcctcgtcatttctgcaagaactgccaaagatactggactgctggaggtacaatgaggaatgtgccggtaggagccggtcgtcgaaagaacaaaaatttcccggcgaccgcatcacattaccggcacttaatgttcccagaggggcttcaaggagccacactcaatgcccccaatggattgcataatgctgtgttgggaaatggagcagctgttttgacctttggtcctgattctcccctttgtgatacaatggcatcaatgttgaacattgcagagcgagcacaaagttgtgttccaaatgggtttcaagcaactgagccgaatagttttgtttcctatagaaaggaggaggatggaagtactagtggtcactctactggagtttctgttgcaacaacttcaacttcaagccatagtggctcacatgaatcagttgataaaagggttgaaggtttcactcctcaattgccatatttcccaagtggcccttggccttatcctatgcctcctcctacattttgcccaccagggtaccctttatcattctatactacaccagcatattggggttgtatgccaccctcttggaataacaatatatcatctatctcacctcaatcttctgttaacaactctgtctctgtccttactttagggaaacactcaagggatggaaacatcattgccccatccaattcacaaagagaaatgcatgatatggagcacaagagctcagaacacaatgtcttgatccccaagactcttagaattgatgaccctagtgaagctgcaaagagttccatttccatgtggtcaaaactagggatcaaggatgataaggccggttccggaggccttttcaaggcttttccatcatccaagggaaacgacatgaatcatcacatggttgaagcatcaccgctgttgcaagccaaccctgcggctctatcgcggtctcttaccttccgtgaacagacctaa

SEQ ID NO: 49989 - DNA, 345 bp, Glycine max
  Peptide Sequence Number=SeqID_166767
atgtcgaagaaccttattccctgctccttcgcgaagcttctcaacatatcgtggagaccgctgatccgttcgtttggacttggcgtggcgtggtcaaggacgaaggcaacctttgcggagtcccacaccctttccctttcaaagtgggatccccgggtaccgagctcgaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagctga

SEQ ID NO: 49990 - DNA, 307 bp, Glycine max
  Peptide Sequence Number=SeqID_166768
gcgccattcgccattcagctgcgcaactgttgggaagggcgatcggtgcgggcctcttcgctattacgccagctggcgaaagggggatgtgctgcaaggcgattaagttgggtaacgccagggttttcccagtcacgacgttggtgtgggactccgcaaaggttgccttcgtccttgaccacgccacgccaagtccaaacgaacggatcagcggtctccacgatatgttgagaagcttcgcgaaggagcagggaataaggttcttcgacatcggcgaagggtgggatcctctagagtcaacctgcaa

SEQ ID NO: 49991 - DNA, 1395 bp, Glycine max
  Peptide Sequence Number=SeqID_166769
atggatttatatggtacagcagaagtgaaagttgagggttttagccatgaacctccacaatcaagccaggtcaacttagaggaaacttataatgatgatatggtgaaggaagaagagggtattgatgcatttcccagcaatgtttctgaccaatatttggatgttgtggagaatggtagaggtaaaaggcccaagtatgaacatgatgatgatccagtcaattgtcttgaaccttcttgggtggaagaaagggttgatgctgttgttgccgaaatgtcgagacatcccaaaccaaatccatccaggtgtctcagtagtgtggcagcaaagccaccatttttcttatttgggaatgtttcaaacatatcctatgactcatggacaaagatgtctcagtttttatatggtattgaacctgaatttgcgaatgctcagtccttttcggctatggatagaatagaaggttacatacacaatcttccagttgaaaacagattccacatcctcccaaagccacctatgactattgaagatgcaatgccgcagacaaagaaatggtggccaccttgggattcaaggaagctattgagcagcatctattgtgaaactaatggaattgctcaaacttgtgatcgactgggaaattttctagctgattctggtggagtgctcacatctgaacagcagaaagacattcttcgttattgtcgcagattgaatcttgtgtggattggcaaattcaaacttggtcctgtggagcctgaacagttggagctcattttaggctaccctttgaatcacactcgtgctaccgagggcaatgttgccgaaagacttaaatcactaaaatactgcttccagacagacacattggggtatcatctttctgtgttaaggcccatcttccctcatggactgacaatgttatcactatttagtggtcttggtggggcagaaattgccctgcaccgccttgctattaaaataaaagctgttgtctcagttgagacttctgaaacaaaaagaaagattcttgagaaatggtggcgtcaatctggacaaacagggactctggttcagattgaagacattcaaaagctgactagtaaaaaacttgagggtctaatcagtaaatttggtggttttgaccttgtcatttatcagaatccatgctcttactcaagttccaggcttcaagccggtgtaggtctctccgctcttgatttttcagtgttttgtgaatgtgttcgagtcttgcaacgagtaagagtaaacatcggtgattttggtacttttctcttgtcattttatgaaactaatgtctctcaactagcgcgatgcgacgatggacaaagtctcaacaaacagtctagcttggacagacttaagaactaa

SEQ ID NO: 49992 - DNA, 312 bp, Glycine max
  Peptide Sequence Number=SeqID_166770
atggctgggaatccaaatagaagagaaggaaaaactgttatggttccaaaaactgagaatttggattatgagttaccaccttatacttcattttcaggggatgttggggacaacgttgcaagttcatctggaggcaaactacgagcgttctttatcggaatgggattcctaccatgccttgttgataaagtgatagaggagaatggtgaagagaattctgatattttactagaggctctcttgagatattcaagagaagatatgcatatacatgaaggattcaaattatcattttataagcatagtccttga

SEQ ID NO: 49993 - DNA, 2130 bp, Glycine max
  Peptide Sequence Number=SeqID_166771
atgactgtttgcagtggtagcagttctggtatggaaatgtatgatgtttctcaaactagaaatgcagatgcttatttgattgaaggcactgatttaaactcacatctaacaagcccaaatattcaacaatttcaagccatgtttaatgatggagcccctgaatttgttgttgatcagaacttgtattatcctgctgccaccaattatgggtattactgtacaggatttgaatcacccggagaatgggaggaccaccataggatttttggtgtagatggtcctgatattcagtacacaggtgcacaaaacgaaagttttccatatatatattatacacctagctatggatttgcacagtctccatacaatccatacaatccttatattcctggtgcaatgataggagttgatggttcatttggaggggcagagcaatattactccctccccaattatcaaaaccctatttcttcacatgcttatattcctcttgttcaaccagacaatttccctaatagttctgttgactcattgtttgataccagagcttctgtcagcagacctgatggaaaaggtttaaaacctaagttcaattcagcttctgtttcctttactaggaactcttcaaaatcattatcaaatcccacaagttccttacccaggatatcagaaggtccgagagattatactggggtgaagaaagatatgacaagtggcaggggttttcttaatatggcttcgtcacctgtccatcaggccagaagcattgatgcctcaacccatcctgtagatactatttccaatggaaatgttttgtcccatcataatcaattaaaaatagcttcctctctgagtagtggattttctgattatggatctaatgctaatggacagtctgtggttgctaaacttcgaccaaaggttcacattggtaaaggactgagtgatgtaaatggaagttctgatgttttaggtgagcaaaatcggggcccgagaattagtaattgtaagtcaaaatttccgctggctgtcaaagcctatacaaacataggagatggcaatacacaagagaatatcatcatttctactgatcaatataacagggaggatttccctgtcaactatgaaaatgcaaagttttttgttataaaatcatacagtgaagatgatgtgcacaaaagtattaaatataatgtgtggtcatcaacacctcatggaaacaagaagctgcagagtgctcatgaagatgctaagagaatagcttctggaaaatttggaagctgcccaatctttcttttcttttctgttaatgcaagtggtcaattttgtggggttgctgagatgattggacctgttgacttcaataaggacatggacttttggcagcaagataaatggagtgggagcttccctgtaaagtggtacatcataaaagatgtgtcaaatgcaaattttaggcacattatactagagaacaatgagaacaaacctgttactaatagcagagacacacaagagattttcaaggggataatgtatagtaaaggtttggaaatgcttaaaatattcaaaaaccatcatttgaagacatctttgcttgatgactttatatattatgaaaatcgtcagaagatcatgctggaagaaaagaccaagttgctaatcagaagttttgaaaatccattaatgttacccacattagaaccacctcggaagttgaattttgtcgttgacatccctccagtcagtgttgagaagaaggcaaagatggatgatgagtttgatagcctaaaacagacttcaagtgctggacatattgttagtagttctgaggtcacaagcaccgcatctgtggatgaaaaggctgagaaaggttcagttgagaaagaagatattgcttctgtccttaagattggttcagttactattaccccaaaacaggtggagactaaaccatctggcattagtgttgctaataaggaaccgcttgatgttatcacagtaggctcaatgcaagtcaaagttaatggatttgccgagtcttcgggtcttttgaagattgggagtatcccacttgatccaagaacactacagctggacggaggtactcgtgttaaaaatggatcttaa

SEQ ID NO: 49994 - DNA, 248 bp, Glycine max
  Peptide Sequence Number=SeqID_166772
atggaagcatgtttagcagtaaaggacctattgcaacagatgatggaccaaggccggctggaagtcagcaatgaggggggtgaagagcagcacatatacatgcagtccacagatgaagaatgtcttagaaagcctaagcctttggtggtatatttcaccatagacgcagctccccaagagccccaattcccctcggtagttagacctattctgtttccgtaccaaaacaaccacgtagtttcgtggag

SEQ ID NO: 49995 - DNA, 251 bp, Glycine max
  Peptide Sequence Number=SeqID_166773
tgtttttgtttggtggtgatgataatgatgatgttaacaacaataccaataaaaatatcaatggtggtcccaatgataatgatgatagcgatatcgatggaagtgacatggtggtggcggcggtgttggtaatgacatttagtgatggtgatagtaatgttaatggtactagtgatgatagtaatgacaatgataataatgttggtgatgttggttacaacaacgttggtattgagttagttgtgatgacg

SEQ ID NO: 49996 - DNA, 246 bp, Glycine max
  Peptide Sequence Number=SeqID_166774
atgcacgaacagagtttggcaatcaattcgtggggctccggactcaatggtggaggatggatgaacgacaatcaattcgtggggctccgagcaatcaattcttgggtctctggacttaatggtggaggatgcatacacggcaatcaattcatggggctccgagtaagatttgatgatggaggatgcacgaacagtgctaggcaatcaatttgtggggctccgtactcaatggtggaggatgcatga

SEQ ID NO: 49997 - DNA, 279 bp, Glycine max
  Peptide Sequence Number=SeqID_166775
gggagtttggcacttttcttgagaagctctgcatacacgaaggttctagagagataaaggtccaagttccagagagttctgagagattttgttgtgtgaagatctgcagagacgcgagttcaaagcagaagccgtttggagagcttgagatgagtttgaggtttccggactatagaaagctaaatcctctgttggatcttccctatagtggaaattggtctgattctaaagtccttgatagtacgggactaagttgttgtgctatcacgaggaatcggg

SEQ ID NO: 49998 - DNA, 303 bp, Glycine max
  Peptide Sequence Number=SeqID_166776
atggcatctaaaaataggaaagctccttctacacctacccaggccagatatgacagatccaggttcacatccaaagaagcttgggagagatatacagatattgtggtgcccaggaaactactaccggagaggaatgtggtagtttattacatcgagtttgacgagttcaaggaggaactcgagagaagacattgggatgagaagttaactgattttgctgacagtagcatagacattgctattgtgaaggaactgaggaaagcctttgaagatcccagggaggggattcgagctaaatgctga

SEQ ID NO: 49999 - DNA, 414 bp, Glycine max
  Peptide Sequence Number=SeqID_166777
atggaaaggaaagataataagcttaggggaagtagcaatggcatcatcggtggttatcaaaagtggttgaagtctaggacgcaagaaataaattgtctcccaaagctaaaaggcctaagtgggaagaaagctgaagtccctgaggaaagcgaagaaatgcaagctttgaaagcggagctcgaaaaaacaagagtggtcaaggagaagctaaagatgacagtcactagggataggaaagagtgtgatgagctgagagatgtcaacatgactatggacgaagcaatcgagcaggaaacaaaaagggcccgaaaggaagaatggagcaggaacaagttccgaggggctctatggggcaacaacaatgagctcaagcttagaaaggatgagagggacgagtcaaggatggaaaccatg

SEQ ID NO: 50000 - DNA, 390 bp, Glycine max
  Peptide Sequence Number=SeqID_166778
atgcctacctccagtccccaagcaacctgcggtccttggaatttctttcaaccttgtaaaaaaccttttacaagcaaagattcacaagggatgtaccctcccttgttctctttgaacctagtggatgtaccctccactagaactgatccacaagagatgtactctctcttgttctcagtcaaacccaaggaatgggaagaatcaaaagaattctcagactgtgtcgttttgaattctttgacaagggagaaaggagacacaaaagaattcaggcagttagtccttccttcttttggaaaagggagaagaaagacacaaaaagaattcaggcgattagtccttggtgaactctttttggcaaagggagaagagaatggaaaggatgaatag

SEQ ID NO: 50001 - DNA, 384 bp, Glycine max
  Peptide Sequence Number=SeqID_166779
atgccactgaaagactctactgagacaaagacgggctgtcaagaacgtagaggaggtaggatgggcagttggtcagatctaggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtagaactacgagatcaccccaaggacgccttcggcatccaggggtcgcggaccgaccatagaaccctgttcaaaagcggaacgcattacctatccgctctcagttggacagtaagggtcggagaaaggcaatcactcattcttaaaaaccagtattcttaa

SEQ ID NO: 50002 - DNA, 321 bp, Glycine max
  Peptide Sequence Number=SeqID_166780
atggaggtgccgcagcacctgctctccgctgtttcgctcagggaatggccgggcaacgtccgggaattgcgcaacgctgcggaccgcttcgcgctgggcctggaaaccgacgtgtccgatgcgtcgccggcgtttcaggatgatggcaggtcggctctcgccccgagggtcgcggcatatgaaaaaagcctgattgcgcaggccatcgcagcccatgggggaaatctgaaatccgtttatgagaacctcggcatctcccgcaaaacgctttacgagaagatgcagaaatacgagcttcaccggcatatgaccgagatctga

SEQ ID NO: 50003 - DNA, 608 bp, Glycine max
  Peptide Sequence Number=SeqID_166781
atgaaaatactgaagacagtttccggccttgctgccgccgctgccgtttcccttttcgcgctgtccgcatccgctcagacctatcccgagcgtaacatcaccatggtcgtgcctttctcggccggtggcccgacggacacggtggcgcgtcttgtggctgaatccatgtcgaaggatctcggccagcagatcatcgtggaaaatgtcggcggcgccggcggcacgcttggcgctggccgcgttgcctcggcagatcccgatggttacaccatccttctccaccacatcggcatggcgaccagcgccacgctctatcgaaagctcgcttacgacacgacaagtgctttcgaatatgttggtctggtcacggaagtgccgatgaccatcctgtcgcgcaagaaccttgagaccacggacctcaaggggctgatcgattacgccaaggcgaacaaggacaaggtcaccgttgccaatgccggcatcggcgcggcctctcatctgtgcggcatgctgttcatgagcgccatcgagacgccgctcgttacagtgccctacaagggcaccggccctgccatgaccgatctgctgggcggccaagtcgacatcat

SEQ ID NO: 50004 - DNA, 114 bp, Glycine max
  Peptide Sequence Number=SeqID_166782
atggcgatgggtgttaagcctgccgaagcaatcaacaatggtccccggatgaaattagggttttctctccgaaacatcccagaactttacggattccacggcgatgggtgttaa

SEQ ID NO: 50005 - DNA, 219 bp, Glycine max
  Peptide Sequence Number=SeqID_166783
atgcaattcatggggctccgaaaaaggggtagagattggagaattgcactaagcaatcactacgcatggctccaaactcgatgcatgaacgaaaacgcaattcatggggctccgaaacagggtagtgaatggagaattgcactaagcaatcactacgcaagggtcccaaagatgggtggaggatgcatgaacgaaaacgcaattcatggggctccgtaa

SEQ ID NO: 50006 - DNA, 507 bp, Glycine max
  Peptide Sequence Number=SeqID_166784
atgtctcttgcaactctttttgggaaacttcaagaacatgaaatggaacttatgagactcaaccaacatgaagaaaatgacaaaaagaagaaaggaattgcacttaaagcctcatcttctattcatgaagaaagtgacaaagaggacttgaatgaacataacaatatagaagaagatgatgatttcagtctcttcgtaaaaagattcaataaattttcgagaaacaaaggaaatcgaagaagatcaaacttcaatccaaagaagaaaggagaagatttctcctctgttccaaaatgctatgaatgtgatcaacttggacacctaagagttgattgtcctatattcaaaagaagaatggaaaaatctgacaagaaaaacttcaaagataagaaacgaaagaaagcttatatcacttgggaagataatgacatcgattcatcaggtgattcagtaaacaaagtcgtaaatcctagtctcatggccacaaactatgaaagcgaagaagag

SEQ ID NO: 50007 - DNA, 238 bp, Glycine max
  Peptide Sequence Number=SeqID_166785
atgagtgaaatagaagaggtgcaagaacagatgaaggctgacatggaggccgtgaaagagaaaatggccacaatgatggaagccatgatgagtatgaaaaaaatgatggaggtcaatgtggctacagttgttgccgccagtaccgccatagaagtggacccgactcacccatctggcctcaatcaagtaaatcctccagtctcagatatagtaggggaaggaggcgaagcgttaggaa

SEQ ID NO: 50008 - DNA, 147 bp, Glycine max
  Peptide Sequence Number=SeqID_166786
atggatctggggatcccacggtcatgtggctccgcatgccaccggactcttgggtcacgcatttcgtttcgatacgaccattcagaggaaacactgggtccaacaaagataggagaaaatcactcaaagtgtatcaatctcacacgg

SEQ ID NO: 50009 - DNA, 213 bp, Glycine max
  Peptide Sequence Number=SeqID_166787
atgttggaagagaagtttgttactattattgatgctagtagcaatgaagagaaaactcattataaagcttgggaaagatctaagagactcagcctaatgttcatgagaatgactgttgcagacaatattaagacagatctccctaagaccaataatgctaaagagtttatgacaagtggcctcagatatcttaagaagggggggttgaattaa

SEQ ID NO: 50010 - DNA, 658 bp, Glycine max
  Peptide Sequence Number=SeqID_166788
aggactacacatcctcacctttagaggactacatgtcctcgcctacagaggcctacacaccctcgccttcataaggttgcacaccctcgccttcatagggctacacgccgtcaccttcagtggactacacgtcatcaccttcagaggactacacgtcctcgccttcagagggatacaaacccctaccttcatagggctgtacgccctcgccttcatagggctacacgccctcaccttcaaaggacaacatgtcctcgccttcagaggactacacgtcctcgccttcagagggctacacgccctcgctttcatagggatgcacgccctcgccttcatagggctacacgccctcacctttagaggactacacgtcctcgccttcagaggactacacgtcctcgcctacagagggccacacgtcctcgccttcagaggactacatgtcctcgccttcagagggccacacgtcctcgccttcagaggaccacacgtcctcgccttcagaggactacacgtcctcgccttcagagggccacacgtcctcgccttcagagggctacacgccctcgccttcagaggactacacgtcctcatcttcacaggactacacgcccttacctttagaggactacacgtcctcaccttcataggactacac

SEQ ID NO: 50011 - DNA, 577 bp, Glycine max
  Peptide Sequence Number=SeqID_166789
atggctgtagcagactcaatatctttccaagaacaactacttcagagggttgcttcagctcagtttaggaagcctctccttcatcttgtgtccactcaagaagacaagggcagatacctcacccaatgtgtcccacttcacaaagcatcactcaaaggtgactggaaagaagctagaaaactattggatcaagatgggtcacttctcaaaacggccataacaaagggggggtgggccacactcctccacatagccgtgggagcaaaccgtgttcactttgtggaggagctgctaaagttgatgcaaccagaagaattggaattgcaagaccacaagggcaacactgcattctgctttgctgcagcagttgggaatgtgcaaattgctgagatgatggagagaataaatgcatcgttgccaaccataaggggtggaggaggactcacccctcttcacttggctgttttacaaggaagaaaagaaatggcatggcatctgttccctaaaactaaggaaatctttgaagaggtggactggactatacttttcattaattgtataaagtctggactatatg

SEQ ID NO: 50012 - DNA, 408 bp, Glycine max
  Peptide Sequence Number=SeqID_166790
atgaagaaagacacttacaacttctatgggtttaagagagaaaggcgagtcactgtagaaaaccccaacagaccaagaaattacatcggagccacatgcttggaggttgcgacaaaggttggagacggagtcgatgaggaaggcgacacggcaggggctagtcttatcaaagccggaggtcgactaatcgtagtcaatgaggtcaaagcagtagacggggaggacggagaggacctctttgttgacatcgatgaggcactcatagtccatgaggtagaagtcattgtggaaccagactattgcagcacgatagagagtagcggtgttggaggggtcacaggggtggtggggtcagcagagatggtggatttgaaggaggttttggaaggactaggaggacgcaagtga

SEQ ID NO: 50013 - DNA, 327 bp, Glycine max
  Peptide Sequence Number=SeqID_166791
atgtacaagactagcggtttggaagtcaaacaacaggaagtcaaggaactctcttcttcattgcttgctggtacatatggaaagctcgcaatgcggatgttttcctggagcctcctattaacactctcgcggaagtggctccggtcaacagcatcttcaacctggttatcagtagttgcgctaaatatcagtggtggtcgttccagagaggtttcttggttgcaccctccaatgggaagcttcaaagtcaacttggatggtagcagcatgggaaaccctgctcctagcgggtttggtggagtcatcagagactcaagtgcgaactag

SEQ ID NO: 50014 - DNA, 210 bp, Glycine max
  Peptide Sequence Number=SeqID_166792
atggatgcagcagctggccagggttattgtggtggtgcagacctggacatgtttctaacgaattataaattgggaaaaactcttggcattggatccatgggcaaggtgaaaattgcagaacatgtattgactggccagaaggttgccatcaagatccttaaccgtcgcaagataaagaacatggaaatggaagaaaaaggtttatattga

SEQ ID NO: 50015 - DNA, 225 bp, Glycine max
  Peptide Sequence Number=SeqID_166793
atgggtgcaaaggataaaatcattaatgcacaagagatctccaacactggtgtcatcactggagatgtctatggagtagatatgtctaacacaggtgtggtcactggagacacctgtggagtcgtctttggagtagcttccgcagtaactggatctatctctggatcagcctctggcatgaatggctctaggatctttggagtggcctctgagtcatcctcctga

SEQ ID NO: 50016 - DNA, 600 bp, Glycine max
  Peptide Sequence Number=SeqID_166794
atgggagagataatcaaacacctagcggaggtgcgacacatggctgtcgagggaggggttgtacaccaagatgtcatcgaagaacacgacgacaaaacgatgaaggaatggtttcaagagcttgttcattgttgcctaaaatgtggagggcacattgcacagaccaaatggcatcactttgtattcagagtgtccttgctgagtgcggaatgcagtcttagcaacatcatcaggcgccatcaaaatctggtgaaacccctatcggagatccagtttggagaaccaagatgccgagccaagttcatcaagaagctcatctatggtcggcattgggaagcggtccttcacggtcattatgttcaactcgcgatagtccacacaaaagcgccatttgccatccttcttttttaccaaaaggaccggacgtggcggaggaagggtggagggttgttggaacaagtgagaatattgggtgataagttcggtaatagctggatgcggagtgggtctgcatcaggcgccggagctggagtaaggatacgtccgctagtatcgtcggagcatctgcacgtagttgaacgggatgaccgttgtaattga

SEQ ID NO: 50017 - DNA, 972 bp, Glycine max
  Peptide Sequence Number=SeqID_166795
atgttcactcaactgcaactagacttcctcaaccacatagtttctgctcgcggtgtcgcgcccgacccctcaaagatcgaagctatggtgaattggccagttccgacaaccacccatgcattgcgcgacttccttggtctcactggtttttatcgtaagtttattaaaggttatgcttctattgctgccccactaaccactcttctgcagaaagataacttccattggggagaggctccacaggaagcttttgattctctcaaacgcgcgatgatcgaagcccctattttgtccttgccggacttttccattcccttcaccttcgagacagatgcttctggctcggccatggatgcctttttgatgcaacgtgcatgcatccacctacgttcgagaattgcatgccataacctcggcagtccgcaaatggcgccagtatttactgggccattccttgaccattctcacagatcatcgaagtctaaaggatctcataagccagggtacaattacacgatccaatacaagtctggaaaaagcaatgttgttgctgatgcgttatctcgggtatctccacccctcgcgagtcactattttttgctctctatccctaacttcatcttccttgacgccatgtgcaaacacttcaccactagtgtgacatttcaggccatactccaacagatcaccctggaccccggctcgcaccctggcttcgaactcagagatggcttattgctcttcaacaatcgggtttggcttgaacccgacaaccccttcatcaaaccattgctagaggagttccactccactcccattggcgggcatttagggttcgcaaagacccttcatcgcgtgcaatccaactttcattgggcctccatgcgtcgtgacgttaaacactttgtccgccactacaccacttgccagcaagttaaatatgagactaaatgccccgccagtctcctctag

SEQ ID NO: 50018 - DNA, 708 bp, Glycine max
  Peptide Sequence Number=SeqID_166796
atggcttctaggaaaagaaaagtctcagcctccagaccccaagctaattatgacactaccaaattcacatctgaagcagcttgggattgctatgcagacaacgttctcgcccagaacattctttcgaagagaaatgaattctatgcaaatttatataatccgaaggataaatctccaaagcaggtcagggttagagggaaattgataaaatttgatgttgattcccttaacttatttctggagactccgatggtcctagagctaggggagagccttcctgcatactccaggttatgtagattatggctagaccctcaggagatggcaacccgactatgtatccctggcaggggatttgttgtgaatgcagagggcctgccatggaagcttctgaagaaggacctcactactctggcgcagacttggagcgtcttgtcctacttcaaccttgcccttacatcacatacatcttatctgaacttagatagggcaaggttggtgtatggacttgttatgaagatggatatgaatcttggagccctcatttctggacagatatctctgatagctcagtccaactcctcccggctaggatttctagcaattatcactgctttatgcatggccacaggagtcaccttagactcgttgactttcaaaactctcagcccaactattaacttggcttacatcaagaagaacttctag

SEQ ID NO: 50019 - DNA, 354 bp, Glycine max
  Peptide Sequence Number=SeqID_166797
atgggggtggcttgccatatgttgcctcaaaaggggagagtctggtggctgaatgaatggtcgtgttgtaacaccattccgcaagggatagaaactgataccacttggaaggggtgtcgtgcacgaagcatcgcaggtattgctccaaggttctatttaggacctccgtcagaccatcagtttgcggatggaggaacaagtcacgctagaagtgtccgacgaagatgggatcacgattggaaaggagactgcgagggaagccattgtccttgcagactaagttcagaaaaaggagtgccactttatgtgccgaatagtgatcgagaagagctccaaagtgggcacctttggtga

SEQ ID NO: 50020 - DNA, 711 bp, Glycine max
  Peptide Sequence Number=SeqID_166798
atgtaccctttcttgttcttagttacaacaacccaagtagatgtaccctctacttgtaccacaaaggatgtaccctcaaatgtgttaagacaaagttctcaggtgggaagaatcaaaagaattctcagactgtatcattctgaattctttgacaagggagaagggatacacaaaagaattcaggtggttagtccttcgttcttttggaaaagggagaagagagacacaaaaagaattcaggcgaaagcttttgcaaaggaagaagatgaagaagttcaagaagatgttcaaagagattcaaaggctgtaaaagaatatgtggaaaagttttttgtaaaggttgaaactagtaatcaattatcagagagaaaaaattatggtgactgggtgtatgttaaactgcaacctttttgccaaccctcacttgcacgtacccggttcaacaaattatccaaacgatattacggtccatttcacatcattgaagccattggggctgtggcttaccacttggctctaccggaagactccaagatacataacgtcttctactactccatgcttaaaccacatcagggtcctgttgcgacaaccaccgcgcctctacctccatatgccaccgacaaccaccctctggttgaacctttaagtgttcttgacaccaagtgggatgataccacctcacccccttccttgctcgccttggtttag

SEQ ID NO: 50021 - DNA, 507 bp, Glycine max
  Peptide Sequence Number=SeqID_166799
atggaggccataaaagagcaaatggccacaatgatgaaggccatgatgagcatgaagaagataatggaagccaatgcggttatagttgccgctattagcgctgtcgctaaggtgaacccgatgctcccatctggcctcaagcaaatgaatcatccaacctcaaatatggcacatatctctcaaaccatgggggagacacatgaaattccccaccacaatctagctgacttcgagccttggctcggatatgccactgaagggcaagcagttggtggtataccctttgaaaacactttggagggccctcagtttcgcccacaaccacaaccattgcattttgcggtgggaagagcccctcctgctatggccgaaaagggaaaggcggatcatctaaaggaaaggctcagggccattgaaggaggtgaagattatgcctttgctaacctagaaaagttgttcctaatacccaaacatggtcattcccaagttcaaggtgccggactttga

SEQ ID NO: 50022 - DNA, 378 bp, Glycine max
  Peptide Sequence Number=SeqID_166800
atggagatggatgaaaaactccttgcatgcaccatagcttggatacttgtggcaagaggagacaatcatgcaacgctcatgacagaagatctgattcacattcacgtcatgaaagaaagagtgaagattgattgggatacttgtgaggtagacaatatattaaagacaaaaaggttgtctgattatcagattttgtatgcagtttttctcaccaaagtcaataagcactatgaagtggacttcacggatgagaagttcaaaattctgattagtataaacaagtttgacaaaggcttgttatcttacatggctcttgtcgagagagacggtcgatggtactatagagaggaagcattggagccaaagattgtggcttaa

SEQ ID NO: 50023 - DNA, 138 bp, Glycine max
  Peptide Sequence Number=SeqID_166801
atgatgagaattgaatatatgcaggtggagaggaacatcgacttggtttatgtaggaggaagcattgggttgatgggtttaatctcacaagttgtgtttgatggtggatgccacatgttagggagggagaaggaatga

SEQ ID NO: 50024 - DNA, 939 bp, Glycine max
  Peptide Sequence Number=SeqID_166802
atgcaagaagaattgagccaatttaaaagaaatgaagtttgggatcttgtgccaagaactaatactcaacatgtaattggaactaaatgggtatttagaaacaaaattgatgaaattggttttataaccaaaaacataacttggttagtagataaaggttatagccaagaaggtattgattatgatgagacttatgcccctgttacaacacttgaggccatacgacttcttctagcctttgcttccttaatagattttaagttttttcaaatggatgtcaaaagtacttttttgaatggatacataaaagaggaagtctatgtttctcaaccaaacggatttattaattatgactttcctaattatgtatacgaatcaaagaaaacactttatggacttaatcaagcctctaggtcatggtatgaaagattgagtaatttcttacttgaacaaaaatttgaaagaggtaagatgtccaaagagtcatcaacacctatgtccacctcatgctaccttgattcatatgaaaaaggcaaacatgtaaatgaatcaaaatatagaggtatgattggctcactattatatctaactcctagttgtctcgatattatgtataatgtttgtgtatgtgctagatttcaagctaatcctaagaaatctcatttagtggttgttaagaggattcttaagtacattaagggtacattgaaagtaggattgtggtatcctaagggtgcatctattagcttagttgggtattccgatttagattatgcaagttgtaaagttgatagaaaaagtaccagtggtacatgtcatttgtttgggagtacttttgtttcttggcactctaagaaacaagcctctatggctctatccatagttgaggctcagtatatattgttgccgatagttgttgtgcttagatcctttggatga

SEQ ID NO: 50025 - DNA, 898 bp, Glycine max
  Peptide Sequence Number=SeqID_166803
ggcattcacgctgccttggtcggcgtatgtgcgattgctgtcggtcaaggacagccaggctcgccggttctacgaggcgcatgcgctgcgtggcggctggagcgtgcgccagctcggccggcagatcgaaagccagttctacgagcgcactgctttgtccaggaacaaggccgcagtgctggcgaaggcagcgctgccgatgcctggggataccgtcaccgcggacgatgcgatcaaggatccgtatgtgctggagtttctcgatctcaaggacgaatactcggaatccgatctggaagccgccctgacgcagcgtctggaaggcttcctgctggaactcggggaaggcttcaccttcgtggggcggcagcgtcgattgcgcatcgaccagacgtggtatcgcgtggatctgctgctgtttcatcgcaagctgcgctgcctggtcatcatcgatctgaaactcggcagcttgacccacgcggatgtgggtcagatgcacatgtactgcaactatgcgaaagcgcactgggcgcttgccgacgagaatccaccggtggggctgatcctgtgcgcggacaagggccgtgcgctggcgcagtatgcgttggacggactgccaacccaggtcatggcagccaactaccgcaccgtcctgccggacgcggcgttgctgcaacgggaactggaggccacgcgcaggcagttcgaggcgcgccaatcgagcaccgcccgcaagggaaaatcgtagccgccggttcagcgttccccatccggcaggcggtcggtgcgcattgcgttacccctggccgccctgcgacaccaatcccccctcgagcggcacgaaccacgcgcgcagccccagctcgcgcacgatcggcgccgtggcccgcagcggcat

SEQ ID NO: 50026 - DNA, 435 bp, Glycine max
  Peptide Sequence Number=SeqID_166804
atggttggacctgttgctggagtcgtgccaccgtttgctatcgagcctcctgttgaagaaaggggtcaacctactactagggttggccttaatgatgatggagttattgaggtctcccccaatatgccttcctctattttagctaagaggaagcgtgatgacaactttggggtgtcaggccgttcaaatctccttcctgctcctagttcacaaggtttgccctcggcctcattggttatccaggcttctgttgctactcttgctcctccaactcctccttttgtgcctattcaggaggtttctgtttcttctcctaatatggttattgcaccgatctctttggccgcccctatcgtggctcctctgtccactgttgttacacccttgaaggagaaaaggagggagagaagtttaactttgaagtgtgtctcataa

SEQ ID NO: 50027 - DNA, 528 bp, Glycine max
  Peptide Sequence Number=SeqID_166805
atggcatgcgcatctagcgaggctgacaattgctccaaggtagccttgtcaaccctctccattatgatcaacagatccttatcaaaagacttgaacctgtggcaattcatcagccatgacgtcagttgccaggactttgtaaaaacagtccttgaagtgatgaaacacgttcaagtcaaactcgagcaacttcttggacacgttgttcagggagacccaaccaatcttgcatccagcgacggtaagaggggacgaaggagacccagcattacggctatgccacatatagcggaaaccctaatgtccccgccactactcctccttgctccccaagaagtagaatggggaaggatcatggtgactagaatgggttccctatctagaaaggcagcaaaagattgcaccctcctacggaggcgagaagtaccttcgccaacacagcacaagccaaccatcctcttagaagaaaaggacttgctattagaagctccatggagagagtctcctcctctgaggagctgccaatga

SEQ ID NO: 50028 - DNA, 579 bp, Glycine max
  Peptide Sequence Number=SeqID_166806
atgccttgcccatcctcccatctcagaacctcacaccctgcaccctcttcttcagccctaagctccatgaagcttaagagcctcatccacaccctcatagtctcccacatgtgccgcatcatccgtgcattctccaaggtcaaagccgtaatagtcgaaatcctcaagggaaagaaaaaccaatccaacattaacttcctccaccaccacaagaagcaaaagatgaccaagaagatcatctttggctccttcaggctccactataactggtgctcctcaaaatcttctcatgttatccctgtcccctctcgggtctttgaagggttgccaaaagctagtgacacccatcacgatgaacaatatttatatgaggattgccatgatgatgatttacaacttgctgggtacttgcagtggcttgaagagaaggttcatgatgataaaaagggttctggaaatgagatgaacgagattgataagttggctgaactgttcatagcggattgccacgagaagttcaagttggaaaagcaagattctgatagaaggttccatgaaatgatggctaggggcatgtga

SEQ ID NO: 50029 - DNA, 291 bp, Glycine max
  Peptide Sequence Number=SeqID_166807
atgggtgttaaacatttcgaggtgggaggattggagctttctaaaggggtctcgcgtctgaggccagaccgtgtgctaaccattagtgaaagagaggtcacgggggtggaagtgggcgtggtggtaaggacggtggcaatgatggaagtgggaatggtggatccagccattggcattagggtgaagcacatcaatgtaacatcgtgggaagatttagaaggaacaaaaagtgttgaggtggaggcgggtgttgtccgcggatctgatgttgagcgaggtggggttttgtag

SEQ ID NO: 50030 - DNA, 264 bp, Glycine max
  Peptide Sequence Number=SeqID_166808
atgaccaccaatcttgttgagtcgattaattcggtactcaagaaatcaagaaatatgccaataattgcactagtaaaatcaacacatataaggtctaatgcattgttcaacaaaagaggaagaaaagtcgcaacaatgcttacatctgaccaagtttatacgcaagtactaaacaaggagacaataaacctgagagaggttcgacccgctgaaaatttcacagtcaggctagatgaaaggtggtgtgactgtggcaaattctaa

SEQ ID NO: 50031 - DNA, 159 bp, Glycine max
  Peptide Sequence Number=SeqID_166809
atgacagggtttctcttgcctaaacattcaattgatttggcacccgttgtggaggactacattgatgatgacagtgaggaggaggatccttccgaggatgagagtgaagtgaaggagtctacagagattaaggaggacccatcagaggattcttcttag

SEQ ID NO: 50032 - DNA, 921 bp, Glycine max
  Peptide Sequence Number=SeqID_166810
atgcttctactggaggttcatccaatcgaggaaagttataatgacaatccttcccactgtcacagggacttcaatgcttctaatgaccatgtttccaacattcctgttggtggtgtcgtcgctgttgaagaagggatttgcccaaactctaacgatgaacatgtttttatgcgtgcttctccgagtgagacttcttttatgtatatgtacttcactctcttatctaatcttcacctcactctcacttttgacaagtttgagtttttcataattcctatagctcctaaatttcttcaccattatagcatgaaagaaaatgaaaagggtggttggatttcccttactggcattactgataaaggcatcatcgatcccttcaccacttcttacaaggatttcaaggaaaaagagcaacaaaaagagcatcctaaagacgattgggctcctcctcctcatcctacgtccagcccgactatcgctatagcgattccaagatgcggtctcttctatgctcagccaatcataccggaacatgatgagggaactgacaaaatcgagaaggttgacaccaagtcacaaaaggctcttgctaagtgcgtcaagatcgagcaagctttggattcctggaagtcttttaaggatacaaagactaagttaaaaaaggcggagacccaggaggaggctttgaagtccaagctcactacaaccaagtcttttgctaaagttctccaagaagagattaagtgtctcaacaaggagtttgctcttttcaagatgaatgcagagaaggttgaagaaaagttaaagagtgatatcggcaaagctaaggccaagatccttaaaactcatgaagtcaacttcttcaaggctacccctgaagtagagggtgccattgaagagcctactcagcctgtaacctag

SEQ ID NO: 50033 - DNA, 201 bp, Glycine max
  Peptide Sequence Number=SeqID_166811
atggtggagacagaaagtagagaacaaaagaaagtgaacaagaaccaaggccaacacagcagccaaaattctgaagctgatgatcttcatgagaaattgagaatggtttcagcaagaagcagtggggaaaagacatatagttgcttagacaacaagcacgttcgtatagaaaacttgggagggtcaagggttcagctttga

SEQ ID NO: 50034 - DNA, 582 bp, Glycine max
  Peptide Sequence Number=SeqID_166812
atgccttcgcttaaaaagaggttctatcaagtcaaggtcaagagcctagggaccaccagtctaaaagagttagggcagttgatgggtcagctccaacgacaagcttttcgcaaagcttacggtaaaatctgggacctagccatagtagaagtctccacagaggccattgcctccttcgcccagtattatgatcatccgctgaggtgcttcacctttggggacttccagctatcacctatggtagaagaatttgaagagatcctaggatgccctctagggggaaggaaaccatacctcttctcagggttctatccctcattagctagaatttctaagatagtccaaatctcggcgcaggaattagaccacagaaagcaagtcgaaaatggggtggttggaataccgagaaaatatttggaggcaaaagcaagaatcttggcaggtaaaggcgaatgggccccgttcatagacattctcgcactgttgatcatcggaggagtcctctttccgaatgtggatgggttggtggacctagcagcgatcgacgcttttctcgcctatcataaccacaaggaaagcccg

SEQ ID NO: 50035 - DNA, 177 bp, Glycine max
  Peptide Sequence Number=SeqID_166813
atggatgatgaagtcactcttattttgcaccataatggtaaaggtggtccagatgttgaaactaaagttgttggagttgaaactctacctgatgtacatgatgctaaaacagaagttgttggagttgaaactctacctgatgtacaagatgttgaaattgaagttgttggagtttaa

SEQ ID NO: 50036 - DNA, 480 bp, Glycine max
  Peptide Sequence Number=SeqID_166814
atggctatggtgatcatcgtcgaaaaaagtaacagagacaacacgttggtggtcgtcggaaaggaagcaccttcatcttcaacaaagagagtgtattctacgggaagaagaaaaggaaacaaagagagtgtcccaagtgcggctatggtgatcgtcgtcagaaggaagcaccttcgtcttcaacagagagagcgcattctgcgggaagaagaaaaggcaacgaagatagcatctcgagaacacaagaaggacaaaaatcaaggaagagatacctatacccagagtgcaggaagacaaaaaggcaagaaaatattatataacaaatccatccctatgttggcaatcaaagatggtcacgttgataatcaattttgtcacaaattcatccatttgttccacacaggctattttattaatggtgatagacggaagttaatgatcagaaaattttgttgcattgtttacactttcgaggactaa

SEQ ID NO: 50037 - DNA, 339 bp, Glycine max
  Peptide Sequence Number=SeqID_166815
atggttaacagtttgccatatctatctctaccattagattatgactatttggtcatagagtatgatggttgtgaacaaggatggggagtcatcctaaagaaagagaaaaataaatatgaaaaaattcatgatgaagaaatctgtaagtatgcttcaggaaaataccacacaaaaccacagggatacaacaagatgaagccttctaaggtctcttatcaaaatataaaacaaaaaatgaaatttggcaatcaagaattgcatgtacttacaaatgagtttcactatcctggtagagaagccatcaacgaaaaattcaattgccttatttacaatatttga

SEQ ID NO: 50038 - DNA, 225 bp, Glycine max
  Peptide Sequence Number=SeqID_166816
atgtcgttaaagctcagcttttgtgatgggtggcatttatggagccttgtgtggggacaccatgttaatggagtgaacaatttggagatgcatcttcctagcagaagtcatggccctgcctcttgcaaatccttcaacaattatgttgatgacacatctcagttagttgagaggcttttcttcccttcttttttgcgatcgacatctacacctttttggtcatga

SEQ ID NO: 50039 - DNA, 761 bp, Glycine max
  Peptide Sequence Number=SeqID_166817
taaaggttgcatcaagggagaccgaaggggaagattctaaggtacgaggatccggtaaggaggtgttggtggttcctttaagcacgttgacttcgagtatgatatcatcgacttcaaatgaggtttcatctacttctgatggagtttcgtcgactagtttaggtgacgaatatagtgacttcttgacgtttataaatcaacttcaagaaatggtggttgataacataaaggtagttctgaatatagcgattattgcaggagaagttctgagacccatcgatgaagtagtagacaaaaatgagctaggttctctagatccgttggctaatgaggagctccaagaccttgccttcctcgagaccctcccccggttacttcctgttaaacaaatattttccctccttaagtctcctaatctcatttgggatcttgaggcggtggctatagcccaacaccttcaagggtcatcggatgtaagtaagctaaaggctaaccttaagatggttaggaactcccttgtctctgctcttaatgtcaatgtgactttggtgggggaaaatttggatttgaagggtttggagactcatgttactaatgttgaagccttggtgaaggtgttgttccattatgaagttcctaatcaatccatatttgatatcaaaaaggatttttacaacagacaactagtccttatggatgacatttcggcttatgccatgtcgtatagtgaacaactggctactcctcctggagagacataa

SEQ ID NO: 50040 - DNA, 609 bp, Glycine max
  Peptide Sequence Number=SeqID_166818
atgaaggccaacataaaggccatgaaagagcaaatgaacacaatgatggaagccatgatgagtatgaaaaggatgatggaggtcaatatggctatagtttttgctgcaagtaccgccactgaggtggacccatctcacccttttagcctcaatcaagtaaatcgtcttgtctcagatatggtaggggagacatataaagtacctcgaggccacactctagccgacttcgagcctcacctcgatatgccacaaagggggaggcattttttagtgtacccccgccaaacgctttgggggaggcctcaatatcgcccacaacctcaacctttacactttgcaatggaaagagggcctcttgctatggtggaaagggagaaatttgatcatatagaggaaaggtcgagggtcattgaaggaggaggaaattatgcctttattgacatgacagagttgtgcctagtgcctgacatggttattcctccaaagttcaagatgccggatttcgacaagtacaaggggactacttgccccaagaatcacctgaaaatgtactacaagaaaatgagggcatacgcgaaagatgaaaaattattgatgcatttcttctag

SEQ ID NO: 50041 - DNA, 189 bp, Glycine max
  Peptide Sequence Number=SeqID_166819
atggctatttatagaaaaagccatttgggacaggggaagcttgcccaagcgagttggttgcttagggttgagggaatttcatggcccagatccgataatcgatttgagcaatccctcgaccttgcattgcaatcggtgttgaacgataaaagcattccccagacgaaattagggtctgacaatatttaa

SEQ ID NO: 50042 - DNA, 333 bp, Glycine max
  misc_feature (16)..(16): n is a, c, g, or t
  Peptide Sequence Number=SeqID_166820
atgcaatctccccctncaaaagtatcagttggtctgtgtcgtcccgacgtggggatcgcacccacaaagacacccagtggacctgaagaagtcaacagggccctgaggtttccagctctgggatcgtgcccgcaaaacactgtggacccggagaagtccaacggggtcttggggttgccagctctgattacgggcctctgtcgattctacggggtgcctgtcgcccccagcaaggtcatcaggccccctattaaccaggctttcatcaagaagtactgcgcccctaggcaggcgcagggcgaaacaccacagcagcattgggatggccggtag

SEQ ID NO: 50043 - DNA, 180 bp, Glycine max
  Peptide Sequence Number=SeqID_166821
atggtgcatgttgatcctgctaccgggaaggccgacggtccccacaggaagaaattaagaacatatttgggattgtggcgcgtgataaggtggacgtcactgatcgaggccgtacccgaatcaaaagccattctcttatcctgggttatggagaattcgtccctaacagtcaaccactaa

SEQ ID NO: 50044 - DNA, 702 bp, Glycine max
  Peptide Sequence Number=SeqID_166822
atgaagatgacgaaacagcatgtgcagcaatcacccacgtggcaaaatgtggagtcgaaatggttgtccttccaccgcggcagcagagccaagcacttgcaacaaaccgtcaatcacaaacggaataccgcttcttctctcagtgtcgtcgaaaggatcgagtacgaccctaaccgctcctccaaaactgccctcgttcgctggatcgaaggtgtctatcatcgtcaccgccacgccgcctccgccaacgccgcttcgcccaagctcctccgtctcgatcccgccgctaccgacgctaacagcattcgcggcattttcgctctcaattggatgctgccgcacgctcacgctagaccatcctccagagagctttttttatctgtgttggcgtccaagggatcggaatcggaatcgatttcttcgctcggaattctaaggtttgcggttgcggtggcaagggctctgttcttcgcgcagcgtgcgagaggggaggagacagtgtgccatgttcaggtgcattattttgctaagctgtttcgccaagctcactggcgacatgccacgtggacggccaggcaatcactagctgtttcgccaagctcactggccacatgcactaggtgtttcgctgatcgtgctgatgaaatgcttacacaaaacagatcctccacacaaaatgtttcaaaacggacccttatttaa

SEQ ID NO: 50045 - DNA, 144 bp, Glycine max
  Peptide Sequence Number=SeqID_166823
atgaagcagcttgagattgctgaattgctggagaacttgaagaaatcaaagtgccgagtacttgtccacatcaaatttttaaacctccctgaaaactattctaaacccctgacctcttacccaacctatgtgtttgggttgtga

SEQ ID NO: 50046 - DNA, 291 bp, Glycine max
  Peptide Sequence Number=SeqID_166824
atgggtacctcacatttacacttaaccatcataggagatgacgatgacgacaacgacgatgatgacccaccttttcccttcatcctttcacccatcaaccaaacaacctccgttagggttccaaaatcccaaatgcctcccttagatggagaggacgtcagaggggtagccgttgaagatgatgtcaaagcaggcggtgatgacgtgggggctgagaagtggcctccgaggtcaaggagtggttgggccttcgaaggggtaccgttgaagatggtgaggggttcagtttga

SEQ ID NO: 50047 - DNA, 162 bp, Glycine max
  Peptide Sequence Number=SeqID_166825
atgacccagatcctccgcgtcggcaagcacctccgtcgcgtgatgggcaatgacagttgctcctctgactggcggatgcagttctacgtgtccccctatgcccgcacccggtcgatgctcctcgagttcagacagtgtttcttgaataagaggatcatcggc

SEQ ID NO: 50048 - DNA, 1005 bp, Glycine max
  Peptide Sequence Number=SeqID_166826
atgattgttatcggcggtaactacttaaatatattattgcaggattatctgaaagcccctgcaaccacagacttggcttataatgcaattctggaacatactattgcagagagggagcgcagtcctgcggtagtctcaaggtgtgtggcacttttgaagcggtatctcctaagatacaaaccaagtgaggaaacattagttcagatagatcgtttttgttcaaccataattgctgaatgtgatattaacccaactcagccgtggtcacgagctttgaatcgacaatctggtgcatcaaccacatccacaaatacatctcctttacctgtatctacctttgcctctgagtcccttgtaaagtcattaagttatgtgcgttccctagtggctcaacacattccaaaacggctttttcaaccagcttcatttgctggaccaccttcatcaggacagtcactaccaacattgtcatctttgctgagtaaatccttcaattcccaactaactcctgcaagtattccagaaacacaaagttctgcaagtgttccagaaacactagagaaggattcaagtgctctatctgtttcaaggttatcaaaaattgaaaaagctgatgaaacggaagaactagggttcattgctcatgatgttctaaaatggcgctggcttgaggaaccacagtcatcatctatagggactgaaaatgatcgagctgtgaattctcaagacatgacagcacatagtttcttagaaataggtgctgcagctctacttgtaggagatatagaatctaagatgaaggggcaaccatggaaattttttggaaccgatgatatgccttacctggatcagctattgcagtcttcgcctgtaacaccaataactaattctgactctgctcgcccccatttgagagcaataacagcatctaaacgcacaaaaccgggctctcgtcagatttggcatgttcttctatcaacttgcattgatatttttcttttttaa

SEQ ID NO: 50049 - DNA, 318 bp, Glycine max
  Peptide Sequence Number=SeqID_166827
atggagcggcgcaagggttccggcagcttcttgacaacggaggatctcaggcgggagacggggattaactgcagcggcaggcacgaggagctgaagctggaaaacattattggattggtttcgattggattcggaatcatcagcatcagcgaatctggaagacgaagaaggaattattgcacatttgaattgaatgcaattgaacgattcgagaatcgagagattggaaggagcaagcaagtgcgaagccaagtactgcgttgtgttccgttagtaagtgccttttgttttgtgttggatttgagatttgagatttga

SEQ ID NO: 50050 - DNA, 3321 bp, Glycine max
  Peptide Sequence Number=SeqID_166828
atggataattatggatcatcttctccttaccggtatccaagcccatatatgtaccctcccaatcctcatcaaccgtaccctcctcctccaggttcagctcctgatccatatgcacagcatgttccttatcaaccatatccttacctttcttcacattccttcaactattcctatcctccacctcctagaccttcctcacattctggccattttgagtattcctatactcctcctcctcacccttctgattttccctacccccctccaccttattatgctcatcctccatcttatccttatccctaccatgttcctccaccaaatcatgatccttccaagccttccctttcataccatgctagtttccaacatggatcatctcattattattatcaacaaccaaaccaggcctattcagcttcggctcctgaagtccaacctgatatccactcgcacaccaatagctactctggtccctactggcaggagaacacaagcactgcagcagatgaagtgtcacaagctagtgatagttccaagccttctcagggttctgcttacccgcctttggatgatcttatgagcaatgttcggttgtctgatggccagccaactgctcctgcatcgccacctgcacctgcaaggcaaccatttatgcattccatttcagttccaaagttgcaacagaagagagaggaattttatggatattcgaataactccttctcggggtggggatcctcctaccacagtcaggtggattcgtctaggctttctgatttttctggctcatttaatgaatcaatgcatagtcagagtttgcagattgttccagtgcagaataaagggtccttgagagttttgctgctacatggaaatttagatatatggatccatgaagccaagaaccttccaaatatggacatgtttcacaaaacattaggagatatgtttggtaaattacctggtagtgtgggcaataaaattgaaggaactatgaataagaagattactagtgatccttatgtatcaatttcagtatccaatgctgttattgggaggacttacgtcattagcaactccgaaaatcctgtttggttgcaacatttctatgttcctgttgcgtatcatgctgctgaagtgcactttcttgttaaagacaacgatattgtgggttcacagctcattggcattgtggcaattccagtggagcaaatatactcaggagcagtagttgaaggaacctttcctatcctgaataataatgggaagccttgtaagcaaggtgctgtcctgaccctatccattcagtacatacctatggagaaattgagcatttatcaccaaggagttggagcagggccagaatacattggggttcctggcacatattttcctttgaggaggggtggaaccgttactctgtaccaagatgctcatgttccagatggcagcctccctaatgtgttgcttgacagtgggatgtattatgtgaatggaaagtgttggcaagatatctttgattccataagtcaagctcggcgtttgatttatattacaggatggtctgtgtggcacaaagtaaggttggttagggatgctgctggttatgcttcagattataccttgggtgatcttgtaaagtcaaagtcacaggaaggagtaagagttcttctccttatctgggatgatcctacgtcaagaagcatttttggttataaaacagatggtgtcatggcaactcatgatgaggaaactcgtagattttttaagcactcttcagtgcaagtgcttctttgtcctcgcagtggcaaacgacatagctggatcaagcaaaaggaagttggaacgatatatacacatcatcagaaaaccgtgattgtggatgctgatgctggaaataatagaagaaaaattatagcatttgttggtggacttgatttgtgtgatgggcgatatgatactccccaccatcctctttttagaacattgaatacaatacataaggatgactaccacaaccctacttttacgggtaatattggtggttgtccgcgggagccatggcatgatttgcattctaaaattgatggtccagcagcttatgatgttttaactaactttgaggagcgctggttaaaagcttcgaaacctcacgggattaaaaagttgaaaatttcatatgatgatgctttgctaaggctggaaagaattccagatgttattggcatcaatgatgctccaagtgttggtgaagataatcctgaagtttggcatgttcagatatttcgttcaattgattcaaattccgttaaggggtttccaaaggatccaaaagatgcaacgagcaagaacctagtttgtggaaagaatgtgctgattgacatgagcatacatacagcatatgttaaggccattcgtgctgcacaacattacatttatatagagaatcaatatttcatcggttcttcttacaattggagtcaacataaagacctaggtgctaataacttaatcccaatggaaattgctctaaagattgctgaaaagataaaagcaaacgagagatttgcagtgtatgttgttattccaatgtggccagaaggtgttccaacaggggctgccacacaaaggattctattttggcagaataaaacaatgcaaatgatgtatgagacaatttacaaggctttggttgaggcagggcttgaagctgcattttctccacaagattatttgaactttttctgtcttggtaatcgagaggccatgaatttgtatgataatgccggtgtgactggagctcctcccccagcaaatagtccacaagcagccagccgaaatagccaacgcttcatgatttatgttcattcaaaaggcatgatagttgatgatgaatatgtgatattggggtctgcaaacatcaaccaacgctccatggaaggaacaagggacagtgagattgcaatgggagcttatcaacctcatcatacgtgggcaagaaaacaatcttatccacatggacaaatccatggatataggatgtcactttgggcagaacatacaggaacaattgaagagtgctttttgcaacccgagagccttgaatgtgtaagaagggttaaagcaatgggtgaaatgaactggaaacaattttcagctaaggaagcaacagagatgaaagggcatctactgaaatacccggtagaagttgatcgaaatggcaaggttagaccccttcaggactgtgaagagttcccggatgtgggaggaaaaatagttggatcttttcttgctatgaaggagaacctaaccatttga

SEQ ID NO: 50051 - DNA, 657 bp, Glycine max
  Peptide Sequence Number=SeqID_166829
atgggagaggtagtgaaagtggcttatggggcgggaatgatagtacttaatactaaaaatcaagctgaagaaatttatgttgatcttcatattttgctagccacttccttaggagcctcagtaggtaagactattaaaacctatattcaatctgataagaaaccaacaacttcagtttcctttatgggaataaagtttagtgaccctgcaccagtaatgagagcattttcttctaaaggaccaagtatagtgggactagatgtgactgacccagctgtgaatatcttgggtgcttcaatgtcttgtcctaatgttagtggcatagcaacacttcttaaatatttgcacaaggattggtcccctgcagctatcaaatctgctttgatgactactgcttacacattgaacaacaaaggagctccaatttcatacatggcctcagataacaaagcatttgccaccccctttgcatttggttcagaccatgttaaccctaaagcagttcttcacgctggtgacttgaactatccatcatttgctgttctatttggcaaaagtgccttaaatgctagtgtgacatgtttgcaaaattatactttcatgtgtaatttcttgaagttcaatatgcaagaaattacactacatgatcttggataa

SEQ ID NO: 50052 - DNA, 954 bp, Glycine max
  Peptide Sequence Number=SeqID_166830
atggctacatggtatttcaaagctttgaggattaagcttttcaatgtcgggtatgttttagattctcggacagctgctcctctcattctttctatgcttgaggatatgcttagttcttctaaaacagcatgcagggttcgtgcttttgatttaattctaaaccttgcggttcatgcacatctcctagaaccgatagttgctgatgatgcttccactattgaagaagaatattctcaagaatcctattatgacagtgacactcaagttatggtgcaaggaagcagaaaaggaagttctcagaacaaatcagacacaggctctgcaattgataagtttgagtcttggattttaaatattctgtatgagatactacttcttcttgttcagtctgaagaaaaggatgaatctgtttgggcatctgctctcagctgtttgctgtatttcgtctgtgatagaggaaagatcaagagaaaccgtttgcatggtcttgacataagggcacttgtaagaatcagtagggagaactcctgggcagaattagttcactgtaagcttatttccatgttaaccaacatgttttatgaagttgctgaagttgctgagtctgtatctggcaaacccaagtttcttgtgaatcaacttgatctgattggaggagttcaatttatttttattgagtattcccttgcaaactcaagagaagagaggaaaaatctgtattcggtgctttttgattacattctgcatcaaataaatgaaacatgcatagctactggtgtcaatgattatagtgatgatgagatccaacctcttgctgctcttcttgctcaaacaaatgcacctgaggcattttatatttctgttaaacttggggtagaaggtattggagagattctgagaagatcaattgcatcagcactgtccagatatcccaacagtgaacgactaaatatg

SEQ ID NO: 50053 - DNA, 1371 bp, Glycine max
  Peptide Sequence Number=SeqID_166831
ctactggaagttgtagcagagaaatttgatgctgtaataagtacgttcactcatttggacaaagagttctctcatatgaatcagataaccaaatctctcaagtttctggaaaatatggaaggtgtggttatgagaaatggcattggtttgcaggcaaagcactcctgggctactttacattctcttcttcattctgaaagaatttcttaccgtcaaaatgggtatatctggttaggtgatctgcttattgctcaaattaatggagaaagagatggaaatatatggtcaagtatcacatacttccagaagaaaattgctcaagctggaactcaagattcttcaaatacatcagatgttcctttgcctattttacttatgtgtggccttctaaaatcaaaatacaactacattagatggggatttttgtttgttcttgaaaggcttctcatgagatgcaaatttttgttagatgagcatgaaatgcaacaaacaagcaacagagatctgggtcatggaaagaaagattggcatcttgagaaagccaatgcaattattgacataatgagtggagctttgtctttggtgtttcagataaatgaaacagatcgcatcaatattctaaaaatgtgcgacatactattctctcaattgtgccttagagttcctcctgctgcatctctgccctttggagatgatgtgcgacatggcagaaatttcaatcacgttaatttaagcaaaaggtttgatggtgataatcatgccaaacaagatacttttcactgggatggacacaaggaagaagcaaatagaagatccggctaccataataactaccacctggatcacgagactgcatcaatggcagcacttttccaaggacgagccgttgtcccaatgcaattaattgcacgcgtccctgctgccatactatattggccactaattcaattggctggagcagcaacagatgatattgctttgggtgttgctgttggaagtaaaggaagaggaaacctgcctggtgctacatctgatattcgggccacacttcttctactacttattggtaaatgcacagtagatcctgttgccttccgggagcgaatgatgaccgagaagccagagaaatatcaacacatgcttcagaatcttgttgttaaggcacaacagctgatgtgggacttgggtttttcccaatacacccctcgcgcccagctcttcttgggcttggctaggcaccccaacaccaaaaagctatgtgctaatccccccctaaacacagagcccttccctaatattgctggaccagaagtggaatggagtatgaaatcctttttccaaattcttaagccatgtccagcagaggaataa

SEQ ID NO: 50054 - DNA, 204 bp, Glycine max
  Peptide Sequence Number=SeqID_166832
atgggaagcggggtcggcatgggtgtgtctggtggtggtgacttaggagaagtgggtgcaggattctgggataaggtggtaaagccctgggtgaggcggttcaccacttcctctaggcgatcaatggtgtggcgggtagtatgctccggcatggtgactgtgggcagagcaggttggaggcaggtcagaccaattgataggtaa

SEQ ID NO: 50055 - DNA, 1890 bp, Glycine max
  Peptide Sequence Number=SeqID_166833
atgacaattacgctttcaccctctctctctgtaccccacccttcccctttctccctcaccccaaccaccaccctccgccaactcttcttcactaacttcacaccgtccccgagacgcaggctccaactccaagcacgtgcgggaaagcccaatgtcctcatccccataaacccctcggtggcagttgagaaaggaaagtacagctacgacgtcgaaaccctaatcaaccgcatcaccgcgctgccgccacgtggcagcatcgctcggtgcctcgaccccttcaagaacaagctctcccttaacgacttcgccctcgtcttcaaggagttcgctcagcgtggcgattggcagcgctccctccgcctcttcaagtacatgcagcgccagatatggtgcaagcccaatgagcacatatacaccatcatgatcacgctattgggccgagagggcctcctcgacaagtgccgcgaggtgttcgacgaaatgccatcgaacggcgtcgctcgcactgtctacgtctacaccgccgtcatcaacgcctacggccgcaacggccagttccacgcctcgctcgaactcctcaacggaatgaagcaggagagggtctcgccgagtattttgacttacaacactgtgattaatgcttgtgctaggggtgggttggattgggaaggcttgttagggttgttcgctgaaatgaggcatgaagggattcagcctgatgttattacttacaatactttgcttggtgcttgtgctcatagggggttaggtgatgaggctgaaatggtgtttaggactatgaatgagagtgggattgttcctgatattaatacttatagttatcttgttcagacgtttgggaagttgaataggcttgagaaggtttcggagcttcttagggagatggagtccgggggtaatttgccggatattacttcttataatgttttgttagaggcttatgctgagttggggtctatcaaagaggcgatggacgtgtttaggcagatgcaggctgcggggtgtgtggcgaacgcggccacgtatagtgttttgttgaatttgtatgggaagcatgggaggtatgatgatgttcgcgatatttttcttgagatgaaagtgagcaacacggaccctgatgcggggacttataacattctcatacaggtatttggggagggtggctactttaaggaggtggttactttgtttcatgacatggtggaggagaatgttgagccgaacatggagacttatgagggcttgatatttgcttgtgggaagggagggctctatgaagatgccaagaaaattttactgcatatgaacgagaaaggaatagtgccgagttccaaggcttatactggggtgattgaagcgtttgggcaggctgcactgtatgaagaggctcttgttgtgtttaacactatgaatgaagttggaagcaacccaactgttgagacctacaattcattcattcatgcatttgcaagggggggactgtacaaagaagcagaagcaattttatccaggatgaatgagtctggtttaaaacgggatgtgcattcattcaatggtgtgatcaaagcttttaggcaaggaggtcagtatgaagaggctgtaaaatcttatgttgaaatggaaaaagcaaattgtgaacctaatgagctgacacttgaagtggtgttaagcgtatactgctccgctggtcttgttgatgagagtgaggagcagttccaagaaatcaaagcttcaggaatactgcccagtgtcatgtgctactgcctgatgctagctctttacgccaagaatgacagtgcttatgcctcccccattgcaaattgtacgattgttagtgttgccctccccttccttatgttgggttag

SEQ ID NO: 50056 - DNA, 198 bp, Glycine max
  Peptide Sequence Number=SeqID_166834
atggttacgcagtggcatggtgttgttgaacgcagagtgtggtggaatgaatgggaaatggaggtggtggaagaagatggagtctgtaacagaatggaggaaaggacacgtgggcccgttttgaaccgggtttggttatccggagcatttggcggtaacggatttttaaacgaccttcaagcgggagaaatgtactga

SEQ ID NO: 50057 - DNA, 249 bp, Glycine max
  Peptide Sequence Number=SeqID_166835
atgggtcatcaacaaaggctaaattctggaacttgtgcatctaagcttcccctgaccaaaccaccataccttggtgcttggacagtggctgatgctatgttggagttagagacaagaatgaaaatcggaatcaaagctattttgggactgcaatggtggggttggcttgcttccaacagttgggaccccaatggcatatggtttcagcttccaaagtctattcaccttgaggacaaggtgaaactttag

SEQ ID NO: 50058 - DNA, 492 bp, Glycine max
  Peptide Sequence Number=SeqID_166836
atgaagttagacacaaacagtggtataaggggaaggactttatttgtcttaattggttgtgaaagaagtgaccaatataggtctaggaagaaagattttgaaagaagaaatattgatagtaggaaatgtgggtgtccctttaagcttcgtgggaaaccagtgattggaggccaaggatggatggtgaagttaatgtgtgggagtcataatcatgaaatagaaaatatattcattgagtgtgtacattatgctggcaaaaacccttctcgtcgcggatgtgtcatgagaactaatcacggtcttccagatgcatttactctaaagagtaaattccgggaaattgcctatcctgatctaaactctatgtgtcctcctccagaaaatgtcaacaccaaagttgctcaaaagaaaccgatgaccaaacatcaaagatcaacaaagtttgatcatcatctgaccaaccaattccaagaagaactatgccgatgttga

SEQ ID NO: 50059 - DNA, 1689 bp, Glycine max
  Peptide Sequence Number=SeqID_166837
atggaggactccgagaaattgacggcgttgaagaaggcctacgccgatatcatcctgaacacggcgaaggaggcggcggcgcgtatcatggtgtcggagcggaaagccacgcgctttcagcaggaacttgtttccactaaggaagaggcgcttcggatgcttctcagactcaaacaaaagttcgattctaagagggatcaactggcacttctgcaatttcctaactctccaatttacacgtacatctggtttgagaatgaagctgagttgtttgtgactgtcagtgaagcagagctgacgtcattgaatcagcagaagaagattgaggagcttgaagctcagctccaggaagctgaggaaatagttagagatctaagggcagagttgagagaaacccaggctgagctggagaatgtcacaaaacaccaaatgcatcccccagttgaacaaaacacaggggctgaaattgaagctcaggaaatttttctgcaagagaacagacttgatccttatgatggatctgtatatactgcacctggtttacagtttgaatctgtctctatttctgacaataggaatccagttgtaaatggatcaaatgatagcagtaagttctgtgggtcacatgatcatacaaacaactgctacattcataatccagattttgcatccatagtcattaggaggaaagagcccaagctctacagaaatggatgcactcagagaatacatgcatttgaaaggagcctttttgatggaaatatgtctgtttcaggaaacttagataatgtacagaatgaaatggtagtcagtgtacatgaagaaggtaaagcaatgactgtatcaactaatgccaaagctgatactatttctgaaaaggagaaaccagatgaacttaaagtggtgaaagcagatgctgaccttgtcaaagttccagttcaaagaaaaaagataaaatttgggaaaaggaacgctattaaatctagattacattctaaccaggttaaggaaacaaataaagaatcacatctgtctggtgccaaagattcttcacttgtattggataatgatgacccctcaagggtaagttcttctatgacatgtgaaaatgaagctcagaaggatctaatgtctccttttgctgatgtaccgacggacacaactgcaacgaatgagcaatcaggacctcatagcaatactgaaaatggggaagtctttcttaaagcttgcagtatttggaacataactaaagatgacaacgaaccgttggataaatcagatttaacaagacaagagagtttgtctgctgaaagtgtggaggttccggcttgtaaagatgttgaggcatctaatgggtcactggataaaatggatccaaaagtatccaatttagatgagaaggtttctaatcgatctacaggtgataagtttaagtacacattctgtagaaagcgtaagaaggaggctgttagctgtgatgatgtagattgctctcaagataataccagttcaaagaaaaagtgtggggagaagcaagatggtcatgtggagcctcagaaatcttgcacaatgactgaatcatctagggacagccggcggctagcacaagttgctcgtcaggagaatctggtgcttggtttcagtagtaacttgaagagaatggggtggggatacaaggggtttagttga

SEQ ID NO: 50060 - DNA, 1833 bp, Glycine max
  Peptide Sequence Number=SeqID_166838
atgtcgtcgacaccgcagagcttaaagcagagagtcttcagatgcctaaccaaactctccgaccgcgacacgcagtctctcgccgctgcggagctcgagtcaatcgctcgaaacctcgacggagccaccttgccgatgttcctctcgtgcatgtactccaccgacgactccgacaagccaccggtgcgcaagcaatgcgttcagctcctagggttcctcgcggagacgcacggcaacatgctcgcgccgtacctgccaaagatcctcggcagcgtcgtgcgaaggctccgcgatgcggactcgtcggtccgatcggcgtgcgtgaattccattgcggcattgtcacgccacgtcagcaagccgccgctgaatgcgtttctgaagccgttggcggaggcgcttttcacagagcaggaccagaacgcgcaggccagcgcggcgatgtgcctcgccgccgcgatcgacggagctccggatccggacccggctaggctggcgaagctcctgccgaggttcgagaagcttctaaagcgcgacggtttcaaggcgaagcccgcgctgttgacgcttgtcggaagcgtcgtcgccgccggcggcgcttccggccacgtgccgctgaatagtttggttccgtgcttggtggaagcgttgagcagcgatgactgggcgacgcgtaaggccgcggcggagacgctcgtggtggttgccgacgtggagagggatttcttatcggagttcaaggctgagtgtgttagagttttcgagaatcgacggtttgataaggtgaaattagttcgggacgttatgaatcagatgttggaagcgtggaagcagattcctgatgtttcggatgaagtttcgccacctcctaaatcgcaatcttcttccaaagagaatgcaagtgatgggcgctatccccaagtctctcacaattcatgtagtcctcgttcaatgatggccaatttgcggaggaaatctactcctttcagcagattcagtccagcagatagttcttctgctagcaatgctaagaattcgagtgcttcaagtagtaacaagagaagattgtttgtttcacggaaattaaaccatatgaattgggatgctccaattgctatggctgatcagggagatcttcaggagagggatggaattgttttggataggagcaaaatggataaaagcagagtttcaaagtcagaaatgaaacgggtactgctaactaaaagttctgaggataaaatgcaaaagtatggtgggtccaaagctggatctcgtgtggttccatatcatgaagatgagagtcaagactcagttcctgtcagtattgtctctaaagatctccaaaggaatgacaaagagagtgaagatttatcgctgatccgtgatcagttacatcagattgagaagcagcagtcaagtctactcgatcttctacagaaattcatgggaagctcacaaaatggaatgcgttctttagagactcgtgtgcatggccttgagttggcattggatgagatctcttatgatttggctatatcaagtggaaggatgactaaatctgatgctcagggtaacgcatgttgcatgctacctggagcagaatttttgagctccaaattccggaggaaaacacatggccgggattcaatcgtgcgattctctagatcaggtggcaccccatcacttgctgccatgaactacccacccaataggaatgctgaaactaagttgacaaaccacagatttaggcctgacggaggcttcatcactaatccgcttgcagagattcatacgaattcgaggaattttgcgacattggagatagcttaa

SEQ ID NO: 50061 - DNA, 492 bp, Glycine max
  Peptide Sequence Number=SeqID_166839
atggatgttgaatctagcttctcacaaattgctcatctctttgatggggagagttatgacctttggaaggattatgaagtgtcttcgtcgcctgaaaatcccaccatggtccaaataaagcatcacaaggagaaaaaaatcaagaaggcgaaggcaaaggcatgcctatttgctgatatttcttatttgatcttcaccaggatcatgaattcacccaaagaaatttgggattatgaagagtatgaagggaatgagcacgtttgtggcatgcaagtgctaaacctgatgagggaatttgagatgcaaaagataaagaaattcaagacaattaaaggatactcggacagattgtttggcatcgctaacaagattacaaaggatttgtccaagatctcgttgacagaggtgatacatgtcttgcaagctcaagatcagagaagattgatgagggaagaatcaaaagttgaaagagttttacctgtcaagcactag

SEQ ID NO: 50062 - DNA, 1644 bp, Glycine max
  Peptide Sequence Number=SeqID_166840
atgtcagccccaagtcaaacaattgtaataacagcgacagctactgcagccactatgttactttttgctgtgacatttttttacttccaaaaatttgttcttgctcgataccaccatcggtacatagttgcaacaagttttcttagagaagcaggattgaacaatgaggatataaagaaagttggtggcaatatgaaaggattacttgttgaagaaaatgggattgatattctgtatatgatggaaacagaaggtgggcaattcaaaactagatttccaaatggaagatacaatcctagttatgaagacgatgaagaaaagggaacagatataatggtccagagatccaaacgaattaagcctcaggatgttacagttccactgccttgtgaaattctagggtcagcctctatattgggtaaggttgtagctaatgtaggtcattcaacagtgtgggatcagatcagtgatcgctcattctggaaatccgtgatgcactccatgttggccaagaacatactcagtgctgagacacttgaaaaactcgctaaaatagctcctacccaagaagaagccaaaatcatgcaattcagtgataatccggataaacttgttgatgctgagtcattcctctatcacatcctgagagcagttccaacagcattcattcatttaaaagcattgcttataagatcgagttacggttgcgaagttattcagcttaaagaacacctaaaaactcttgagagcagttccaacagcatcctgagagcagttccaacagcattcattcatttaaaagcattgcttataagatcgagttacggttgcgaagttattcagcttaaagaacacctcaaaactcttgaaatgggttgtaatgagatgaagactagtagtctgcttttgaaattccttaaggccattctcaaagctggaaacccaatgaatgttggaacttcaagaggcaatgctcatggtttcaacttaagtgctcttgaaaagctctctcatccggtagctcagtttgaagcaagacaacaagctagtaatcaaaagcacaaccttaacagtagcactggtgaaacaagcaacaccaatgaaccacattcagataaccgggtacaaaaagaggaagttaaagagtatctagtgttaggaggtctaagggacgagttatgtgaagtaaagaaagcagcaagcattgagcatcagaatttctctagtatgtactctattcccaatgcttatgttactaaaattcgacagattataacatgctttggcaacagtgagaggggtggatttattaaggtaatgaaagggtttccagaggaatgtgaagtggagcctaaggtggtgagagaggaacaagaaatggtcatggaactgctgaagaaaaccaatgagtattatctaacaggaggttccaaagataacatatcgaacccctttcaactgtttattacagtaaaagaatttcttgacatggtagatgaggtttgcaaagaacttagaaggcagctagaaaaaactaatgcaggaggagaagctgtatcaacaccaccactttcaccatcaaagagggcaccactcagattaacaaacttcaattacattttcggccaagcacgtcaggagtaa

SEQ ID NO: 50063 - DNA, 450 bp, Glycine max
  Peptide Sequence Number=SeqID_166841
atggagatggctttggcgcttgcacctcccacaaaggtgcaagatctttctatggctgattttgcattctcaccttgtcccttttgccgcggacacgagactctccttcatgtgttgcgtgattgccctcgagccgcaagcgtgtggcttcctcttgttgctccacaacaccaacgtgccttcttctcttactctctatggaattggatggtgacttatcttcagaagccttggtccattgttaactcgaatgatgaagattgtgttttgttcgctgctacagtttggttgctgtggaaggatagaaaaagttgggtctctgacgggtgtggtctttgtttttcctctgaaagagtgcttcatcgtgtgggtgctctagctgatgattatgggggagttgttgaggttgaacactctgctcctagcccttctgtacgctgtgtttcgtag

SEQ ID NO: 50064 - DNA, 2901 bp, Glycine max
  Peptide Sequence Number=SeqID_166842
atgaatgaagcatcaatcaataacacggagagttacctatacctccatccgagcgagaacccgaccattgcccttgtttccccagtcctagactcaactaactaccactcatggagtaggtccatggtcactgcattaagtaccaagaacaaagtggagttcatagatggaagcgcgcctaaaccactgaagacggatagaatgcatggagcgtggcgccggtgcaacaatatggttgtttcgtggatagttcactcagtggctacctccatacggcaaagtatactttggatggacaaagctgaggaaatttggtgcgacatgaaatcaaggtattcacagggggatcttttgcgaatctccgatctccagcaagaagcttcaacgatgaagcaaggttcacttacaattactgagtatttcactcgtctacgcatgatttgggatgagattgagaactttagacctgatccaatctattcctgcaatatcaggtgctcctgcactgctttcaccattatcgcgcaacgaaagctcgaggatagagctatgcagttcctgcgaggcttgaatgaacaatacgctaacattcgttctcacgtccttctcatggatcccatacccgccatatccaaaatattctcctatgtagctcaacaggaaaggcaattgctaggtaacaccggaccaggtatcaacttcgaacccaaagacatctccattaacgccgcgaagaccatttgcgatttctgcggacgcattggtcatgtggaaagcgtgtgttataagaagcatggagtgccctctaattacgatgcgaaaaataagagtaacaatggaagaaaaacgtgcacccactgcggcaagttaggacatacagtggatgtctgctatcggaaacatgggtacccgccgggatacaagccttacgatgaaaggaccaccatgaacaacgtagtgacagtagaaagcaaagccactgatgatcaagctcagcatcatgagtcccatgagttcgttcgcttctcccctgagcagtacaaggcactactcgccttaatccaggagccatccgccgagaacacgacacccaatcaacccaaacaggttgcatcaatttcttcatgcaccgtcaatactccaataaacctagtgtctagaaatgtcatgttttatgaagatcatttcccatattattctgaaatccagcatttaaacccagataattcagctccatctccgggatccttttccggtaagaaccttgacccaccaatagaaaactacccatcacgacccacgatatcagtaccctcatctaatgaaccttcaaatgagcaacctcttccacaccttaggcgttccacacgagcaaaacatgccccgacatatctccaagactatcacagagaccttgcttcatctacatcaaatgcttcggcggttgttcgttatcctctaagttcagtgttttcatactcacgtctctcacctgcacacaggaatttcgtcttgagcatctcatcaacaacagaaccctccttatacgccgaagcttctcgccatgactgttggattaaggcgatgaaggtcgagttacaggctctccagtcaaacaacacaaagacacaaagcgcgattagttgcaaaggggtacacccaaatggagggctggatgtcaacaatgcatttctccatagggaacttgacgaagaagtgtatatgcaaatcccaccagatctttcggttgataatccgcagcttgtatgtcgtcttcaacggtctctttacgggcttaaacaagctagcagacaatggttcacgaagttatctagcttcttaacctctcacgggtttcaacaatccaatgcagatcactccattttcttgcgcttcacaggagccatcactacgatactcttagtatacgtggatgatatcatcctcacaggaaacagcatagctgaaatacaaaccataatcaccctcctggatcaagagttcagaattaaagaccttggagatttgaagttctttctcgggctcgaaattgcacgcacctctgatggcatccatctatgtcaacataagtataccttggacattttatgtgactcaggtatgctaggttgcaaaccaaactcaacaccaatggattactccacgaagctgcaaatgaactcaggaaaccttctttcgactgagtcttcatcctcctatagaagattaataggcaaactcatatacctcaccaacacacgcccagatatcgcatatgcagttcagcaactcagccaatacatggctacttctaccaacactcatcttcaagctgcctttcgcatccttcgatacctcaagggtacaccaagctcaggactcttcttcgctgcgacgggcactccccaacttcaagctttcagtgactcggattgggcagggtgcaaagattccagaaaatctactacgaggttcttggtttaccttggttcttcccttgtctcttggcaatcaaagaagcaatcaaccgtgtcgcgcaactcctctgaagctaagtatcgagctctcgcttctaccacttgcgagctacaatggctgacttatctacttcaggactttcgcaccacattcattcaaccagcaaccttatattgtgacaaccagtctgcaattcaaatagccacaaatcctgttttccatgagcgaaccaaacacattgagatagattgtcatattgtccgtcacaagattaactcgggcctcgtcaaactccttccagtttcatcatccctgcaactcgcggatatattcaccaaggccttgacgcctgccatctttcagcacctttgtaacaagctgggaatgatgaatatccattcccagcttgaggggggctcttaa

SEQ ID NO: 50065 - DNA, 969 bp, Glycine max
  Peptide Sequence Number=SeqID_166843
atggctattaaacttgtggaaacagctattgaatctattgattcttttgtctatcgtgaatctgtaaaaagtgaagttaatctcaggtctgctcaactttttgctctcaatcatctcagatgcatggctgcccttgataacaaagaatgctttagagatttgctggataaatatgttgagcagtatccttcctgcatagaattggtcctggcatcagctcttatacagaaacaggatattaatgttgatagtttcatgggatttgaggaagccattaacagatggtcaatagaagttcctggaatccagtgcatctggaatcagtacattgaaaatgctatccacaatcgaagaattgatctggcaaaagcaattacaatctggtggttcaaatctatttggcaaaatgataaaacagcagcatgcattgctttggacaaggctaagagtactgctagttttggaggtttagagcaatgtataaagacatatgtaatgtttctggtttatgatgcgtggagcttgaaggaggatggttctgatggtgccatcaagaagaatttggagttgtatgctgatggttcctctcaagcattgctagttcccaagttatggtttggttcatctattttaccacaaactgttagtgaccccaaacatctggtggattttgttgaagccattatggaggttgttcctcacaacttcccattagctattgttgtttgcaagctactaaccaaggaatacaattctgactcaaactcagccagtctatggttttgggcttgttcaagcctgctaaatgcaattttggatgccatgccaataccacctgaatatgtctgggtggaagctgcagagcttttgcacaattctatgggcattgagacaatatgtgacagattttatagaagggctctatcagtgtacccattttctatcatgttgtggaaatccttctattag

SEQ ID NO: 50066 - DNA, 375 bp, Glycine max
  Peptide Sequence Number=SeqID_166844
atgttgatctatttcctcatttcagataccgaatcagccaaagcatctaggcaacagcttaaagaggcaatttacgcttccttgtttgacatgaatgttcctgctgtttgcgccatcaaccaggccactctagctctgtatgctgcaaaacgaacttctggaatagttgttaatataggttttcaagtcacgtctatagttccaattttaaacggtaaagtaatgcgcaaggtgggtgtggaagttgtggggctgggagcactgaaacttacaggatttcttagggagaagatgcaactgaataatttaagttttcaatctttgtacactgttcgcacattgaaagaggtattgatattcatctttgtggtctga

SEQ ID NO: 50067 - DNA, 621 bp, Glycine max
  Peptide Sequence Number=SeqID_166845
atggaggaaggaaatgcttggagaatagaagatggtagaaccgtggatgttaaaattgacaaatggatcaatcggttgttagatcaagagaaaaattcctggaacatggagcttttttcccaaccttttgaccaaccaacaatggaagcgattaaagtaatgccacttaggtggacaatgacaacgtgtagtattttctggaagcacacctccaatggttattatactgtgaagtcaaggtattttgtggcaaataacaaatactcccgtcttgagtcaccatcttttcaagaagagtcaaccatgcatgctctagtctactgtggtgaagccgctgtgtttgtttgcatcaccattgagcttgcaaactggggaggagagataaggagagccttgccagcttcaagccacccccgttctcctccagagagtgtaagtaataacaggataaggtggaatgctccactcgatggtatcttcaagatcaattttgacattacaattccaaaggaagtgtctcaagctcattgtagagaatctaaaggtcatgtattggtggcgacaatgaagctcctcgaatcaatcttggagccaagggaggtagaagcctatgcattctga

SEQ ID NO: 50068 - DNA, 345 bp, Glycine max
  Peptide Sequence Number=SeqID_166846
atggtagtgggaaatgcaactatagaaaaacctagagaagaatggaatgatgacgaaagaagaaagagattcaacaaatttttgagaaataaaggaaatcaaaggagatcaaatatcaatccaaagaagaaaggagaagattcctacttaaccccaaaatgcgatgaatgcgatcaacctaggcacttacgattaaattgtcatgtccttaaaagaagaatggaaaaatctgacaagagcaatttcaaagaaaagaaagcaagcatcacttgggaagataatgacatggattcttcaagtgattcagaaaataaaatcataaatctgggtctcatggcacattga

SEQ ID NO: 50069 - DNA, 1566 bp, Glycine max
  Peptide Sequence Number=SeqID_166847
atgtcccgtcaccaaggaggtaatgctgaagatatggcagatgaatttgaaatggaagatgtagaagacgacatggatgatgaatctattgatagagaaaggggtggtgtagagtctgacatagatgattatgatcactcgatttctagggctaatattgtagttttggtacagagtggtaagggagtagacactacagctgctcaggccagaagaggacaggatatccagggaattccttgggatagccttaacatcactagagaaagatatcggcaaactaggcttgagcaatacaagaattatgaaaatatccctggttcaggggacaagtcggggaaggattgtaagaataccaaaaaaggatactccttttatgacttcagaaaaaattcaagatcagtaaagtcttcaattcttcattttcagttgaggaatttggtatgggctacatcaaagcatgatgtataccttatttcacagttttcaataatgcattggtcctctttgacttgcaaaagttcagaagtacttaatgtttcgggacatgttgcaccatcagagagacatcctgaaagtttattagaaggttttactcacactcaagtcagtacacttgcagtgaaggagaagcttctagttgttggaggatttcagggtgaacttatttttaaggtatatgaccaaatactccttacaagacttgatcaatcatattcccttgagttagcttttgggtttgggtttgggttaggctctgttactctgccagatgctgctaacttgtccctcataggaattgttcttggtattagaactatcaacagatatcaagattttatcaccttctttgttactggaatgcagcacctagatcgacctggtgttagcttttgcacgagaacaacttatgatgataatgctatcaccaatgccattgagatttatgattgtcctagtggtgcagttcatttcacagccgctaataatgatagtggagtgagagactttgatatggagaaatttcagctttctaagcatttttgttttccctggccagtgaatcatacttctctcagcccgaacggtaagctactactaattgttggagacaatcctgaatgtatgttagtggactcccaaaatggaaagacaattgttcccttatctgggcactttgattattcatttgcatcatcatggcatcctgatggtgtgacctttgccactggaaaccaggacaaaacctgccagatttgggacttgcggaatttatccaagtcagtggctgtgctgcagagcaacattggagccatccgttcaatcaagtatacttcagatggccggtatatggctgttgcagagcctgcagattttgtacatgtgtatgatgtaaaaagtgggtatgagaatgaacaggaaattgatttcttcggtgagatatcaggcatatctttcagtccggacactgagtccctgttcattggggtctgggatcgcacttatggtagccttcttgagtatggccggcgacggtattatgcataccttgattcacttacttga

SEQ ID NO: 50070 - DNA, 363 bp, Glycine max
  Peptide Sequence Number=SeqID_166848
atggcgtggaggtttatgggccatagttttgcgtgtggcgatggtgggtttagtatggtgtggaggtggtgttgggtagttgtggtggtggtgtttgagtgcaacaatgtggtggggtgcaatagtcatggaggtttgggggagatgcaactaggtttgcttggaagaggaagggagtttaaaggagggaaggaagaggaggtgatccaattactagagttagaggaagatcataacaatggggaggagaatgaagaggatttttggttgatcaggaaggttctctcaaacagcaatgtgaacccaaaaggtgttctagacctcaatgatcaagcgtggaaggcaagagggagtagagattag

SEQ ID NO: 50071 - DNA, 390 bp, Glycine max
  Peptide Sequence Number=SeqID_166849
atggctatgtttggcgatttcaacgttatcctaaacaaagatgaaaaagatggggtaaactcgttaccattttgtggcatggaggaccttggctttaaagtgcacaagtttacatggagcaaagaaaggagaagtggagacaacattaaagagaggttcgatagatttttatcaaatgggagtagagttaacctagaaatgatggaagttttagaagaacatttcactcttgaagaggtgaaggaaactttggcacaaatgcatttgttgaaggcatcgaggaccaatggtacactagccttgttttacaaatctttttgggagctaattcgtaatgatgtgacacacaaggtcttggagatccccaatgatggtgaagaccctgcatga

SEQ ID NO: 50072 - DNA, 402 bp, Glycine max
  Peptide Sequence Number=SeqID_166850
atggagctaaacattgtaaggatgaataatgaggaagtcaatttcaacattagagatgtaatgaaacatctttttaaccttgattattgtttaaagattggtgtggtttatcaattagtggaagaagacgtgagtagacacacttcttttacaccttttaaacatgtggttgtgaatgtcattgaaaatcttgatgaggctaagcaagatgagaaaaaggattgtttaacctggttagaatctcagagtttggaagcatgtttagatgagggaaaacatgatgtcattaaagagaaagagaaaacaagcaaagaatgtaatgcaaagattgacactagcagcttgggacaatggatctacaatggagaggattcttcttaccaacaacttctacgtcaataa

SEQ ID NO: 50073 - DNA, 390 bp, Glycine max
  Peptide Sequence Number=SeqID_166851
atgcaggcagatgaagaagaaccagttgctcctgaagcagtactagcaactagagaaggggagcgaaatggcaagacaattgctgaagctcaactggtaggggaggctacttgggaggcatcagagacagaaacgatcaaagagaagctcccttctctctgcgttgaggaaaatgcagaaattagagagggtgatattgatgggaacccagttcctatggttcttggacagtctacaattgagaaacctcttaaggtctacactaggaggccaaaggcccaagtgcctaaagctgaacaccctaagaaggaaatcactgaagcaaatgaggaacagtgtagacataattttggttcatatacagctgttagtttggggaacacgaaatag

SEQ ID NO: 50074 - DNA, 246 bp, Glycine max
  Peptide Sequence Number=SeqID_166852
atggaatttcgtaattttgacacaagatgcactggggagttattgaagcacatggacaggcagaatgaggtccttatgcaagcatatagatccatgttccatgaattgcggaaacttcaggttgaagaagaaatgcttatgcgcaagatgcatgaagttatgtcagctcatgatcccactaaaagtcctactagtgagaaacatcttaaggtctacactaggactgtaggagacccaagtgcctaa

SEQ ID NO: 50075 - DNA, 285 bp, Glycine max
  Peptide Sequence Number=SeqID_166853
atgaagcaaattcgatctcaatacaagaataagctttatcatttacatcaagtttatcttaaagaaaaggatagaccaaaatacgtatctctagaatattggaactggctaattaaaaacaagtggagtggttcaaaatttcaggaaaaaatcttgacaaacaaagctaatcgaagcaaacaagaaataaaatcaattattggcacaaaatcaattgtgcaaaagacatttgaaatgaaagaagattcaatatctggtgaatggccagatggtgtggaagtttag

SEQ ID NO: 50076 - DNA, 210 bp, Glycine max
  Peptide Sequence Number=SeqID_166854
atgcctaataggagtggaaaaagaaaagaaaatcaagataaagatgaatggagtgaaggaccaattgagagaaagctcatcattgatccattggcgccacattgcaaggctcaaaggaaagagttcactcgtattttcctaggctcttgttgtttgaacgtttttctatcaaacaactattggtcgacgaaatatgaaccaaaagcttag

SEQ ID NO: 50077 - DNA, 300 bp, Glycine max
  Peptide Sequence Number=SeqID_166855
atggcctatcaaacttgggaggtggaacaaggaagtcttcaagatcttgaatccattgacttggttgatatctatcctgatgatgttgtgtcttcataccaaaaggccttggagatgtataatgttggtaatattgtcagaaatgtttactctagggcaactaagaactgcccttgggttggagctctttgggttcgatatatgctttcattggagcatgttggtgcttttgagaaagacttgtctgagatattttcttggaaacaacccacttttataggaaaatttcccctttcttga

SEQ ID NO: 50078 - DNA, 768 bp, Glycine max
  Peptide Sequence Number=SeqID_166856
gaaggaaagaagggagttctcttctcatgtggggactacccaaacattctgttgatagggacgaggggttgtattaactacaatcctgcacttgctataagacagttagggtaccccatgaggggagcaccgatggaagagagcctctcgcctttccttgtgagagatttcggcgcgcaaagtttcaagattgtacaaagagtccacaaggcgtgggaaagcccgttaagaaaagataaagaacttaggggcatccataatggcatcatcggtggttatcatgaatggctgaaagttcatacacgagggttagattggctctccaagttgaaaattatcaacgagcagaacttcgaagctccggaagaggatgaagaagtccgagctctaaaaacagagctaggaaaggcaagactcgccaaagaaaaattcaagttagtcgctacagacgtccggaaatgtgccgagttacaagaagaaaatgcagctaccgcaagagcccttgaacaagaaaccaagagggctcgcaaggaagagcatgaccgagacaaattctgtggagctttgtggggcagcaacaaggaactcaagcttcgaagggaagagagagaccaatcacgagtacatagcatggtcttaaaggaggagttagctgcttgctcaagatccaagaggagttttggcccaacacttagaagccacggagcaaagcatgccagctataatagggcagtacaaagaagagttaaactagtctttgacccatga

SEQ ID NO: 50079 - DNA, 165 bp, Glycine max
  Peptide Sequence Number=SeqID_166857
atggataagagcttgaaggtaggagaagatgagtggagagaaaggaagagaaggagcacgaaatttcgtgcctcaaatgagttatggttcagcccactaattcatgatcaagtccaagattctctactaagtgtgcttagatgtcatgaggcatgtaaagcatga

SEQ ID NO: 50080 - DNA, 1254 bp, Glycine max
  Peptide Sequence Number=SeqID_166858
atgaatgtgacaaataagccaaacccagatggttccaccaatgggtttcagtctcagcttcaagttcaacaacaaaatgggtgggagcagggatcatctagactcagacccactaaaccttaccctgcaccaacggctcggtaccaggacattgttcgtgatgcaaacctcttctggggaacgcttcaagcttttcacaaaatacttggcaccaaatacaaggttgctactgtgggaggaacgtcacttgatctacatcgcctttttgtcgaagttacatctcgtggtgggattgaaaaggtgattgttgatcgtaagtggaaggaagtgattctgaccttcaatttcaaagataccataacgagtgcatcatttgtggtgcgcaaatcctatctatcgatgctttatcactatgagcaagtgtattattttgggaggcaaggcattcctcccccaacacctggtcttgagatattcagtattggccaaaatagagtatataagtggggacaattcccacatattgtttttgggattgagttaggtttaaacccaaattctaagatggtagcagagtctatgataatgattgttgttgggttcatcaagcctcaagatgtccagacctcagtgcgagggggtgtcatagattctacattgactagtgatcttatgattagaggccaatcaggccaaccctatagctccacaaccattccagaagttgctgctgtgaatgattcacctgttcagactttgtgttcatccaatcgtggtactccagtacaggcacatgatgatatggtttctggaacaattgatgcgaaatttgatggtggatatgtagttacagtgattctaggttctgagcagctgaaaggtgtcctgtttcatgttcctgataatgtgtcccagagttctcatgccgaaggcacatctagttcacagaatcttggtgatggcacatctaattcacagagtcgaaagagagcaaaatatgctccacgtgatccatttcggccaaagtcgaacaggagcggttacaactttttctttgctgagaattatgccaggctgaagccctcatatcatgggcaggagagagcaattagtaagaggattgggtttctatggaacaatctgtcagaagctgaaagacaggtttatcaagagaaagggatgagagataaggaaagatacaggactgaactgatggagtacaaatccaataattcaactccaaatgctcaatag

SEQ ID NO: 50081 - DNA, 406 bp, Glycine max
  Peptide Sequence Number=SeqID_166859
gcacttttggcatccttttcaattacgtgaggaagtttctctcaaggttcctgttgaaccaaattctgacttatcaaggttgattccttatggtgtcaccgtgacttatcttccatctctggaagtggtgaccctcttcgtcaacattcttgtatcaaacgttccaccccgtaaggttcacttcagaggacaaccccaaacgcgcatatgtttcaaacttggtttccaacctttaaacaacgcaaaaggtgtctttgggacagccttggttggaacacgatttaatatatacactgtcgtctttagtgctttagcccacaaggatttaggaagattggagttgctaagcatacttcgcaccatgtccaataatgtctggttccttctttctgccacaccattctga

SEQ ID NO: 50082 - DNA, 1190 bp, Glycine max
  Peptide Sequence Number=SeqID_166860
gtgttgagagacggcggatctatgacattgtgaatgtcctggagagtatcggggtactctcaaggaaagcaaaaaatcaatacacatggagagggtttgccgcaatccctctcactctacaggatctcaaggaagaggggttgaaggagaattctaattccctacgtgggcctggaaaccatgataaagtttccgacgacgaagatgacgaggaaacacagtccaatcccgccgctactggaagtcaaagtgacaagttgaaccctaattctactcttcctaaacctctgaaaaatgaaaatgaatgcaaaaagaagaaaagatatggttgggatgctttcaaagaaaagaatattgatctaggatggagagttgtaagggaactgggacaccaccatctcaccaaatcatctgtgccgtttgttaaaaggttgctggcagcaactgtggtttatctttgttgctggcagcggcaccaactgttgcgttttgaaaatcgaagagaaaaatctctggctctgcttacccagaattttgtcaagctctttgtctgctctaatgtggaattgatctcccttgacgaggctgcaaaattgctacttggggatgcccataatacgtctgtaatgagaactaaagttagacgcctatatgacatcgcaaatgtgctatcctccatgaaccttattgagaagacccatacaatggatacacgaaaaccagcattcaggtggctcggttctgaagggaagacatgggatgagacacttcacaaatcaaacctaaacgactctaggaaaagggcgtttggaagtgatatcactaacatcagttttgagaggaataaagtggaattgttcacgagtggggacttgaatccgaatcctaagaagccaagaatggaaaatggtagtgggctgggtgaggcagacgaaaacaatttaaaacaaggcataaaacaagcttcaaagagctatgaatttggtcctttcgctccagcttgcgtgcccaaagttggagcctctcagaataataatatgaagcaggtgcatgactggggcagtcttgcaactgcacatagccctcagtatcaaaatgaagccttgagagaactcttctcccattacatggaagcatggaaattgtggtactcagaaattgctaggaagaggccattacaaattttgtaa

SEQ ID NO: 50083 - DNA, 252 bp, Glycine max
  Peptide Sequence Number=SeqID_166861
atggatgggaacaactacaattcctgggctgatcagtgggatgatgggccagaccctgtgatggttggttccaatagttactctaacaaaaacagtaacggcaacaccgccaaatacaagcaaaagctcggtgagggttttggtaagaccaaagcagtggcctccaccggcgtcaagaaattgaaggatggtacctccgttggcctccactggatcaaggccaagtattccaaagccactcagaaacattga

SEQ ID NO: 50084 - DNA, 987 bp, Glycine max
  Peptide Sequence Number=SeqID_166862
atggctacgtggaaggttgctcctgctttggctgcgggttgtgctgcaatattgaagccctctgagttgccgacgtgtttggagcttgctcaaatttgccaagaagtcgggcttcctcctgtagacaagattgcctttactggaagctctgcaactgggagcaagattatgacagctgcagctcagctgatcaagcctgtttcactagagcttggtgggaaaagcccaatcattgtttttgaggatgttgacctttacaagggttgcagaataggtcctattgttagtgaaggacgggcatattttctgtttctcatttctgcatatatgtcctactctctttctaaagtaaaggacagttatgctctgtatgaaaagatattgaagtttatctcgaatgctaagagtgagggtgcaaccattttgaccggtgggtctcacccggagcatctaaagaagggattctttgttgaaccaactgtcataactgacgtgactacctccatgcaaatttggagagaagaagtatctggacctgtgataccaatccttgcttcgatgcaggtttttaaggctgggattgtgtggattaattgctctaaaccgtgcttcactcaagcaccatggggaggcattaaacgcagtggttttggtcgtgaattaggagaatggtatgcggtggcggaggaaaaggagtgtgtgcagcggaagaaagagtgtgacggtggcaaagatttgttagacttgctgtggagttttctatcggggtcatcagaggtggcaatgtttacagaggctatttcatctcgaggcagcagaggaggaatgcgacaatggcaaagaggtggccttgctgcaacagagagggagaagcttgcaacaattttgagtaaacaagagtcactggagggtggttttaaaagagatgttctgagcagttatgatggtgatagtgatggagaacaagttaataatttctggtgttag

SEQ ID NO: 50085 - DNA, 141 bp, Glycine max
  Peptide Sequence Number=SeqID_166863
atgaagccttgcacatggactgaagtaagcaaagaagcagacactaaggaagagagaagtgttatgctaaaacacaaagcttcagaattgaggagggaaaaggataaaaatatcaaccatatttttagtcagttaaaataa

SEQ ID NO: 50086 - DNA, 195 bp, Glycine max
  Peptide Sequence Number=SeqID_166864
atgcgtgttagcagctcaacagtgagtgacccttctttcttaggagaccccatcgttccttcttccgagggcaaggatggaaattctcatcctgggtcaaggtttatggtgagttcgaattttgactcaaggcttgtagaacggctagacatgatgtatgtcagggtgttggtttggccagcggttcagggataa

SEQ ID NO: 50087 - DNA, 1473 bp, Glycine max
  Peptide Sequence Number=SeqID_166865
gacatgctccctattcctttagtagatgatcttttggatgagttgcatgggtctaagatgttctccaaaattgatttatggtcaggttataaccaagtgagaatggagaacaatgatatccacaaggctgcatttaagacacatggaggccactttgagtacttagtcatgccatttggcctaaccaatgcaccagccacattccaagggtactatagacggtttgttcgagggtttggtgggattgcaaggcctttaaccaaaatgttgaagaaaaataatttccactggtctaacaaagcaaaagcagcatttcaatccctcaaggatagtctgattcaatcaccagtattagcattacctgacttctctaaggtgtttgtggttgaggtggatgcttcaggttatggcattggtgctgctgatcctgacattcaaaaattgatccaagatttgcaaaccgatgcttcttcacataaacatcatacttggaaccataatgaactcagaaggaaagggagattggtagttaggaaggatctaactttacagacggatttgttacaatggatacatgctggtcctactagtggccactcgggtagggaagccacattgaagaggttgaaatcaattgtatattggagaggcatgaccaaggatcatatcactatggattttattgaaggtctaccaaattccaaaggaaaacaagtgatctatgtggtagtggacaaattaagtaaggcggcccactttatgtccctaacacacccctacactgctattgaagttgctcaatccttcttggacaatgtgttcaagttacatggttttccagactctataaccagtgatagggatcctatctttgtcagccaatttcggaaggatttgatggcctttcaaggggttcagctacaactctcttcagcttatcatccacaaacggatggtcaatccgaggtggtgaatagatgcttagagacattcttgagttgtatgtgttgtgatgttcctcatgagtggtctaaatggcttccgctggcagaatggtggtacaataccaaccataacacttccatacagtgcagtccttatgaggttatgtttggccagcctcctccaatttaccttccttatttgccgggtgagtcaaaggtggaggataaaattggggttgtagcttacaagctgaagctgccacaggggtctaaaatccatgatgtttttcatgtttcacagcttaaaagacatgttggtgaagcaccagtttcaaatttccttcctacagattccgatggtgttatgggaggcaaagaacctgaactaattctggatagagcaactgtcaagagaggtaacaggactgtcacaaaggtgttggtcaagtggaaacaccaattaatcgaatatgctacttgggagttcttgtatgatttgaagaggacgtatccaacttttaatccttga

SEQ ID NO: 50088 - DNA, 984 bp, Glycine max
  Peptide Sequence Number=SeqID_166866
atgtctgggaagggagaaatacttatttcacgtagacagtggaatgaagagcaactagaggaaaatcttgaggaatgtcatggaaccgttagagatgccgctatcactatgggaacacacgtgagcccgcttagagagtacgacaagttccaacgggagctcgagaggcgtatatggcataaagcctttaccaggcagcctgatcgtcgcattaatgtggccttgttcaaggagttttatgcaaacttgtatgacccagaggataagtcccccaggggagcactactcagcctttttaaggttctgctatacacacctagaccctcaggagcttgcttccaagctatgcattctcgaggcgaggttagtttgcggtctggtgacgaagatggatatggatgtgggctcggattccctgctcttaccaccgctctctacattgctaggggagtcgtgcctgactcactaaccttagagtccttgagccttgccattaatttggcttatattcagaagaagaactacgcttctgctccttcctcttctacccctgctccagcttctacatcagcacctcctccaccagcaccctccggcacctctgctcagaacatagacgtcttggtgccgatgctgcagagccttcaccatggcttatgcctggcgatgcagagtattcacgatctggctcaacatcggcccatcatcagtatggaggatttcatggcccaggtggcctggccaggagtccatccttctcctgtggggggaggtgaggctcctacagcccaagagccacaaccagagccggaggcgacacctgcggagactccagaggtcacacttgctgccacacccatggatgtcactgagtacacagattatgcagcagatatggcagcagtgcagagcacctgggatccttggcctacttcagctcgggacatacatctgccagcccaagatgctctttcctcaccttag

SEQ ID NO: 50089 - DNA, 1681 bp, Glycine max
  Peptide Sequence Number=SeqID_166867
atggagagcaacatcccttatatagtggaagaaaatggattgaaaagaagcaaccacgctgagaggtggagcggtgagaagtcgacgacgatggagctcgaaacggagcggacgatacagcttgaaaatagcattgacatcggtatagtcgttattcctagttttaccttcatcagtggtatcagcttggaccttccattggcagttatggcagaagcaactcataatcaagcagcgttgcgggaacaagaagagcgcttggaacaccggatcacgtcaaaactcaaagcgcgcataatggagattacatcttcaatacatcaagcgattgactcttccatcgatcgacgaatcttggaaacattacaaaagaactttgattcagagattaatgctacggaccgaggacctcatcgtagagacgaacaccatgcaaattccaattattcttgtggaacgcgtttggcacaaattgatttcccgcgctttagtggtgatgcaattcaacaatggatctaccaatgtgaagtgtatttcgggattaatggtactcctgtggattttcgggtgaaattggttgtaatacacttcaaagggaaggcactacagtggcatacctcctttgtgaagactcttccagaaggtaaccttcctaagtggactgaatttacaaacatattgatcgatcgttttggtgtagtatatgatgacccaatggctaaacttatgcaattaagacagaagggtacggtggtggaataccatgatcaatttgatgcaataacttctagattagacataagtgttgctaatttgttaagctgttttttaggagggttaaaaaaggatattcaaatgacagttaaaatgtttcagcctcaagatgtaagaaaggcattccagttggctaaactgtatgaatctgcttccagttcatacatccctaccaaaaccttccctaaattccagaaaacacaacctagtacaaaagccattttacccacacctaaccctacccacaagcctattgattcacaatttaccttaaacccaactcaacgacaacctaataaaaaactcacacctgcctttatggctgagagacgatccaaaggactttcttatttttgtgatgaaccatatagccccaaccatgctttaacacataagaaacttgagattcatgttctggaggtgagtgatactgaggaggagattgtagatcagtttgacaacacgcatgaagatggtagtacttctttggaccctcaaatattagttaatgccctgactggtatagctagttccaaaactatgagagtgactgacattcctatcttaagtgtggcagtagctgatggagctcgggtaaacattacttctactgttaagcagttttcttggatacttgaaaacactggatttacctcagatatgcttcttatacccttgggttgttgtgatgtggtgttaggaattgagtggttagttactccaggggacattacctggaacttttataggttatttatgcagttttatgtccaagataataatttcctactgcactcattaaccacacatgctaccaatcaagctactcctgaatctatagaggagttactattgcagtttgaggacattttccagggacctacgagactaccacctaagagaaaag

SEQ ID NO: 50090 - DNA, 993 bp, Glycine max
  Peptide Sequence Number=SeqID_166868
atggagtaccaatcttttggaagagtccagagaccaaaaggggctaacataatgcaggcattgaaggtgatcctggttttggctgttggtgcatggctgttatatcaggtcaagcactcgagaaacgatacagagaactatagcgatcaaaccgagtttgatggagctatattgttggggcgtaaagggatgccatcacggttagatgaaatggattttcctgactcaggaaatgtagattctgcaggagaagctaatgagtcaagtaatggcagggatgatgggtctggtggagccaaggaagataaggctgaagaagagtttggacatatctatgagatattcagcagaggaaaagaagtggaacttgaaccagaaagtactcaacctgagttatcatccaaaattcaacacaaacatttgtccaaaacaaaatctgaaaaggttggtttagaatcaagaagtgagtcaggtcacaaagagcatggcaatgagaaatacccaaggataccaataataaatgattctaaaagtaatgacaaagaagaagaagtacaactcagggaacagctaaaggaagtgcaggttagaaagaatgctacatcagatttctcaaaaatggagaatgatggggatgagtggcccaaaattagagaaaaggaaaccaggatgcacaaaaatgtggccgataatgacaaaaatgctgaagtgacagaggaaataaatgaggttcaaagctttcatgatgaaaatggtgtcccacctaatgttaatgaaactgaaatagtgcatgaagaaaacatttcaaatgctggcaaaggaagttggtttagaaaacacatttatgaagtcacatatgtagaagataacactgttgaagtgaattgggaagcatcaaagaaccatgctgatgaagaaattaatacagtaagtattactcaagtcgacccttcaggcatcaaacgcaattcagaaattgatggagatagctag

SEQ ID NO: 50091 - DNA, 477 bp, Glycine max
  Peptide Sequence Number=SeqID_166869
atggcagcaccacctgcgagggcacgtgccgattacgattacctcatcaagcttcttcttattggcgatagcgcttattaccgtggagccatgggcatattgcttgtttatgatgttactgatgaagcatctttcaacaatattaggaattggattcgcaacattgaacaacatgcttctgacaatgtaaacaagatacttgtgggtaacaaggctgatatggatgaaagtaaaagggctgtgcctacctccaaaggtcaagcccttgctgatgagtatggtatcaagttttttgaaaccagtgcgaagacaaacatgaatgtggaggaggttttcttttcaatagcaagagatatcaagcaaaggcttgcagacacagattctaaggctgaacctcagactatcaagattaaccaacccgaccaggcagccaccgggggtctagctgctcaaaaatcggcttgctgtggttcatga

SEQ ID NO: 50092 - DNA, 870 bp, Glycine max
  Peptide Sequence Number=SeqID_166870
atgtacccttatgaggctgaagctgtaattatcaatctggtcaagtcatggatcaagaccagaatggatggactggaggagtgtgtagacagaaatttacaagaagaggtatggaatccgcgtgcaaataaagagtgctttgctccttctgttcttgagattctaggaatcatagatgactctctggaagcgttctttctgttgccaatacccatgcatgcagccttgcttcctgaattgatgtctgctcttgacaaatctctccaacaatacattttgaaggccaaatctggctgtggatcaaaatttcatggtgttttcaggaaaaaaggaaagtcacaagtgactgatcagagaaggatatttcatcatggaactacaaacgtagacagctcatttgcattaccccagttttgtgttcgcataaataccatgcagcgcattggcatgggactaaaggttttggaaaagaggacaatttcccgtcttgggaattctaaatcaacaaaagagtatggtatagaggacaagttcaagctttctaaagctgcgtctgtggaaggtatccgtcaactctctgaggccatgacatacaaagtgattttccaggatctgcgttatgttctttgggatggcctgtattttggtgaagtttcatccactagaattgagccttttcttgaggagcttaatcaatgcttgaagattattttgtctactgtgcatgacagagtcataacgcatgtaattactgaggtgatgaaggcttcttttgatgggttcttgttggttttgttagctgggggtccagcacgtgctttctccctcgaagaccatgttataatagaggaagactttaagcttgactga

SEQ ID NO: 50093 - DNA, 1062 bp, Glycine max
  Peptide Sequence Number=SeqID_166871
atgtctatgcatagttttaggttcttgcaacttatattcccctgtcgtcgttgtttctctacccaaaattctgtgtttcgatctcttctggattattctggaaacgacccagtagcgttgatagctactcagttgagtaattgcgctactgtgagggaacttaaccaagtgtatgcccacgttttaacgacgcactttttgatctccaatccggcgccgtttaattggaacaacattgtaaggtcatacactaggctagaggctccacgcaatgcacttcgcatcctcgttttcatgttaaggaatggggttttgcccgattgttacaccctccccattgctctcaaggccgtgtgccaaacatttgatgttaaccttgggaaacagcttcattccattgctatcaagattggactgcaatgtaacgagtactgtgaaacggggtttcttagcttgtatcttaaagctggtgaatttggaggtgcccgtatggtgtttgacgaaaatcctgacccaaagctgggttcttggaatgctgtaataggtgggctttcccaagctggccttgccagggatgcgataagtgtgttcctcaatatgaggaggcgtggtttcatgccagatggtgtgaccatggttagtgttatgtcggcttgtggaaacattggtgacctcaacctggctctccagttgcataaatgtgttttccaggctgaagctggtgcgaggactgacattttgatgttgaattcgctgattgatatgtatgggaagtgtggccggatggatctggcttacaaggtttttgcaatgatggaggaacaaaatgtatcgtcgtggacgtccatgattgttgggtatgggatgcatggccatgtgaaggaagcgcttgattgcttctggcggatgagagaggctggggtgaggccaaatttcgttacttttattggaatgctaagtgcttgtgtgcacggtggggcagttcaagaggggagattttactttgatatgatgaagaatgtttatggcataacaccccaattgcagcattatggatgcatg

SEQ ID NO: 50094 - DNA, 711 bp, Glycine max
  Peptide Sequence Number=SeqID_166872
atggcaagaccacctgtgattgaattctattactattcggttaattctcttcaccctgaacactttgttaaccatggccattgcttcaattcagactcattctacgcatctcttattgataattctacccacaagagacaccttgatcaaatacataaccagttagttatctccgggttgcaacataatgggtttctcatgactaaagtggttaatgggagttcaaatcttggacaaatttgttatgctcgcaagctgtttgatgaattttgttaccctgacgtgtttatgtggaatgccatcattaggagttattcgaggaatatgttcagggacactgttgaaatgtatagatggatgagatggataggagtgcatccagatggattcacttttcctcatataatcagatataggtttgggtcagatgtgtttgtgcagaatggcctcgtgtcattgtatgctaaatgtggtcatattggtgtggcaaaagtgattggattgctctgttgcgcaagatctttctttgatcaaatgaagacaccaaacgtgattatgcggaatgcaatgatatctggctatgcaaagaatggccatgctgaggaagcggtgcatctattccgtgacatgatctcaagaaatattaaaccagattctgtcactgtgaggtctgctgtcttagctagtgcgcaagttggttccctcgaataa

SEQ ID NO: 50095 - DNA, 366 bp, Glycine max
  Peptide Sequence Number=SeqID_166873
atgcacgagcacgagcatgttgtggagttcgaggacattcttccttcccccttcgctccaaacttatcagaatcggagctccgggaaacggcctatgagatgctcgtgggggcttgccggagttcggggcccaagccgttaaccttcttctcgcactctgagcagtctaacagaggaggaactcagcggattccgtcgccttcattgtacaggtcgctgactgtgacggcgtcgtcgaggaatggaagggcggcgaccacgggggagttgatgagagtgcagatgaaggttacggaactcactgacactagactcaggcgtgccctcctcagagtagctgcaggccaggtctctttctcctcctaa

SEQ ID NO: 50096 - DNA, 1734 bp, Glycine max
  Peptide Sequence Number=SeqID_166874
atgataagctgtgattttttgcagtcttatcagcataaaagcttttggatgccacgagatgctggctgcatggctgaagaaaatgtgggatatgaaaattcttccagagtagaatccaagcgcagtcataagtggtttatggatgcaggtgaacctgaaatattcagcaacaagaaacaagcagttgaagctgttagtggccggccagtttctggagtttcacatgcaaatgtttcccaatgggacaacaattcaggatttcactcagtcacaagtcaattttctgaccgtctttttggatctgatcttgctaggactgtgaatttggttgataagaatgtgccatccattgtaagtggaaatctgaacatgggaaggaaggattttgagcatcaatacggtaatgatccttctgtgggattgtcaatgtctcattccatagcagacacttcatcatgtctcaattttggtggcatcagaaaagttaaagttaatcaagtcagagattctgacaactgcatgcctgctgcatctatggggcactcctatagtagggaagataatagtacaatttcagtaggtgctggctacaataagaatgatggtggcaatatttcattgggtcctacttataacaatgtaaatgacaacaccattgctatggggagcagaatgagtaagaccgatgacaatcttctttcaatggctcacaccttcaataaaggggatgggggttttatgttgctgggccacaattatggcaagggagatgaaagtatcttatcaatgggtcagccctttgacaagggagatggaaatttcatatcaatgggtcaatcatatgagaaggaagatggcaatttaatatctctgggcacctcatataccaagggacatgagaactttataccagttggtccaacctatggtaaatcaggagaaaatttcataactgttgctccttatgacaagggtactgatcatattatatcactgggtccaacatatgataaggtggattcaaatattgcatcaacaattccatcatttgacagaggagattctagttcattacctgtgggtcaaaaccaccataagggtcagaacagttccatatctttcggaggttttcatgatgaccctggaccaaatatccctagcggaatcattagtggctatgatctgttgataggaagccagaactcagctcaaggtatggatagccagaacgacctgactgagacaaacactgaatcacttgtaaatagcattccaaaacccaatactaaaaatgatattgttaagaacaaagagcccaagacaaccaagaaggctcctactaacaacttcccttcaaatgtcaaaagtctactgtcaactgaatctgcacggcagaaaagtcttaaggggatcataaaaggaactgggtatttgtgttcatgtgacaactgcaaccagtcaaaggctcttaatgcatacgagtttgagcgtcatgctggtgccaagacaaaacatcctaacaatcacatatactttgagaatggaaaaaccatctatgctgttgttcaagagctgaaaaacactcctcaggatatgctttttgatgctattcaaaatgtgactggctctaccatcaaccaaaagaactttcgaatatggaaagcatcataccaagctgctactcgggagcttcagcgtatctatggaaaggatgatgtggtcattccgtcttga

SEQ ID NO: 50097 - DNA, 189 bp, Glycine max
  Peptide Sequence Number=SeqID_166875
atggaaaaacaagggatcttgacagtggaagcagatcaggtggcaaggagcatgaaggtcaaaggagatgatgatgactggatggaaagctcaaaagaagagatggatggagagcaggctgagcaatcaaagtctaatggagaacctcctcaagatcttaattctaatgttgacattgaagagtattga

SEQ ID NO: 50098 - DNA, 273 bp, Glycine max
  Peptide Sequence Number=SeqID_166876
atgaatgaagaacagcatgtggcaggaggtgagaaaaggagtcaaagtgaggtgaaggggtggcggtggttgactggttggtcaagaactggtcccccccccccccccattactcgttcaatttgtgcggctgtgctgcggaatgtacatgtcgacgagagagaaactggacctattgggtcccttccaattcttcttaatgggcttcaaatgaaattgaaattccagtcttcttctttgttattgccatttcattttgtccattatatctaa

SEQ ID NO: 50099 - DNA, 195 bp, Glycine max
  Peptide Sequence Number=SeqID_166877
atggatatacacacagtgactgcatatccagcaggggctcagagcaacctagcagctccaccaccacctgtaggttatcccactaaggatgatcttccttcccaacaaaatgttcctgtcaaaaccactaccaggggtgatggcttctggaagggatggtcagttaatttatatccaaaatcttacttcgtctaa

SEQ ID NO: 50100 - DNA, 237 bp, Glycine max
  Peptide Sequence Number=SeqID_166878
atgttgaaatgccctaggtgtggggtatcacggtacaaagtcaaggatgatgaggaatgtagtagtgatgaaaactcaaataagggcccctcagcgaaggtgttgtggtatcttccgatcgttccaaggtttaagcgtctatttgcttatgtagacgatgcaaaagaccttacatggcatgcaaatgggagaaactacgatggaatgctccgtcatccatctgattccttgcagtga

SEQ ID NO: 50101 - DNA, 971 bp, Glycine max
  Peptide Sequence Number=SeqID_166879
atggggacaaatcaaaacggaaaaagattttatcaagtcaagattaaaggtctagatgtcaccagcctcaaggagttgggacgattgatgggacctctccaaaggcaagccttccgcaaagtgtacggaaagattttagatttgaccgcagcggaggtgcgagaagaacagcgcacggattacacccgtgtccgcttcaaagttatcgctcgtgcgtcgaaaaaagaagagtcgattggggaccaacacttggctgggataggaggcaacgcaatcaattggtttcctcgatggaaggaaggcaaggagggagttcttttctcatggtaccccatgaggggagcaccaacagaagaaagtctctcgcctttccttgtgagggatttgggcgtgcaaagtctcaaggttatacaaagagtccacaaggcgtggagaagtccgttgaggaaagacaaggagcttagatgcatccgtaatggcgtcatcggtggttatcatggatggctaagagttcacatgcgagggttagattggctctctaagttgaaagttatcgatgaggagaacttcgaaacttcggaggaagatgaggaagtacaagctctaaaattagagctagggaaggcaagactcgtcaaagaaaaattcaagtcagccgctacacacatccggaaagagtgcaccgagttacgagaggaaaacgcggccactgcaagagcccttgaacaagaaaccaaaagggcccgcaaggaggaacatggccgagataaattccgaggagctttgtggggtagcaacaatgagctcaagctccggagagaggaaagagaccggtcacgggtgcatggcgtgatcttgaaagaagagttagctgcttgcgcaagatccaagaggagtttggctcaacacttggaagccatggagcaaagcatgctagcattcatagtgcagtacaaggaagagttgaacca

SEQ ID NO: 50102 - DNA, 378 bp, Glycine max
  Peptide Sequence Number=SeqID_166880
atggatgatgaaaaattttgggacaaatttaataacctaatcctgaatgtgaatgagtcaggttatttatttagcttgaagctaaagctacaccgagaccggtttggacctggacccctaaccgggctgggtgaggtatcggaccggagatgtacaagagccggtttggctcggtgtgaaccggctagtttggcggaaagcgatgactcgaatgggtttgaaaacccggtgggtggtggtgcgccggtgatggatcgtcgaaggcggtggttgggtgccggttgtgacaactgggtggttgagatgggaggcacggtggtgacatggtgtttggcaaggagtttgtgcggcgctgagacattgtgtgttttaggttaa

SEQ ID NO: 50103 - DNA, 1179 bp, Glycine max
  Peptide Sequence Number=SeqID_166881
atgggaaaggatctgtttagtaatttaccagacgaaattctaggtcgcatagtttcatttctaccaaatgaatcatcgctagaaaccagccttctttctacaaggtggagggacctgtggaatgaagctcttgtcaaacatggaactcaagaggatatcataggtgttgttgctggttttatcacacgttttgaggagtttgatccattgaagcatcctagaaagcttcaatttcactttgctgaagacagtgtagtctcagcaaccgttgcaaataataacaagcttatgcttcatttttccccttggaaagaagagattcaaatggggtatgagttggagttcaagcaaactaagcaacacatagccacctaccagtcttttccttccactttctcagtcaaaaccctctatttgaaatcggtgagttgtttcacaagtaatattgctgcctccatcgtttcaaatttggagcatcttcagaatttggtggtcattgactgcaaagggttggaatctttgagtgttgactccacctctgagcttcacatgttaaccatcttggattgcttagagttgaagactctccatctcaaaacttctaggctcaagtcttttcggtatcgtgggcctcttcctttgcttaggccagaatatcatttcaacctgcgtgatgccatgcttgatttcagattaggactaagctgcagtggtttaaagaccaaggattttgatgcaacccttttaacaataaagaactgtgaagttcttactctgtgtaaatggacttttgaggaattaatatggccatcgatttctcctctatctgggagcttcatattctataaattaagagagttatggtggattgacaactatcatgaggatgaatacaacacagatgccttgttctccttcttgaaattatgcccttccttggagcatctttttgtgactattgatcctgaaagttattcggctggagggtccaattcatgcttaatgaaagggactaaatgcacagaactggaacatcttaaactgataaagtttatgggattttcaagtcgaaaagatgaaatctcattggctaaatgtttaattcatctaatcaagggaaagcctccaaagataaagacttcagatgggaattgcttggatgcagtgtttgtgcagtga

SEQ ID NO: 50104 - DNA, 285 bp, Glycine max
  Peptide Sequence Number=SeqID_166882
atggccgtcggttccgtcgctgctgcggcgcacggcaccgcgctcgtcctttacttgcactacttcgcgaagatcatccacgtgctgcggttggatcctccgcacggcacgtcgcaggagcagtttgacaggttcaccgaggttttcgtttctgatagtttgatttggttcacttggctagctggtgattgtcgaagaaagtacccgtggaaagatgactttctatttgatatctttagggttttgatgggattgctttgtgttgctgtctgccaaggaaaatga

SEQ ID NO: 50105 - DNA, 3612 bp, Glycine max
  Peptide Sequence Number=SeqID_166883
atggctacattcttcagtggtcttgtcattggccttgtcaattgttggcagattgctttgataacgttagccacgggtccatttattgttgctgctggaggaatatcaaacatattccttcataggcttgcagagaatatccaagatgcatatgctgaagcagctagcattgctgaacaggcagtttcctatataaggacattgtatgcattttcaaatgaaactttggccaagtattcatatgcaacatcactgcaagctactcttagatatggtatattaatcagtcttgttcaagggcttggtcttggatttacgtatggactagcaatatgttcttgtgcattacaactctgggttggaagattcttggttattcacggaaaagcgcatggtggtgaaattataacagctctttttgctgtaattctaagtggcctgggattgaatcaagcagcgacaaatttctactcatttgatcagggacgaatagctgcttatagactatttgagatgataagtcggtcatcctcatctgttaatcatgatggcacttcccctgattctgtgcaaggaaatatagagttccggaatgtttatttcagctatctgtctcgtcctgaaatccctatcttgagtggattttatctcactgtacctgctaagaaagctgtagcacttgttggcagaaatggctctggaaaaagtagtattattccactcatggagcgtttttatgatcctacattaggagaagttcttttagatggtgaaaatataaaaaatttgaaactggaatggctgaggagccaaataggactagtcacccaggagcctgctttgctcagtttgagtataagagacaacattgcttatgggagggatgccaccatggatcaaattgaagaggctgctaaaatagctcatgcacatacatttatcagctcattagagaagggttatgacacacaggttggcagggctggtctatctttgaccgaagagcagaaaataaaactttctattgctagagctgtgcttctaaatccatcaattcttcttcttgatgaggttactggtggacttgattttgaggctgagagggctgttcagggggctctggatttgcttatgttgggacgctcaacaataataattgctcgaaggcttagtctcataaagaatgctgactatatagccgttatggaggaaggccagcttgttgaaatgggtactcatgacgaattattggcactggatggcttatatgcagagcttcttcgatgtgaagaggcagcaaaacttcccaagaggatgcctgttcgaaactacaaggaaacttcagccttccaaattgagaaggattcttcgagtcatagcttcaaagaaccatcatcccctaaaatgattaagtcgccctctcttcaaagagtttctaatgcatcccgacctccagatggcgcctttaacttgctagaatcaccaaaagtccagagcccaccgtctgagaaaatgcttgaaaatggtctggcattggatgcagcagataaggagccatcaataagaaggcaggatagttttgaaatgagactgccagagttacccaagattgatgttcattctgtgcatcgacatatgtcaaatgagtctgacccagaatctcccatttcacctcttttaacatctgatcctaaaagtgaacgctcccattcacagacttttagtagaccacttagtcattctgatgatgtttcagttaaaatgagagaaacaaagggtgcacggcatcgaaaaccaccatcactgcagaagctggctgagcttagttttactgagtggctttatgctgtgttaggaagcataggtgctgctatctttgggtctttcaatccccttcttgcttatgttattggtcttgtggtgacagcttactatagaattgatgaccctcatcaccttgaacgggaggtagacaggtggtgcttgatcattggctgcatgggtattgtgactgtagttgccaactttttacagcatttctactttggtattatgggagagaaaatgacagaaagagttaggagaatgatgttctcagccatgctacgcaatgaagtgggatggtttgatgatgaggaaaacagtgctgacaatttgtccatgcgattggccaatgatgctacttttgtgcgagctgcttttagcaacaggctttccatatttatacaggacagtgctgcagttattgttggtcttctcattggtgctttgctgcactggcggttagcacttgtggcttttgcaacctttccaattctctgtgtttctgccattgcccagaaattttggcttgctggattttcgaggggcatccaggaaatgcaccgaaaggcatctttggttcttgaagatgcagttaggaacatttacactgttgttgccttttgtgctggtaacaaggtaatggagctctacaggctgcaattaaagaaaatatttaagcagagctttcttcatgggatggcaattggttttgcatttggcttttcacagtttctactttttgcttgtaatgccctgctactttggtacactgcaatatgtataaaacgtggttacatggatccacctactgcactcaaggagtacatggttttctcatttgcaacatttgcacttgtggagccttttggattggctccttacatacttaaacgacgaaaatctctcatatccgtgtttgacattatagatcgtgtgcctataattgatcctgatgatagctcagcattgaagccacccaatgtatatggaagcctcgagttaaaaaatgttgatttttgttacccatctcgtcctgaagtgttggtattgagcaattttagcctcaaagtcactgggggccaaacagttgctattgtgggagtttctgggtcaggaaagagcactataatatctttgattgagaggttttatgacccagttgcaggccaagttttcctggatggtagggacttaaagcaatataacttgagatggttgaggagccaccttggtctggttcagcaggaacctattatcttctcaacaaccataagggaaaacatcatatatgcaaggcataatgcaactgaagctgagatgaaagaggctgcaagaatagcgaatgctcatcatttcattagcagcttgcctcatggttatgacactcatgttgggatgagaggtgttgacttaaccccagggcagaaacagagaattgcaattgctagggtagtgctgaaaaatgcccctatcttgttgttggatgaagctagttcagcaattgaatctgagtcaagccgagtagtgcaagaggcaatagacacactaataatgggaaacaagacaactattctaatagcgcatagggctgcaatgatgaggcatgtggacaatattgtagtgcttaatggaggacggatagtggaggagggcagtcatgatacattggtagcaaagaatggtttgtatgtccgactgatgcaacctcattttgttgaatcactggtgacttctgcacctgaagggtttttcctggaatgtggggtggaaactggaaattggcaatga

SEQ ID NO: 50106 - DNA, 2535 bp, Glycine max
  Peptide Sequence Number=SeqID_166884
gtgcctagggctcttccaaccgtgagttttgctcgaaattcgatttttccgattcttttgcaagtgggtatggtggggaacgatgacgcgggccacctctccgcctcccgggaaatgttctggcggtcggcgtcgtggtcctcctcgcgcaccgccgccggaaatgcctcttccggcgaggcggagaagggcttcgctgattccggcgccgccgacggtccccacggccagaaccggcggtttggtccgccgccgctgacgcctcggtcgcagcagaattgcaaggcgcggtcttgcctgccgccgctgcagccactctccatcgcccggcggagcctcgacgagtggccgaaggcgggctccgacgacatcggcgagtggccgcagccgcccaccacccccggcgggagagctaatggtagcaatggtgaaaggttgaaacttgatttgtcttccattcagcataacaaccctgatcatagtaggagtaacaatggaaatgggcttgtgaagagggatagaattgcattttttgataaggagtgttcaaaagttgctgatcatgtgtaccttggtggtgatgctgttgctagggatagggacattttgaagcataacggtatcactcatgtgttgaattgtgtgggatttgtgtgtcctgagtactttaaggctgattttgtttataggactttgtggctgcaggatagtccctctgaggacattactagtattttgtatgacgtgtttgactactttgaggatgttagggagcaaggtgggagggtatttgtgcactgttgtcaaggggtgtctaggtctacttccttggtcattgcttaccttatgtggagggaagggcagagttttgatgatgcttttcagttagtgaaggcagcgagagggattgctgatccgaatatggggtttgcttgccagctgttgcagtgccagaagagggttcatgctgtccctcttagccctagctctttgctgaggatgtatagaattgctccacactcaccctatgatcctttgcatctggttccaaaaatgttaacggatccttcattggctgcattggactccagaggtgcatttatcgtgcatattccttcagccatatatgtttggattggtaaggattgtgaggccatcatggagagggatgccagaggggcagttggccagattgtccggtatgagaaggtgcaagggcctaatgtgataattaaggaaggtgaggagcctgtttccttttgggatgctttttcaagttttctgcccttgatggacaaggacaaatctggcaacagagtagaagagggaaaaagattaaccagtcaagttttacctggtgagaggagggtggactcatacaatgttgattatgaagttttcaaaaaagcaatcaccggaggctttgtgcctccatttgcttcgtcaggtgaacatgaaacacatctgcctgcaagagagagtagctggagtgttaaagtttcctatactggcacaaaggagtttgtttcagcccctcggttatccttcccaagggtttattcagattccatgttgtgtatttatacgtcagcaaatgcaaatttgtctccatcatcatccttgtcctcatcgtcatcatctgtatcatcatcctcttcgccgtcttatgtttctccagattccatttcttctgattctagccctcattcaaagtctttgtcagaagtgtccccagattcttcctccatagttttgacttctattcctgtatcttcatgtttgtctaatttttctaatttgtcaatcacatcatattctactcctaaaacagtgtctaacagtacagatgtccttggggtcaagttatcacatccctggtctcagtcagcctctctaccgttgaagaaatcatcaacttcccttgccgaacggagaggtaacttgtcaaaatttttgaagttgccactaatgaatgataagacacaagtaacagataaatcgtcaacttctcatgctagtcgagaatatgacattcttgttaatgggaatgttagctatctgcaacaatccgataataaagattatttttgtaagtctaacaaccatgccaaggatggaggtgtgaattcaattcaaaagtgtgagctggcattgtgtccaagcattgctggtagcatggacctcaaggaatttagtcagtctacattgaagcgaactaatgaaagtggcttactgcagtgtaatgtcgcacaaacttgggtatatcactggcccagtctacaaaagattgagacatttggtgcaagtcatttggattctaaagctgcttttgtcatattctctcccagtatgcatgtacatccaggaaacattttatatatctgggtagggaggtctttcaattgtgatgcttcacaggttcacttagatattgataaacagaccgattatgtaagaattgctgactggaatcaaattggttgtgatctccttgctcagtttagtttgccaaagaacacagtcatgaaggtatga

SEQ ID NO: 50107 - DNA, 231 bp, Glycine max
  Peptide Sequence Number=SeqID_166885
atgacgttcaagtactcaatgtcctggtcgaatactctattggtccagtactatgtactaggagttatctttccttcatgtggggtccagacgccacttcaaggagaagatgagtcaagaagaagctcaccaccacaggaagatatggataagagcttgaaggtaggagaagatgagaggagggagagggagagaaggagcacgaaattttgtgcctcaaaagagatctga

SEQ ID NO: 50108 - DNA, 474 bp, Glycine max
  Peptide Sequence Number=SeqID_166886
atgtttgcacgttcgattaaaggctgccgtcccttagggacggacgtgtggggtgctaataccttccccgtgcgtaaatacaactcccgagcctttcacttaaaagttcgtagatcgcgtcttttccggtttttccgacgttttcctcaaataaacgttggtggcgactccgcgcgtattcctttcgtggaacacgcatcccgcgagtctcgcgtcaccctcccgccgaagggtaggttgcgacagcgtttcgtttctaaacgaccatttagaggaaacactgggtccaacaaaatagaaaaaaatcacttaaagtgtatcaatctcacacaggaggattggtgtcatcccttgaagaatttgagtgaagaagcaagggaaaaccaccttaagagctattggactaagaagcactccaaattgagtgaatcaccaaagagagaacaaccaccaaaattgaggacctttttgtaa

SEQ ID NO: 50109 - DNA, 222 bp, Glycine max
  Peptide Sequence Number=SeqID_166887
atgtcattcatgattttttggaattatgaaggggcaatcttcaaaccgaatgccattacattctactcgtattgcccgaaaggatactgtcgcaacctaaccttttgcgggcaagcgaagcgaggctcacgagtgcgttttccaaaggaggaaaatgcgcggagtcgccaccaacgtttatttgtggaaaacgtcggaaaaaccaaaggaaaccggtcataa

SEQ ID NO: 50110 - DNA, 1158 bp, Glycine max
  Peptide Sequence Number=SeqID_166888
atggctgggatacccaacaacatggctactttgcttttggctcgtatgacgcaagtactagagactttagtgcaagattgtgatgttgaactgattaagtattgcaaattatctgctttcaccaagcacaattccacccaagagcacaaggtgacttatgccacctgcatgttgagcggagaagctaaagactggtggaagtttgctagtcaagcccttccaagtaacgaggaagtcataccatgggctgcattcaaagagagttttttgggtaactacttcccaagggacttgcgcaagctaaaagccaaagaattcatggagttgaagcaagaaagcatgacagtaggggaatatgattcaaagtttcatgagttgatgaaatcactaatctatgaggagagcgttaaggggaatcaagctgagcctaagtttggaggtccaacaacaacaatcaacaacaacaataacacttacagtctgcttaaatgttgtatacgtggaggaccacatttccagagggattgcccacaactagctactgtttgttctaattgtggaaagacgggacacacacttaaggattgttggtctacacccaagaaggatggcaatcttggaagtggagctaagaacaattacaagaacaacaacgaagggaagctgagtgtggcgtggaagagtctagacttgcttgtgtcttctttgccatatgaattcgtagtgtctacccctacctacaaacttgttaccacttctattgcatgctttgactgttctgtgatggtcgacgataagactttctctatgaatttgatttgtttacctctttctcatcttgatgtgctgttgggaatggattggttatcatccaatgatatttcccgtgtgagtgaagacaagagggtaaacaactgtcgcaacctaccctacgatgggagtgagggcgaaaagccaaagaagcgtcttccaaaaagcaaaatgcgtgggagtcgccaccaacgcttattcgatgaaaactgggctaagcgcgcatccaccgctaagcgtagcttcagcgcgcttagcacaacagaagaatctgacagggcatcagcatcaaggtcgtgcgctaagcgcgagatcagtgcgctaagtgcagcagttgtctttagctag

SEQ ID NO: 50111 - DNA, 288 bp, Glycine max
  Peptide Sequence Number=SeqID_166889
atgcccttgttacatgggagtcatagttcttctctcatctttcctggttctgatgagttttgggtatattgtttgcggctcattaaagaagtgcttagtaccaaaaacaatagtgtctcgttgagcttcagacccactttttcgagtttttgtatgtcgaaaaagtgttcaatatggatggagggttcattgctagtgtgtatggtagtgatttctagggttgagattatctcgacagcaggggagttggaggtggcaaatgcagagagtttgagagttagggtttag

SEQ ID NO: 50112 - DNA, 429 bp, Glycine max
  Peptide Sequence Number=SeqID_166890
cttcaattgagagtagatgaaagctataccttgctggttcccaaagccaaggaatcttcccaagtcacaattgaggcaaatacagtttatggtgcattacgcggattagagacattcagccagttgtgttctttcgattatacaactaaaacagtaaaaatatacaaggcaccttggtccatccaagataaacctagatttgcatatcgtgggcttatgctggatacatcaaggcactatttacctattaatgtaattaagcagattattgaatctatgtcctatgctaaacttaatgttctacattggcacatcatagatgaacagtcatttcctcttgaggtacctacatatccaaacttgtggaaaggttcatatacaaagtgggaacgttatacagtagaagatgcatatgaaattgtcaagtaa

SEQ ID NO: 50113 - DNA, 210 bp, Glycine max
  Peptide Sequence Number=SeqID_166891
atgcagaaattgattaaggataggatggaaaataaggtggataatttcgtgggtcttaataaggtggtttctggcataaaatggatgaatgggatgaaatatagaaatggcaataacggaagctacagggctccaaatgaggtgattccaaaacgaggtgaaaggtctcgttttgaaattcaatttaggctcaagaatcacttaatttga

SEQ ID NO: 50114 - DNA, 471 bp, Glycine max
  Peptide Sequence Number=SeqID_166892
atggacaatggagatggaatagccgtcggttggttaggacatcctgtctttagagataaagaggggcatgaactttttgtacgtcgtatgcctactttttttgaaacatttccggttgttttggtagatggggatggaattgttagggccgatgttccttttcgaagggcagaatctaaatatagtgtggaacaagtaggtgtaattgttgagttctatggtggcgagcttaatggagtcagttatagcgatcccgctactgtgaaaaaatatgctagacgtgctcaattgggtgaaatttttgaattagatcgtgctactttgaaatcagatggtgtttttcgtagcagtccgaggggttggtttacttttggacatgcttcttttgctctgctattctttttcgggcacatttggcatggtgctagaatttattcagagatgtttttgctggtatcgacccagatttag

SEQ ID NO: 50115 - DNA, 309 bp, Glycine max
  Peptide Sequence Number=SeqID_166893
atgaattgcgttttcgttcatgtgtcctccaccttcgagtttggagctatgcgtagtgattccttagtgccattctccattctcaccatttttcggagccccttcaattgcattttcgttcatgtgtcctccaccttcgagtttggagccatgcatagtgattgcttagtgccattctccattctcaccctttttcggagccccatgaattgcgttttccttcatgtgtcctccaccttcgagtttggagctatgcgtagtgattgcttagtgaaattctccattctcaaccttttcggagccccatga

SEQ ID NO: 50116 - DNA, 192 bp, Glycine max
  Peptide Sequence Number=SeqID_166894
atgtcagtgaaaaatctcgttgggcgtctaggagtacatgacaagacaaaccacacactagtaagtctggtcactctcactaggcttaaaggagcactcaaatcgggtatatttacccccaagacctacattccgaagagtccatcaaggcctctccctcctaattcaggttcaacccagaaaacattttag

SEQ ID NO: 50117 - DNA, 177 bp, Glycine max
  Peptide Sequence Number=SeqID_166895
atgcccttacggacactattcctacttccccatcaggctctgataccagaggtcagcggagtaggatcaaacggacagataggaaatatcaaggtcacaccggagaccggcttacaaaacccaggttttcataaacaaagaaaccgaagcggcggcagagctgcacaggatcggtga

SEQ ID NO: 50118 - DNA, 303 bp, Glycine max
  Peptide Sequence Number=SeqID_166896
atgagggcaaagatattagagaatgttttaatcatgtctagattattgcgatcgttttcccgtatttcttttcgctcgaattcctcctcttcatcttcttcaagaaacaccaatctcttaagtgatcaagataaccagacccaagaggtcgccccaaaacacaatctcttcgatgaggaagtccgattcgaagatattaatcaaaacatggatgactggaacattccagaaatccctcaggatcaactatacgttcctgaaacaattaaagacaaacacaactttgattacataatcaaaaca

SEQ ID NO: 50119 - DNA, 467 bp, Glycine max
  Peptide Sequence Number=SeqID_166897
atgaccggtcctctcaatgagtcaatctcatgctttctcataagggtggacccttgggtactagaacctattgcctttagaggactacacgttctcgccatcagaggactacacgtcctcgccatcagagggttgcacaccctcacctttagaggactacacgccctcaccttcaaagggttgcatgccctcgccttcagagggctacacgccctcaccttcagaggactacacgccctcaccttcaaagggctacacaccctcaccttcagaggactacacgtcctcgcctttagaggacaacacatcctcgcctttagagggctacacgccctcacctttagaggactacacgccctcaccttcagaggactacacgtccttgatttcagagtactacacgtcctcgccttcagaggactacacgtcctcgccaccagaggactacacgtccttgccatcagagg

SEQ ID NO: 50120 - DNA, 192 bp, Glycine max
  Peptide Sequence Number=SeqID_166898
atgaagcaagaaatgaggttaattaactgtaaagtatgcaagggttcagagcgtggtgttcccgtgtcctctagcatgaggttcttcttagtcatccacctattcatctgctcccccgaacacaagttcaagatcatcacaggatccaaacacaacaacacacagggagtgagttatcacattcctagctaa

SEQ ID NO: 50121 - DNA, 117 bp, Glycine max
  Peptide Sequence Number=SeqID_166899
atggcggtgatgggtggtgatggaattgccggaggcaatggagaggcctacggagataggtcaaatcagaagatcacctatgaagatagtccaccgttgcatttgttgaaaacataa

SEQ ID NO: 50122 - DNA, 363 bp, Glycine max
  Peptide Sequence Number=SeqID_166900
atgaagtgtcactaccttcatattacagtgttgaaagcacctgggatgaaacctctcaatatttgtttgagtaaacaacatgaagtaacagatgctgtcacagtctgggaatggactgggtctgcgtgggatgaaggagctgaagcatctcagtggttctcagattttttaggaaagccctgtcaactagtccgcttcaattctgcttcagaagttagacaagtggatcctgattatgttcgaggacagcatcggacctatttctctgacggttatccattcttacttttatctcagtatttcttatactcaggaatcattggatgcactaaacgagcttctaaaggaacgcatacctattaa

SEQ ID NO: 50123 - DNA, 937 bp, Glycine max
  Peptide Sequence Number=SeqID_166901
ctgtccatggatgatttgcctaatgttgtacttgggcaggttgtaatggaaattcctcttgaattgatgttaaccataagcaagaagctcccatggatgtttttccctgatataattcccttggatcatccaatatttgatattatcaactcaacaaatccagagacagattgggacctaaggttagcatgccttctcttatacgcatttgattgcgaaggcaacttttggcaattgtatggcgacttcttaccgagtgcagatgagtgcactagcttacttctggcttcagaggaggaacttttggagctgcaggattccgatcttgcttccactattagaaaacagcaacaacgagccttagaattctgggagagtaactggcacagtgctgcaccccttaaaataaagcgtcttgcacatgatcctcaaaggttcgcttgggcagtaggtattgcacagtcacgatgtattaacatgcaaacgagaattggtgctctaaatcaagaagcaaatatgctgattccttatgctgtgcttcttacttttcctacttacgatgttttttcaactaaggacaggatgcttgaggttcttataaatgctggacagcgcattagaaagggagatgagaatccttgggacgagatcaaattctcaggcaatgcacgtattcatttggattccttcgtgtcaatcttccatatatctggccttcctgaagagtattaccataataattgtctgtcaaatgctggggatagttttgttgatggagcagtcatagctgcagcacgaacactgccaagttggtcagatggggatgtgcctccaatccctagcgtggaaagaaaggctgccaaggagttgcaagatgaatgtcaaaagatgctcgcagcatttgctacaacctctaagcaagaccagaaattgctag

SEQ ID NO: 50124 - DNA, 1197 bp, Glycine max
  Peptide Sequence Number=SeqID_166902
atgtctcaacctgagtcgtccctggcttctaccttagcagaaacctctttggtaaagcaagagtgtgatattagtgatcctgttcatgattttgcttcaagtgattcagagatggaagcaaaacgaatagcaaaggttgctaatcttgctatggcagaactccttaagcttatgaggattaatgagcctttatgggccaagtcttcatatggtgtgccgggatatgttctcgttcgtgaaagatatgcaagcatgtttcctagggttgatagcttgaatagtcctcctcacactactcgtgaagaatcttcaaaatattgtagagtagtgagaattagagcgaggaaattggttgagatgcttttggattcggaggaatgggttaatcatttcccaacaatagtttcaaaatcagaaacagtcaaagtgcttgatgtgggttcattggagaatcgaaatggagcattgcaagtggctatttcaccgctagtgtcgtctcgagaattattcttccttcgttattgtcagcaagttacagatggtacatgggccatagctcatgtgtcgattgattcaattgaagggcgtgttcttgattctccagttcggaggcttccatctggctgcgttatttatcaaatgaatgaagaattttccatggttatttgggctgagcacgtggaagtgaatgaaaggattgctacatgctcacgaggaggttttactcgtgacaatgttgcatatggagctgaaaggtggctttgggcacttaatagaatgtgtgagaggtttgtttggacttcaataaacaacatgccccctcaagcatctccagaagaggtgaagggattcaatgcaaggatgagggccatgaggttttctaatcgaatggttcaaggattttttggtgttttgtataagttacgtgatggtggccttgcacaatctttagaggaaaacaacaccgagattaagatctctctccggaagaacacaacaccaggcatgccagaaggcataattgccactgccatcacttgcatcaggctccctgtccctcaacagaatgtttgttccttcttcatggaagcaaaaaatcgtcctaagtgggatgttctgagcggtggatttgcagtaaatgagtttagtcatttcacaatgggtggaagaaattgtatttcaattttgaagatttaa

SEQ ID NO: 50125 - DNA, 1869 bp, Glycine max
  Peptide Sequence Number=SeqID_166903
atgaaagctttcgtggctgtggctctgtttgcgttgttgttggtgtttgttgatgcgaggtttgtggtggagaagagcagtataactgttctgtcacctcataagctgagggcgaagcgcgatggcgccatcggaaacttcggtcttccggactacggaggattcatcgttggctctgtgctgtatcccaccaaaggctcccacgggtgtcaggtcttcgagggcgataagcccttcaaaattcactcttatcgtcccactattgttctccttgatcgtggagagtgttactttgccttgaaggtttggcatgccgaacaggctggtgctgcggcagttttggtgactgacagcattgaggagtctctgataaccatggattctcctgaggagagctctgatgcagatggctacatagagaagatcacgattccatcggctctgatagagaaatcctttggtgattcgttgaaagatgctttgaataacaaggatgaagttttgctaagaattgactggagagagtcagtacctcaccctgacaacagggttgagtatgagctctggaccaacagcaatgatgaatgtggagctcgttgcgatgaacagatgaatttcgtgaagaattttaagggtcatgctcagattcttgagaggggcggttatactttgttcactccacactacataacttggttttgtccaccacccttcattcttagcagtcagtgcaagtctcaatgtataaaccatgggagatattgtgctccagatccggagaaggattttggagagggatatgaagggaaggatgtggtgtatgaaaatttgaggcagctttgtgttcatagagttgccaatgagagcaaccgttcttgggtttggtgggattatgtgacagatttccatgtcagatgttctatgaaggagaaaagatatagcaaagattgtgctgaggaagtcatgaaatcattagatctgcctgtggataaaattaagaaatgcatgggtgatcctgaagcggatgtggagaatgaagtgctaaagaatgagcaacaagtccagattggtagaggatcccgcggtgatgtcaccatcttgccaacattggttataaacaacgtacagtatagaggaaaattggagagaactgctgtactcaaggctgtatgttccggatttaaggagactactgaaccttcagtttgtttaagtggagatgtcgagactaatgagtgtcttgaaagaaatggaggatgttggcaagacaaacatgctaacataactgcttgcaaggatactttcaggggaagagtttgtgagtgccctgttgtgaacggtgtccagtataagggtgatggttatactacatgtgaagcttttggacctgcaagatttatgctatcactttacttgacatccctcaaggctaactcaattcccttctgtataaaggactccaaggtaaatggctgtcagtgcccagttgggtttcgtggggatggtactaataaatgcgaagacgttgatgaatgtaaggaacgaagtgcttgtcagtgtgatggctgcagctgcaagaatacttggggtagttacgattgtaaatgcaaggggaacctcctatatataaaggaacaagatgcttgtatcgaaagaagtgaatcaaaatttggacggttccttgcctttgtggtcatagcagttgttgttggtgctggtctagctggttacgtgttctacaaatataggctccggtcatacatggactctgagatcatggctatcatgtcacaatacatgccattggaccagcaaaataatgtagttcatgctgaaactcaacctttacgacaacaaggcaccgtgtaa

SEQ ID NO: 50126 - DNA, 910 bp, Glycine max
  Peptide Sequence Number=SeqID_166904
atggaatggatcgctgatccaacaatttgggccggcctggccacgttggtcgtgctggaaatcgtgctgggtatagacaaccttgtcttcatcgccattctggcggacaaactaccaaaacaacaaagagataaggcccgtgtcgtcggtctgttgctggcgctggtcatgcgtctggcgctgctcgcctccatctcgtggctggcgacgctgaccaaaccgatgttcatcgttgcggagcaccccttcagcggccgcgatctgatcatgctggtcggcgggatattcctgctgttcaaggccaccatggagctgaacgagcggctggaaggtaaggatgaagagcagcacggcgcacgcaaaggcgcgcgtttctggcccgtggtggcgcagatcgtggtgctggacgccgttttctcgctcgactcggtgatcaccgccgttgggatggtcgatcacctggcggtgatgatgatcgcggtctgtatcgccatcggcctgatgctgctggccagcaagccgctgacgcgtttcgtcaacgctcacccgactattgttatcctgtgcctgagcttcctgctgatgatcggtttcagcctggtggcggagggcttcggctaccacattccgaaaggctatctctacgcggcgatcggcttctcggtaatgatcgaggcattgaaccaactggcgcagttcaaccgccgtcgtttcctgtcaaaggtgcggccactgcgcgaacgtaccgccgaggctgtgctgcgcatgctgagcggcaaacatgaagaagcggaggtcgacagccattccgccaacctactggcggacagcgacagcgaaaacggcgagatcttcaaccagcaagagcggcgcatgatcgaacgcgtgctgggcatggcgcagcgcatcc

SEQ ID NO: 50127 - DNA, 279 bp, Glycine max
  Peptide Sequence Number=SeqID_166905
atgatgggcgttgaggcggcaaaattcaactttaatcgggaggacgtggatcagaataggaggattgccgcaaacatcgatcggcgccgagtggccaacggagccaggggccggagggcgcaaatatctaccgggatctgcaagccaagggcggtagcgtgcccgattgaatccctttgttcacgctgcgcaggtgaatgcagcgctacgatgaattggaatgaaaatgcaaacaagactcaaggcagtgatccccgttgcgggggtgggatcctctag

SEQ ID NO: 50128 - DNA, 723 bp, Glycine max
  Peptide Sequence Number=SeqID_166906
atgacaaatctcaattttgacgtccatgcctttactttgaacatcaggatgtgcagactattggcattgggcgaccaaaaacactttggtcgtgttcatgctgctggagtcgccagatgcagttgtagatacaatcccaagggctcgtgttgcttactgagcctgagttgtgtcgatccctcagggcaggacccagacatgggtgaatcagacaaatgtgggttgtatgttgatgacaatcctccccgcctggttgcccttggaagagtttatgaggagtccacaaccgtccacaatgtccctttaggcaataatcaagtgaaggttgttgttgaggaagttcaagatgctaatgcctacatccttgtacacactcaagaggataaacagggagctgagggactggcaaaacctgtagataggtcggaacctgatgacgatcccctataccagatggcattgacaatcttgcagcttttcctcaagactttgcaagtgtcatgggatgcaactatgtttggggtgtataatgataacttcccatttgcatattggcaactggtcgttatatgtcccaaggacaatgttgtcgtctgtactttgaaggtattcaacgatattcaaggaaataaaaccaaggcgactgctaaatggattgcagttaaatattttactggtccaagaccattggaactagagagattaaagacaattcacatttag

SEQ ID NO: 50129 - DNA, 312 bp, Glycine max
  Peptide Sequence Number=SeqID_166907
atgagtactaggacaacgcaacagcgtcacaatgatgtcgttgcggtggtgcaacgggatggcggtgcaacgacacagtgggatggcgagttggtgtgtaagtgtgaggaagaagaactgaaggaaaaaagagaatgtatgtgtgggaattcgtcccgtgtttcgaaaaccgaccaagtcatcggtttttctcaaaactggacaatgcgatatgggctgaagcgagtcgcttgcatgcccgatttaattccccaaacggactggatagaccactggttctcggtcagatcgaccaatctggtctggttttaa

SEQ ID NO: 50130 - DNA, 947 bp, Glycine max
  Peptide Sequence Number=SeqID_166908
atggtgggcgggttactgctgcttggcatcagcgccctgatggggaaaacgctgttgccgtccggcgccgcgtctaccggctggcgcgcgaccgatattatcgaatacgtcaagatcttgctgatgagccgcggcggcgatctgggcatgatgatcatgatgctgtgcggtttcgccgcctacatgacgcatatcggcgccaacgacgtggtcgtcaagctggcctcgcgcccgttgcagatgatcaactcgccttatctgctgatggtggcggcctattttgtcgcttgcctgatgtcattggcggtctcttccgccactggtctcggcgtattgctgatggcgacgctgttcccattgatggtgaacgttggcatcagccgcggggcggcggcggccatttgcgcttcgccggcggcgattatcctggcgccgacctccggcgacgtggtgctggcggccaaggcggcggagatgccgctggtggacttcgcgttcaaaaccacgctgcctatctcgattgccgccatcgtctgcatggccgtggcgcactttttctggcagcgttatctcgacaggaagagtgatgaacagcatcacatcgtggacgtcagcgaaatcaaaacgcatgcaccggggttctacgcgatactgccgtttacgccgatcctcggcgtgctgatcttcgacggcaaatgggggccggagctgcacatcattaccgtgctggtagggtgcatactgttggcggccgcgatcgagttcgtgcgcagcttcagcgccaaacaggtattcagcggcctggaagtggcgtatcgcggcatggcggacgcattcgccagcgtagtgatgctgttggtggccgcgggcgtcttcgcgcaggggttgagcaccgtcggctttatcagcggatttgatcgggttggcgcagtcgttcggcaccggcg

SEQ ID NO: 50131 - DNA, 615 bp, Glycine max
  Peptide Sequence Number=SeqID_166909
atggaggataaagaggaacaagaggatgagctcttgttaataaccttcatagattgcatagaagggaagaaggatgagtggtttctagactcgggatgcggcaaccacatgagtagtaacaaggagtggttctcagaattggatgagaactttcggcacaatgtaaggcttggtaatgatactcacatagctgtgaaggggaaaggtagtgtttggatggttgtgaatgagattatacatgtaatcacacatgtatattatgttcttgaactcaagaataatttattgagtataggactgcttcaagaaaaaggcttaattataacaattcagaacaacaggtgcaatgttgttcatcctaagaaaggcccggtcatggaagtaaacatgagtggaaacagaatgtttgtgctgatagcaactatgggagcagaaactacaacatgttttcaggtggatttggaggataattttcaactatggcataatcggctaggatatttaagctatgatggcttaaaaactcttatctttaaacaaatggtgaaagggttgtcttctatcataactcccagaaatatttgtgcacattgtctagcagggaaacaacactga

SEQ ID NO: 50132 - DNA, 672 bp, Glycine max
  Peptide Sequence Number=SeqID_166910
atggtgaaatccattaaatatgtacaacttgcaattccgaaatttgatgggcattatgatcactgggcaaagttaatggagaatttccttcgatcaaaggaatattggcacttggtagaacatctgaaggacttgaagataaagaattatctctatcaagcaattgatagagaaattctggacactattctaaatgatgagacgtctaagaatatatgggattcgatgaagcagaagttccagggctcaacacgggtgaaacgagcgcaactacaagccttacgcaaagactttgagatgctgcaaatgaaggagggagagtcagtggattcatactttgctcggacgttgaaaattgccaaaagtatgaaagcatatggagaaaatatgcaagagagtgtcataactgcaaaaattatgcgatctatgaagacgaagtttaactacatggtgtgctccattgaagaatccaacaacagggatactatgacaacagacgaactgcaaagtagtctattggttcacgagcagagaatgatgtttccagcagaagaggagcaggtcatgcagatggtggctgatgagaaaagtggaagaggtaaaggaagagggagaagtatagggtcttttcgaggcagaggaaggggaagacagacattcaacaaggctgag

SEQ ID NO: 50133 - DNA, 474 bp, Glycine max
  Peptide Sequence Number=SeqID_166911
atgagaagcaagacgggaaacatgggctggatggtgataaaggttgatctagaaaaggcttacgacagactgaaatgggactttgtagttatccatacgattaatctagttgtggggaagaatctatggatgcctattcagatctctagaggtggcctgactttttcacagctaacctttgcagacaacctttttttgtttgcagagacatctgttgtctgggtggatgttatcaactatgctttaaggaacttttgtgagagttcaggagcaaaagtgaatgaggaaaaaataagaattttctttttgaaaaatgtaaattggcatatcaaggaggagacttcagcaggctttgactttcaatgcaatgaaaacataggaaaataccctggcgtgcccatttttcataaaactgttagttcccaaaccttcaactatgcgactgaaaaagttgataaaagacttgacagctag

SEQ ID NO: 50134 - DNA, 249 bp, Glycine max
  Peptide Sequence Number=SeqID_166912
atggttctcggcctctattacgaatcagagtttcaccatcgcgtcatggagaaggaagctaagtccatgccccacttgatagtgcgactcttcttctcctccagatcgaaatcggcaatcagtggtggtggtgtgggagagaaggggaagaaggagaagaagaagcggttgttttctgttgaagaggtagttggcagtggcggcacgacacgttcgacaattgtttctgttgaagaagtggaagaatga

SEQ ID NO: 50135 - DNA, 159 bp, Glycine max
  Peptide Sequence Number=SeqID_166913
atggaggtttacgatgtgagggcattgcatgtcaagggaatctccggcggcagttattgccacctgcttattgatggatttgactacataggagtcattggagtctgcgaaggagcaacgaaaaacgatgtcgaatcttcctcgatcgatctcctctaa

SEQ ID NO: 50136 - DNA, 210 bp, Glycine max
  Peptide Sequence Number=SeqID_166914
atggtgatgacaacaatgatggtgacaatggttatgacaatgacggtgattacaattgatgacgaattgacaatgacaataacaataatcatgatggtcactataatagtgattatggtggtgacaacgatgacgatgaaagttatggtgacaaaagtggtaattgttgatgacgtggtgacaacgacgattatgatggtaatgggttaa

SEQ ID NO: 50137 - DNA, 129 bp, Glycine max
  Peptide Sequence Number=SeqID_166915
atggtgacaacaaggataatgatgatcataatgacagagatgatgacgacggtggtgttggcagcagcgatggtaaagactgtcatgtctgcaaaggtggtggccatcatggcaactttgatgatttaa

SEQ ID NO: 50138 - DNA, 621 bp, Glycine max
  Peptide Sequence Number=SeqID_166916
atgaaggctgacatagaggccatgaaagaacaaatgaccacaatgatagaagccatgatgagtatgagaaaaatgatggaggtcaacacaactacagtcattgccgcaagtaccgccgctgaggtagacccgactcacccatccggcctcaaccatggaggcaaagcattaggaagtataggcaacccccatttcgtgcaagttcagaacaagcattccttcccaccatatggtttgcctctgaactatacaccacccaatgttgctcatgctcccgatgagaacatcgataactccgcacccatacccattgagagccaacaaccccaatctgatcatgcacatgtctctcaacccatgggagagacacatgaagcacctcgagaccacaatctagctgacttcgaaccttaccttggatatgccactgaagggcaagcaattggtggtgtacccctgccaaacactttggggggccctcagtttcccccacaaccacaacccttgcattttgcggtgggaaatgtccctcctgctatgatggaaaggggaaaatttgatcatatagaggaaaggctgagggtcattgaagaaggcaaagattatactttgctgacataa

SEQ ID NO: 50139 - DNA, 405 bp, Glycine max
  Peptide Sequence Number=SeqID_166917
atgcataaggcattgcgattaaatgctccattgccatatccacacctagtcactctcttccttcaacactttaacatccctcttgattctgaaccttatgttccaatcaagagatcctttctaataggcgctgctgtgattgcatcctttggttaccgaaaagagcatgatggctcttgggtgaaaaagggtgctcaacccattgatgaagaaggacatttacaaggtggagaagattcctctattcttcaaaagattttggaaaggtttgatactttggagttacaagtggacatgcgattcgaggagatggagtcaaggattaccaaggtcgaagaagatgtctcttacatccgtacaagctttgatctaccaccaccaccgccaccatcatcttcatcatag

SEQ ID NO: 50140 - DNA, 354 bp, Glycine max
  Peptide Sequence Number=SeqID_166918
atgacgactaacaacaaataccgattaaggttgaatcctgcaaagtgtactttcagggtgaaatctgaaaagaagttgcttggctttatcgtgactcagaaaggaatagaggtagacctagataagctgaccgtcacttgtgagcctctcttcaagctattgcttaagaatcagtccgtccaatgggacaatgactgtcaagtggcattcaaaaggattaaacgatgtctcatgactcctcttgtgctcgtgctgccggtgcccgaaagacctcttatcctatatatgactgtgttggatgagtcaatgaggtgtgtgctgggacagcatgacaagtccagaaaaagggaatag

SEQ ID NO: 50141 - DNA, 219 bp, Glycine max
  Peptide Sequence Number=SeqID_166919
atgctggctattggtaatcgattactaccttctggtaatcgattaccagagagtaaaactctttggctaacggcggtcctgaaggtgacgacgctttgcccatgcaagggttgcaacaataggattcacagggcgttgttgaagaataaagatatcgtgagcaatttgcagaactgcagctatgagagtatcatctcgggtagctcaaggcaaaaatag

SEQ ID NO: 50142 - DNA, 330 bp, Glycine max
  Peptide Sequence Number=SeqID_166920
atgcaatcacagggactcgcactgcctcttgagcttgaggttggtccttcagctgctcgtgtcagcacaaaggaaagttatattgatccctcaaggaatgatccagacacgggtgactcagagaaatgcgggttgtacgttgaagaaaatcctccctgcccggttgccataggaagactttatgaggggttgacaaccgttcacaacatcccttttcaccatgatcaagtcaaggcatatgactcagacaagtatgcgagcggggaatgccgatgtgtatggattcctcgagccacggtccatacagagatctgggcaaatgcaatttga

SEQ ID NO: 50143 - DNA, 225 bp, Glycine max
  Peptide Sequence Number=SeqID_166921
atgggttggctcttgagagtgaggattgcaactttcgcaaggcttgatcatttgtgtggactccctgatggttgtgctaagcctaaggatatccagggagtaagtttgcaacccttgttccagcgtgctaggcataagctacaagtgctaagcacaagggttttgtgggctaagcttataataactgtgctaatcatggtcctttggacaataagtactttctag

SEQ ID NO: 50144 - DNA, 570 bp, Glycine max
  Peptide Sequence Number=SeqID_166922
atggcctcgcaagactcacccacaatagagacgcccgatacacacatattagttgcatgtgtcagcacgatggggagctgtgctgaagttgctgcaaaagcttctattgaagagccttctgttgtggatgtggccactatgggcttgtacatagttggtgaccaattttatgacacttatgccccggtcccttttccaacttcaaaaattcagtatgtgagggaggccattaacacattcgttggttggccgacacattttgtaaaacctatatctgatgaagagtcacacaatcatctgcctaaaccagttggagttgttcaaaggtgcaatacaattgaaatagagaaaccattgagagaattaattaagagtttgtttgatgtttaccagaaaccagttgagttgccatgggatgggccaaaatttgggattcctaatgttaacaatagtcatgtaaaatatatttcaattaggtttatggatgacaagagtacaagcttaggtcatagttcagtgtatggtttccttgagcctcaatccatacacaatgcaaaggatagatcgtag

SEQ ID NO: 50145 - DNA, 332 bp, Glycine max
  Peptide Sequence Number=SeqID_166923
atgggcatatttgggcagtctatgctccatgctgaggtgttatcctttctcttggctgtggatagaccattgatgaaatccatggagatgtcactcctactttggatgagcataggcaatggttgtaggagactgggtacatctacttgggttgttgtaactgagaacaagagagggtatatctcttgtggatcagttcaagtggagggtacatccacttggttgttcaaagagaacaagggagggtacatcccttgtggatctttgcttgtaaaggattttacaaggttgaaaagaaatctcaaggaccgtaggtcactaggggactggat

SEQ ID NO: 50146 - DNA, 594 bp, Glycine max
  Peptide Sequence Number=SeqID_166924
atggaggaagagagagacgtgtcatcgtatgagttgtcagaggagaaatatgacccactagaggagatccatcgagtcatccaatcggtagttcaattcgacgaataccggaggacacagaggaaggagagccacaacctcgtgcgccgtttcaagttcatgttgctgctctgggaagagcttcatgacctcctacaacctttcctagaaatcggtgtgacttggttaaccaaagtcaaggatgtgcttttgttcaccaaggatttgttgaaactatgtagccaaggaagcaagatccacctcgctttggagaccgaggtagttatgatcacgtttcagaaagtgtatgacaaattaagccaagcatttggtgatgtgccttgtgatgaaataggtatcttagatgaagtcaaggaacaagacacggaacttgcaatggatatgatggttgtgttttctgacaatgatgacagaaatgctgatagtgctatcattgagaggctggctaaaaagctagagctttatagtgttaaggatctcaatatagaaacattggctattaggaaccttgctgcagaaagaaaagggcaatag

SEQ ID NO: 50147 - DNA, 414 bp, Glycine max
  Peptide Sequence Number=SeqID_166925
atgaaagaagggagtccagagaacaaggaatgtgttgcatctgttcttcttgagttgtgctcaagtaactcatcctttacattgacagcacttcattttgaagtgtatgagtatttaatggagataaaacaaaatggaacaaataaagcacagaggaaagcaaatgcagtgctagatctcattagtaggaattatgagttgcaagatttgttgttgttcaattccttacttgatagtagggattgggtagtccatgttgtgacactgactaattcagctcctaatgggaagttgccaatgtcaatactaaaagatagcatcttaaatgaagaagccaaaaggacgaagcattgtttgagtgttacttctactcaatcaaaagcactagttatagattcacaggggagaatgtaa

SEQ ID NO: 50148 - DNA, 162 bp, Glycine max
  Peptide Sequence Number=SeqID_166926
atggagttgtatcaactcaaaatggagatgggaggagatctccatgaccacatcaacaagttcattcaactaatgtggtggagtctgagcgagggatcgagcaatcattcaaggagacatgatgggccaagaggaagatcaaaatcgcaatcgcattcgtaa

SEQ ID NO: 50149 - DNA, 159 bp, Glycine max
  Peptide Sequence Number=SeqID_166927
atgcatatgcatcattgttgtcctgtaagtcggaggataggagaagatttggtcgataccacaccaagtccaaggccaaaggtacgagcagatactgggcccgtgatcgacaggttgtcgtcctacgcctggcttaagacgttaaagaagcgctactag

SEQ ID NO: 50150 - DNA, 285 bp, Glycine max
  Peptide Sequence Number=SeqID_166928
atgactaaaacacatcaaaagggggtacggaaagggaaaagagggaggagcttgccacccagctcgcccaagcgagctaggttgcttcctccagaagaactttacaaattacgtaacgatacttgttttctttccgtaatgtctcgaaaccttacggattacacaatcatcccttctttggcttctggaatgttacggaactttacggattgtgcaacaatgcttccttttgactttcagcatgtcacgaaacttcacggattgtgcaacaatgcttccttttga

SEQ ID NO: 50151 - DNA, 297 bp, Glycine max
  Peptide Sequence Number=SeqID_166929
atgtccaacaaggtcctagggtttccagctctgattacgagcctttgtcaattctacagagtgctcattgcccccaacaaggtcatcaggccccctactaatcgagctttcatcaataagtactgcgcccccaggcaggcgcagggtgaaacaccacaacagcctggggacggccagcagcgggcaatagacgcaccgccgccaccttcagagcccctcatctcacctacaaaggctggagcgttgcctatgacccgtggtcgaccaacaggcaaccaagtccaaagccaaaggtag

SEQ ID NO: 50152 - DNA, 990 bp, Glycine max
  Peptide Sequence Number=SeqID_166930
cgtgctcttagcgtcctccttgcagtcggtgctagtcttgaactcaacgaggtacctattgtagtcttctttcatcttgaagtagaagaccttggagtcgtcggaggtagcagaggggacgaggcgcgtgttaaggattccatcacagatgttggagagtttggcctcaatcttggagtggtagtcacagatgacgacgatgtggtgctcgttgttgtggctctgctgcttttgcttgatcaagggaatgatgcgtcaggaggcgctacgcgccctgatcacgttcttacatttttcactagtaacatcaatcctagccttgcagacacattgatagtccctacttctaaggttgatagtcctaaatgcgtcaaggaatttagatcaatcagtttgtgcaatgttcttttcaagactatctcaaaagattggctagggtttcttagagctaactctaatcgaatttggcttcctgatacaatcatttgtcttataatgaacaatataagaacaacttctctatccttaaaatggaataatgagatatctgaatctttcttcccaacacgtggacttagacaaggtgaccctctttctccctatctctttgtccactgcatggataagttggctcttcttatacaagaggaggttcaagacaattcatggcaacctatccatgttacacgtggaggtcccaagatgtttggttatgtgtctagccttaaggtcaatcttaagaaatccaagttttattgttctaaaaatgtccctgatgctaagggtggttctcgattctgcttaattctagtcctaactatgtcatgcaaaatgcttggctccccgaaggaatatgtgatgagattgaaaagaagattagatctttcatttggggttgttaccacaagcattgggccaattgacaaacagtcactaaagccaacaaagatggtggtcttggcatccgcacttctagggaagtcagtatag

SEQ ID NO: 50153 - DNA, 240 bp, Glycine max
  Peptide Sequence Number=SeqID_166931
atgaggggtttagcctcttattttcatgaaaggctttacaattgcaagggtttgatagggagagaagaggataaagaaggatggagatggagggaaggaatgactcctaaaggtgcagttcaacttggttttcacacaaccttcgcgctaagcgcgattgctgctcatagtgtgtgtggcggtaatctcgcgctaagtgcccattcacgatccagacttctccatactttttggcgctaa

SEQ ID NO: 50154 - DNA, 135 bp, Glycine max
  Peptide Sequence Number=SeqID_166932
atggatgcagaattcacaaagagatgtgtacctaggagcctacttgaatggttgcggcgcaagacgaagattattcaatgttttgataaggaatacggaaaatacccaaatgggagggcaaaagggtcattgtag

SEQ ID NO: 50155 - DNA, 207 bp, Glycine max
  Peptide Sequence Number=SeqID_166933
atgcaggatgaaacaaatatatactatagtaccggttttgtgaccggaactatttacatagtacaaaattattttcttccttctttgaggaagagccttcgtcttcttcttgttggagaagctgtaggacttcttgaagatttttggccagacattcctttcacctggagctggccaggaaaggagctagttaagatttctgattaa

SEQ ID NO: 50156 - DNA, 228 bp, Glycine max
  Peptide Sequence Number=SeqID_166934
atgctccaaccatatgtgatcaacataggcttaaaggagcactcaaaccgtgtgacccccaaggcctacactccgaagagtcctctccctccttattcagggttcacaaatgttagagagaatgagaagggattgaagcctccatttgtactatcttcatgcgattcctttttctccctccacgaatattatctcgccaatcccaatggtgaaagtgtgcgcaattga

SEQ ID NO: 50157 - DNA, 741 bp, Glycine max
  Peptide Sequence Number=SeqID_166935
atggtcagcctgtgtgagcaactggcgaaactcggcgtctgggtgcgtctgcactacgtttatccgtatccgcacgtggatgacgtgatcccgctgatggccgaaggcaaaatcctgccttacctcgatattccactgcagcacgccagcccgcgcatcctgaagctgatgaagcgtccgggcgcggttgagcgcacgctggagcgcatcaaacgctggcgtgaaatctgtccggagctgacgctgcgttccaccttcatcgtgggtttcccgggcgaaaccgaagaagatttccagatgctgctcgacttcctgcgtgaagcgcgcctcgatcgcgttggctgcttccagtacagcccggttgaaggcgccacggctaaccagctgccggatcaggttccggacgacgtcaagcaggcgcgttttgatcgcttcatgcagttgcagcagcagatctccgcagagcgtctgcaggagaaaatcggtcgcgagattctgataatcgttatcggcgcgcagccggtcccagcacgctttgaatacggccgccgcagcggccttttctttttctaccgtccgcggcagctctttgccgtcagcaccgtatttccgtccgccctgatgattgctgtagcggcgcgcgcgggtgtagcccatctgaataaatttgcgcgccatatccataccgacaaaatcatcctgcgcgcgatacgcctcgaacagctgcatgattttttctga

SEQ ID NO: 50158 - DNA, 786 bp, Glycine max
  Peptide Sequence Number=SeqID_166936
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctgttcaacttaccaaagtcacaacttcagtgctatggtgaatcaatttgcacaggttcagacttgctaagcatgtgcaacaatggtcagagtccacttgataggttaatatctatggtagcatggtgcatatctactactcgccctgtgacttttggtgttgctccttataatctcattcttggtgagacacaccatgtttcaaggggaaatcttaatgtgttattggagcatgcattcatatgcatagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 50159 - DNA, 336 bp, Glycine max
  Peptide Sequence Number=SeqID_166937
atgggagctgctgaaaggctggacatcgtcggaaaggactggctgaccgtggacgaggccgcgcactactgcggcgtgtcacgaagccagttcgattcgaacatcgccgactacggcatcgaaccacgaaatttcatgggcaaaaagctctacgagaaagctgccctttactctgcaatctacggctccagacaatggtcaaggtcacaatcttctggcgggacggcgccgcgtacctcaactggcgggaaggcggcaagcgaagccgtgtcaccattggtcgcgtcagcccacgcgaagctgagggcgtacgagcagcgaaagaagcggaactga

SEQ ID NO: 50160 - DNA, 572 bp, Glycine max
  Peptide Sequence Number=SeqID_166938
ctggtcaagaccgccttcttcgcctcggaccccaacctgggccgcatcctggccgccgtgggctatgccggcatcgacgacctggacgtgtcgaagatccgcctgtggctcgacgacgtgctggtggccaaggacggcggccgcaacccggcctaccaggaggccgatggccagcgcgtgatgaagcaggccgagatcacccgacaccgtctacacctgcgatttctcgcacgagtacgtgtcgatcaacgccgactaccgttcctgatcaagacccgccatccgcccggctgaccccgggcgcgaagcgacggcgttcagttgcgcgccgggcctcgcgggatggcggcagcaatgaaatccagtggctgcgccttacccatcgccggtcactgcccccggggaatccgtggcaccaccgcggtccccggcaggtgacaaccgttgagcggcgcgcgtccccacgacgccttgcggcgggatacgcgccctcttcttccgacgatgcccgcgaatgcgacgcgggcccggtgccgggcccgcccgttcgctcttccaggatcacaccttga

SEQ ID NO: 50161 - DNA, 449 bp, Glycine max
  Peptide Sequence Number=SeqID_166939
ggaggtggttgtcgcccagctcgcctaggtgagctagggtgcttccaccagaaggcaccgccttcttttgcaacactcaggaaggctcaaggttccgaagggagcaaacaaggttcaaggaccgaccgcaagtactctcggacgaaatttgggtatgacacacgccctcgccttcagaggactgcacgtcctcaccttcagaggactacacgtcctcgccttaaaggactacacgtcctcaccttcaaagggctatatgccctcgccttcagagggctacacgccctcgccgtcaaagggctgcacgccctcgccttagaggactacacatcctctcctttaaacgactacacgtccttaccttcagagagctacacgccctcccctttagaaggctacacaccctcaccttcagagggctacacgccctcaccattagaggactacat

SEQ ID NO: 50162 - DNA, 626 bp, Glycine max
  Peptide Sequence Number=SeqID_166940
atggaggctgaggtgacggttgttgagagtttagatgggttgaatgtggctaaggaggggttcaaggtactgagcaaggcacgtgaggtggaaagtgaggtgggaggaaatgatggggttagtaggcttgaggataatgggctaaggaataaaatgaaagtgtctaagggtggcaaaggtaaaggggctaagaatatttttggagtgaaagaaactaagaatgagccttctacgagcataagcccacagtcagttagtaccaagacttttacaccttttgttcctaagacatctaatggtgaaataaagcaaaaaccagtaaaaggaaaagtggatgtgtcgagtttgtcctctgttgctcaggtggagtctgaagagggacgtgcatttaatgcttgcattaaatgctcgaatgacctgagacttcagacaaagaatagagtgaagaatccacctgtgagacaacaaatacttgaagacaaaggcttgtgcatacttccaactatcgcaacctacccttcggcaggagggcgacgcgggggctcacgggtgtgtcttccaagggaggaagcgcgtagagtcgccaccaatgtttattcgaggaaaacgtcggaagaaccggaaag

SEQ ID NO: 50163 - DNA, 381 bp, Glycine max
  Peptide Sequence Number=SeqID_166941
agagactctatacttggattgactcactctacggtggctcactcaagcttgaggatagagacttctcaagctatttatcttctctctcagaaaggctctctacttggattgagtcaccctatggtggctcactcaagcttgaggatagagacttctcaagctatttatcttctctctcagagaggcttactcaagcttgaggatagaaacttctcaagctatttatcttctctctcagagaggctctctacttggattgactcactctacggtggctcactcaagcttgaggataaagacttcccaagctatttatcttctctctcagagaggctttttctcactctaagaaatggattcactcttgtcttggatggatag

SEQ ID NO: 50164 - DNA, 654 bp, Glycine max
  Peptide Sequence Number=SeqID_166942
tgctggatttatgagcactttccgagtgtgcatcagtgcgtcaccgatgatgcgtacaaggagacgtcccctcgtgcctctcggtggctgatgacaaaggctcatatgaagggaattacaggagcatcgcaccgggcatgttgtgatgctttgacggtcactgacgtgtgctggttgccttacagtgaccatcgaggggttagggggtttgagctgatttcatcgttccagggtcagctgagatggggtcctatggtgatcatagttcgaccggagagggtgctacgccagtttggttacattcaaagcatccctctatcgcctgttagcgcttcattgtcatatgatgatatagatgacaggtggatgcatttctcggaccacgtagtagctatgggtgagctttgtgtagtgcctgggcaggtatctacggattacatgaagtggtttttccagatatctcacccattcatgataccgacccaggcaggctatgaggtgatcgcaaaaaagttggagcgtgtgctcaaccttaggatggtcactgtaaggacagaattacatgatatcatgcaagattgcctgaagatcgccaggggggtgccagcgcagatggaagtgttagggcccgacaaagatgcgcacagagcatga

SEQ ID NO: 50165 - DNA, 600 bp, Glycine max
  Peptide Sequence Number=SeqID_166943
atgcaggatttgtttctaaagtttgtatacaatcagaagaaaagatgttggcagcttaggaagaaaggctataccattggcagattactatgggttccaccaattacaggggaattatgttatttgagaatgatgcttaccgtttgtaaaagagctacctcatttgaggatttaagaacagttgataatgttcagtattctaaatataaagaagcatgttttgctatgggatttttacaagatgataaagaatttattgaggcaatcaaagaagcaaaagactggggttcagcacattatataagaaagctatttgtgttgttacttttaactgcaacaatgagcaaacctaaacaagtttgggaccaaacttggcattggatggctgatgacattgtctataattataaaaaatcatcaacaagtccagcattgcagcttgatgatagaactcttcaaaatttggtcttgcttgaaattgaacaactgctgcaagcaaatcaaagatcgctaagagactatccttcaatgccatatccagaggatgagaattgtccagcttatctagacaatagccttatattacttgaactgaactaa

SEQ ID NO: 50166 - DNA, 519 bp, Glycine max
  Peptide Sequence Number=SeqID_166944
atgacccaagaagccgtggaccacgaccacgaagaagacgacaccgagtcttgctttttccaggactccaacgaccgtttactctcctcttcttcctgctccacctccacctccgacgacgacactcccactccccaaaacgacaccctcactccccacaacgacactaacgccaccaaaaacattgcctccctcaatgccctcccacaatttccttttccaactatgtgcaagtacgacgcctggatctccgaaccctcctccctctccgaacgccgctcccgcctcctccgccagttcggcctccccgcaccgccgccatcctccgccgcaatcccccgatcagcctcctctcaccattgcaccgacactttctccaccaccgccgccgccacgattccccgatcgaaatccgacaacaccgcggatcgcggcaccaagcattgcaagtcctcggttgttccaatccacgacaatgacgacgtaataatcgtggtcgtggtggttctgtttgtgtga

SEQ ID NO: 50167 - DNA, 584 bp, Glycine max
  Peptide Sequence Number=SeqID_166945
agaattactgtactcagttcctatcctatttgaatgaacgtggggatgatgggccgatggttattatattgacacatgccagaataaaagatgcacaaggaagttatccagcttcagtgagcaattccttcaaggcgtcaaaactattgattaatgatcctatattggaaattcaggaatttaaagagaggcttttagatttaggtgttgaggctgaagccaaaactattttagaaatcgatgccatttctgaggacgttgtttgtgttacggtggggactattagcaaaatagtcatggataaccattcatggtcttatccagcctgtgctcaatgtcataggaaaactgacatccaaacaggaccattcacatgtggatgtggcaaggataatgatcagcctgttctgaggtataaagttgaagtcatggttacccaaaacaatgagagcagcacatttttgctctgggaccatgaatgtgctgaattgattggtgaaacagctgatgatgtgaatagggtcaagattgaagatggtgatcttgatttggatgcttcccctcaagcacttgacaaattgtag

SEQ ID NO: 50168 - DNA, 332 bp, Glycine max
  Peptide Sequence Number=SeqID_166946
gaacacgagatggaactttaacactcaatcagaatgaagaaaatgacaaaaagaagagaagcatagcccttaaagcctcatcttcaatacaagaagaaaacgaagaagaagattatgatgatgaagaagatttttctttctttgttaagaaatttcaaaaattcatcaagaaaagaagaattgacaggcgccagaatttcaataatggaagaaaatcacaagatgattctcaagcccttaggtgctacaaatgcaatcaaattggtcacatcaaggccaattgtccatcaaatgaagaatggtcggagaaaagtgaaaaagaaaagatttga

SEQ ID NO: 50169 - DNA, 414 bp, Glycine max
  Peptide Sequence Number=SeqID_166947
aatgaccaaacttggtctctgcgtgccatcggacacgactgtgtctgaatggcaaaagggaatgaccaaacttggtctctgcgtgccaacggacacgactgtgtctgaatggcaaaggggtgcggataaccgtaaggtatctccgcgtatcataatgaccaaacttggtctctgcgtgccaacggacacgactgtgtctgaatggcaaaggggtgcggataaccgtaaggtatctccgcgtatcataatgaccaaacttggtctctgcgtgccaacggacacgactgtgtctgaatggcaaaggggtgcggataaccgtaaggtatctccgcgtatcataatgaccaaacttggtctctgcgtgccaacggacacgactgtgtctgatggcaaacgggtgcggataaccgtaag

SEQ ID NO: 50170 - DNA, 516 bp, Glycine max
  Peptide Sequence Number=SeqID_166948
ggtgcaccttttgagcgcaccattgttgacgattggaagtttgattactccagtcatgatgcccgccgcatggtctgcattgaccaggcggatatgaccggcagactgcttgccgggtcattgacttttaattgtcacatcatgcactatatcattgttagaattttgatgcctcgttcttttaatctagctcaagcctcagaagaggacttgattctgatgtgggctttcttgaccggtcatccaatcgactgggcccatttgattcgttactgcatgcataaggcattgcggtctagtgcacctctacctaaccctcagcttatgactttatttcttcgacattttaaaattcctttgaatttagagccttttgtgcaagttaaacgctcctttgctattggtgccggtgcggtaacctccttcggctaccataaggacatggatgggcaatggttgaagaaggatgcacaacctccgcaagaagaacatactccctctcctctgcctcaatga

SEQ ID NO: 50171 - DNA, 162 bp, Glycine max
  Peptide Sequence Number=SeqID_166949
atgcatgccacaggtgctcctaacccacttggtcagaggcaaatctcgcttacggctttggatcttcttcgtcaatggagtcatttgcttcttgaatatcaatggcagcggaatggagaaggaagaaagatgattgaagatgccacttcaaggagaagatga

SEQ ID NO: 50172 - DNA, 498 bp, Glycine max
  Peptide Sequence Number=SeqID_166950
atggattcactcggtgggagtcatcccctcaacactccaccaaaagctgaaattcgtggtggaagggcatttggtcattgtttcgggggaagaagatgttttggatccctcctaatgcagccccgcatgtctagtgcgacaatgatggtggcccagataatgttagggcacgactatgagcccagaatgggtttgggcaagaataatgatggcatggccggcctagtagacatcaagggaaaacgcggtagattcaggttaggctataaacccacgcagaccgatgtaaggaaaaacatcttggaaaggaggaacaagggccagggcccacagccaagaccgcaagcaagagaggtcccaccgtgccacattagtagaagcttcgtgagcgcgggcttaagacacgaagagcaagtcaccgcaatatgcaacgaagcccctcaaaggtggtcagacttggtgcagccatgccttcccgatttccagctagggaactag

SEQ ID NO: 50173 - DNA, 288 bp, Glycine max
  Peptide Sequence Number=SeqID_166951
gtaccagcttatgtagcagctcaactcctaggaagcacacttgccagtggaactctgaaactattatttatggggaagcatgaccagttttcaggaacactcccaaatgggactaacctgcaagcttttgtgtttgaattcataatcacatttctccttatgtttgtcatatccggggttgccaccgataacagagcggactcaatgaaaaatgttacatgggttagatcatctgttatcaagctgataaatgaggtggagagtgtgcacaggggcattcttgagtga

SEQ ID NO: 50174 - DNA, 672 bp, Glycine max
  Peptide Sequence Number=SeqID_166952
atgccggttccacaaacagagaaacaagtgagaggttttcttgggcgtctaaattacatttctcgtttcatctcgcacatgacagccacgtgcggacctatattcaagttgcttcgaaaagatcaaggggttgtttggaccgaagattgtcaaaaggcttttgatagtatcaagaattatctgctagaacctccaattcttatacctccagttgaaggaaggcctctgattatgtacttgactgtgttagaagattctatgggctgtgtgctcggacaacaggatgagaccggaaggaaagaacatgccatctactacttgagcaagaagtttaccgattgtgagtccaggtactccctacttgagaaaacttgttgtgcactagcctgggctgccaagcgtcttcgtcactacatgattaaccacaccacctggctaatatccaaaatggacccgatcaagtatatctttgagaaacccgctctgacaggaagaattgctcgttggcagatgttgttatccgagtatgatatcgaataccgcacccggaaagcaattaagggaagtgttcttgctgatcatttggctcaccaaccaattgaggactatcaacccatcaagtttgactttcctgatgaagagattatgcacttgaagatgaaaggattgtga

SEQ ID NO: 50175 - DNA, 351 bp, Glycine max
  Peptide Sequence Number=SeqID_166953
atgcacgaacaacgcttgacaatcaattcgtggcgctccggactcgatggtggaggatacatgaacgacgatcaattcatggggttccgaataagatttgatgatggaggatgtacgaacagtgctaggcaatcaattcgtgggactccaaactcgatgcgcttggcaatcaattcgtggggctccggactcgatggtggaggatgcatgaatggcaatcaattaatggagctccgaataagatttaatggtggaggatgcacgaacagcgcttggcaatcaattcgtggggctacgaactcgatggtggaggatgcattaacgacaatcaattcatggggctccgaataa

SEQ ID NO: 50176 - DNA, 535 bp, Glycine max
  Peptide Sequence Number=SeqID_166954
gcgacgaagaattcggcaccggtttgtcgcgcgactgggcttccaagggcacccagctgctgggggtcaaggccgtcatcacgcgcagcttcgagcgcatccaccgcagcaacctggtgggcatgggcgtgctgccgctgcagttcaagggcagagacagcgtgcagtaggtgggcatcactggcgaggaaacttacgacatttcgggcctggagaacggcatcaagccgatgcaggacgtgacgctgacgatcacccgcaaggatggttgaaagcaggacgtgacgctgatgttgcgcatcgacaccccgatcgaggtcgactactaccagcacggcggcatcctgcccttcgtgctgcgccagctgctggccgcgtaacgcccgggccgcaaaggcaaagcccctggaaccgcgaggttccaggggctttttcatcgccgagccgcctcaagatgaaaaatgccccctcggggggcagcaagccgaaggcgcggcgtgggggcccttttcatcgccgagccgcctcaagatga

SEQ ID NO: 50177 - DNA, 462 bp, Glycine max
  Peptide Sequence Number=SeqID_166955
atggaagacagctccaacaacatcacgccggtgttccagcaggtgatcgagaccaagcccatgcagaccggccaggtcaaggtgctggacatggccgccatgcagaaatcactggccgaatcgggccgcgtcgcggtctacggcgtgtacttcgataccgacaaggccgaggtcagcgccgaatcgaaggcggcgctggacgagatgggcaagctgctcaacgccaaccccaagctgaaggtctacgtggtcggccacaccgacaaccagggcacgctggccggcaacctggagctgtcgcaaaagcgcgccgacgccgtggtcaaggcgctggaagcgggctacaagatcccggccgcgcgcctgtcggcgcgcggcgtggcgtcgctggcgccggtggcggccaacgacgccgaggccggccgcgccaagaaccggcgggtcgaattggtcgcgcaatga

SEQ ID NO: 50178 - DNA, 408 bp, Glycine max
  Peptide Sequence Number=SeqID_166956
atgcctgaaaaaggggtgaaaacccctatgtttctgctagaaatcgtgatgaatgtgttaagcgcacctgctgcgcttagcctgttcattatcaaggttcacttctctagaggcttgggaaagtacacaaacatagtggtgcctagaaagatacttccagagaggaatgtggtgatataccacactgagttcaatgatttcaaagaagagcttgagagaagaaattggcatgaagagttgactagctttgcagaaggcagcattgatgttgccattgtaaaagaattttatgctaacctctatgatccagaggataaatcaccaaaacaggtgagggttagaggtcatctagtgaagtttgacaaagacgccctcaacacattcttgaagacccctatgatcacttag

SEQ ID NO: 50179 - DNA, 836 bp, Glycine max
  Peptide Sequence Number=SeqID_166957
atggttgaagaagaagctatagataaaaagaagagacgtttagcattaaagactagcattccatcaagtgatgaaagtgaggataacaatgcagaagggtcggatgctgaaaatttgaacctgcttgaaggagagccatcttcctccaacggattcacttgcttcgagtgccaaaagacaggtcatgttaaggcatatattgctttagatgacaatgaatcaacaatttccagcgacaatagtgacgaggaagaaaaaaaattgtgcttgatgtcaaacaatgaagctgaaagtgaggtaatcattttctatttggaagatgatgataactatgatcagcaactagatgctttcaatgaaatgcatcaagaagcacaaaatttggtcattgcaaatagtcttctaaaagcggataaacaactatggtatcttgatagcagcttctcaaggcatataataggagacaagtcaaagttcatgtctctaaaagctaaggaaggagtatttgtaacatatggtgacaacaacaaagggagaatacttgtaaagctaggaatgtcgagaccacaggcaacaacactaagagccttaaagaatcttgattctatgtcccttaaggaactagctggtatcctcaaggttcatgaacaagaactttatcaggacaaaggaaccaaaagagaaaagtatttggctcttagcagacaaaagaataagaaggcatcatcatccaaagaacaagtatcgagaagtttgttcaaagctcttaaggccaatgattcatctaatgatgaatctaagaaagattctgatgaagaaaatatggtgaaacaaag

SEQ ID NO: 50180 - DNA, 621 bp, Glycine max
  Peptide Sequence Number=SeqID_166958
atggctatggaagtgagaactttagggaggctgtttggtgaagaggcacccaactgctcccacaggaaaccctttccagtggtaggccctcatgtcaattatgccataaacactaaaacaactaacgttttcgccaaaaacacaaaaactgataaagcttcaatgttggatgaggtgatagaatatttgaagcagttgcaagcacaagtgcagatgatgaataggatcaacatgtcatctatgatgctgccattgaccatgcaacaacaacttcaaatgtcgatgatgtctccaatgggcatgggattagggatgggaatggggatggggatgggaatgggaatggatatgaactccatgaaccgtgctaacatccctggcatccctccagtcctccacccttctgccttcatgcccatggcagcctcgtgggatgccgctgttgctgccgctgctggtggaggcgaccgccttcaagggactccggcttccgtgatgcctgaccctttgtccacaatttttggatgccaatcgcagcccatgaccatggatgcctacagtagacttgctgcaatgtatcagcagctgcaccaacctcctacttctggttccaagaactga

SEQ ID NO: 50181 - DNA, 411 bp, Glycine max
  Peptide Sequence Number=SeqID_166959
atgcttcatacatacaacagaatcaaaccaaatagagggaagcaatataatcattcaatagcatcaacatcagaaacaatacaatcattcaaaacatcaatagcaacgaatcaacataaagagagggaacgaataaccacttacctagaagaagaagaactgcaaccaggaagaaccatgaaccaccaacaagaagaagaaccagaagcaagaagcagtgtgcgtgaagaagtaatttgcttgaagaagaggcagaggaagaaggagaacgaagaagcagaaggagaaggagaacaaagaagaaggaagaagcacaagcggcggaagatacccaaagcaacaaccaaaaaagtaatatctatgttaataggcttaatcaagaaccgacccacaaaaaaggacttagcctag

SEQ ID NO: 50182 - DNA, 356 bp, Glycine max
  Peptide Sequence Number=SeqID_166960
atgagccagtgtgttcctagttgggatgtcgaagacaacccaccaccctcaagagtctctcttcgctccaactccaattcaactgcccctgatgttcccatgttggactacgaggttgctgagctgacatgggaaaatgggcaactttctatgcatggcttagggctaccgcgtgtgccggtaaaaccaccaacagccgccacgaataagtacacatgggagaagcctcggggaagtggcaccttggagtccatagtgaaccaagccacgagcttttcccaccaggaaaagcccagaccgttaaacggagacagtggtggtggtggtggagtttatgggaacttcatggtcccatg

SEQ ID NO: 50183 - DNA, 1170 bp, Glycine max
  Peptide Sequence Number=SeqID_166961
atggcgctggcgcgagcgtggcgcgaatcgaaattatggcgcgaaagagcttcttcttcttcctctttatatttcaaagattctcacattacacacatttctgcatctgcagcatccatggcttcttcattgggtcgaagaagaacccacgctcccaaagcatcctccacccttaacgacgacgtttcctgcgaggaatgcggcggtggccactccccttccaagcttattctctgcgacaaatgcgaccgtggctaccacctcttctgcctccgtccaattcttccctctgttcccaaaggctcttggttctgcccctcttgctccaatcacaaacccaagtctttcccccttgtccagaccaaaatcatcgacttctttcgaatccaacgctcccctgaggcattatcaaatcaagacacgcggaggaagcgaaagcggggtgggggcttggtggtatcgaagaagaagaggaagctgttggcgttcgtgccgagtgaggatcccaatagaagattggaacagatggcgtcgctggcgacggcgttgaccacaactaaaacggagttcagcaatcagcttacttacatgcttgggatggcaccaaggtccgctaatcgtcctgctcttgagcgcggtggaatgcaggtggttttgtcaaaagaagacaccgagaccttaaacctgtgcaagcgtatgatggaaagaggagaatggccaccactcatggttgtttttgatcctctagaaggcttcactgtagaagcagatagatccatcaaagatttaaccataataacagaatatgttggagatgtagactttttaaaaaatagggaaaatgacgatggagatagcataatgacacttctctcagcttctgatccttcgcggacgcttgtcatctgtccagacaaacgaagcaacatagctcgattcattaatggcatcaataatcacacgccggaagggaaaaagaagcagaacttaaaatgcgtgaggtttgatgttggaggtgaatgccgggttcttttaattgccaatagagatattacaaagggggaaaggtgtgattgtattttgaagtttaagatttttgttgtgttgttgagttggagacgaagatggccaaagatgaggggggaggaagggagaagaggaggaaaatga

SEQ ID NO: 50184 - DNA, 498 bp, Glycine max
  Peptide Sequence Number=SeqID_166962
atgtgtcgcgtcaattttgtggaccccagacagtacataatccctccaagctctgagtctatcttgttggtgaaagaggttgttcggtgtcggggtggtagccccgacaagttcgagagttacaggtcctttgtttctgattccgctatcggtatggacataagtgatttcaagggttctattcagcaacctcttgtggatcgtgaagttgttctaaacggtgacttttcctcggaggagatacaccatgaagcttttgacgacgagtcttcttcctataagagattggtggacccgcactatgtcagcaggggtacctctcgtcctcacagaaggaggaatgatttggcaagtagggtggagcgtattactgaagagaaacaagatcttacagcgatagtggctgaattcactaaggacgtgaaggacaatgaactacttgatgaagaagaaataactatcacagaggaggagcaggatgctggggccaatgtttag

SEQ ID NO: 50185 - DNA, 1792 bp, Glycine max
  Peptide Sequence Number=SeqID_166963
atgcgtttaccctgggtttggcgagactcaccaagggcagaccatgggtttgacgaacctttggagattcgaccagggatgtgtctgtcttggattttggcgaggctcagtgagggctcaccaatggaagaccttgggtttgataagcctttagagatgcgagactcaccaagggcggaccttgggtttgataagcctttggagatgcgagactcaccaaaggcgaaccttgggtttgataagcctttggagatgcgagactcaccaaaggcggaccttaggtttgatgagcctttggagaatcgaccaaggaggcatccgtcctgggttttggccagactcgccaaggcctttggagaatcgtcatctgtttgccgcaaactggctaggggccacgaaagtcatgcagtgtcactagctggttgcatactgagagctgaaatgttcgacaagggtattgaagctgtcgatggaccatggagggagtcctccgtaccatatcaatgtggcccctttgatggacgttgggaaaacttgacacaagattacattgtcgttggtgtggagattaacctgggtggggaatgcatccagatgcaaatctaccttaatgatatggttgaaaaaaggatgtcgacgagtcgtccgcccttcatggcgggcggagtgctagtcgccctggggcgtctcacacaagcctccaactggtcgtggtcagccttcagctttttgagttcctctttatggcatcactccatctttgcaatacatgtttggagttgttggagagtgtcgttgtttgtcatggttgttaggggaggattggagctctatagaggtgtctcgtgtctaaggtcaaaccgtgtgctaaccattggtgaaaagaggccgcggggaaaattttaccatagctccacggtaggcgccaaatgtacttaccaaaatctagagctgattgacgttagggtcgacgtagccaagatggactccacgatctcacacgtcgaactacatgtacccttcactgggagaactaaggggggacttgcaaaacaaaggactacaatgctcaagaataagggagggaagaggtatgggtttgtgcagtttaaaggggtcaatgatgttgaaagattggttcgggaattagataatctttggattgagagcatgaaacttcatgtgaacatttcaaggttgaataaggacaatcaacatagtaggagagaagtggagagcaactcaaggagaggagggaggttcttggagatgagagatgcccttatgctggaaggatgtagcatagtgagtgtcagatacttgggagacgatagagtgctattttcagggataaactgtgattgtttggaagccttattgcaagctagagctgatggctgggatttctgctgcatggtggcgtcctttaagcctattgccattcatgagaggatttgcattaatggggcaatatatgatgtcttagtaaaggaagagatggtctataatcaaactaaagacaaatattgttgtcatttgcgtagtcgatcaatcaagaatggtggatctgaagcgggcaaaattgatggctttgtaagggaaattaatgacattatgagctatcctggttcagtggatagaggtgatggtgaagattatcttcagttgtcggaggaagaggaaaaggaggaaagtcatgatgtgctagcagctatgtcagaaaaaaagggtatgggaagagcaattgggaaacaaccaggcaacggagtagtgcaagaatgggaaggagttg

SEQ ID NO: 50186 - DNA, 276 bp, Glycine max
  Peptide Sequence Number=SeqID_166964
atgaggaagaatgtggtggtggcggtgagcacaactcttgcggtggtagtagtaggagcattgatcagaaggtggaagcagtggaaagagcaacagttgaggaaaacaaaccaaattattcgaaaattcgctagtgaatgcgccaccccagtaacaaagctttggcaggttgctgatgatttggtctcaagcatgaaaatctctcttgtgtcttcccatgaaaccaccactctcaacatggtcatttccaacgttacatcactcccacttgggtaa

SEQ ID NO: 50187 - DNA, 525 bp, Glycine max
  Peptide Sequence Number=SeqID_166965
atggatttgacttacttgtcttatagattatgcactagcctcagcctggttcacaaaggaatggtgaaagagcttaataaagcgttgactaatcatggaatgaaaatgcatgtttcttcactggttgatgaaactatcggaggtttggccggtggaagatactataacagagagagcgtggcagcaattacccttggcatgagcacaaatgccgcttatgtagaatcaacagaagaagttgctaatgaccttacacaatctcccaattcaagcgagctggtaattagcatggagtggggaaagttcaattctcctcatcttcctttaacaacatttgatgctagtgtagatgctgaaagctcaaatcctggtagcgagattttcgaaaagcttatttcaggaatgtatttgggagaagttgtgagacatgtcttgttgaagttggcccaagaaacagacttgtttggaagtagggtgcctccaaagttaatgactccatacttactaaggtatctaaatccataa

SEQ ID NO: 50188 - DNA, 183 bp, Glycine max
  Peptide Sequence Number=SeqID_166966
gaaataattgattacgtagctacagagatagctaagtttgtttcatcccatcctgagattgacgatggtgcaccagcgaaaaagaagaaattgggcttcaccctatcatatccagtggatgaaattttgcctttcgcggccacaacatttcaacggaaaagcgcaaacaatccagttgagtag

SEQ ID NO: 50189 - DNA, 231 bp, Glycine max
  Peptide Sequence Number=SeqID_166967
atgtgtgctatacatgaatatctcattttccattgctcacactattctgccccagcccaatctggcaatctccattcccatcttcgtgagtccagaacgtcttcaactgagcttctacctccactcgtctggatcaaccagagtcttatacatattcactttagcagtttagctagctgcgaggaggagaaaacaatggtgaaactgaagaaggatcctgttatcctgtaa

SEQ ID NO: 50190 - DNA, 138 bp, Glycine max
  Peptide Sequence Number=SeqID_166968
atggtggtaactacatctgcaaatggtagctatatgcctatatgtgtttacggtgaccataagaccaaaaccaataacgttatttatcacggtaaccactttttgcaagtatcttcttccggagaaattattgtttga

SEQ ID NO: 50191 - DNA, 249 bp, Glycine max
  Peptide Sequence Number=SeqID_166969
atgggggtggtgaaggaggttttgaggaggggtttagagagggtgtggcagaggtcagaggagatgaaggagaaaaggagggacttagcattgaagaacttgcggcaggcgaggaggggaaggagaagggagctgagggatgatgacacgtgggtttggagccaccagaagaaggagaagagagttatggggtcggagttgagaggcttgcatgagaggatggagaggatgagagagagagtgaggtga

SEQ ID NO: 50192 - DNA, 297 bp, Glycine max
  Peptide Sequence Number=SeqID_166970
atggggaaaagaggtgcctctccctttctttcgctaacacacttttttttttctgcgcatatgattgcgaaggagtatccaggtcaattaccaagatttttaaactcctttcatgcacttctcataatgttatatgagtttaaaatatgggtgtccaatggaggatgtgataacaggattgtctatacagtgctaaggatgaaaatcagtgtactacaacccaccaaggaaggctttcttaggtttagctcctactaccttgcctcaaacacttgttcaacacaagagatggtctga

SEQ ID NO: 50193 - DNA, 153 bp, Glycine max
  Peptide Sequence Number=SeqID_166971
atggcgttcaagttgagcaaaggtgtgcccaaagaggaaggaagtggtggtggtgaggaatctgagtcgataggagggctcgaaggtgaaaggagagggtcaatgtcgtcatctatgataaaaaggtggatatggggcttacaacaaagtccc

SEQ ID NO: 50194 - DNA, 504 bp, Glycine max
  Peptide Sequence Number=SeqID_166972
atggcttgtttgcaagattctaatggccattttatttcttcattgtcatcttgtttcacagggatcctttctcctctagaggctgaagctagagctcataatgttgctcttcattggctatcttctcgagaccagagacatgttattatagagactgattgcaagcaaatccttgacattatgaaggccagaaatttccagaacaatgaatccagaatcgaaagaggtttgatgacagggtggttgtcagcctataaaggaggaaaagagccaggagttatgggtggtgggccctggtgcagcttcaacagggaaacatggaacatcgggtgtattttagaatccgaaggcaagcgggttgtagagaaagttgacgatatggccggagtcgcacttagacccaatctccaacttgaaaggataagttgcggcaatggagatcggcgtaatgtttcatggcttcctatgctttctacaggcgtctctgtaattggacctagatag

SEQ ID NO: 50195 - DNA, 405 bp, Glycine max
  Peptide Sequence Number=SeqID_166973
atgggaccatggagttgggcgattatgaatgaaagacctaaggtattgtttaagagttcaattgagaacttcggtctagtcgtcgatttcaggatggtacaagagaacccctatgactcagggagactgaaaatgaaatccaaggataggtcttcccagataccggccagaatgggtaatggatgccgaaggcgtgtgggtttgcaggagaagtctgaaactcttctagaagcagaacgacaaatggatggtcctgtgatagccatattttgcctttgtagaatagtaaatcacggtggattgcaaaatcctagtgatcctagtgttagacataagcccgaagaagggtgtcgggataaggcatttgccgtggcgttgccggtgccggtgccggggtggtattga

SEQ ID NO: 50196 - DNA, 951 bp, Glycine max
  Peptide Sequence Number=SeqID_166974
atgccgacgctggagaccttttgcgtttatggtgtcatcaaccaccaacgcgtgatcattcatgttgatggggtgccaatccctcttcacccaggttctgataacagtacagggccatgtcttcaccataggtctttcgcactccccttatctggtgccgacatcgttctgggagttgaatgtcttaaaggattagggcccgtaactattgattacactgtactttccatgtccttcacccattggggccaacccatccaactttttagagatgtacccattagactagctacagcttcaacccatcgttttaagcgcatgctccacactcccttcctctcggctttgttccatagcaccaatgtacctaaccaaacccaacctccaacttcttcctccccaatctccgacatcaccactcatccacccattacctctcttattgccaaattacagttcctctttactgaaccttcgggacttcccccacacagacctataacacaccacattcaccttctcccagaatcaaaccaagttaacgtcaaaccatactgttacccacatagccagaaagcggagtttgaaagacaagtctcgtctatgatggatggacattatgagtacagagttatgcctttcggcctctataacatgccgacaaccttccaggccactatgaacgaagtactcaagcccttcatatgcaagtatgtcgtggtctttttcaacgacatattgatctatagttcttctttgttagagcatgtgcaacacctggaggtagtgtttgtcgttctagccaagaccccgccaagatatctgccatggtcaactgccccacaccttcctccaccactgcactcagagtcgcaacttgccttcgacaacctgaagcaagtaatgactcaagcccctgttatgcttcaccctggaaatggatgcctctag

SEQ ID NO: 50197 - DNA, 1837 bp, Glycine max
  Peptide Sequence Number=SeqID_166975
atggaatccaaacaagaagcaccaagtgttattttaaacttgatgggtcttgatcaagtgcctacccaacatcccattagagataagcagaaagtgctctctgagaattacctgcagaaagttgcctctattggtgtcagaaagaagcgttcatctcatcagcatcattcctctggaatgaatactagtgaaaaggaagaatttgaggatgttttaaaagtggtcaaagcactaaggcgaggtaagcaccataacccatcaaagggaaatggtaaagagaatcctatttcttgcaaaaattctaatttggatgatgggctgctccaagagatattttatcctaaaagcatgagactgtatcctgaaatgagggagagaaagaaaatatcctatcacatgaattctggtaagcagagttcaaggcctttcagtaaaatttcagaggagatttcaatgcaatcgggaaatgttgcaaacggagttttaaatactgcttcaagttcttttctcagagggaatgaagcatttgccagtgatatgctaaagctgaagcctgcttcaaatatttcagttaatgagatccaattcaatttccctttcctctgttctgattccaggaccaaaactttggcacagggggatgtggctgaaaaattgcgagaacttggacggtgtggtcaagtctgtatacataaccagttgcctatgatttctgaacatggaaatggaacaagagatttgactcatcaaagtggttattatagcaatgacaaaattagaaagaacattagatgtaaggctggtgttaattacagctttgctagaagagtgtcaatacctctttgtgcagcttcagttattgctgataacggtagaactatgaatcaggatatcttgtttcagagatattggggtttgagaaagaatgcatctgcaaattggttatcatggaagtcgaagaatgaaaatgttaaccagaaagaatgtatggaagatgtgaacctcagtcctggccatgagaaactcccttccctttcctcttatttccatagtaatcacactgaagagaatggtataaatcatatgtcagagaagagagtttatgggaaggatttgtctgataaggtaactatgcctcctcaattgtcaagttctagtccttctcccgaattgatagacagtcagatcttgcaagagaggcgcttaatgaatgatgaagtgaagaacaaaacatatgaagacagtagtatgcctatgcaaaatgttgtgtctcctgattcatcagttgatttcttggtatctgatgcaacaactgaggttgttggcagatcacattataacccaaccaatcatcaatataaatcaacagtcttcttgtcacaagaaattgattctctgagttatacttcaaagaaacagagtgttgctcattgttctgggaccttctgctcaaagtcccaccacctaccaccttatcaaaaccaatgtggaaaaattctagatacatcagattttcaagaagattctgtactttcactttgctctgaggctgaccccgattccatcagtagctttgaggaggcatatgaacctagtccaatttcagttttggaacccttatttggagaggacagtcgattcagctctaaatgtggcgatcatgtatatgattcctctgaagtggatgatgaagaatatgatttgaatgtttcaagtgatgaagattgtgagaatgaatatgtagatgaccctgaagaaaagaaagatatagcaggattatttagagctgaagaaagtagggatttctcatatgttgttgaggtcttaaccgaggcag

SEQ ID NO: 50198 - DNA, 513 bp, Glycine max
  Peptide Sequence Number=SeqID_166976
atgaattggcatgggccggtcccagaatcactaggcaagttgcgaaaccttcgggtgcttcatctggatggcaaccacttcaatgggtcaattccgaagagttttcgagatttgagaagccttagtgaattgaggctgaatgataatgggcttattgggtcggtcccatttgacagagaaatggtatggaggatgaaaaggaagctaaggttgaataataattcagggctttgctatgatgcaagtagtggtttaggggatagcatggattccacatttgatttaggtatcagtttgtgtgacacttcgaatccagggtcggttaggacagtgcaacatctttcggctacccaaaagttaatgcccgtcacatcagatgctgtggaagcacttacttcatggaagttgatggcgtcggcgtttggatatacagaaaataatgttgagatgagagaaaccgtgcagatgtcacgtttatatacacttgctttctggtccagtgtaatgaaatga

SEQ ID NO: 50199 - DNA, 177 bp, Glycine max
  Peptide Sequence Number=SeqID_166977
atggctcagcaatgcatgcatggccatgcggctgataccggccgagatcactggcttggccttcaaggaaaggacacagtgctgttccaagttgtagaagcggaggagaacggggaggttggaagttttggggtggaaaagtgcaagcaagttggagactttttggtgagtggctga

SEQ ID NO: 50200 - DNA, 495 bp, Glycine max
  Peptide Sequence Number=SeqID_166978
atgaagctgtcgggaccaaacgggtcagcttccgacggcggtgcgacgacgcatgggcttcacgtgccagaaatcttgcgagacaaagatgacgagtgggagctcctttggcgaaggagagtagagagcgcaatcgagtcttcatcttcgactcaccatgaagctcgtcagttgaacaatgaaaccgtgtcaattgagctcaagaatggcactattgttcatggcaccattacaggtgttgatatcagtatgaacacacatttgaaaacagttaaactaactctgaaagggaaaaatccagtcactctagatcatctcagtgtgaggggtaacaacatccgttactatattcttcctgacagcttgaatcttgagaccttgctggtggaagagacacccaagatcaaacccaagaagccaactgctggcaaacctttgggacgtggacgaggaaggggccgtggccgtggtcgtggtcgtggtggtggccgttga

SEQ ID NO: 50201 - DNA, 318 bp, Glycine max
  Peptide Sequence Number=SeqID_166979
atggcctcctctagacctattttctccttttccgggactccaaccatcaccactgcaaagcttaacttgaagaattacctttcgtggtctgcttccgtgaagttgtggtttctcaatcaagggcaccatgaccacttggagaaagcttctgattctattccagacgataaaagacctgaatgggagaagcttgactatcaactctacgttgtgttatggaaatcagttgagccagatattttggagatctttcgatcatttaaatcgtgtcgttctttttggaagaaagcccaagaaatctttgcctatgatatctaa

SEQ ID NO: 50202 - DNA, 1335 bp, Glycine max
  Peptide Sequence Number=SeqID_166980
atggcaagagcagaacatgcatgcacaggattgcatatctcacaagactacacgtataatcattcatcaaaagagaaagaattaattagagtaacaaacattgatatatatatgatatatcctatctttatgctcgctctaccttttcccatcagtacccatttttgtactaagaagcatttgttacatttatgtaaccaaaggaaaatcaaaagtacgcaggaggtgaagctcggtggcgaaatcaacatgcaacgcagtgaaagcatgcgactaaaggagaagaaggtgaaggatttgatggttgacaagaagaggctagtggaggtgccgtacatggcgtccctggcccacacaatgactacactggtggcgaacaaggttgtggcggtgccggtggctgcgccgccggggcaatggatcggagccggagggtccatgatcgttgagtctgataagcaaaccggaaccgtacggaagcactacatagggatggtgactatgcttgacattgtggtccacattgctggtgataaccacttgagtggtgacgatgatgatatcaccaaagaccttgatcaaaggatgtctggccctgtctcctccatcattggccactcctttgaaggccttagcttgtggactctcaatcctaataccagcctgttggattgtatggaagtgttgagcaaaggggtgcatcgtgctatggtaccggttgatgggcaggcagagaacgtggctgcagctggggtggaacttgtagagtcagcttggagctaccaaatgctgactcagatggatgtgcttaggttcttgcatgatcgtgctggtgaaggtgatggtgaactgcagagcattctgtcacgttctgttcaagatttgttggctgtcactgaacagatttatgccatcactgaccgcacaaaactcgtggatgccattaagtgcttaaaggctgctatgttaaatgctgttcctattggcagatgcaggaagcttatcggtacattttcttcaactgatttgaggggatgccacatagccacgctgaaatcatggttgggaataagtgcactagcattcactgaagatgttgcatcgagtcctttgtacacagaatcagaatcggacacccagattaatagaagggagcttgtgacttgctttgccgaatcacccttgtctgaggttattgaaaaggcagtgactaggcatgttcatcgagtttggatggtggatcatcagggtttgctcgttggggttgtttcacttacagatgtaattagagttataagacattctctgctatcatctgattcagatgatctgtaa

SEQ ID NO: 50203 - DNA, 183 bp, Glycine max
  Peptide Sequence Number=SeqID_166981
atgtcagcatggaagattctttgcaccaatgttacggaatatttgaatcttggaaaaattgagcctttaagtgagtacaatttcacaggtactgatttcaattattatgagaggctcttgcaagaatcagatagaacattagtccatgatgtcggccaggtatcatcgttcatcagcaaatga

SEQ ID NO: 50204 - DNA, 420 bp, Glycine max
  Peptide Sequence Number=SeqID_166982
atgaggcaagagaacataatgcattaccaccaagtggagcctgctgcatggagctactacatgagggttcatcggagcatggaagaggaccagatggagagagttgcaaggctggcctcacagagtgcagtagtgatattcagtgtgagtagctgttgcatgtgccatgcaatgaagaggctcttctgtgggatgggggttaaccctacggtgcatgagcttgaccaagaccccaaagggaaagatatggaaagagcactcatgaggctccttggaattggaatcaactcaacttcttctgctgttcctgtggtcttcattggagggaaacttgttggccccatggacagggttttggctttccacatcagtggcacccttgttcctcttctcaaacaagctggtgccttgtggctttga

SEQ ID NO: 50205 - DNA, 186 bp, Glycine max
  Peptide Sequence Number=SeqID_166983
atggagaatgcggaggagcagcagcagcaaaacgaggaggttttgtcggttgaacttccggctccttccggattaggattaggatactatggaaacaatgctgtgaatttttgtgcttttcatattcttctaatttgtaatctagcattaggcatagatatgagcaagtggagtggcatggaataa

SEQ ID NO: 50206 - DNA, 253 bp, Glycine max
  Peptide Sequence Number=SeqID_166984
atggttgagcctggctaccacaaagcaccctctaaggtggtttctatccctgttcacttcgtgggtttaaagtgcactggaaccgaatttgccacaaagatccagagggtgttgagagattttctggtgaggaacaccttgaggaagatcgctgccatgagggtggagttggagcgtgaaaatcttgaggaatctctgaaaattgctagagatgctgttatcgcttccggaacacatgtgagtccgcttagag

SEQ ID NO: 50207 - DNA, 2442 bp, Glycine max
  Peptide Sequence Number=SeqID_166985
atgggcatattcagatgtgggaccttgtttttccatgtgctccttttgtttagaacctgtctggccaaagatcaacatgttagtcagatatatcctggcttcagtgcatctcagccagattggagcgaccataatggttttttcttgctatccaacagctcagctttcgcttttggattcttcactactcttgatgtttcatcgtttgttttagttgtcatgcacttaagcagctacaaagtggtttggactgccaacagaggcttactcgttgggacttctgataaatttgtgcttgaccatgatgggaatgcatatttggaaggtgggaatggtgtagtttgggcaacaaatacaagaggacaaaaaataagatccatggaattgcttaactcagggaatttggtgttgcttggggaaaatgggacaactatttggcaaagttttagccatcccactgatactcttttgcccggacaagactttgtggaaggaatgacactcaaaagcttccacaacagcttgaacatgtgtcattttcttagttacaaggcaggtgatttagttctctatgcaggatttgaaactccacaagtgtactggtccctatcaggagaacaagctcagggaagctcaaaaaataacactggtaaggttcactcagcgtctttggtgtccaattcattgagtttttatgacataagtagagctttgctatggaaagttgtcttctctgaggactcagatcccaagtcattgtgggctgctaccttggatccaactggtgctatcactttttatgatctcaacaaagggagggctcctaaccctgaggcagttaaggtaccacaagacccttgtggcattcctcagccttgtgatccttattatgtttgcttctttgaaaactggtgcatctgcccgaaacttctcaggactcgctataattgcaaacctcccaacatctccacctgttctaggagttcaacggaacttttatatgttggtgaagagcttgattattttgctctcaagtacactgctccggtttccaaatcaaacctgaatgcttgcaaagagacttgtttaggaaactgttcatgccttgtgcttttctttgaaaacagtaccggaagatgctttcattttgatcagactgggagtttccaacgctataagaggggtgcaggtgctggtggttatgtttcgttcatgaaggtctccattagtagtgctagtgatgatggacatggcaacaaaaatggaaggaatgacatggtgctagttgttgtcatagttctcacagttctggttatagttggtcttataacaggattctggtacttattcaagaggaagaagaatgttgctaagtatcctcaagatgacttggatgaagatgatgatttcttggacagtctctctggaatgcctgcacgttttacttttgctgctctttgtagagcaactaaggacttttcttcaaaaattggggaaggagggtttggctcagtgtatctaggtgtgcttgaagatggcactcagttggctgtgaaaaaattggaaggtgttggacaaggtgcaaaagagtttaaagcagaagtgtccataattggaagtattcatcatgttcatcttgtcaagctcaaagggttttgtgccgagggtcctcatcgccttcttgtctatgaatacatggcaaggggttctttggacaaatggatcttcaagaacagtgagaacaccttcttgttgaactgggacacaaggtacaacattgcaataggcacggctaagggattggcctatctccatgaggagtgtgatgtgaggattatccactgtgatattaagccgcaaaatgttcttcttgacgataatttcactgctaaggtttcagattttggattggccaagctaatgagccgtgagcaaagccatgtgttcacaactctaaggggtacaagagggtatctagcaccagaatggataactaactacgcaatttcggagaagagtgatgtgttcagctatggcatgctcttgctcgagataattggagggaggaagaactatgatcaatgggaaggggcagagaaagcacattttccttcttatgtgttcagaatgatggatgaagggaaactgaaagaggttcttgatccaaagatagatattgatgagaaggatgaaagggttgagtctgctcttaaaattgctctttggtgcatacaagatgacgtgagtttgaggccttccatgactaaggtggctcagatgcttgatggtttgtgccctgtacctgatcccccctcattatctcaatctggtacttattcagctttcatgaaattgagtagtggagaagctacttcatcgggacaggctagtttttttagtaatgtacccatgtcatgtgttcaattatcaggaccaagatga

SEQ ID NO: 50208 - DNA, 1026 bp, Glycine max
  Peptide Sequence Number=SeqID_166986
atggaattatttataaacaaacttgaacattctgatgcatgtgatgcagttttaggggataaagcatttacaggaacatatggagtaaaatatggaaggatagctgacaacttacatccccaagaaagcgtggttaccttactcaaagcagcaaaaattaagaacattaggatatatgatgctggtcataaactcctccgtgccttcaaagggtctggcattgaaattgtggttggtcttggcaatgaatttctcaaggacatgagtgtgggggaggataaagccatgagttgggttaaagaaaacgttcagcaatttcttccaggtaccaaaattcgcggaattgcgttgggaaatgaaatcttgggaggcacggatatggaactctggcaagttttgctccctgcagcaaagaatgtttacaatgcccttagtaagcttgatctagcaaaagatgttcaggaagatgtccttccatatatgaagcctctcttacaattcttctcacaaattggcactccttttttcattaatgcatatcctttccttgcctataagaatgatccacaacatattgaccttaactatgccctcttcctaaaaaatcctggtatttatgatgcaaagactaagctgcattatagtaacatgtttgaggctcaggttgatgcagcttatgctgccttggagcaggttgggtttgacaagatggatgttattgtttctgagactggttgggcttctcatggggatggtaatgaagctggagcaacaataaaaaatgcaaggacttataatggtaatttacgcaagcgtttactaaagaagaaagggaccccttataggccaaaaaaagtggtgaagcctggcccaatgtccgagagaaactttggattgtttaaggctgatggaagcattgcatatgatattggcttcactggacttgtaccttcttcatcaacttcatctttcctttccttcaaggtatcgactatggatacctcctctactttcactattaattaa

SEQ ID NO: 50209 - DNA, 851 bp, Glycine max
  Peptide Sequence Number=SeqID_166987
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcctttggttctggtggtggccgcggcccgcgctcgcgtacccgccgtggccaggacgctctggtccgaatgcgtcttagcctcgccgaggcagtttttggcgttaccaagtcgttagaagtcgaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 50210 - DNA, 669 bp, Glycine max
  Peptide Sequence Number=SeqID_166988
atggcgctgaggctgagtactgttgtttctgatgttggtccgagctattcggggaaacccaggtttaggttcagaatcagaagtgttgctgccacagttagaaacatggccttcagtgcaaccttcaaagctggtagattcccttattctcctggacaagaacctacttccaggaaatgccgagtttttgctctagcagatgatggaagtgggcttaagcagtttgaagatcttgttttgaaggatggttatcgtgctgttcgattcaacccatatttgtggccgcccagggaaaagatgacaaataaagttgggaaggaaattttccaaagggctggagaactcaatgtgccagtgggcttcatgtgtatgaaggggcttgatctgcatatttctgaaattgagcaattgtgcacagaattcccatcaacagttgtattgcttgatcacttgggcttttgcaaaccaccaatagtgtcaagagcacagtttccttatctggatttgtctcctctcttatcccaagttgtctctcactttggtgctaaccgtgtgatgtggggcagcgattttccatttgttgttgctgaatgtggttacaaaggagccaaagaagcaatgcatcttattgccaaagagatctctttgcctttagcagatttagagtga

SEQ ID NO: 50211 - DNA, 471 bp, Glycine max
  Peptide Sequence Number=SeqID_166989
atgggctccaagaacccgtcagtgattgcaatggagcaagtgggactgtatatagcattggaggattggcgtggaaattacctgagggacaaagcatggacgactacttgctcttttggattggacatgatgattcagcttttgctaatgttgtgctcacattcaatgcctatattacctggtgttgggattttagttggaactcttggtgttgctggttatcttcacataatcaatcagatgatggagctcattactggggcaggcaagaaggcatatactttggttatgggaagaccgaacccagctaaacttgctaactttcctgagtgcgatgtttttctatacgtttcttgtgcccaaactgctctgttggatagcaaagagtatctagctccagttattactcccttcgaagcaatgatagctttcaatagtcaatggataataagtaataatctctacccttag

SEQ ID NO: 50212 - DNA, 852 bp, Glycine max
  Peptide Sequence Number=SeqID_166990
atgacaggtgtcacagagcggattgagagcgaggttcgggtgaaagtgatgaaattgaagagggaacaaagggagaggatgaggctctacgagaccatcatgaacttgcttctcaagttggattttgttaaggtgttgttacactactctggcctcagagagtgcagaaagtctctcatcaacaaagctattgcccttcaagaatttcttgatcaagtgactattctccattttgaagagaaggagggtgagtgtgtgggagaagagaattgtttggtggaggaagagaaaagtagtggagtggaaactttcaagagtggggagggtgaatgtgttggagaagataattgtttggttaaggaagaggaagatgatggaatagaaactttgaggaatggggaggtagaaaaggagaagggtaggtgcatggaagaagaaagtattgggttgggaacaagattggtagaggaagaggagggtgaaaatagatgtgaggagcaagaggaagaagatgaggaaattgaagctttgaataatgaagacgtggaagaggaggatagtgagggaggaaggggttttgttggggagaaatatttggtgaaagagaaggatggagaaggaaagaagagggagttgttgttggagaagatggtggaggataaccagaagatgatggagatgatggtgcaactctttcagaggaatgagatgcagactacacttcttgcatctctcaaacaaagggtggagccgcttgagagagccttggcttgtgacaagttgaggaggaaaaaaaagagaaaggatgatgccaaaaataaacaaaatcatcctaaaaatggctttatctaa

SEQ ID NO: 50213 - DNA, 339 bp, Glycine max
  Peptide Sequence Number=SeqID_166991
atggcttctatctcacagggccttgttctcaccagtgccatgcttctctcaacaactctgctttatgttgctttctccaggcaaaaaaccaccccatcatttcaaattcatcactctaacaaacccaccttgcgatcttgcttgtattcagaggaaaagaaaagggagagaaagaagaagaaagtgaaatttgcagatagtgtgaaggagggaagagaaaggaatgagcaaagaagcaacagcagacaaagtggtggaatgccaatgccagcaaacagaatggctttgtattacgggattttgaggaaccgagtgcatagaattgagtgctctcactaa

SEQ ID NO: 50214 - DNA, 318 bp, Glycine max
  Peptide Sequence Number=SeqID_166992
atggaagttggaaaccaggaagaagaagcacggttttcattcttgaagggtggatatgttgatgactttgaaaatcaagaaaatgctgaagaagaaagggaaactctcgctctagtaaatgcaacagaaaaggcactgcagttgcagaataactcgaatgctctaatgaaagggaatgcaagatcaggagtggaatttttggcaaatcgatcttatcagggtctgaatatgtctagtgagaacgcctccccagaaccatatctcattggacggagaggaagggcatctgggtacgaggatgagaagaaaaaacaatga

SEQ ID NO: 50215 - DNA, 825 bp, Glycine max
  Peptide Sequence Number=SeqID_166993
atgggacaaggagtgatagggaagcgtgatagcatagctgacaaaggggttgttacgaacaagcttagaatgacaaaaatacaggaagcaccaacatcaatgatgcagagaggagaaaggaccaaaggaagatgtcactgccctcgaagccagctctgggttcttaccctaacaattggtgctctcattgtgcccttgccccctttgctgccttctccattgcgaccgccacaagctttgactgttaggcgtctcacctcgaaggagttagcctcgcgccatgagcacgagctgtgcttcacatgcgatgagaagttccatagaggccatcgttgtgcctctaggacccatttggattctaatacagtgcaacttgacccgaaactagccacacccatatccgaaggacctgacccaaaactcacacctgacccggacccaaaccccacacctgatttgaacccaaaccccacacccgacccagaactggcccaaaccccattacacgtgatgttcttccatcacggacacttcgtggaattgccgggcgagaacgccatcacttcggatcttcttccccaacaccagttccgccacttttgtttgaacaacaagggtgttttgcacttccatattgctggatttcctgaagctcctcttgaatcactacccattgaaacacctagtacacttcatcgacataaaccttgggacccaagagtgatagggaagcgtgatagcatagcaaacaaaggggttgttatgaacaagcttagaatgacaaaaatacaggaagcaactacatcaatggtgcagagaggataa

SEQ ID NO: 50216 - DNA, 390 bp, Glycine max
  Peptide Sequence Number=SeqID_166994
atggaagcgcgaaacacccttgttattccgatagaggtggcgaaactagtgttggagaagaagaccccaagtggtagcgttctcgccaggcaattccacgaagcgtccgtgatgaaagaacatcacaccccgtgctcatggcgcgaggctaactccaccggggtgagccgcctgtcggtcggagcctgtggtggtcgcggcggagaaggcagcaaaggaggcaagggcacaacgagagcaccaattgttaggccatacgagggggaaccaaaggggttggcggtggagctaccagcgatggggttcgcggccgcggtggaggcaggtgaaagtccgatagcttctgctcctggatcttcgcaaggccggcgacctggtccacagtcatag

SEQ ID NO: 50217 - DNA, 210 bp, Glycine max
  Peptide Sequence Number=SeqID_166995
atggacggtgcaagagactatgaggtagcgatgggtggttatcaaccctatcatttggctaccaagcatgtcattatgaccttcctgaatcctattgcgatttccgaaggaaatgtgacacaactgcaaggatttcaattcttcccttacaccaaagctcctgttcttggggccaaatctggctacatgccacctgtccttactacttaa

SEQ ID NO: 50218 - DNA, 399 bp, Glycine max
  Peptide Sequence Number=SeqID_166996
atgaccaagaagctttggcaacaagaactcgaatcagatcaaagcagcagtggaaaatgcttgtgctggcgtggcacaaaccaaagaatgggagtgtcatccctaaatcaaaaactttccttcataactgatcattcattcttaaagcttcacattaattttctaagatggaagtttgggaacaagggaatgcatatttaccaagagaagagaagagaagagaagaaagatgttggtggtggtgaacagagcaccgaaacaggggaggggcagagcaacaataaccagggaaggaagcagagagaagagtggtgggcgtgggaatgcaatgaaactcaagtgttgatggaagatgtattgagtggtgaacagagcaacgaaacaggggaagaagggtga

SEQ ID NO: 50219 - DNA, 788 bp, Glycine max
  Peptide Sequence Number=SeqID_166997
atggtgtacgttcagaagaaggcgtatgcatatacatttgcttcatgtgcttaccgcgaaaagaaggagtttttcttcaccgtgttaattattctgagtgtgattacacccggattgagcagcacaacaactagtttcaatgtgttgcagtatggagcagttggaaatggacaaaccaatgattccccagcctttctaaaggcgtggaaagccgcatgccagagcaactcacatatatctcgcctcatcataccagcaaaacggacattcttgctgaagcctactaccttcagtggtccatgcaagtctaattatacctacattcagctttcagggaacattattgcacctaaaacaaaatcggaatattctggattccacacgaacacatggcttggcttctcattcgtcaatggtttagctatcagtggaaaagggaccattgatggtcgaggctctgcctggtggcaacagccttgcgtaggaaatccactacccgcagtaacattcaatagatgcaatcgtcttcaacttaaaggatatacaagtattaatcccgcaagaagccacatgactctaacaagctgcaagaaaggcataatctctaacatccgtctaattgctcctggaacaagccctaataccgatggcattgatatttctggctcaacagacattcaagtacttaattctttcattgcaacaggtgacgattgcattgctattagtgctggatcctccaagatcaaaataactggtataacatgtggtccaggccatggtatcag

SEQ ID NO: 50220 - DNA, 498 bp, Glycine max
  Peptide Sequence Number=SeqID_166998
atgcagcttctcacaagcagcaacctccatagtcagtcaaccccaacccaaagagtctttcaagctcaaccaaaccaagccacagaatgcgttttacagaatgatgaggctagtagttcctgtagttacacggtgagcataaaaacaagctgcagttctcccccctacaccagagattacatcagtcttgcatttggtgatgcttatggctaccaggtttatgttccaagactggacggtcctcgttcaggaacattcgagcggtgctctacggatacatttgagatatacggtccatgtacgtaccaaacatgttatctgtatctatacaggacaggatacgatggttggatgccggagaaagtgaccgtgtacagctattactaccagcctgttacattttactacaacacttacatacctaatgctatttggtatggctttgactattgtaacggttatttaccctccacctcaactactactgcgccgcagtag

SEQ ID NO: 50221 - DNA, 1101 bp, Glycine max
  Peptide Sequence Number=SeqID_166999
atgaagttactaggctggatgcacaggaaacttcgccagaatagtagtgagccattcaaggacttggtcattgggaattcttgcaattgtctttcagggcaggcaccacttgatgatgaacaagtatatcagaaaccaagccttggggtcaaactttccaaacatgctcagaaaggtcacaacaaccttagaaactcttttgctggtgtagaagcagcaagggtagatgaagactatgagggagaatacttccctggcttccttgcaattggaactcttggttcagaaccaatatccgacccatcaacaacaccatcatttcccatttctgttgagagcataactgaaaaagaagatgaagtcactgagaatgatctgaagctcatcaatgatgagctggagaaagtgctaggagctgaaaccaaggatgatgtcagcattgactcatcaaggaggactagccatgttagcactgggagaagcagccatgtcagcactgggagaagcagccatgcgagtataataacactcagtggaaagccaatagaaggcacagaagcaaatggaaatggtgctgcaatttgtccactccagggatatctctttggaacagctattgaactgtctgaaacaacaacaactgcagcagcaaagaaagaacataggacttcgctcggggaactgtttcagagaagcaaatcatctgaggagaatttcggtgcaaaatgcgaaaaggaggacaaaagagccgagaaggaagtggacaagtcttccatgaacctgatgaaagaaaagctgaagaaaagaatgctccatgcttattccaagaattctacttcaataaatggtgggcctattgattctgcttctgctgagacaaaactgaataagattctccatatgttccgcaagaaagttcaccctgaaagttcaacagctgcacaaaaatctggtaaacaccataagaaccagaagaagaagaaaacaatcaataatggaggctacaacaaaagtgacctggtgcatccagaggaagattcatctgtcaacagggagtactggatcaaaacagatgcagattacttagttctagagctgtga

SEQ ID NO: 50222 - DNA, 165 bp, Glycine max
  Peptide Sequence Number=SeqID_167000
atggtgagaatgtgcgagaatgagtttcaaaggtcgtgtccaaatttcatgacgatccaacggttttgggtgtatgcgggaatagagaaagctcagtgcaagggacatttcttccatcacggacattatcttgaaaattccaacaatgggtatatgtggaaataa

SEQ ID NO: 50223 - DNA, 1224 bp, Glycine max
  Peptide Sequence Number=SeqID_167001
atgaacaccgaaattgcgtgtattcgcttaggaaatgcctatgttatcccagtgacatgccccaccattgccagtgagttcttgagaaaacaagatgcaacttttacatcaagatcactaagcatgtccgctgatctcatcactagcggatactcaaccacaatttttgtgccctttggggaccaattgaagaaaatgaagaaaatcattaccaatgattttctttcttcacccaagcacctatggcttcatgacaaaaggactgaagaagctgacaaccttatgttttacgtctacaacgagtgcaaaaatgtgaacgatggtgtctgcatgtggactagagaatatcaggagtgcttcaaggcattattgtggtattttgggaagggcagagaggatgaatggcctggttttgaggaaatggaacatgttgattccatcttcgatttgctcaactacatttatgcattttctgtttctgattatatgccatgcttgaggggacttgacttggatggccaagaaaagaaagtgaaggaagctttgaggatcatcaagaagtatcatgatcccattgttcaagtgagaattaaacagtggaatgatggattaaaggttgatgcagaggactggcttgattttctgatctctctgaaagatgccagcaataacccatcattgacattggaggagatcaatgcacaaattatagaattgatgcttgcaacagtggacaattcatcaaatacctttgaatgggcacttgctgaaatgataaaccaacctgagttgcttcaccgagccgttgaagaattggacactgtggtagggaaagagagactggtccaagaatcagatatacctaagctcaactatgtaaaggcttgtgcaaaagaagcttttcgccttcatccaattgcaccctttattcctctccatgtctctatgagtgacacaatggtgggaaattacttcattcctaaagaaccaaatttgaagttcatatcatttagcacaggaagacgtggctgtcccggagtgatgcttggcaccacaatgaccgtgatgctattagccaggttgctccatggcttcacttggagtgcaccacccaatgtttcatcaatcaaccttgccgagtccaacgatgatatccttcttgcagaaccacttgtggcaattgctaagccaagattaccatcagagctagctataccaacttga

SEQ ID NO: 50224 - DNA, 2808 bp, Glycine max
  Peptide Sequence Number=SeqID_167002
atgggttccaacatttgcgttgtgaatggttcgtgcactcacgaatggagaaaggggtggcctctgcgatctggtggattcgcccaactatgctgcaagtgcggatttatggaggagtggaagggtgacatccttgacccgttttctactattccggacaaggttttaaattgcggttgtggttgcggtttcgttgcaatcattgacattgcgggaaaatgcagatctgcttacgagaattcagttttctgcaataaattccactgccaacaaactggttggagggagtgtaacttttgcaacaagcctatccactgcggatgcatagtatctagatctttgttcgagtatcttgactttggtggcataggttgtgtgagctgtgtaaatactacccaacttagtatgatgaggaatatggaaaatccaaatgtgactgttttgtcgataaaaaataatgcgggtgatcggcattctgctcattttgatggcagactgcctgtgggtggtgttgatgaaggaaaacttatgcaattctgcaaaattatcgaagctagtgaatccagccgttggaatcatgctcaaagagatggcataattgcacatcgtgggcaaaaaaaccaagaagccaagagttcattcagggaagtggaaattggattttcaaatgtgatgaatccatctgttcaatcattgacatttgctacattagaaaataataggtcaacatgggagattaaaaacatgcatgaatcaaatacaaaaccatctttgagtatgtatctgggaaatgcatcagggaacaactctgtcccaccttctgctggagaggctgtagaaggaagacttgatggaaaaacatctcctccctttcaaggatcacgctctatatttcctaaaccattgaagaatgggcttaccatgaatatggaaacaaataaaggtacaatgtctcaatcacgtgttgctcggccacctgcagatggcaggggcaagaatcagttacttcctcgatactggccgaggattactgatgaagagctagagcgattggctggagatttgaaatccactgtagtgccattatttgagaaggtgttgagtgccagtgatgcaggtcgaattggccgtcttgttctcccaaaagcctgtgctgaggcatattttcctcctatttcacaatctgaaggtgttcctttgcgaatgcaagatgtgaaggggaatgaatggacatttcagttcagattttggcctaataacaacagcaggatgtatgtattggagggtgtgactccttgcatacaggccatgcaattatgtgctggtgatactgtaacatttagtcggatagatcccggaggcaaacttgttatgggtttcagaaaggcatctaattctacagatacacaggatgcctccacatctgcacaatctaattcagcaaagggaaccgtctcttctggtaccgagaatctgccatcaggaagtaataatgccgatcttctccattcattgacagggaatgttgaatgtcacttaaatggacatacagagcatctgcatttgggtactggaactgctggattgcttaaaactgaaaataatgagatgacaaacagtagttcaccacaacaacaaatttccgttttagagaagaagaggactcgcaatattgggcctaaaagtaagaggttgctaattgataatgaagatgccatggagttgaaacttacatgggaagaagcacaggatttgcttcgtcctcctcctagtgtcaagccaagcattgtcacaattgaggaccaagtaatcgaagaatatgatgaacccccagtttttggaaagagaaccatattcagtgcctgttcatctggggggaaggaacaatgggctcaatgtgatgattgctctaaatggcgaaagctgcctgttgatgctcttcttcctcccaagtggacatgttgtgaaaatgtttgggattcaagcaggtgttcatgctctgcgccagaggagttaagttcaagggaaatagaaaatcttctgaaaaacaacaaagattttaagaagcggcgaatcgtagaaagcagcaagtcaatccaagaacatgagccttctggtcttgatgctcttgccagtgcagcagttcttggagaaaatctcattgacactgccgagtcatcagctggagtcaccaccaaacatcctagacaccgtcctggctgctcttgcatcgtgtgcattcagccaccaagtggaaaggggagacataagccgacatgtacatgcaacgtgtgcatgaccgtgaagcgccggttcaaaactctcatgctaaggaagaagaaacggcaatccgaacgtgaagcagatgctgcccaaaaagatcaaactcttccaaaagacgagctggataccaatggagcatcgagagacgatacaagtcagttggagaaagaggctggactaaaaagtcaacatgaggtgggtgggtccagtgctggacagatagatctgaattctcatcccaaccgcgaagacatgcaagtggaaaccactggacttaacatgtctagtcatcttgaacctgcaacaaaccatacagtaggggaatttatgaaccaaaatggcctaagaaactttaataatgaagtgcaaactggtcagaattcttctttgcacactcctaaatctaatggagaaggtcagagatacttctctgatggaagatgctttgcatccattatgtggaaccaggaaagaaaagatgaggtacacagtcaaaccaatcaaagtcaaaacaatctttcttaa

SEQ ID NO: 50225 - DNA, 561 bp, Glycine max
  Peptide Sequence Number=SeqID_167003
atgtattttctttctgtcttctggactctacagcatcaatttgttgctgttaccgaatggtctggtgggttgtatgtgtctccaaccatagctggaagcaggcctggaagtcttattgctggtgcatgggcagcgatgatgtctctagggaaagaaggttacttgaaaaatacaaaagcaattatggaagggtcaagaagaatacagaaaggcatagaggagattgctgagttgtttattgttggaaaacctgacatgacgatagtggcttttggatctgctgttctggatatattcgaagtcaatgatgttatgtcatccaaagggtggcatttgaatgcattacagagacccaacagcatccatatctgtgtgaccctgcaacatgtgccaattgttgaagactttctcaatgatttgaaggaatctgtgaaaactgtgaaagcaaatccaggtccaataagtggaggcctagcacctatatatggtgccgcagggaagatgccagatagaggcatggtccaggaattgctggtagattatatggatggtacctgctaa

SEQ ID NO: 50226 - DNA, 1071 bp, Glycine max
  Peptide Sequence Number=SeqID_167004
atgggcttcctggcaaacgccggcaccgtcggcctcgacccggccgattacgctgtaaaccttccggctgccgatccggccaatccggacccgacggttcgcgatcacgcgctgacgcagttcgagctcgagctttcgtctaaggttctggcctatgttcaggacaccgtgcgcggccgcatcgatccgaacaagctgtccggctatcacgatttcaagcgcaaggtcgtcaatctcgacccggtgctgaagcttgcccggatgagcccggatgtcggcgcctatctcgccagccgcagcccggatggacgcgagttcgacatcctgaagaaggaacttgccaagctgaaggctgaaggcggcgatcaggagcagatcaccatctcgctcagcggtctgctgcgcccgggcgacagctcgcctgaagttgccaacatcgtcaaggccgtcggcaagcatggttcggaagcgctgaagacccagcatgcggcgatgcttgccgcttacaccggcgctcccgaatattcgcccgacgtcgtgtcgctggtcgaagacttccagaaggagcatggcctgaagcctgacggcgtcatcggccaggcgaccgtccgcgtcatgaccggcggcgacagcaatacggcaaagatcaacaagctcgtcgtggccatggaacaggcccgctggctgccggaagatctcggcccgcgctacgtgatgatcaaccagccggccttcatggtctactaccacaacgacaacaaggaacagctgtcgatgcgggtggtggtcggccagccgtcgcaccagacgttcttcttcgaagaccagatccagacggtcgagttcaacccattctggggcgttccgcagtcgatcatcatcaacgagatgctgccgaagctgcgcgccgacccgaactatcttgaccgcatgggctatgaagttgccgtcaacggccgcgctgttccgtcgtccagcgtcgactggtatggctcgacgtccaacgtttccgtgcgccagccaccgagcggtgacaatgctctcggcgaactgaagatcctgttcccgaac

SEQ ID NO: 50227 - DNA, 774 bp, Glycine max
  Peptide Sequence Number=SeqID_167005
atggccacacagacgcaagatccacgttcaaaccctaaccctaatcccaatgcaatgtcggcaacgccatcttcctccttcttcatccgcgccgccggcggcaacggtccctccgccgctcccgtcgccggctccggcgagtcgcactcgcaccaccggagggcgcactcggaggtcagcttccggctgccggatgacatgattgacttgtcgccgtcggatccgttcaacggcggatcctcgacggcgagcttcgaggagatcggatccgaggacgacctgttctccacctacattgacgtcgagaagctcggggctggacgcggcggaaacggatcggatcagagcggttatggaaatggcgccggcagcagctgctacaacgacggcgagaagagtccgagcaccgccgctgcgcggccgagacaccggcacagtagctccgtcgacggttccacgtcgacgagcatgttcggagagatcatggatgcgaagaaagccatgcctcctgataagctcgcagagctttggaacattgatccaaagcgtgccaaaagaatccgaatgcgatggtttaaagttgatgtcacatctttcgatctatatctagaactgctgtgggatggtaataaaatagctataatactggctaatcggcaatctgccgcacgttcaaaagaaagaaaggcacgctatatacaagaacttgagcgcaaagtccagacccttcagactgaagcaacaacactttctgcccaacttacactgtaccag

SEQ ID NO: 50228 - DNA, 132 bp, Glycine max
  Peptide Sequence Number=SeqID_167006
atggcatgttcgacgacggtgagggctcaatggcggtgccacgacaatgtgggtgagcggatgacccaacgatgtgtgatggaggcctgggaacctcgtgctttcgaaaatcaccaaaaggaaagtcactga

SEQ ID NO: 50229 - DNA, 918 bp, Glycine max
  Peptide Sequence Number=SeqID_167007
atgggtggtgatgatcaaatgaagacgctgcaggcaaagccaaaacaacaacaacttcaacttgaagaactgtaccaaggaatcccagatgagtctgttaaccttacctttcaagacctagccaatgtgaattcatcaaacaacacattggccactactaaacacgtttctgaaggaggtataattaacaaccctacaaatataccatcaccttctctttccacagtgcctagacttgacttcaaaaaaggcttggaggcatcctatcacagccatcaccaccatgacaacaactacaatcatcaccatcaacaccaacaacatagaggtggtggtgactctccatggggtcgttttagccatgcaagtgatggtgtaccaagtaggactggtgagtatagcatgagttataatggtatgaagagtggtgagagttttgcttctggaaaaggtggttctggtcgacgaaggcgaccagggattcctcactctaagatttgcaccatttgcagtaactatgtttatcttttcagaactagatgcctggtatgtggcagggtttattgcaggcagtgtgtggaaataggcatgggagaaatgacagaaggaagaaagtgcattgagtgccttggattgagattcagccaaaggtacatagaaagagcagggatggcagggtgttgtagtttgaggtatccaagtacattgaagcatgttgagctcaattgggctgagaaaggaccaaggaggagtggtgatagaggctataataatggtcaccatagtatggcctccacaagaccaagaacccctacaaaccgaaggagtcctctttctattgccagcactgaagcctcctttgtcatgtctgcaacccattctcccttttctgctcatcaccaccacatccctctttga

SEQ ID NO: 50230 - DNA, 396 bp, Glycine max
  Peptide Sequence Number=SeqID_167008
atggagcaacaggcacagctgcgtgatgttcttaatgatgcattgatgaaggaggttgagaggcttaagattgctaccggagaggcattgaaccaatctgagtcttttaacctgggaatgcaccagatgccatatgcagggtcaaatttcttttcaatcccaccacattcaggtccttctgggcaccagaacatgcaattgccaccatttggccactcccattccactgtgccgactcatcagctgcaacaaacaaattctcaccaaatgtcagatatattgcaaaacgaccagcttggtcgtctgcaaggactcgacattagtagcaaaggaacacccgtggtgaagtctgaaggcccctcaatatctgcaaatgagagtagcaccacattttga

SEQ ID NO: 50231 - DNA, 773 bp, Glycine max
  Peptide Sequence Number=SeqID_167009
atggattcttcgatctctcacttcagagcctccgcgaattccttcctctcccaatacgaacctctcgctttgcttctcgctcctctcctctctctcctcttcgccctcgctctccgctccttcttccacctcctctccgagaacggactcaaagccacgctcctagggtttctcattaactccttcaaattggtcccaggtgtgaagagatacatagatgccgaaaaacaaaaggttgtggataagttgcaatctgatagtaaatctaaaagagaaggttggaaaactgagttgccaagcacaggattagggacaactgtccttgagaaaatgagagaggagaaaattaatgacgcagtttggcaaggcaaatgctctggtacagtctacattggaggaagtgaatctgatggacatttttctctgataaatgaggcatgttcaatgttatgtagagaattttacatccaattgggatttgggatattgtttaaggtcatatcaatgctccttagctgggttgctgatattgctctatgctgttgcatgtttgcacataccaatcccctgcatttggatgtattcaagagtgttgcacgctttgaggcagaagtggttgcaatgacagcagcacttcttggaagtaaggaaaaaagttctggaggacaaatatgtggcaacatgacatccggcgggactgaaagtatattattagctgtcaaatcatctcgtgactatatgaaatctaagaaaggaattacaagacctgaaat

SEQ ID NO: 50232 - DNA, 399 bp, Glycine max
  Peptide Sequence Number=SeqID_167010
atggaggcaggaatattggaatttgagcagaacactgtcagagtttcatggcattgctgcttagtgaaagtggtgtcatggaagtatgacatgatggaagcaccatgctttgaagatgatggatgtcaaacagagaagcgatccctttttgtctccatctctggtgcatctcttcactgtctccatctctggtgtgctgtctacactagcaattctgcatcatctgacaactcattcctctgtggaaactccaaacctcatcctattaggctttcacatctcacttctcaccacctctctgttctctcacacaaacccatccacccattatccaacaccaagaagcagtcccaaacagttgattctcttcaactatacaacacactgaatccaccataa

SEQ ID NO: 50233 - DNA, 438 bp, Glycine max
  Peptide Sequence Number=SeqID_167011
atggagttagaataccttggccattttataagccgtgaagggaagccagttggtttgatacaacctcttgcaattccagatcaagggtgggaggatgttaccattgactttagtgaggggttgccaacatcacaagggaaaaatgctatcatggtggtggttgattggctaagcaaatatgaccattttctcatgttgacacttccttatacaaccaataaagttacaacaatgtatgttgaagggattgttaaactacatgggatgtcatcatccattggtattgacccttctatagatgaccaaggacaaacggaagtgcaacctgagcagatattgaagtttagatggatgcagaaaggattgtggacagtagaagaggccttggttcgttggaaagggcctgatagtgaggaagctatacttgggaaagagtag

SEQ ID NO: 50234 - DNA, 1518 bp, Glycine max
  Peptide Sequence Number=SeqID_167012
atgaacagcgacatttcccggtgggtcatggagttcctcctccgcagttccgtccccgattccctcatccagaaaaccctaaccgccctccctctatcccccgccgaaccccgcctcaagaaaaacctcctcctccgcaccctccaaaccctcctccgtagagccacactatcggaaaccgcgctcgacatcctcgaagacctcgcccctgtctctgacgcgcaacgccgcgcgtactgcgcagtcgccgtggagtgcaccgtcaagtacctcgctgcgtgccccgacgttatcgatggtgagtacgccggcgctgtacggcggatctggcgcggacgcgtggcggcgctgcaggcgcgccggagcgggctggtctctggggagttggtgcggtggcgcgatgagatagagaacgcgcttggggaggattccagggcggctcgcgagaggctggcggggttgaatagtcggagggacgcgatgaatgaggtgagggtgtatttgaaggaagcgtgggaaatgatggggccttcgtttttggaaacggttgcggcaacggagaagaagaacgatgaaggtgcctgtgataatggtagtggtaatggtaatgatgatgatcatgatgatggtgcatgcatggaggatgtggcaatgcattatgagaatcaggaaccattggaagagagtgttgatgcgaatcaggaagtgggtgggtctgacttaactcctcagagggataaagcaattctgaagcggaatcctcagcttaaacacaaacactctgcatttcgtgcatctcataagggaaggggaattaaaatatctagtccggaggaagtggagtcaaccaaaccatggagaaaacatgatcctgtgcctagtgctgaagttaaaaaaattcgggaatccctaaaatcaagttcttcggagttacaggcattggttaatgatcctcttcccgatgcattgcatatatctgatgttgtaagatccaaattggcaactagtgatacaaaaattgagccaccgattgaaaaccagcatgaagatgtagaagtacaggatccagatgtttgcctgagtattgtaccttttcagcccaatgatgtcaatcttgggaagaagtcttctgttcattgtagtaacattcaccagcccagcttgatggaacggaacagaagtgctcgtacctttgaggatggaaacttggtaaagataatttttttcacgcggaaaaatgcttgttctcctgggggaagttctcccaaaaggattaccatcgcccatgggttttttattgcagttgtgtgggaggattcaatagacaactcacaacaagcaagacagccaaggaggaggaaaaggaaatggagttcgttggaagaagagacactaagggctggtgtaaaaatgtttggagaaggaaactgggcaacaatccgaagtttttacagtaacatatttgaaaatagaagtggagttgatctgaaggacaagtggagaaacatgatacggtga

SEQ ID NO: 50235 - DNA, 3213 bp, Glycine max
  Peptide Sequence Number=SeqID_167013
atgctggagcactataccccccaagtcacgacggacaaactggaggaggctatcagccgtctcagcgtcggccataccaacctcaacatgaaggttgaatctattcatacttcgctcactgcgaaaatcgattctctcctcgaacgctttgcgtccctcactgttcctccacattcaccgtcgtcctctcctgtcccgccaccaccgccaatccatcgccaccacatgaagcttgaggttccacgcttcgatggcacggatcccctcggatggatattcaaaatatcccaatttttttattatcaggggatccccgatcacgagcgcctcaccgttgcggcgttctacatggacggtccggctttgtcctggtaccagtggatgtccaggaacggattcttcccttcgtggccggtgatgcttcaggcattggagtcgcggttcgcgccctcattctacgaggatccccaaggagcgttgttcaagctccagcaaaccggtaccgtgagtgattatctcaccgatttcgagcgcttagccaaccggacgataggcctccctccctcgtgcctactcaactgctttatatcaggattgagcccggagcttcgccgtgaagttcaggccctccgtcctctttctctgccgcaggcgaccgagcatgcgaggctccagaaggataagttgctcgaccgccgccgcggtactcgagcccctccacaccccaaccttaattcccaccacaaatctcttacgctaccaaccccagcgtcgccgaaggttcctctgaagcgcctcacgtcggaggagatggcggtacgcagagaccaaggcctctgctaccattgcgacgacaagtggtcgcaaggtcacagatgcaagccccgtctgcatctcctcatagcggacgaagatctcgaaccttcctcgagttcgtctacttctgattccctgtcccacatcgcacctgaccccatccaagcgccacaaatcagtctcaatgccatggagggtactccggcatcgcagaccttccggcttctcggctccttgcaccaccaccaagcggttatcttagtcgacggaggaagcacacacaattttattcagactcgtgtggctaagttcctcgccttgccgacagctccgacggccgccttgagggtcatggtgggcaatggccacaccttggactgtgacacgatgtcctctcaggtctccctcttcatccaaggtcacgaattcagactggatttgtatcacttacccatttgcagggtggatattgtcctagtggtccaatggttaaagcttttggggccaataaccacagactaccttaaccttaccatgacattccttcacatgggcctacccatcacacttcatgcagatgcaccccccaccccttctcatgcctctgctcatcaattaaaatgcttggcccagactcagagcatatctgctctgttccatatcaccaccaccaccacgcctgtcctatcttcaccacccccctcgacctcaccaataccttcacagattgcatcagtgcttgacaaatttcctcacatatttgcagaacccacgcaacttccccccaaccgcaacatccagcatcatatacaccttcttccccaaacgactccggtcaatgttagaccgtaccgatacccccattttcagaaggctgaaattgaaaggcagatatcagccatgctcgccgctaacctcatccaacccagtcactcacccttctcatcccctatcctcctggtaaaaaagaaggatggttcttggaggtgttgcatggattacagggcattaaacgctgtaacggttaaagatagattccccatgccgacaattgatgaattgttggatgatctgggacaagcttcgtggttttcgaagctagatttgcgtcaaggctttcaccaaatacgcatggcggaggacgatgttcataagacggctttctgcacgcaccagggacactacgaattcagagtgatgccgttcggcctctgcaacgcgccgtcgacgttccaggcggccatgaacgataccctcaagcctttcttgagaaaatacgtggccattttcttcgatgatattttggtgtttagctccgatttggacacgcacgtcacacacctggaatccgttctagataccctctccgaccgccaattccttctccggcgaaccaagtgtctttttgctcagaatcagctcaactatttgggccatattatttcccgtaacggcgtcgcgccagaccccgataagatttcagccatgttggcatggcccatcccaacgtccccaacggctctccgcgggttcttgggccttactggcttttatcggaaatttataaagaactatgccgccattgcttctccacttacatcgctattgcgcaaagatcaattccgttggtccccggaggcccaccaagccttccttactcttcaacaagccatggtccaggcccctgtgctcgccaatcccaatttctctttgtcgttcaccattaaaactgatgcgtccggctcagccatgggtgttgttcttcttcaactcgagcaccctatcgcctattttagcaaagtgctttgtccacgtttgcaacgagcctctgcgtatatccgagaactccacgccatcacctcctctgttaggaagtggcgtcactacctcctcggtacgtcgttcacgatcctgacggatcaccggagtctgaaggaccttatgtcccaaccaggcgccgccaatgttgtggcagatgcgctttccagagtcgttccggcgggcgcaacttgtctggccctgatcatgccccatttcaccttcttggaccaattgcgcaggtccttgcggcaagacacgcgttatgttgacctcatggcagatattcgggcttggccagaggcgcattcgggcttctctctccaccaggacctcattatcaacaatggtcatatttggatcccattcccttgtccattcacgacaactttaatggaggaattccattcctcgccgttgggaggccattccggcgttgcaaagatgctccaccgtctgcgccaaaaatttcgatttggccctccgtccgcgctgatgtgcgccatttcgtcgcacaatgttcaagtctgccaacagactaaatatgaaccaagcggctgcggggtacttcacccctaa

SEQ ID NO: 50236 - DNA, 804 bp, Glycine max
  Peptide Sequence Number=SeqID_167014
atgactagaaaaaaggtgaaactcgcattcatagggaatgatgctgcaaggagggcaacatacaagaaaaggaagaaggggatgctgaagaaggttgaggaactcagcaccctctgtggcattgaagcgtgtgctatagtttatggccacaatgatcctgagccagaggtttggccatcccattggggagtccaaagggtggtggaaaagctcagaactatgcctgaattggaacaacgaaagaaaatggtgaaccaggagggtttcattggacaaaagatcctgaagggtaacgagaaggtgatgaagcttatgaaggacaatagggagaaggagataaccatgttcttgtttcaatgccttaatgcaggtaggattcagcctgataataacatgaccactgctgatttgaatgttctttcatctttgattgatcagaacctgaaggacattagtaaaaggttggaaacgctgagtgttaacgagatgacaccaaaccaacccttgatgcaaacaccagcataccaacccttggtggaagcaccatcatgcaaccaatcccatttgcaaacaccagcgtaccaaccccagacgcaaactccagcattggcagtacccaagaatgaagaaatggcactgctgaattatggccatggtttggatatgagtgataactccatgcaaaggctgttgtttatggacttgcttaatagtaatggggatgagacgataatgcctccatttggtgatgccaatctccaactccaaaatgacttttggcctgacctaggcctattaccttga

SEQ ID NO: 50237 - DNA, 207 bp, Glycine max
  Peptide Sequence Number=SeqID_167015
atgcctagacttatgattactactgctcagaggagacttccgggacttggaattgcttcatactctaagcataatcgcgcaagtgttgtcaaggatgtttctgtggctaggcatttcttttgttcaacacaattttatatacaacaccattttatgaagcacgatttgcttgttagcggtaaaaggcgcgacaatttcgtcatttaa

SEQ ID NO: 50238 - DNA, 987 bp, Glycine max
  Peptide Sequence Number=SeqID_167016
atggccacaggaaagctgaaactcacattcgtagccaacgattctcaaagaaaaacagtatgcaagaaaaggaagcagtcactgctgaagaaaacggaggaactcagcaccctttgtggcattgaagcatgtgctatagtttatggccccaatgatcatcggccagagatctggccatctgaatcgggtgtcaaaaatgtactgggaaagttcatgaacaagccacaatgggagcaaagcaaaaagatgatgaaccaagagagtttcattgcacaaagtatcatgaagagtaaagacaagttacagaaagttgtgaaggaaaacaaggagattgaaatgtccttgttcatggctcagtgctttcagacaggtatgtttcagcctgatatcaatatgaccgcagctgatatgaatgttctttcatcggagattgaacagaacctgaaggacattgataaaaggatggaaatgctgaaagccaaccaggtgacaccaaaccaacccgatattgaatcgttaacatttcaaccccagataatgcaaacatcagcattccaaccccagattcaaataccagcattcgaaacccagatccaaacacaaacataccaatcccagatggaaacaccaacatttcaaccccagatgcaatcaccagcattgttccaaccccagatacaaactgcatcataccaaccccatatgcaaacacagtcataccatccccatatgcaagcaacatcattcccaacccagatgcaagcaccatcataccaaccccagatgcaaacaccagcataccaacccgatatccaaaccctagctttcgaaccccagatgcaaacacctgcacctgaagagatgacactgatgaattatggctatgggtcgggtatgaatgcaaatcacatgcataggcagaagtttaatggtaatgggtatgagacaataatgcctgcatttggaggtgccaaactccctctctaa

SEQ ID NO: 50239 - DNA, 4359 bp, Glycine max
  Peptide Sequence Number=SeqID_167017
atggcagaccatgtgacaagaaagaccaccaccgacagacttgaaaatgccatcacccgtctatccaacagccaatctactcatcttgacaaacacgctgatcttgttgacaaatattcagagctttccaggaaggttgattcgatcctcgatcaccttcacctgcgatctcctgcacgtgagcattccgatcccggcaaccagttccaccaacacaattcggtcaaactggacatttcgaggtttgatggccgcgaccccatggtctggatcttcaagattttgcaactgtttgaataccaaaatacgtcggaagaagaaaggatcacagtggcctctttctaccttgatggagctactttaagctggtaccggtggatgtttaggaatgggttcatcacttcttggtcaggcatcttgcaggccttagaatccaggttcgcgccttcatattacgatcaccctaaaggggctctcttcaagctgacacaacgtggcagggtaaacgagtacctaaccgtgttcgaacggttagctaatcgcgttatcagcttgccaccaccttttttgttaagttgctttgtttcaggtctaacgccagacatacgccgtgaagtgttagcacttcaacctatctcgcttccacaagctatggctcttgcgaagttgcaagaggataagttgcgagaccgccgacaaccgtcactgcgaccccacaacgctccctcaccttcgtatcacccccctaaccgaaagttacaatccacatatgtccaaaggacaccggacgagatggccctccgacgggagaaggggttatgttacaattgcgacgagaaatggagttccacccatcactgcaagggacgtgtgctcttgtttatcgccaacaatccttcccctataccagacgaacctatcctcgaccttccctcaccatcatcactagaacaagaaccaacaacttctctggactttgacccctcctcaaacttaaaccctccctcactcctcgactgcaaccaagtttgccccgacaccacgctatccctccaaggccaccaattcacggtgacatttcacttgcttccaatcagtggcgcagacgcagttctgggcatagaatggttaagacagtttgagcctataaccattgattacaccactttttccatgaagttcacctatatgggccagcccatcgagctacacgcggatgtcactactggacctaagccaatctcagcgctacaagtaaaatgtttacttcaaaccggatccgcgtcagccttatttcacttaaacctcattccaatcccacaacccgacccaccccatcttcctcacccgatacctgcagttgaatctctactcacccacttccatcacctgttccaaaacccctcttcccttccccctccacggaacatcgttcaccatattaacctcctacccaacacaacaccaatcaatgtaaggccttaccgctacccacaatttcagaagtcagagataaagaaacaagtgttggagctcctctcttctagtttaatccagcctagtatgagtccatactcatcgttggtgctcttagtgaagaagaaggatggaacctggaggatgtgtgtagactaccgcacattgaactcagtcaccatccgtgaccgttttccgatcccgatgatcgacgaactacttgatgagctaggaaacgctgcttggttttctaaattggatctcaggcaggggtttcatcagatcctaatgcatggtccagacgttgagaagacagccttcagaacacaccaagggcactacgaatatcgcgtgatgccttttggattgtgtaacgagccatccacttttcaggcggccatgaacagcttgctaatgtcgtatctcaggagattcgctatcgtgttcttcgatgatattctggtatatagcaagacgttatcctcgcacctcgaacacctcgagatcatctttcagactttagttcaaggccaaggagtcgaacccgagccctccaagattcatgccatggtgcaatggcccacaccactatcgcccaaggaactcagagctttcctcagccttactgggttttataggaaattcatcaagaactatgcgatgatcacagctcccctcacatcactcttagccaaagacgcgttcgaatggtcattaaacgctcaatccgcatatgagcaactgaaagcagccatgacaagtgcccctgtgcttgccctacctgattttgacgaaccattcgtgatagagacagatgcctccggcgccgacatgggcacggttttaatgcagaagggtcacccccttgcatttttcagcaaacagtttgggccacgcatgatccacgcatcaacctacgttagagaacttcatgcaatcatcgcggcaatacgtaaatggcgccaataccttttggggcattctttcaccatattgataaatcataaaagcctccgcgaactcatgtcacaggtcgtccaaacttcagaacaacactactacctctctaagcttttgggcttcgattatacgatccagtacaaggtgggatcatccaacaccgtagcagatgcattatcccgaacaacacccaggtcctccggcgagctctttttactatcagtacctaacctcgattttatgaacgacctgcgacacacccttcattccagcatggactttcagacactgctatccaaggtgcgtgaacatcctcaagatcaccctgactatcgaattcacaatgggttattgctgtttaaaaatcgcatatggttaaatgacgacaacccgtctatacctaacctcatgctagaattccatgcaactccgttaggggggcatctcgggggaatgcagtgtttgtcaacaaaccaagacgagtacacaacgccccgttggctttcttcaaccactttcaccaccaactggggtctgggaggacatatcaatggatttcatcactcagttgccggtatccatcttggagccttacccactaatcactcagctttcaaggttgcttctttattcatggacatcgtatgcaagcatcatggatttccaaagagcatagtctccgatagagacccactcttcctgagttccttctggcatgagcttttccggttatgtgggacacgcctgcgcatgagcacgacttatcacccacaatccgatgggcaaaccaaagtcatgaatcaggttttagagcaatatctcagatcattcatccacgagcaactaactacttggtatcgttatctcacattagcagaatggtgttatatcatatctcttcattccagttcagggctgaccccgtttgaagtcatttatggtaagccaccgccagcgttgccacactaccttcagggtgtatcctcaaatgaggagaccatgaaaagactagcagatgataagcgtcgtgatgttaacttcaccataggacaatgggtctacgtgatagaacgcgtaggccaagtctcctatcgactcaagttgcctgaggaagcgaggattcaccccgtgttccattgctcgcttctgcgagaacaccatggtcagaaaccagtagttcgccctctatgcatcttggattctaaactcgatacctcctcatccccaccaacaagactcgacaaggtggtgtttgcgggcgagggtattgttagcaataacctacaggacctcgaagctactgaagctgataaagttacaaaggtagttagcaccgttaatacggttaggaaggctcctgatcctgaggcagaggtttggccatcccattggggcgtgcagagggtgctggaaaagttcatgagtatgcctgaattggagcaaagcaagaagatggtgaaccaagagagtttcactgcacaaagtatcatgaagggtagggctcgtcctgataataacatgactattgctaatttgaattttctttcacggatggttgatcagaacctgaaggacattgataaaaggatggaaactctgaaagttaatgagatgacacaaaatattcaaccccagatgcaaactccagcattgaattatgccctagggtcggatatgaatactgctgagcccatgcaaaacctgtggtttatggactttcttaataatggtgatggggatgagagattaataatgcctgcatttggtgatgctaataattcaactccaaactggcttttggtcaaacctgttgccttgaaaaaaagggatgtgcttgttaccagtcctttgggggatcatgtttcagttgaattttcatttgcttggtttggttatttttactgtccatgtgtgtcaatgtga

SEQ ID NO: 50240 - DNA, 597 bp, Glycine max
  Peptide Sequence Number=SeqID_167018
atgatgaggttgactcgtgattttggtgatacaatgcaaagagatgttgtgcctgcagtttcttctgatgttgaggttgttgcacgtgagactgcacagttgttggaacagcataatcatctctccgttcgtgaccttgctagtaaattcgagaagggtttggcagcgccaactaagttttctgaagaggctagacttagagaggcagcatcattggaaaaacatgttcttttgaagaagcttagagatgcacttgaatccttaaaaaggcgtctggcaggcagaaacaaggatgatgtagaagacactattgcgatgagggaaggggaactaatacaagagaaggcagaggtgaagaagcttgcaaatttttttaagcaggcttctgaagatgctaagattgttgatgaggaaagagcttttgctcatgctgaaagtaaggatgccagagcagcagttcaaagagtggaagtggcactacaagaacacgagagaatgtctcaagcttccgggaaacaagtcatggatatggaacatgagcttcgagcattgagggttcaacttgcaaagaagactagacagtatcttcgactttag

SEQ ID NO: 50241 - DNA, 387 bp, Glycine max
  Peptide Sequence Number=SeqID_167019
atggatagagagaaagatgaaagctttgcttttagaaaagaggaagggaaggggaaaaaccaaaagccccaacttgcgatgtataaacctcaagaggcaaaaccgcggatgacccgatcctctcatactactcaaagaactcacaccccagcgtggccaccacctgaacccacgacttggtcaactttcggcatcggcgtccacagagtcataattctcagcggcgagaacccacagcaaggccgaggtggcggagctagtaatcatggagaagacgaagctcgacgagcgtcttctccatctcgtgggcggtgtgggtgcatagatgaggttgagcagggaaggattaacatgtcaagcaaaatcaacatgtatttgcacgcatga

SEQ ID NO: 50242 - DNA, 159 bp, Glycine max
  Peptide Sequence Number=SeqID_167020
atggccaaacctctgcctcaggatccttgggctataaactatggcgcatgcctcaatgccgcaaagggtgctggaatcaaacgaaatgaatgcgggttgcaccttttttctggtcatgatggtgaccagaaaaaaggggaaaacgaaaacaaaatttaa

SEQ ID NO: 50243 - DNA, 951 bp, Glycine max
  Peptide Sequence Number=SeqID_167021
gatgtttccatcgacttcatcacgggtctcccgtgctcccacgggttcactgttatcttggtcgtggtggaccggttctcaaagggggtctactttggtgctcttccgacccactatacggcttataaagtcgtagttttgttcttagattgcgtctgcaagcttcacgggtttccccgtagtatcgtgtcggaccgagacccgttgtacgaagctccgtatgagcacggcgtaccacccgcagatggacggcaaaaccgagaatggtcctacaacacggcccaacacgtgggcacgggaatgtcgcccttcgagggctccaccgtcgttgccgtggacgatttgctccgttctcgtgagtctattcacgcttcccttcaacgccgtcttcgcaaggttcaggaagctatgaaggtggcagcagataagcatcgccgggatcttgcgttccagacttctgtagccccctcgtatagcaaattagctaagaggttttacgggcctttcgaagtggtggaacgcatcgaacccgtggcttataggttgtcattgccggcgtctttgcgcattcatctcgtgtttcatgtatcccttcttaagcttcataagggatccttgccgtctactccgatgaccctccctgcgacgtccaccgacaaccaccctctggtggcacccctggccattctcgattggcgcctagatcatgctgtttctccccctgttcagcaggtcctggtccaatgggagggacatgcccctgaagattccacttgggaatgctgggaggagctgcgttgcgtccacaaccttgaggacaaggtcgttttcggggacgggagtgttgatagcaacacgcagcagagcaacacacagatagaagataatgcagaaaatagcagaccaaagagagtcaggacaaggcctacttacttgcgcgattatgcttag

SEQ ID NO: 50244 - DNA, 483 bp, Glycine max
  Peptide Sequence Number=SeqID_167022
atgacgatctgtgttcctggagcaactccatcagagagaccaactccgcgggatcgaggtacatgtggttcggagcatcctcagtctcagaaatccagaagttgtgttatgagtgaaaggaagataattgccttggttcaaagtcaagtgtatggtagtgcatgcatcttcttccaatggcgccccactgttggaccttcttcctactgcatcttcttcctaacattccctaacccatcaaaaacaccttgtcctcaaggtgttgggcggtggcttcgatggtggtggtggatatggtggcgtcgaacatcatcgccgatgacagatggagcaaagccaagtcttgacggtgaaaagaatccaaaccaagcgtggatgaatatgatgcttgatggcatcgttgccgagcaagatggtgtcattgccataagggattttgcggcaatggttgtggctgtaatgacagtgggcagtgtggagtga

SEQ ID NO: 50245 - DNA, 780 bp, Glycine max
  Peptide Sequence Number=SeqID_167023
atgtccgatcatgacatgtaccctttagatcacaaggacgaagacgatttctttgacgaaattgatgaccaaaaccatggtgggggtgttggggatgctgctcttgatgaatatgagatgcttactaaggtgactgatacatcagctgctcaagcaagaaagggaaaggatattcagggaattccatgggagaggttgaacatatcaagggagaggtacagattgacaaggcttgagcaatataggaattttgagaacattcttacatctggggatgctgtggacaaggagtgtaagcaaatggagaagggtggcaattactatgaattcttctataatacaagaatggttaagcctaccatccttcattttcagctgagaaacttagtatgggcaacttcaaaacatgatgtctatcttatctccaactactcagttaatcactggtcatcattaagtggtaatttgtctgagataatcaattttgctgggcatgtggccccgacccctactaaggaacacaatttaaatggcttcaatagtgctttacttaagtatacatatagatatgcaggaaatttgttggaaggattttctcagacccagattagcacattagccgtcaaggataatcttcttgttgctggtggcttccaaggagagcttacttgtaaggaaataatgtctggtatgccactttttatttttccatgcttgttccctgggatgtgggttgctgtgaacaaattctcccgtggcaaatgtagggcaggtggttag

SEQ ID NO: 50246 - DNA, 1587 bp, Glycine max
  Peptide Sequence Number=SeqID_167024
atgtctatggttgatgagccgctatatccaatagcagtgctcatagatgagctgaaaaatgatgacatccagctgcggttgaactcaattagaaagctctcgacaattgcgagggccctcggggaggagcgaacacgaagggaattgataccatttttgggtgaaaataacgacgatgatgatgaggtacttcttgcgatggcggaagagttgggggtgttcattccttttgttgggggagtggaacatgcccatgtgttgctcccgcctttggagatgctttgcactgttgaggaaacttgtgtgagagataaagctgtggaatcactatgtaggattggattgcaaatgagggagagtgatttggttgagtatttcatccctttagtgaagagattggcatcaggtgaatggttcactgctcgagtgtcttcatgtggactatttcatattgcttaccctagcgcacctgaaatgtcaaagatagaattgagatcaatgtacagtctgttatgtcaagatgacatgccaatggttagaagatctgctgcttcaaatcttgggaagtatgctgctactgttgaatatgcccatttgaaggcagacactatgtcaatttttgaggatcttactaaggatgatcaagactctgttagattgttggctgtggagggttgtgctgctcttgggaaactgctggagccacaagattgcatcacacatatactaccggttattgtcaacttctcgcaggataagtcgtggcgtgtgcggtacatggttgcaaatcaattgtatgagctttgtgaagctgtaggccctgaacctaccagaacggaattggttcctgcctatgtgcggttgcttcgagacaatgaagctgaagtacggattgcagctgctgggaaagtgaccaagttttgccggatattaaatccagatctttcaattcagcatattcttccttgcgtgaaggctaaaatactttgcaagatctttgcaggaattgtcaacggattctttgcagcatgttcgctctgctttggcttccgtgataatgggaatggctccagtgttaggaaagtagttaaacaggatcaccctttaggaggcatttgtttcaaggatgcaacaattgagcagcttcttcctatttttctctcccttttgaaggatgaatttcctgatgtacgcctaaatatcataagcaagcttgatcaagtgaatcagcacagagcttatgatcttatgccaccttctatagagatgcagagtaaaaatcacataacgaaaaaaacttttcaaagatatgttgatcaagtcattcttgcagccattgttgagcttgctgaggataggcattggagggttcgacttgcaataatagaatatatacccttattagcaagtcaattgggggttgggtttttttatgacaaacttggtgctctttgcatgcagtggttacaggacaaggttcattcgatccgtgaggcagctgctaacaatttgaagcgcctagctgaagaatttggtcctgagtgggctatgcaacacataattccacaggttcatgtcttggcttaa

SEQ ID NO: 50247 - DNA, 576 bp, Glycine max
  Peptide Sequence Number=SeqID_167025
atggagggagccatgactcacaatggagatatgttcaagctagctacttatatttacatgtattggaagccgataatggaagactatttatactctaaggatttgcatgaaccaatcacccaacaagacaaaccagaaaggaaaattgacaagattaggagctccagaatcagaaagcaagcagtagcaatgattcaaaaatatattgatcgaagcttgttcaagcatgtgtcaacttacactaatgtctatgagttgtggacaaaacttgaatccttgattcaaaagaggacgcccagaaacaaagcctaccttgtcaaacaattggcaaagttggagtacaaggacggccaaaacatgatcgaacatttgaacatctccaaagttgtcactctcagcaattccactccagaaggaaagctcaacatggattatgttatagacagtttgttgattgaagagtcaatacgaagagaaagaggcttgaacaaccagttcgaagccaacgtcgctgaaaatagaggaagtaagaatgtggaaaatcacaaggcaggtccaaacctcgcactagactaa

SEQ ID NO: 50248 - DNA, 141 bp, Glycine max
  Peptide Sequence Number=SeqID_167026
atggctcaggatttaggagcgattgctgaggatttggagcgggtcatcaacctcaggatggtcactgagggcactgacttacatgacatcatgactcgttatggaagtcttaggctacgccagagacgccgcatagattag

SEQ ID NO: 50249 - DNA, 529 bp, Glycine max
  Peptide Sequence Number=SeqID_167027
gattcctttgaggagcaggcgtcatagggatccttcgtcccccatggacatcaggatgttctcaccgctgctattggacatccagagcaccctggacgtgttcgtgctgctagagtcggtgtcaccatcaagcaatacttcggatcggctccgcgaacatcccacaactcttcctacaaatcagggaccagctagaggagtcgatcacagaaaaagtgactcgacaactcatggcatcgttcagccagatgcagtcccagtttcggtcccaaatgcaatcttagggacttgcactgcctccgaagcctctggttggtccctcaggtcctcgagaaacgatcctgagacgggtgactcagaaaggtgtggcttatacatcgaagcaaatcctgcccacctggttgccctcactattagaaaatacactttcaacatcgattatttagaacattctacatcggttctaaaaccgatattgaaagtgccgatgttgaatgtatcaatgttaacatcggttttggagaactaa

SEQ ID NO: 50250 - DNA, 960 bp, Glycine max
  Peptide Sequence Number=SeqID_167028
atggataccttcaatgtgttgcatatgagagggtcccttcaaaaattctggtttatcaagcctcagatgatccactttaccgtggctatagagcagcagttcaatcgtcaattagattttgcatcatgggagccacctcatggtccgtacaagacattcaattatccttggagaagctatgttaaagtcagtggagctttgaggcattgtgctttcatggtcatggcaatgcatggatgcatactttcggaaattcagactgatacaaaaatgtctgaggtattgctttcctgttttacacataatccatcatcaatgaagttttccttgctgctactcgcacctccagagaagagaatggttttcagtaatgaacttcagaaggttggtaatgaaggagctgaagtattgcgtcaactaggaagcaaagtggaaaagatggaaaagctaagcaatgtagacatactcttgaaagtgcatgaggcagctgagcaattgcagatgaagattgatcaacaatcattccgcttgttcaattcagagagttggcaggatgcaaaaaagcctaaagaaattgaaaataatgacaattgtttgttgattgatgtcaaagacaacgagaacaaaaactcactgatatcttccctcagtgaaacaggagctgattcaagacttaacataaacatagagccttcggttcctgaattgcacacttcacaaagcttgatgtccaataaaatgtcatggccacgtctctcattttatggagataacatgttacttgagcaagattccaaagtatatgaaagtgcaagctctctgtccttggcaacatttgcttcccttttaatagagtttgttgcaaggcttcaaaatcttgtggatgaattccaagatctcggtgagaaggccaatttcaaagacgtctttgatgaaccaatgttgaaagaggcaatatga

SEQ ID NO: 50251 - DNA, 189 bp, Glycine max
  Peptide Sequence Number=SeqID_167029
atggatgaactgaaggatttgatcaagcaagttgcacctcctgggattcccccttatggtattgatgaaacacaaatggtgttgattgagtctaactattggaaaaagattgggccaatagaaattttagctgttttcagtaaacctgtaccggaaatggaagacgagttgtccttgtcgcaaagttag

SEQ ID NO: 50252 - DNA, 216 bp, Glycine max
  Peptide Sequence Number=SeqID_167030
atggatttcaaaggtggtgtccaaatttcacaacaatccaacggaaaagagaaagctacgatgcaaagtgaacttctctcatctttggcatttatttgcatatttcaacggaagagactcacaactttgtgggcagagtactttggcgaaaaagcaccgagatgggtgcctttagagtatctatcgactacgactaggatggtcgtgaatccctag

SEQ ID NO: 50253 - DNA, 180 bp, Glycine max
  Peptide Sequence Number=SeqID_167031
atggaagaaccagaaacagcgaaacacacagcaaatgtaagtttacctttattaagatggaagaaccagaaacagcgaaacacacagcaaatattttcacattctaaattcacgtttgggagggttaatttggatatacatccaaacacccactcagtctttcttcttggtttgaagtga

SEQ ID NO: 50254 - DNA, 1776 bp, Glycine max
  Peptide Sequence Number=SeqID_167032
atggcggagcacggcactcgtcgcacaaccacagaccgccttgaagaagccatagcagccctctccgagagacactccgacttggccaataagttagaagcatggtgcgagcgtctctcacacctcacctctgcctcaccagcaccttcccaaccttctccacatccacggccacccgtcaagctcgacgtgccccgctttgacggccacaatcctctaggatggatcttcaaagtatcacaattcttcgactaccagggaaccccggaggaagatcgaatcatggtggcctccttttatctcgacagaccggttctcagctggtttcaatggatgttcaggaatggtttcattacgtcttggccagcccttctccaagcaatcgaagcaaggtttgcaccttcgttctacgatgatccacgaggaaccttgttcaagcttgttcaacgcgggtctttgacagactacctcatcgagtttgagagactcgccaaccgtatcacaggtctctccccctccgtcttgcttagctgtttcatctccggtctcaacccgaaaatccgccgtgaagaagacaagctattggatcgaaagaagcacacttccaaggcctcgtttgggccttctccgccaccaaacccacctgtacctcacacacccacccatctcgcaccacgacccaaggccccatttatcaaaagaatccaggaagaaatgacatttagaagagaaatgggtctatgttacaattgtgatgaaaagtggagttcatcacatagatgcaagggtcgagtcttgctcctcatcgcggaccttgatgaacccgccacatctgaacctccctcaacagactacccacacttcccagcaactgaacctaaccccaccccggacgaaaccaacccatttcttgacccgaacgcaccccacccccatattagccttcatgcattggctggtgtccttgcctctgacacttttcgcttatatgggttgatcaacagtgctcgcgtcaccatattggtcgacagcggaagcacttacaatttcgttcaacctcgtgttgcaaaattcctgagcttacctgtgaaggagacaacaaccctcagagttatggtgggcaatggttccgtgttacaatgccaccagctgtgctccgatacacaagttctcatgcaggggcatacctttacggtcacgttacgggtgctgccattgagtggggcggatattgtgctcgaagtggaatggctttgtaccttagggcccataaccaatgactattcatcatttaccatgcagttcgtctacaaagatcaaccagtcaaccttcatgccgatgtttatgtcgataactctccagcatctgctacccaggttagacaaatgatctccaccaactccacttctggcttattccacatttcactcttacctgtgaaccaactcgaatcaaccacagaccccccacatcccatacctgccattaacaagcttctactccgctaccactccatctttcacaccccttcagaattacctccccctagacaccacgaccaccatatcaacctcctccctgtgaccaaccccgtgaatgtcaggccctacaggtatccaaactttcagaagacggaaatcgagaagcaagtatcggaattgttgaatttcgggctcatacggccaagtcaaagccccttttcctctccggtattactggtgaagaagaaagatggatcgtggcgcatgtgtgttgactaccgagctctcaatgca

SEQ ID NO: 50255 - DNA, 381 bp, Glycine max
  Peptide Sequence Number=SeqID_167033
atggagcttgattatcacgcagcgaaatctgacagtggtcacgaacaactgaggccgaagccgcgctctaggaacgagaatgaagaagaagaagaaggcgtagaagaggtgttagtgatagatgttgagtatgatagtactgatggtgtgaggtttgatgtgttcatcaacgaccaaggcgacaatgagattggaccccaagattcagagtttgcgggaagctttgtgactttgcctcactcgccgcatgtcaaccacaacaacatcaccaaagcttctttcagacttggagtaacaaaagacgatgatagtatttctgtcacactggctcccatatatgggaacaagcctgttacaattaaggacgtaaggatagattaa

SEQ ID NO: 50256 - DNA, 3216 bp, Glycine max
  Peptide Sequence Number=SeqID_167034
atggaatgctcgtataatacctcgcaacactcgggcactgggcttaccccttatgaggtagtctatggaaaacctcctccttcgattcacaactaccttcgaggttcttcccacaacgaagcagttgatgccatgctcaccacgagggaagaaatctacgccaccctcagacgcaagttactcaaggcacaagacaccatgaagcactacgccgatagatcgcgttgcgaggctcaatacgaggtcgatcagctggtatatgtgaagcttcgaccttatcggcaatgttcactacgaactcagacctccaacaagcttgctaaacgatactttggaccttttcgagtgctagaacgcgtcggcaacgttgcatatcgtctacaattacctgaaggatgtcaaatccatcctgtcttccactgttcattgctccggtctcaccatggcccacacgacttacaagcaaccccacttcctccagctgcaactcacaataatcctatcttagaacccttagctgttctggatttgcgcatggacacttcaagtcaaccacccaggaaacttgtactggtacaatggaaagggatggcaccagaagagtcaacgtgggaagattgggctgatatccacgactcccatcaccttgaggacaaggtgactttcccaggggaggatattgttaggaacgttaacaacaatgataccagtagcaacgaagcacgaccacgaaaagctaccacgagaccccgatacttagaaaggccgttagatgttcgttgtaaccattgtagcatgtataaaagcctgaaagtggcaaccatcatcttctctctcacgaatcttccccttcctgtacctaacattgtctttggtgcgaaacgcgcatcgctcttccatggaaaaactttctttgctggaaagcagcctgaactcggtggagggactgtagagcttggtcctcatactgctctccaccgttggaccggtgatccaagacagcctaacaaagaggacatggggagattctattctgctgcaagagaccccattttctattctcaccatgccaacgtcgataggatgtggaacatatggaaaaaaataccaactagaaaaagaagggatttcaaaaaccgtgattggttggaaaccacctttttcttctacgatgagaacaagaaccttgtgagtgtgaaagtgaaagattcccttgacttgaaaaagatggggtatgtttaccaagatgttgacattccatggctccagaaaaggactaaacccaaaagaactagaaaagctaagcaagtggcgttcacacaacagtttggcggcattcgtgaagcaatggctgctgagactggcccaagttccaagtttcctctcactttattggactcaaaggtaactctacttgttaaaaggccaaagcagttgaggagcaagaaggacaaggaggaacaggaagaagtgttggtgattgatgggatcgagtttgatggggataatgatgtcaagtttgatgtatatattactgatgaagatgtcgaggagattggaccagagaacacggagtttgctggaagctttgcgactctgggtcattcccattcaaacatgaacatggacaagaagatcaaaactagtttgacattgggaataacggatttgttagaggacttggatgccgaaaatgatgatagtattttggtgacattggtaccacgatctgagaatgtaaccatcacaattcagagcatcaagatagagtttgagaaggaggagttccttcctccaggaacacccgttagggttagatcagctgctcaattcttcaacaaagactatctagagaagtatgagaaagcccttacgcgcatgaaagcccttccacctgatgatcctcgaagtttcatacaacaagcaaacatccattgtgcatactgtgatggtggctataaacaagttgagttccctaagctcgacttcaaagtccacaactcgtggctattcttccctttccaccgttggtacctttatttctatgagaaaatcttggggaaattgatcgatgacccaacctttgctcttaggttttggaactggaacaaccctgatgtggcatgggataaaatccaccaaccccctactctcgtagacctaaactatagcaaaaacaatgacggcagtgcaatcttcctcggaaaacctttccatcctggagaggagcctaataatagtgctggttctgtagagagtgttcctcacactcctgggcacatttggactggcgatagaaatcaacctaacggtgaggacatgggaagattctattctgctggaagagaccccattttctattctcaccatgccaatgtggataggatgttgaacatttcgaaaacaatcaaagaaaccgcgttttacttctacgatgagaacaagaaccgtgtgcgtgtgacgataaaagatagcctcgacaccaaaaaactagggtacgtttaccaggatgttgacattccatggctcaacaaaaagccaaaacccaaaaaatctagaaaagctaagaaggccgctgaagctaggccaagcgtcaagtttcctctcactttgaattcaaagaacaagaaccttgtgcgggtgaaggtgaaagactccctcgactcgaaaaagatgcggtacatctaccaagatgttgacattctatggctcaagaaaaagactaaacccaaaataactagaaaagctaagaaggtaaccctacttgttaaaaggccaaagaagttgaggagcaagagggagaaagaggaagaggaagcagtgttggtgattgatgggattgagtttgatggggatactgatgtgaagtttgatgtgtatattactgatgaagatgtggaggagattggaccaaagaggacggagtttgcaggaatctttgctactttgggtcattcccattcgaacatgaacatggacaagaagatcaaaactagcttgacaataggagtaacagacttggatgctgaaaatgatgatagtattttggtcacgttggtaccacgatgtgagaatgtcaccatcacaattcaaggcataaagatagagtttgaaaaggaggagtggaaatatgtcactgtcatatacgacttaattatggcacttttactggcaaagaaaattttattgaatatatttcgtttgttgttgttatag

SEQ ID NO: 50257 - DNA, 411 bp, Glycine max
  Peptide Sequence Number=SeqID_167035
atggcaagctctcgtcacgccccaaatttgaccccaagtggcacttccaacagcgatgctagctcccgcaacaccacgataaggaggaggttgtcgccacacctgtcttcacgtcatcacacccatttgcaaatcgctttcacctccccttttaatttgttttttctttttgtgcttgatttgtcccatgcagaagattttggggggaagtgggttcttgatttgctctttgcaccatttgttgcctttcttctagcgtcaatcatatggccaaagaaggttttttccagcacatcttgtgcttttaattatattcatgtttgtaatagcaaggacaatactagagatgataagcaagcagcaatccacgaagggagtgtagaagcaagcttcatgatgaatcaagattga

SEQ ID NO: 50258 - DNA, 716 bp, Glycine max
  Peptide Sequence Number=SeqID_167036
atggggtatttggcttgggctgcaagagaccccattttctttgctcaccattcaaacgtggataggatatggaacatatggaaaacaataccgggagggtttagaagagatttcaacgatgatgattggttagagtccagctttctcttctacgatgagaacaagaaccttgtgcgtgtgaagatcaaagattgtcttgactccagaaagttggggtatgattacgaatatgttgatgacacgccatggctgaatgttcgtcctagacccaaatatgcggttcctctccccctcccgtttccacttccacaacctttgccgttccctctcactttgaattccattcaacgtacaactgtgaagaggccaaagaaggaggagtcatggagcgaggtagaaaaggcggaggtgttagtgatggaagttgagtatgatatgactgaggatgtgaaatttgatgtgtttatcaacgaccaaggtgacgatgagataggacccgaggattcggagtttgcgggaagctttatgaccttggctcattcgcatgggcaccaaagcaagaggacaacaacttctcttagattggcaataacggatctgttgaaagatttgcatgcactggacgatgaaagtattgcggtcacactggctccaagatatgggaacaagcctgtcacaattaagggcataaagataaagcttgtccctctggtgga

SEQ ID NO: 50259 - DNA, 637 bp, Glycine max
  Peptide Sequence Number=SeqID_167037
atggcttctatatcatcacatccatccttctcgtccctcctcagtttctctgcatccttttccattccttccatgtttccaacgtctcaaaaaccatgccaacctagcaaaccaaaacgtggtcgtcatgcttcaaaagttgcatgcaatggtaaccctaaccctagaaataggagggacattttgattggccttggaggactttatggtgctactactcttagtggtaacagcaccggttcagcctttggtgctccggtgtctcctccagacccaactaactgtgttccgccactattgccgggcgaaaatgatgtcaattgttgccctccatccccaatcgtagacttcgagttcccttcacacaaaagacttcgacatagacgacctgcacaatgggtcgatgatgattacctaaacaagtacaaggaagccgttaggctcatgagagcccttccacttgatgatcctcgaaatttcatgcaacaggcaaaaattcattgtgcttactgtcataatggctatcgccaaaaaggtttccctgatcataatctccaagtccacggcaattggctattcgcccccttccatcgttggtacctctacttccatgagagaatcttggggagcttgatcg

SEQ ID NO: 50260 - DNA, 129 bp, Glycine max
  Peptide Sequence Number=SeqID_167038
atggcacaacgagagtgtgggttgaaatcgcaagggaaacttgtgagagaatgctacgtgtggagcgtgagaatggctgagagggagagggagctacggagagagctaaggcaaaagtttcctttttaa

SEQ ID NO: 50261 - DNA, 180 bp, Glycine max
  Peptide Sequence Number=SeqID_167039
atgcaaatcgcagaagccattggcgactttggccaggctttgacacgtggcattggtctcgccagtgtcactggcgatttgaggagaagcagctttttcaggttgaaatcgccagtggaactagcgaattgcgctgtagttggaattgccagtagcactggagagttgcccttggagtag

SEQ ID NO: 50262 - DNA, 222 bp, Glycine max
  Peptide Sequence Number=SeqID_167040
atgggcttcttttcgaagctaatttccgatatggtgttgttttggaacttattcctgcatggggctgttcttaacgtaaaatgcatgaaaatcgcagaagccattggcgagtttggcaaggctttaacacgtggcactggtctcgccagtgtcactggcgatttcagcatgcatgggactcgccagtttaactggcgagttgtgctaggggagccaggctag

SEQ ID NO: 50263 - DNA, 792 bp, Glycine max
  Peptide Sequence Number=SeqID_167041
atggattgggaccagctcttggccgggataggaggtagaacaatcagttggttcccccgatggaaggaaggaaaagaaggagtccttttctcatgtggggagatacccaaacactccgctgcaccgacggaagaaagcatgtctcctttccttgtgagagatttcggcgcacaaaattccaagactatacaaagaatccataaggcgtgggaaaccccgttaaagaaagatcaagagcttagaggcattcgtaatggcatcattggtgggtaccacgaatggctgaaagttcatatacgaggtttagattggctcgccaagttaaaagtcgtcagcaaagagagttttgaagcaccggaagaggacgaagaagtccaagctctcaaaagcgagttaggaaaggcaaaacttgccaaggagaagttcaagttggccgctacacacgttcggaaggagtgtgccgggttacgggaagagaatgcaattaccgcaagagcccttgaacaagagaccaagagggctcgcaaggaagagtatggccggaacaaatttcacggagctctatggggtagcaatagtgaactcaagttgcgaaaggaagaaagggaccagtcgcgagcacatagcatggttttgaaagaggagttagttgcctgttcaaggtccaaaagaagcttgtctcagcgtttatgcaagacggagaccaacatgctagctatcatcgccaagtaccaagaagagttaggtctagccgcggcccacgagcataggattgcggacgaatatgcccaa

SEQ ID NO: 50264 - DNA, 825 bp, Glycine max
  Peptide Sequence Number=SeqID_167042
ttgaatgaaaatcagcttaactacaaagaaagtctactaaggttcgtggagcatttgggaccaacagctaaaagagttgcagcgaaaaaactagaagcacttgaagatcaacaacgtttgaatgatgacactacattgcagaacctccccgaaaatgcttctgggacacaaattatccagcagcaaactccgcagataccaacactgccagaacttttcaatgttcagacacttgctcttgcccaacccatttttaataggccactcacaaatcctggttttgcagcctcgctaaacagaattgtcaacactcatgttggcaatgttaacaccaatctgtcttccagcaatgcgttttccatggtgcatccaacacacctaatctcggggcctcaaccaaggcctgaaggcgctgttaacctctctgatctgtctcttatgtctcagacaaggcgaagatcctcaatgtatgacatgcctgccaatatccttacagggaattctcttgtgcagcagcatcagccatggcctgcaggcacctcatatgatcatgcagggaactttcaagtcatgtttgatgcacaacatttcaacaataacatttgccctatgctggcaagttatgaccaggttctgccacaagctcaaatggggcctcatggagatggaccagttcctttacaagaaccagatccatcatcttctctacaaatggtcttaggaggggcaataaatcattatggagaacaagggcagccagaagaggctcttctacagcttccttgggagggtgatcagctacctaacttggatcttggcctctaa

SEQ ID NO: 50265 - DNA, 1398 bp, Glycine max
  Peptide Sequence Number=SeqID_167043
atgcaaggcttcaagacagcacaacagccaagttcacaacaacaactctattgtcactcttccttcttgcttaggggaaacgaccctaaccgaaacacaacgcgattctctgatcttggggagcttcaccattcctctagtgtttttcatcatgaagatgctgcggatttaagctcaagttctatgtttagtgtgaagtcgaacaatgttgttggtggtagtaacatacagtatgggacattgaacacattgagcacggtgaatgttgggtctgcggagattggtacaagtgtgcgagggtgcatggatacagggcagcaactgatgtatcacaaaggagtgactacggcagccttgcctttggggaatggtcaagttgagaattgggatgattcaggcctagctgataatagccaacagactgatcatacctccacagatattgacactgatgatataatccaatgcaatagagtcaagaatgggacacgaatggttgtgcactccaaggatgcgacaaaggtgaaacctggagatcaaaagacccttcgtagactggctcagaatcgggaggctgcaaggaaaagtcggttaaggaaaaaggcatatgtacaacagttggagagcagccgagtcaagcttgtgcatttagagcaagaacttcaacgagcacgtcagcagggtatatttattgcgactccaggggatcaaggtcatttggctgttggaaatggtgccttagcatttgacatagattatgctcactgggttgatgagcatcaacgtcttctcaacgatctaagaacagctataaattctcaaatgagtgatagtgacttacatattctggttgatagtgttatggcacattacaatgaattatttaggctaaagagcattggtgcaaaggctgatgtattacacatacataatgggatgtggaagacacctgtggaaagatgttttatgtggcttggtggattacgttcgtctgaacttctcaagatcatcaagaaccaccttgagccattaacagatcagcagttgatgggaatttgtaatctacaacagtcttcccagcaggctgaggatgctttaaatcaaggcatggaagcattgcaacaatctcttgtagaaatactttcctctacttccctaggacccaatggtagtggaaatgttgctgattacatgggtcaaatggctcttgcaatgggcaagcttgctgttttggggagttttcttcacaaggccgacctcttgaagcaagaaactcttgaacagctgcaacgaatcttgacaacgcgccaaaccgctcgagccctccttgtccaaaacgattacatttcaagactaagagcgcttagttcgttatggttggcgcgccctagagagtag

SEQ ID NO: 50266 - DNA, 279 bp, Glycine max
  Peptide Sequence Number=SeqID_167044
atgtcaccagtggagcctctatgttacacaaacacatcacgcgacttcaggactctgaggtgtacggcgaggaactcctttccatgggaacagtgccgacgacgacgtgcttcaggcgacaaccacgtttttcaaccaccacctccgacacccaaacaggacgacactcttgcttctaaaaaccaactaggcgatgacgatgaggcaaaaagcttacgggggttgcaattgcccatgaaatcatgcgacaacttaggggttacctcaaagaatgcataa

SEQ ID NO: 50267 - DNA, 951 bp, Glycine max
  Peptide Sequence Number=SeqID_167045
atggataaggaatcctacaaattccaaaattcaaatcacttagaggatagcaatctcaaaagggacggtccatcatttataaagggattggatgctatcacatcttctcttactcatattggtggtaccattggtaaatccttggagatctatattagcattcttagttgtggtcaggatgatgaaggtttaacaattgttgagaatcggacttcagatatcattcaggaaactcgtaaacatattaagaagaagcctggaaactctgtaggacaaaatcaggagacaaaccattctactacattgcatcaatcccaactgcggaaccagatgtcaccgaagcaaacagaccaagaacttcaactgaaggcatctcgcgacgttgcaatggcaatggctgccaaagcaaaactacttcttcgggagttgaagactgtcaaagctgatctggcttttgcaaaggatcgatgtgctcagctagaggaagaaaataaaatcctccgtgagaatcgggaaaggggagatagccatgatgatgatgatttgttcttgtatgcatctttcactgacatacagaagatacgacttcaacttgaatctcttctagctgaaaaagctcgcctggcacacgagaactcggtttatgcccgtgagaatcgctttctaagggaggttgtcgagtatcaccaacttacaatgcaggatgttgtctaccttgacgagagcaatgaggaagtcactgaagttaaccctcttaaccttcccccagtgcctaatatggccctggattctattactccatctgcaacctcccttttgcattctcctgaaccgaaccttggcatggcttcagaattaacaagaggcacctcatctactatatctggaaaagatgcaaagagtaatgagattactataaaggattcacggagttctgaagcgactagataa

SEQ ID NO: 50268 - DNA, 294 bp, Glycine max
  Peptide Sequence Number=SeqID_167046
atggttgcactaaggttggcaacaaaagtcaacaaagacacattggttctcagtggagggccaaaagatgagaagattcaagtagctgatgactcgctcagcaaggcagatccgctcagcgagtgttatccgctaagcgaggaatacaactcgcttaacgggttgggaaaccctagaagaggatcagagatgtgctctcctagcacgcagccagtccgcccagcgaggtcgttgtcccttattgcgcttagcgtgcctagctcgctaagccaaaattcacttactctcgcttag

SEQ ID NO: 50269 - DNA, 963 bp, Glycine max
  Peptide Sequence Number=SeqID_167047
atgagggttggaaccagtttccttgcactgctctcattgttgccattgcttctttctccgcaattttcaagtgctcagcttccacctgacactggcatctcatcacgcacccttgatgccattctccaagattgtgcctttaaggcatttttgaggccaaaaactggggtaccctatggtggccaagttcccagaagcctaaatggaattagagtttcagcaatgaggcttaggagtggtagtttgaggaccagaggtgttgaaagatacaaagagtttcagatcccaattggggttgttgagcaaccttatgtggagaggcttgttttggtgtaccataacttaggcaattggtctgagaagttttaccctttgcctggttacacatatttggctcctgttttaggtctaatgccatatagtggtgccaatttgtctgcttctgagttacctgaattggacataagagcttctgataagccaattttgatcaacttccctcatgtgaaatcagcaccattagggtcagtgcccaagtgtgtgtactttgatctacatggttcagtgcaatttgacatcctattacatgggaatgtttgttcaacagtccaacaagggcacttctcaattgttgtggagtctaatgccccttccccagcacctgctgctgcggctgtggctgcggctgcggctgctgatgttaggaaaagtggtagtgggaggaacaagtccaaggtgtgggtaattgttgcatctttggttggtggatgcctcttgttgatcatgttgagtcttttggttgctaaagtgaggagaacaaaaaaagggatgaagattcagcaattggaatgggcagctgagagcaatgaaactttgcagatagcatctattgggggcaccaaagcaccattggcagtagggactcgcacaagaccaacaattgaaaatgattacataccttag

SEQ ID NO: 50270 - DNA, 1413 bp, Glycine max
  Peptide Sequence Number=SeqID_167048
atgcatgctgatctgttgactcatgtgtctaggactgaagtgaaggatattgtgttctttatgggtccttatagagctccagcttctggtaatttcaatacctacctggttgatactctgattgttcctatacctaaaaatgataatcccactactttaaaagagtttagtcctatcaatttatgcaatgtaatcttgaagattgtactaaagtgctggttaacaggatcaaacccttcctggataacattgtctgccctctacaaagtagttttattcttggaaaaggtactagtgataatgccgtcattgctcaggaaattgtccaccatatgcacaagaagaaagctgactttgagagagtttggctttccttcccaaactctcaaaataatcatggctcttacaacctccacatctctttctcttaagtggaataatgagagtttggatagttttaagccaactggaggccttcgacagggagatcccttatctccttgtttctttgttttgtgcatggagaaattagctttgatggttcaaaataaggtcaaggagaatcaaaggcagccggttaatatttctagaaatgggcctaagatctctcatcctttctttgtggatgattgcttattattcacaaaggcaaaatcctctcaagtgagattggtgcagcaagttcttcatgatttttgcaaagcttctggtcttaagaatcactttggcaaagtcagtgataaattccattcccatttattctatgcagaatttgtggttcctaaggggcctaagaatcgaagtggtttgggcgttcaaactgcaagagacatgaatgtttccttattggggaaacacgtctggtctatgcttcatgagcgtaataaattgtgggttgagcttcttagtaaaaaaagtaccatcctccatgataatatcaagcctggtacttcttatttgtggatctttattcttaaggctgcagctattcttgagcttggctttcggtttagggtgggagaaggaaaagggctattcattgagagtaacttcttgaatgaggacattgttgatactatcatttgggatggttcttttgacgaaaactactcacccaagtctgcttataggtggatcacccgagcccgtcttgcctgccccaattttcaagatgcaagactgtgggaggatatctttcatgtcttgagagattgtcccaaagctcaaaggatttggaatatgattcacttccattttcagaatcccttaatcattgataacccgaggagctcgttgaaagtcaatgcagaatctaaagttggcatcaagtttgttgtgacgtgtaagttcatttggagagctagtaacatggagatctttcaagatgtggtggaattttcaaagatgatcgtg

SEQ ID NO: 50271 - DNA, 204 bp, Glycine max
  Peptide Sequence Number=SeqID_167049
atgtcgcttgcaagtggaacaacttatgcttcttgctttgggacttgctgtaactcaaaagaagggaattatgatcagaattgtggcaaggaaggatttcaaccaaagcgcaaggaaaagcttctctttagtcaagattggacaatcatctatcaagcttcttgtagacatgaagcccattttgcacattccttctccaagtaa

SEQ ID NO: 50272 - DNA, 387 bp, Glycine max
  Peptide Sequence Number=SeqID_167050
atgcagaagtttgtcaaagatttatcacgtgataaggaatgcaaaagggatcgaaaagagacccacaaggagcctacccccatcactttctcaaatgaagatttcgaggggatagaccgatgtcacaacgatcccatggtagtcaagatagaggttgctaactttttagtatgcaaagtcctacttgaaaatggaagctcgactgatgtcttgtattggacgatctttaaacaactaggcatatcaaaaagcttgattgagccattcctagagcaattcataggttttgcaagagagacaacagacacgataggatatgtgcacttggtaactacattggagatgaaaggggttaaagtccatcatgatcaagtacctcctaattga

SEQ ID NO: 50273 - DNA, 270 bp, Glycine max
  Peptide Sequence Number=SeqID_167051
atgtctaatttgtacaatcagatttccttaccttcaccccaaagagccaattcaccaaacataaacatgagaggcaattttgatgttgatagtcagtacttaacagagctgctagcagaacgacagaagcttggacctttcatgcaagttctacccttatgtacgagactcattaatcaagcaggttcgtcatatttgggacaaatgcaggttgatgcagccacaattgtggttgcagaaactctaaaaaccttgaagttgcggttctaa

SEQ ID NO: 50274 - DNA, 630 bp, Glycine max
  Peptide Sequence Number=SeqID_167052
atgacttctccaaactcaacatcaaacttcactggctggaaaagcctgtcacatgaaaggttagctggtgtacaaggactaagcatggattggcaaacttcaccggttgttccaagttctcccattgtgaagaagatattgcgcttggatattccgaaggatagctatccaaattttaattttgttggccggcttcttggccctaggggtaattcactgaagcgagtggaagctactacaggttgccgtgtatttatcagagggaaaggttcaattaaagacttagacaaggaagaattgctacgaggaaggcctggctatgagcacctgaatgatccacttcacattctaattgaagctgaactacctgccagtgttgttgatgtaagattgatgcaagctcaagaaatcatacaagagctacttaaaccagtgttacctcttccacttaccagagtgtggctaatgctgaaaggcaatattgatgagtcacaggacttttataaaaggcaacaactaagagaacttgctatgcttaattccaacttcagagaagagagccctcaactgagtggtagtgtctctccattcacttctaatgaaataaaacgggccaaaactgatcaatag

SEQ ID NO: 50275 - DNA, 3280 bp, Glycine max
  Peptide Sequence Number=SeqID_167053
tgatttatcaagcaaccgccttactggaaatattccatcctactttgctgatcttccacgtcttcagaaactgtcacttgcaaacaattcattggatggcactgtttcttcctccatttggcagaataagacttcaaatggaacaaaaacatttctcttggagttggaaaataataatcttacaaccatatcaggcagtattgatcttcctccaaatgtcacagttgggcttaatggaaatcccctttgctcaaatgtaaccctgactcagttctgtggatctgaaggggctaatgtaacagatggttcatttacaacaaattccagttcctgtccccctcaagcatgccctcctccttatgaatactctgtgaattgtttctgtgggcttccattgattgttgactatcggctgaaaagtcctggattttcaaactttcttccatatttgaatgattttgaggtctacatggcttctggtgttaaaatatctaccaatcagctacaatatgatttttattggcaagtaggacctcggctgagaatgaacttgaagttttttcctgcatatgttgataacagtagtagtcatactttcaatagaagtgagctcctacggctcacaagcatgttcacaggatggctaattccagacagtgatttgtttgggccttatgaactgatgggttttaatcttttgggtccttaccaggatgagattggcaggagttcaaaatcagggataagtacgggtgcgctggttggcatagtcataggggcaattgcctttgcagtgacgttatctgcaattgttaccattcttatattgagaataagattgagagattatcatgccgtttccaggcgacgtcatgcatccaagatctctataaaaattgatggtgtaagggcctttagttatggagaattgtcctctgccacaaacaatttcagcacctctgctcaagttggacaagggggctatgggaaggtttataaaggggttctttctgatggcacaattgttgccataaaacgtgcacaagagggatccctgcaaggtgagaaggagttccttacagaaatatcattactatcaaggttacatcatcgcaatcttgtgtctctgattggatactgtgatgaagaaggtgaacagatgctggtttatgaatttatgtctaatggcacattgagggatcacctttctgatgctgtgtacatcttccatttctctaagctcaatgatgcagataatttgttttacagtaattgtgtgcctaagtgcctttctatgttatctctcttaagagtgtgcttaatgtttacagttacagctaaagatcctctgacttttgccatgagattgaagatggcattaggggcagctaaaggtcttttgtatctacactcggaagctgatcctccaatatttcaccgagatgtaaaggccagcaacatattattggactctaagttttctgcaaaagtggctgattttggactttcacggcttgctccagttccagatatggaaggagttgtgcctggtcatgtatctacagtggtaaaggggaccccggaaaagaacaggtgttcagaccctagatccaacctttcaagtttcaagttgaaacttgaacggttgggtctagtgtcccaaattcaaatggtatcagattcagagattggtgtggtagccccaagtcctacattggatgaattggagaataatggttgggctacccttggttaccttgatccagagtacttcctaactcgcaaattgactgacaagagtgatgtttatagtcttggtgtcgtatttctggaacttttgacagggatgcatcctatctcacacggcaaaaatattgttagagaggttaacgttgcgtaccaatctggcgtgatattttcaattatcgatggacgaatgggctcttatccatctgagcatgtggagaaatttttgactttggccatgaagtgttgcgaagatgagccagaggctcggcctagaatggcagaagtggtcagagagcttgaaaacatatggtctacaatgccagaatcagataccaagagagctgaatttatgtccagtgattctggcaaagcagacagtcacagtacaccatcttcatcttctgcctctgcttctattatgaagacaccttttgtatcaggagatgtgtcaggtagtgaccttggaactacactttcattgctcgtttccctcttcttcctctacgagaacatatctgatgatggtgggggagcgcgaaccaaggcaaggagttgcggcggcatgatggtgttggacacgatggtgaggacgcaaggtgctggtggagctggtgaggagtcgcgtgctcgtggatctgaatgtgatgagaccaatgtcgcgtggagaggtggtggctcgcggtcttcgtgcgatggtgatgggttgggcggtgaaaagaaggagaaggggaagagaaagggcgggtgggtcggtggtggtattattagcctattaggcctcgaagtagcggggtataaaagcaccaccaccttctcccttctccatcttcaagcgttctactatttcgtcaattccaacaacaccacaatgggaagaagaccggcgaggtgttaccggcagataaagaacaaaccgtacccgaaatcccgtttctgccgcggcgtgccggagccgaagatccgaatctacgacgtgggaatgaagaagaaaggcgtggacgagttcccgttctgcgtgcacctggtctcgtgggagaaggagaacgtctccagcgaggctttggaggcggcgcgcatcgcatgcaacaagtacatggccaagttcgccggaaaagatgccttccacctgcgcgtgagggtgcatcccttccacgtgctccgcatcaacaagatgctatcgtgcgccggggccgacaggctccagaccggcatgaggggcgcctttgggaagccgcaggggacgtgcgctagggttaacattggtcaggtgctgctctcggtgaggtgtaaggatgctaacagtcaccatgctcaggaggctcttcgtagggccaagttcaagttccccggccgccagaagatcattcttagcagaaaatggggatttacaaagttcagtcgaagtgagtatttgaagttgaagtctgagaacagaattgtgccggatggggtcaatgccaaggttcttgggtgtcacggacctttggcaaatcgtgagcctggaagagctttcttaccagctactgcttag

SEQ ID NO: 50276 - DNA, 1190 bp, Glycine max
  Peptide Sequence Number=SeqID_167054
gggagaaagagtactatgaaagacaatttgctactctcaaatcgtttgatgaagtggactcggtggaatcatctgactgcattgaggaaagcgatgaggagcaagctcagcaagaaagagcaatgaagatctctaattatgcaaatgtagctctgttgatattaaagatttatgccactgtaaggagtgggtcaatagctattgcagcatcaactctagattctctacttgatctaatggctggtggtatactttggttcactcacctctcaatgaagaacataaatatttataaatacccaattggaaagctaagagtgcagccagttggaataattatttttgcagcaatcatggcaacacttgatttctgtttggatgaacatctgtaccttttgctcatgcttaatgtaaaccaacatgaaggaatcaaatttgatttatggtttaatcaaatttctgtttgggaaactaaaaaggtattaatcacagctgtacaacaactaatacaaaacagtcctgctgaaatgatgaccactgaacagttaatatggttatactctattatgatatttgcaacagtggtgaaacttatgctctggctttactgtagaagctcaggaaacaagattgtccgagcctatgcagatgatcaccactttgatgttgtaacaaacatggttggactagttgccgctgttcttggtgataaatattactggtggattgacccagttggagctattttgcttgcaatttacactattacaaactggtcccacactgtcatggaaaatgcagtttcactggttggacaatctgcacctcccgaagttttgcagaagctgacatacctcgttataaggcaccctcgaatcaagcgcgttgacactgtccgcgcatacacatttggggtcctatattttgtggagggctgggttttattagcagttatagtcggagtgttgatacttgcacatggtttattcttccagacctttttcctaacggttgacattgaactgccagaagatttacccttaaaagaagcacacgctattggagagagcctacagataaagcttgagaaacttccagaagttgagcgggcatttgttcatttagacttcgaatgtgatcataaaccagagcactcagttctcatcaaactgcccaacaatcagccttga

SEQ ID NO: 50277 - DNA, 1317 bp, Glycine max
  Peptide Sequence Number=SeqID_167055
gctcagttggcccagacgctgttcggatcgccgttgcgggcgcggcgttgactggccactgccaggcgggcgaagccgaaggccatggccagcgcgatggcatcgacccagaacagcggccagtggccacgcgcggccgcacgccacagccagtcaccattgagtgcgccgtgcaggatcggcaccagcgcggtactgattgccgccgcccacagcagctcgcgtgcggcctgtgccgggcggcgcagcgcggcccacagcgcacaggccgcccagctgccgaagcaggcccagcggatgccgtggtcgaccgccgccggcgccagccgttccagcaccagcgcggtgaggaacgcgaccgagatcgccacgcacaggccgatgcacacgccgaccgtggcccgtgccatgttcactccggcgcgcggttgctgcggctggcgacgcttgcgccgcgactcgatccacagcaggttgcccgagtagaacaggaacgcaccgcccaggccgagcaggaagtacagccagaccaccaccccgttgccgaactcgccgaagtgcagcgcataggcggcgctgagcgtggcgtggttggcgtcgcgctggcctggcagctgggtggccagtacctggccggtggcgacatccagcgccacggcgccgagcgggccgagggtgccggtggattcgccggtgatctcgatggtggcgttggtgtcgcccgcgttggccagcttcaggtaggccggctcgaagctggtcacgccctgtgcgcgcgccacctccagcgcccgcgcctgcagcacgcgcaggctgcccggcggcgaggggatgccggtcgcttcacgcaccggtgcggtgtccatcgctgttggcacggcctgcagggccttgccgtcgaagatcagggggttgagcagggccatctgcacgaacaccaggcagagcagggcgccggtcaccgcgaacatcaggtggaagggcaggctcagtacgccgatcacgttgtgcgcgtcctgccacagctgtttcaggttgcgccccggacgcagcgcgaacaggtcgccgagcagcttcggcagatggatcaccaggccgctgagcagcgccatgccgtacagcaggctgacaatgcccatcacgtagatgccggccacgggcaggcccaggctgtagtgcagctcgttgaccagctcggccagcccggtctgcggcggcgtcgggctgccgccaatctgccccggccaggcataacgccagctgccatcatcggcctgccagtacgcaagtggctgcgggtggtcggcgccggggaag

SEQ ID NO: 50278 - DNA, 1191 bp, Glycine max
  Peptide Sequence Number=SeqID_167056
gccgccaaggcccgcatcgagcagatcacctcggacgtcgagccgggccgcatctacgaaggcaaggtcgccaagatcatggacttcggtgcgttcgtcacgatcctgccgggcaaggacggtctggtccacgtgtcgcagatctccagcgatcgcgtcgagaaggtcggcgacgtgctgaaggaaggcgatgtggtcaaggtcaaggtgctggaagtcgacaagcagggccgtatccgcctgtcgatgaaggccgtggaagaaggcgacgccgtcgccgcatgtcctgctgcggtgcatgagaggcgctacgcagccattgttctgtcaccgttgcgcggatcgcgcctgtccatcggacgacgtgccacgacatcgactgtggccgtccttgccgtactgattgccggcgccctgcccattgccgcgcacgctgcgcccgcacagccgccgatcttcggtgcctactaccccggtggttccgccgagcgctatccggtgtcgagcattccggccgagcgcctgacccacctgttctacgcgttctcgaccatcgaggacgggcgctgcacgatcggtgcggaagcgccgaagaatttcgccgcactggccgaactcaagaaggcgcatccgcacctgcgcgcgctgatttcgatcggcggctggggcgcaggcgggttctccgatgcggcactgaccgaaaccagccgcaagcgcctggtcgactcatgcatgacgctgttcttcgagcgccatgcaggcagcttcgatggtgtggacatcgactgggaattcccggtcagtggtgggccgaaggaactggcgcaccgcccgcaggatcgcgccaacctgacccggctcgcgcaggcgttccgcgtggcacttgatgcgcgcggtcgcaaggcggggcagccgatgctgctgaccgccgcgctggccgccggtcgcctgcagacggatggcccctacgatccggcggcgagctacgacctgccggcgctggccaaggtgttcgatttcatcaacctgatgagctacgacatgggcaccggcttctcgacggtgtcgaccttcaacgcaccgctgcatgaggtggcggccgatccactggcgccggaactgcggcgctggaacaacgtggccggtgccgtgcagttctaccgcgaccacggcgtaccggccgacaagctg

SEQ ID NO: 50279 - DNA, 540 bp, Glycine max
  Peptide Sequence Number=SeqID_167057
ggagtggcaaaggactggctgtattaccttgctccaaggtccatcacgagctgggatgaccttaagagagtattcttagaaaaatttttccctgcttccaggaccacaaccatcaggaaggatatctcaggactcagtaatatggagagaagtatgatagatgctgccagtggtggagcccttggtcaacttggtaacccagctggccttgaatcagaaatctgtacctgttgcaaggacctttgcccttccatgcagcaacctggagcaattgagcagcctgaagcttatgttgcaaacatttacgatagacctcctcaacctcagcagcaaaatcaaccacagcagaacaattatgacctctccagcaacagatacaaccctggatggaggaatcaccctaacctcaaatggtccagccctcagcaacaacaacagcagcctgctccttccttccaaaatgctgctggcccaagcagaccatacattcctccaccaatccaacaacagcaacaacccccagaaacaaccaacagttga

SEQ ID NO: 50280 - DNA, 936 bp, Glycine max
  Peptide Sequence Number=SeqID_167058
atggcctcagaatcagacgatgattctgaaacagacctacaaaaacaaatccaaaaggccaaacagaccaaaaatgtctgtaaccaaaaaccaagccaatcattgactcaacaagaatcaacaccacaacccagcaatagctatatttcaaaaaacaaattcttcaatgttttacaaatggaaccagaatactgggacaagaatcctttcaaggcaaccgccaaaccacgacattatggctcaaacttaaaccaacccaaaaaatttcctgcaccttttgatcctgcaggatataattattgggactacattgacgcctggaccaatgtgttctggcatcaaaatagtaaatttaagcattcgtggctaatttacttcaagaataacactgtgtataattttccaaattggttcctccaatggtggaactacttcggaccaatttcgcagatatttccagaagaagtccagcagggattccaacaattcaccaagctcttcaatatcaaggaaacaagaattctggcagatttaaagtacttttccagttttgccttgtcatggattttttcatggcaatacagatatggaaaaaccgaaaacaacaaacaatatccatcattgcagagacatgcctttgtaaagtggtggtcacaatttgatacctcaaaggctactccagaacaagtcaagaactggtttcagagcaaccctgagtttctcaagcctgctgatccagagacatctttgtttctgaatcaaaagtctcaacttgcagcattcttagcaagctcaaaatctaaaaagagtcttgctcagaatcttaaggaagttctccaactacttcaacaggaagaagaagaagaagaaccccccaagaaggaagccgaatcatccgagaataatgatgaccaagaagatgatccattctactag

SEQ ID NO: 50281 - DNA, 553 bp, Glycine max
  Peptide Sequence Number=SeqID_167059
gagggcgagggcaaggccagctgagcttccttctacttctgcggctcctattccatcatccacttcagcagccccttctgtcccagctcagacagattctcagcgctttgaagccatacttcagagcattcatcagggacaaatcattttattacagagtttacaggtggtggcgcctccaggatctattccttcagttgagcagttcagggagatggtagcatggcccgagacccaaccttctcttcacagggaagatgaaggtcccacagcccaggtacctcggcatgtggaggatgagtcatctgaggacaccatcccagagccatttgttataggagaagaggcagaggagacacaggtgagacaggtagctgctgccacgcctgagcgatcccttgaggccttctgcacaaggggaggacataccctttccccagcttgcagcagacacctccactcctcttctagagatgccagaggacccgactacaccagtcctggctatgaacacttctcctccagctactccagtattgcatctgacagatga

SEQ ID NO: 50282 - DNA, 876 bp, Glycine max
  Peptide Sequence Number=SeqID_167060
atgcaactcggtgacgaagtcagagtgccacctatccgcatcgcggaagctgcgtcaaaaccaacagtaaatagtgtcaaagccaaactggctgagcaagtgatttatgaagatgacgctatgctggccttgaacaagcctgctggtatggctgtgcatggtggcagcggcatcagcctcggggtgattgaacagttgaggctggagcggccacaagccaaatttctggagctggtgcaccggctggaccgtgaaacatcgggcgtattgatgattgccaaaaaacgctcggcactgacggcattgcatgatgccatgcggcatcaccagatggataaacggtacctgatgctggtgcagggacaatggcaagacagcaaaaagaaagtcaccctggatttacagaagtacgtgactgaaagtggagagcgcagggtgcaagtggtcgacgaacctttgctgaatatcgaaccaggtggcaggaaatcactcaaagccagtggtctggtagccaagcgccatgcggccaaaggcagatttgaggtggaaacacaaatctccgaaacctggttttacctccaggaaaaattaggcacctacagttttttgcaagccaagctgattactggacgtacccatcaattgcgtgtgcaattgtcgcatttgggatttcccatcctgggtgacgataaatatggcgatttcgcactgaataaacagttgaacaaacagggtttgaagcgcatgtttttgcattccagtgaaacccgtattgcgcatccattgaccggcgaacctctacatctggttgcgccgctacctgtagagctagaacagtttttgcaacaacaacgtcaacttcagttgataaagtag

SEQ ID NO: 50283 - DNA, 333 bp, Glycine max
  Peptide Sequence Number=SeqID_167061
atgacccaagagctggtagcccgcggaggcaccttacggttattcgcacctcgtcattcagtgaccccaagtgtgattgacgagcagaggccagtgtggtcatctgcacccttttgtcatccagaggcggcgggcccgatgacaagcagagacaaaatttggtcattctgcacccttgtatcatccagaggcggcgggcccgatgatacgcggagataccttacggttatccgcacccttttgtcatccagaggcggcaggcccgatgacaagcagagacaaaatttggtcattctgcacccttgtatcatccagaggcggtgggcccgatga

SEQ ID NO: 50284 - DNA, 255 bp, Glycine max
  Peptide Sequence Number=SeqID_167062
atggatacctcagagccttacactggggcaatgaggggcatcgtgcatgaacctcaaccttacactagggcaatgaggggcatcgcacatgagcctcaagtgagcataggggcagatcaaaagttctcatccatccatgtttttaaacaaaaaaggggggacaaatcctgggatttcaatggattgattaaacatcaaacgactccattgccgtcactcccaaatggtcaaaatcaaacagaacatacactctga

SEQ ID NO: 50285 - DNA, 219 bp, Glycine max
  Peptide Sequence Number=SeqID_167063
atgatgcagagaagcagtacacacatagcagaaagtacacaagtgctcaagggtaagaaggtgcagaggtttgggtgcaaagtagaagtcgcgcttagcgcatcatccacgctaagcccacaggttaaagttcaattaccgcaaagatatagggctcaacacagtgatgtgcacttagttgaactattcagccaaccaatcaggggtctgagcgcttag

SEQ ID NO: 50286 - DNA, 350 bp, Glycine max
  Peptide Sequence Number=SeqID_167064
taactttcagaggacccaggaaggtcagagggaagagatttgaggccccttccacatcagcatcagaggcaccaacaccttattcttctacacttcctccctcttcctccacagagatcccagtgattcctcctgcacccacacagataccacttccaactcctctctttgcagcctccacagcccaggagcctgtgactgaggagccaccagcaccagcagcagaggaggagatcactccagctcagaccccacagccatctccatcatctgcacctgctcctatggagattcagccatcaacactggatcttaatgaagaacagccacaggagaagcatgacgtttaa

SEQ ID NO: 50287 - DNA, 333 bp, Glycine max
  Peptide Sequence Number=SeqID_167065
atggggcgcaaactacggtcaatccaatcaatgaatctagcaacatggaatgttagggcccggaagaagcactttgagcgatataggcttcggcttaccgaaccggagtttagtacgagatcgcttcacaccttaaaaagagagctcaggaacttcccccttcttgcttttcaatctttccttttctcgacctttcacttcatggcaggaagatgccccaccactgactcggtttatctcaaggtctgcttacaaaagtcttcctttattataaataaaggaatagcgctaagaggccatggggccgggaggcatagtaatcaatcgtggtga

SEQ ID NO: 50288 - DNA, 487 bp, Glycine max
  Peptide Sequence Number=SeqID_167066
atgcaaaatcatgagattcatttaggcaagagctattctttagaagattatcaaagggaaccagagttacgaacctactatcaaaaggaggcagaaagaggtttcaatctggacaacttgttaatgcaattcaaggatacaattgaatcaattcaacgagcatttaaaagtacagaaattcaggttggtaagctggtagaagaagtgactcaagctgtgggcagaagagaagaagaatttgtagaggttgaagctcaagaggaaagccctgtaaataagcatgatttaaaagaagaagatgaggagaaagtgcaacaacgggagcaatgctcacaagtacacactcaacaagaaaataatctccaagttaagacatttcctcatcaactgattgtcaaagaagaaaggcctgaagaccatgaggttccaatcattctgggacaaccctgtttgtcaactgctagttgtgtattagacatgggtaaag

SEQ ID NO: 50289 - DNA, 1049 bp, Glycine max
  Peptide Sequence Number=SeqID_167067
aaggaacctctttccaaggactgactgtagagggtaaaaagccagagaagaatgaagtgtcttttgctacttggaagagcgcacagaaagtggtgcaggagggaacaggtgtaggatggggaaaagttgtgcagttgatagagagtaaaaaccgtgaaggactgggatttgcttcctctgcaggatccgcaacgaacagtgttggatcaagctccattactagcaccttttgtagcgccgggttcatcaacaactcgccagaagccaatgctgtcttggaagacgttcctgaagagagagtacttgcatttgtcacacctggaaaacttgtccgcaactgggacgcggttgacgtcccttcagtagttcatgcatcaaaactaggcatttatgagcccgttgaacataataaccctgcactctctcccaacttcgaatctcctgtctacgaggctgaagaggaggaggatgatgaaatcccggaggaacttgctcggttattggaatatgaaaagaaaaccattcggcctcatgaggaggtagtagaggtgattaacttgggaaccgaggaagataagaaggaagtcaagattggggcatcgcttgaggtaactgtcaaacgaagggtgattgaattgctcaaagaatatgtcgatgtgttcgcatggtcgtaccaggatatgcccggcttggatccccgtattgtggagcaccgtttgcctttgaagcccgaatgcccaccggtcaaacagaaactgagaagaactcgccctgacatggctctcaagatcaaagaggaagtacagaagcagatcgatgcaggttttcttgtcacatcagagtatcctcaatggttagccaacatagtgcctgttccaaagagggacggcaaggtcaggatgtgcgttgactaccgagatttgaacaaggctagtccaaaagatgactttcctctacctcacatcgatgtattggttgacagcgctgcaaagtccaaggtcttctccttcatggacggtttctctgggtacaatcagatcaagatggca

SEQ ID NO: 50290 - DNA, 186 bp, Glycine max
  Peptide Sequence Number=SeqID_167068
atggggtttttcttggtgggaaatttggctttgagtgtttttggcctttttcttttttgtttttgtttggcgcgaggtgcacaagccactgacgcacagggcaaggattgtggtgagttgggactttggctcaaggcttgtagaacggatggacatgatatatgtcagggcgttggtctggtttag

SEQ ID NO: 50291 - DNA, 353 bp, Glycine max
  Peptide Sequence Number=SeqID_167069
ccgacaaggaaagtattgatgacactgtatgcgaaaagtacgacattagcaaagagaagtgggcccaattttgtcagacccgcagagacccttcgtggaaggcacaggccatccaaaaacaaaacactgcccctcacgtgttgtcccgtgggggttatgaatatctagaaaacaagttgatggaggagaagaaaaagaaaaaagcggaggaagctgctcaaatcgaaagcactgacaccgtgattgatcctccatctcccatcagacaacacgattcgttggaggagcaaaccttacagggttcctttgtcgcccatggacgtcaggatgtactgactactgccattgggtga

SEQ ID NO: 50292 - DNA, 564 bp, Glycine max
  Peptide Sequence Number=SeqID_167070
atgactcaagagctggtagcccgcggagacaccttacggttatccgcacccttttgtcatccagaggcggcgggcccgatgacaagcagagaccaaatttggtcattctgcacccttgtatcatccagaggcggcgggcccgatgatacgcggagataccttacggttatccgcacccttttgtcatccagaggcggcgggcccgatgacaagcagagaccaaaggcggcgggcccgatgatacgcggagataccttacggttatccgcacccttttgtcatccagaggcggcgggcccgatgacaagcagagaccaaatttggtcattctgcacccttgtatcatgcagaggcggcgggcccgatgatacgcggagataccttacggttatccgcacccttgagtcatccagaggcggcgggaccgatgacaagcagagaccaagttttggtcattctgcacccttgtatcatccagaggcggcgggcccgatgatatgcggaaatacccgagtggttatccgtataaacattcttttgctatctgtaagacagaacgcttga

SEQ ID NO: 50293 - DNA, 200 bp, Glycine max
  Peptide Sequence Number=SeqID_167071
cctgcagagccagggttttacttctttttccgtgccctactccggaccagtttagggcagaggtcgcatggcttggagattggcctgaggcccgggcaggagaggcaccagcagaggctcccgacgaggcagatgaggcccgcgaggacgaggagatgaccgatttacttgatttcttaggaggaagcggggccacatga

SEQ ID NO: 50294 - DNA, 909 bp, Glycine max
  Peptide Sequence Number=SeqID_167072
atggctgaggacgtcgctggcatgactgatgatgtccctgagcagcctacggaagcacctgatctgcgtgcggacgcacagggtgctgatagtggtgaggggtcagatggtgatgatgctgcagagggattccctggtggtccacgtgacccgtcagtgctgacatcatttgtcgagcatgttgcacatgctgtgtggagtggacaagaacgtcctgatttgaagttagtgtcacatgggaggaaggtgacactgattgggaggccagtgtctgagattgaaggcctggtggctgccacaggattaagtccactgatagattgttcagttattactggcaatcctagacttatatccgcatttgtggagaggtggcacaatgagactagcaccttccaccttcatgtaggagagttgacgatcacattggatgatgtgtcgtccatcctacatttgtccaccactggcgccttgcacagtttccacgctctttctacggaggaggccagattcttgcttacggagttgttggaagtgtctgctgaggaggccagagccgagacagcactcacacgtggagcatatctcgcgcttatctgctgcactctttttgctaataagagtgcaacatacatgcatgtggtccaccttgacgctttccgggacctcgctcatagtggtggttacgcttggggggttgccgcgctggttcatatgtatgaccagttagatgaggcttgtaggaccaccacccgacagcttgcggggtacttgacgctacttcagtgctggatctatgagcacttccctagtgtgcaccagtgcgtgactgacgatacataccaggagacgttcccacgtacttcccggtggttgacgtcgaaggcgcacatgaagggcatcacatga

SEQ ID NO: 50295 - DNA, 228 bp, Glycine max
  Peptide Sequence Number=SeqID_167073
atgggtctctgtcagttctatagagtgcctgtcacctccagcaagggcatcaggccccctactaatcgagctttcatcaagaagtattgcgtccccaggcaggcgcagggcgaaacaccacagcagcctggggatggccagcagcgggcaacagacgcaccgccatcacctctagagttcacctcaaaaaggttagagcgttgcttacgacctatgtccgaccaatag

SEQ ID NO: 50296 - DNA, 776 bp, Glycine max
  Peptide Sequence Number=SeqID_167074
gattgtatggtcctggaatatgggtgtccgatccttatggactaactggaaggatacaatccgtaaatcccgcgtggggcgtggaaggtcttttccatcttagtgtgcgtccaccccaacgtctatataaaggattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagttcaatggacaatggagatggaatatccgtcgatggggatggaattgttagggccgatgttccttttcgaagggcagaatctaaatatagtgtggaacaagtaggtgtaattgttgagttctatggtggcgagcttaatggagtcagttatagcgatcccgctactgtgaaaaaatatgctagacgtgctcaattgggtgaaatttttgaattagatcgtgctactttgaaatcagatggtgtttttcgtagcagtccgaggggttggtttacttttggacatgcttcttttgctctgctattctttttcgggcacatttggcatggtgctagaactttattcagagatgtttttgctggtatcgacccagatttagacgctcaagtagaatttggagcattccaaaaacttggagatccaactacaaaaaaacag

SEQ ID NO: 50297 - DNA, 183 bp, Glycine max
  Peptide Sequence Number=SeqID_167075
atggaggatagggtcatgactgaccgatcgtcgtctcttcccggtgctggacaagcagagaacgtcgctgcaaggcagcctataatggggcatgcccacattgtccccgttctcttgctattgatgcttacacgcgcgcccaacaagtgtacggtgaaatgcctcaatggcattagcgcgtga

SEQ ID NO: 50298 - DNA, 312 bp, Glycine max
  Peptide Sequence Number=SeqID_167076
atggcaaacttcttcttccgcgctttgaaatttggttcccttctcctccacaggtattggcatcctccattgactagctttgtttgtttcttccgccatccagacgaaggttcttccgccagaagaaccttcttctgcgcatgtgggaggggcagttggatattgaagcggaagaaggagttcttccgcgggaacctgtggaagaaagcggagaaggttcttccacgcgttccggcagaagaaggttccgaaggttcttccgctggatccagcggaagatggttccggaggttcttccgcgggctccagtga

SEQ ID NO: 50299 - DNA, 1749 bp, Glycine max
  Peptide Sequence Number=SeqID_167077
atgtcactgtccaatggagatgattcaactgtcacttccaagcagcaaaaacctcagcttccgaacccttttgatctcactgactctgagatccttgagaaagtttatctgacccacctccatgatgatgacaggtgcgatgtagaagtcctttcggacattgtgtcaactgttgtacttaagacgaggttagctgaaggcaaagcatatcagaccgttttccaaccagaatatcgtacaatgaagctgatttcttgtcagatcataacgacaccacgtggtgaacgctacgtgcatcaaacaacaatgtgcattcttcagcacctgagaagctactcgtgggaggcaaaagcactggtaactctagctgcttttgctttggagtatgggaaccttttgcacctgagtgatgttgcaacgccagagaagcaactcacaaactcgttgaaacaactgaaccaagttgaagctagaaagaagcctgccaccactttggtggagttggtaatggaagtgcttcatggcatccaagagtggacaagattatcaggtcttgattatgacatagtggaagtgccttccttgacagaagcccagcaagaggtccctgttgttgtgtattggataattgcttcccttgttgctgccaccgccaacctcgttggtctatcggaatataaattatcagcttttctggaaaggctttcttcagctgcttataaattcaaggaacatctgaaatcgagcctagtgcaaaaaggttatgcagatgaatactacaagcgcaggaatgcaatttctaaacccaaagatatagtagaattcttgaagcttctgatccatcacaatggatcaaaggatatcgaagtcttcagccagaaatatgtcttgttgttcatttcaagcctcgacaagattgaagatgagatctcacttttgaactcaatccatgacagattgcatgagaatccaaatgaagtagtaaaaaattacaagaaaggggatttcaagattttgtggatccccattgtggatgcctgggacgtacaggcaaaaacacaagttcaatatcttgaaggataccatcaaatgaaattcaactacttgggaaaacctattatcccagtgctcacccctcttggtgacataatgaatgaagatgcaatgaacttgatttttcaatggggtatcgaagcgttcccctttaggaaaattgatggcattgagcttactctaaaatggaaatggttctgggacgcaacaaagaaagcaaatcttggaatacagcagttggggaaggaagaccccacggatgttcgtcgtttctggatagaaatagaaaggaagagactgaagaagcacaaagatgcagtggactgtgagattcgaaagattgtgaagaccttgctttgcctcaaacaagatcaacaaggatgggctattctcaccaaaggctctaacgttagggttttgggtcacggtgaaccaatgcgccaaactttggctgagtttgacacatggaaagagaaagtgtttcaaaaagaagggtttgacgtagcctttgatgagtactataagactaagcttgatgagttatatgctcgccaagaatgtgattttgttaagaataatgcagatgtgctagtaactatagcatgcccaaatcccacatgtggacgtgtgatggaggtgacatctgttaattacaagtgttgccatcgtgatgctacgaacaatgtcaacatctga

SEQ ID NO: 50300 - DNA, 1572 bp, Glycine max
  Peptide Sequence Number=SeqID_167078
atggatcaagacagttctattgggaaagttttcaagttcacacatgttctggctgcctccttcgccggtttagttgccgccgccgccgcctcaagctaccggcgggcaccgtccacggtggtgggagagcagaagaaggttattcccgagctacgtaggacggaatctgggcgtctcggggagatcgaaaagttctcccactatgttgcaaggcaaatggggtttgaagatgctgatgaggttccagagctatgcatattggcccaagagtatttgaaaaaatccaaagggtgcgatgaaagcatctttgaatatatttccagtggcaatgtggagaacactgattctctatatgcgaaattagttgaggagttagagagatgcatcctcagttatttagcatttcactggaaccaagctacatctgtcattagtcaggttttgggtgtggagtctcagcagaaaaaaaagctgaagggaattctattggcagctacaagggaacagaggtttgatagagtaaccaagaatctgaaagtgacaagagtgatctctactttggtggaagagatgaaagcaataaatggtgactcgcaatgtacagaagtgatggtgcccatggcccacagtgagaggagtccagtcctgctgttcatggggggtggcatgggagctggaaagagcactgttcttaaagacattcttaaagaatcattttggtcaggagcagcttcaaatgctgtggtggttgaggcagatgctttcaaggagagtgacgtcatatatagagcccttagctccagaggtcaccatgatgacatgctccaaactgctgaattggtgcatcaatcttccactgatgctgcatcatctctgctggtgacagctctaaatgagggtcgagatgtgatcatggatggtaccttatcatgggaaccatttgtggagcaaactattgctatggcaagaaatgttcacaaacacaggtaccgaatgggggtagggtataaagtagctgaagatgggacaattactgaaaattactgggagcaagtaaatgatgcagaagagcatcaatcagaggaaatttctaatggagaagcacacacccaaaagccttacagaattgagctagttggtgtggtttgtgatggctatcttgctgttgttagaggcattaggagagctattatgacagggagggcagtgagagtgaattcacaactgaaatctcacaaaagatttgctaatgcatttccaagatattgcaaacttgttgataatgccagactctattgcacaaatgctgttggtggtccaccaaagcttatagggcggaaggatggtgatcacaatctactagtggatcgtgaagagatcaagtgcttggaaacgttaggcagtttgaatgctggagctgattccatctacgaacttcacaaagaacccagccccataatggaacctggttctgtttggaatgatatagttatgtcaccttcaaggccaagtgatcaaaaagaattgaaggaatctattcagaaaatagagaaatccatccgaaaaatgtaa

SEQ ID NO: 50301 - DNA, 1422 bp, Glycine max
  Peptide Sequence Number=SeqID_167079
atggattacgacatagaggctgtgcattccttgcaagctgccatgcaagagatccctcttgttgtatactggacaattgcttccactgttgcttctattggcaaccttgtcggtatatcggagcataaattatcagcatataaagaaaggcttgaattcatttttaaaaagttgcagttccacctggagaattgcagagtggaaataggaaggatacaagattactgcttccgtaacactattagatatcctaaacttaaagatgtggtagagctgttggatattctgattattccaggttctgacaatggaacttcgatacccaaaatatttgaaggcggcgtcctaattaaaaatggtattgaagtgttcaagcagaaatatgtgatgctgttcttttcgagccttgacaacattggagatgagatatctcttttgaattccatcaacaacgggttgcaagagaacccaggagaagaaataaaaggtttcaaaaaaggggatttcaagattttatggatccccattgtggatgactggaagactacgagggagcagtttaataatttgaaggaaaagatcaaattctaccttgtggagtactttgaaaagttaccaggatatgatataatagtggacaaatttaaatacgaaggcttgcctatagtgtctgtggtcaaccctcaaggtcagataatgaatgataatgcaatgcagattatttttgaatgggggatcgacgcctttccttttaggcgaagtgacgtttatgatctcaacaaaaaatggaaatggttttggaatttgttggagaaaaccgatgataatgcaaagcgcttggggaaggataacactagttacgtcttcatctatggaggtaacgacagtagctgggtgcagaacttcaagatcgcaattgggaaaattgagaagcatgtgatcaacaatgtggacatcaacatagagccctatcagttgggggagagtaacccggacaatgttccttcattttggatcggcctagatgggaagaagaagaacaaggggtgcaaggacaaagtggactgtgaaatccaagaagttgtgaggaccttgctttgcctcaaacaagacccttcaggatgggttgttcttggtagagggcgtaacttgaagattctgggtcatgctgagcccatgtatcaaaccgtgcttgattttgataagtggaaaagcaaagtgcttgagaaagaaacctttgatgtggccttcaaagaatattatgatgtggttaaggagaagtatgctagtctcccatatgatcatacttcaagtgtcctagcaacaataacttgcccaaatcccttgtgtgggcgtgtgatggaggttacatctattaattacaggtgctgccatggtagtgcaaacagctgcaatctctga

SEQ ID NO: 50302 - DNA, 2571 bp, Glycine max
  Peptide Sequence Number=SeqID_167080
atggctcttgtacccactcgcccattcttcgattcatttcattcttctcccaacttccactctctccgcttctgcaactccctcttccgccactccctcacaccctctcccaattccactttcctccgtcgcaaaccactcttcatctttcgttgcaaccctgccaagagtttctccaccgataaacactggttgaagcgttggaacgaccccacaaacaaccacgcccgtccgaagccgccatgtgctgttttggactattctgaaaatgggcacgcgtcaaaatccggtcttgcgagctctgacgaggagggtggtgatggaaataccggtggaagcaccatggataggattgtggaaaaactgaagaaatttgggtacgttgaagatgggattcagaataaggagagggtgatagaaaaagggtcagtggaggatatattttatgtggaggaaggaatgttgcctaattcacgaggtgggttttcttcagaatctccattagggtttggaagctttggaagtgatgatagagaagtgaggtttccgtgggagaagccggtggttgaagagttggaagagaggaaatccatgaggagtaggagtaagacctctctggcggaattgactcttcctgagtcagaattgaagaggcttctcaagttgacttttgagaagaagcacaagaccagaattgggaggagtggggtcactcaggctgttgtggacaagattcatgagaggtggaagacttcggagattgtgaggctcaagttcgaaggcgaggccgcgcttaacatgaagaggatgcatgagatacttgaggtttggtgtttatctttagttgattctatgttcagaaaatcttgcttttgttgcaaaacctgtggtgtgcatgatgggaatgagaagcaaatgtctggcaactctgtttccttatacaggggtgtgagctacgaggttccttcagtacaacagaataaaaaaatatataggaaaagcgagaactcttctaagcttttaccaacaccttcttataattctgtggggaatccttcagacattgcttctaattctgggacaagtgcaccattggcaaaattggaatctacaaatgatgagaaagaaagagattatctgcccaaagtcaattatgaacatgaagtagacaagttactggacggtcttggccctagatacacagattggcctggatgtgatccattgcctgtcgatgcggatatgcttccagtaactgttcccggttaccaacctcccttcagagttcttccttttggagtgagagcaacacttggtttaagggaggcaactgctctacgaaggattgcaaggacccttcctccacattttgctttaggtagaaacagacagcttcaaggattagctgtagccatgattaaattgtgggaaataagttctattgcaaaggttgcactcaaacgtggtgtgcagctaacaaccagtgagagaatggcagaagagatcaagaaattgacaggtggtattctactctccagaaataaagacttcttggtcttctttcgaggaaagaattttttatcagcagatgtcactcaagccttgctggagagggaaagaatggcaaaagtaatgcaagatgaggaggagcaagcaagattgagagcgtcatcattgctcataccgactaataatacatcagagctgtcagcagaggcagggactcttggtgaaactttggatgcagatgcaaagtgggggaaaacattggatgagcgtcacaaacaaaaaataatgagagaatctcttattgtcttgcctatggcttttgcatttaattatctcatcatccagcatgattgtaatgctctttcttccaagggtttccttgatgaaactttaaaactcttcattgaactggctgaaagaaagttaaggagagctgaaaaagccttaatgaaggtggagtcgtttttgaagccatcagaatacaaagcagatcctgaaagtataactgatgaagagagatttatgtttcgcaaattaggattgaggatgaaagctttcttacttcttggtagacgtggggtttttgatggtactattgagaacatgcacttgcattggaagtaccgggaactggtcaagataattgtgaaggctaaaacctttgaacaagtaaaaaaaattgcactagcacttgaagctgagagtggaggtgttctggtctcagttgataaagtttcaaaaggatattctgtaattgtttatcggggtaaggattaccagcgtccttcaacattgagacccaaaaatctattgacaaagagaaaggctttggcacgctcaattgagctccaacgacatgaggagcaaatggagaaggtaaaggacaaaggagatgaagcattgtatgacaaattggattctgcctatcctagcgatgatgagaactcagaggtggaggatggtgagcagggtgatgaggcatatctcaagacctataatagcgaaaatgatagtgaaattgaaagtgaagttgaaagtgataatatgtatcctccaatctga

SEQ ID NO: 50303 - DNA, 1095 bp, Glycine max
  Peptide Sequence Number=SeqID_167081
atgatggtacacgtatacagggaacagaggtttgagagagtaaccaagaatctgaaggtggcaagagtgttctctacattggtggaagagatgaaagcaataaaggttgactcacaaaaaacaaacgacatagtccacactgtccacactgagaggagtccagtgcttctgcttatgggaggtggcatgggagctggaaaaagcactgttcttaaagacattcttaaagaatcattttggtcaggagcatcttcaaatgctgtggtggttgaggcagatgcttttaaggagagtgacgtcatatatagagcccttagctccagaggtcaccatgatgacatgatccaaactgctgaattggtgcatcaatcttccactgatgctgcatcatctctgctggtgacagctctaaatgagggtcgagatgtgatcatggatggtaccttatcatgggaaccatttgtggagcagactattgctatggcaagaaatgttcacaaacacaggtaccgaatgggggtaggatataaagtatctgaagatggtacaacaattactgaagattactgggagcaagtaaatgaggaggaagaagaacatcaatcagaggaaaattgtaatggagaaccacgcacacgaaagccttacagaattgagctagttggtgtggtttgtgatggctatcttgctgttgttagaggcattaggagagctattatgacagggagggcagtgagggtgaattcacaattgaaatctcacaaaagatttgctaatgcatttccaagattttgcaaacttgttgatgatgccaggctctattgcacaaatgatgtgggtggtccaccacagctcaaatggcggaaggatgatgatcagaatctgccatatcccaaagatataaaatgcttggaaaggataggcagtgtaaatgttgaagctgattccatctacgaactttacaaggaacccagccctataatggaaccaggttctgtttggaaagacattgttctttcaccttcaaggtctaatgatcagaaggaattaaaggaatccatacagaaaatagaaaaattcatcagaaaacggtaa

SEQ ID NO: 50304 - DNA, 420 bp, Glycine max
  Peptide Sequence Number=SeqID_167082
atggcattggtactgtccaaaacagcttcaaatggcaccactccacagcagaaagatcaactccccaacccttttgagcttcaagactctcagatccgccacaaggtttatctcacacatgtcaatgatgaaaaagagttcgacagggatgtccttttcacccttgtgtccaacactctcaactctgcctctgctcaactttcagcagctgcttcttctgttacaagtttcaaaccagacttccctacacttaagtggctttcttgtcagatgataaccacacgtggaactccagaatgtgcacaccagacagcacttaggatccttcagcaactgagtggcttctcgtgggatgcgaaagcactagtagctgtggctgcattctctttggaatatggagaatttttacgccttgatcgg

SEQ ID NO: 50305 - DNA, 745 bp, Glycine max
  Peptide Sequence Number=SeqID_167083
cattgtggttgagtggagccagggtagtagggaacagttcaaagctttgaagagtggcatcaagttttatgcggtggaatacttctttgagttaccggggctcaagataataaaagatacagaaagactgaattatgagattcagcctattgccccgttgttcagctctaaaggtaccctattgaatgaaaatgccctggaagtgatctttgaatggggcatagaggccttccctttcaggaaagttgatggtgatgaacttactctgaaatggaagtggctttgggatttaatcctaaaagcaacacctgtactacaggtgaatcaggtgaaggagaacagatacatctttatctatggaggtgccaacaatacgtgggtccagaacttcacacacgagctgtcaaagataaaaatgaacgagaatatccaacgtgcagatatcataatagagaactatgaactggggaaggggaagggtgaactcaacaacagtgttccaagtttctggattggcgtatcgcaccaagaggcagtggactgtgagattcagaagattgtaaagtgcttattctgcctcaaaagggacccacaagggtgggccattctcagcaaagggcacaacattaagcatctctgtcatggccaggctgtttatcagatcgtggctgagtttcaaaactggaaagagagagtgttcgatagagaagggtttgacattgccttcaaagagtactatatatga

SEQ ID NO: 50306 - DNA, 537 bp, Glycine max
  Peptide Sequence Number=SeqID_167084
atgacattaaaaacaaagtcaatccccgatttccacagccagtgccaaaccagaattccctacactgaagctgatttcttgccagacgtagtgctgcgtattgcgtacagcaaacaacaatgtggatccttcaacacctgggatgcgaaggcactgatagccatatatagctgctttgtctttggagtacgggagtttcgttcaccttactcagtttcaaacaaacgacgtgctcggaaactcgctgaggcagctgaatcaagtccagagaaggaatgcctctgctgttggcgaacttgtcacaagccttccaagccatccttgttgttgtataatggtcaattgctgccaccgttgcttccaccggcaacctcattggtttatgccaatgtacgagattacattaccatccagaacgtctttgagaggcctaaagatattgtggatcttttgaaggctctgatctacccccaacaaaagggagctgagaatcccaagatatttgaagggaccaacctagttacaagggttagttag

SEQ ID NO: 50307 - DNA, 207 bp, Glycine max
  Peptide Sequence Number=SeqID_167085
atgggatccattttgagatatttctatgcgaaacctgagatgatggttctgctccttaattatgatgttagctatgttcctggctttgtgcttcttgacaacaatggaaaggcccttgcaaagactggtgtcccaaatagtcgtttacatgttattgcaggactctcccatcttctcaaaatgaagcgtcctcaacaaaattattga

SEQ ID NO: 50308 - DNA, 255 bp, Glycine max
  Peptide Sequence Number=SeqID_167086
atgaattggccccaggaggtgcaaatcgacattgatatggacgatttccatggcctcagcagtgtgcaaatcgccattggaatgggcgatttccatggcctaagtcgtcagaccaaatggcaactctcccctaagcccaaaaagtcaacaaaatcagctgcactgcatcctgcacgtcctgcaaagttgcctgcacccctactgctagcctatcggaaatcgctagtcagacttgcgatttctccacagccatga

SEQ ID NO: 50309 - DNA, 216 bp, Glycine max
  Peptide Sequence Number=SeqID_167087
atggagacttggactaggcaatcactgcgcgaggatccagactcagcggtggaggaagcatgcacgataatcaattcatggggctccgaatcaaagtggggaccggagacttgcactaggcaatcactgtggaggatgcatgaacgaaaatccattcatggggctccgaataaaagtggagaatggagaattgcactaggcaatcacttcgcgtag

SEQ ID NO: 50310 - DNA, 441 bp, Glycine max
  Peptide Sequence Number=SeqID_167088
atgcttcagggctgcgttgatgagcgacgaatagcagcgctcagactcctcctgttccatgctggcgtatgccaggctctttgcttcggccctgacttccccgcggatgttcgtcaccatgtcgtaatgtccggccagaatggtcaggtctttgcgaaagcggttgaactgtgtcgcttcgtcagcgtgttcaagcccggcccggtcagcggcccagtgctggaaacagaagttgaagaaagcgaaaaccttgcggtgaaaggcggggttgcgggtcagtttgatttcggcggtgtactgctcgccattcttaaatctggtcaggcgctgtacgtcggaatcaagcgccggggtgaaaatcccccctgccgatttgatcagctcgatttgcatggctggcctcaatcatcttctgcaccagtgccaaagcctcatcagtga

SEQ ID NO: 50311 - DNA, 243 bp, Glycine max
  Peptide Sequence Number=SeqID_167089
atgacagcccaaaccaacggcgatgagctggagcgagagaaattcgaggcgtggtattgcataaattaccgcacaccgttcacccacatgcagcgccacgataaaagcgatgattacgtcgacaggcagattagagccgcatggcgagcatggctggcacgcagcaagaaggaggaaaagaaggtaaagagtggtgcagccaggagaggtcttcatgagcaacgtaatccccctaagacctga

SEQ ID NO: 50312 - DNA, 402 bp, Glycine max
  Peptide Sequence Number=SeqID_167090
tcgcggaacacagcatatcttcacgttaaggcgctggagaaaaaaggcgtactgcagcgtaaacacaagcgtagccgaagcattgttctggctgacgcgccagcagttgagctgcccgacctaaacgacagcgaatactggtacgagggcgtgtttaaacactcgctttaccagcgagacgtggtggacgccatcaaatcggccagcatgaaagcccggaacatcaccgaatcgattatcaatctggcaaaggtagacggcctgacgaccgagaaattccagtctcatcttcgcgccattgacttgctggcccgcgaggcgcacgacctgatagtcgatgctgaattcgagcgcgattcccgttccgaaaaaggcggcaagaacaagaagggaggtttctga

SEQ ID NO: 50313 - DNA, 150 bp, Glycine max
  Peptide Sequence Number=SeqID_167091
atgactttattttgcacatggcttcctatcgaatcaaagatcaaacgtggtgtgggatatcgccagtcgagaacgaccttgaatggcaatctgaagggaagagacaccaaaaatgggttttcctttgccggcaatcccttaccttgctga

SEQ ID NO: 50314 - DNA, 810 bp, Glycine max
  Peptide Sequence Number=SeqID_167092
gtcctcgccttcagaggactagatgtcctcgtgatcggagggctgcatgccctcaccttcagcggactaaaggtcctcatctttagaggactgcaagtcctcgccatcagagggcggcacgccctcaccttaaaaggagtacacatcctcggcatcagagggctgcgcgccctcagcatcagaggactacacatcctcgcctttagaagacttctcgtcttcagagggctgcacgccctcaccttcagagggctacacgccctcccttttagaggactagacgtcctcgactgtagaggaatagacgtcctcaccttaagaggactagaagtcctcgccatcagagtgctgcacgccctcgccttcaaaggactacacatcctcctctttagaggactgcacgtcctcgtcttcagagggctgcatgccctcactttcagaggactacacatcctcgccatcagagggttgcatgccctcaccatcagaggactactcgtcctcgcctttagaggactacacgtcctcgtcttcagagggctgcacgccctcacctgcagagggctacacgccctcccctttagaggacttgacttcctcgcctgtagaggaatagacgtccttaccttaagaggactagaagtcctcgccattagagtgctgcacgccctcgccttcagaggactacacggcctcgtctttagaggactgcacgtccttgtcttcagagggctgcatgccctcaccttcagaggactacacgtcctcgccatcagagggctgcatgccatcaccttcagaggactacac

SEQ ID NO: 50315 - DNA, 387 bp, Glycine max
  Peptide Sequence Number=SeqID_167093
atggctatggttacatgtgagctcatgtggatcaaacaatttcttcaagaattaaggttttgtgaagagttgcaaatgaagttgtattgtgataatcaggcgcgcctccatgcgcactttggttacatctggcaccactttttgttgttagatgagccccaaataccattgatcattgtagaggcacacaccacatatcacgttccttttgaacatactcctcaatgcaacatcaaccatgttatttcctacaatgcttactttggattcaagcggtcgagcaacccactgcgattctggcaacaattcttcggacatgatgctaatgggtgggccactagatctactttctgtcagatattactgttaatgtttgcgaggaagtga

SEQ ID NO: 50316 - DNA, 147 bp, Glycine max
  Peptide Sequence Number=SeqID_167094
atggagttcaacgggttgaggggtgggggtcacaacccactctttgaggatttacctagtgagtctggtagtggggccgccactgtgagatatgggctaatctccaatgacactcacgaaacaagatgcaagtgcaaggccgtgtaa

SEQ ID NO: 50317 - DNA, 183 bp, Glycine max
  Peptide Sequence Number=SeqID_167095
atggttaacgaaactaggatcgtagttttactgagaccgttttgggtacctgcgggaaaagagaaagctacggctgcgggaaaaagaaagagttttggagaggagaagagagaaaacgaaaatgagggaaagaagaggcatcgtccgtctaaaaacagacctaacatcgctatttatacctag

SEQ ID NO: 50318 - DNA, 758 bp, Glycine max
  Peptide Sequence Number=SeqID_167096
gtaggccaccacgatgaagcagctttcaccgatacggtccaccagcgtgcgtacccgcttggtgctggtcacgggagcggcctgccatggctgggcctcaccgggcagcgtggagaagccgaagcccgcgatggcatctacgaccctgaagcccgccttggtctggctcatgccatcggccagcgcggcgtcgtaggccgtctgtgcccgatgccacagcgcaatgacgtcactggccggcgtgccgatcaggcgcagtgctgccgacaccagaggcatggcgatctcgtcaggggtatagggcaaccacccacgatcatgcttgggcaagcgctgcagcagcacgggaaccggctcgtcgatcgccacatcgggaaggcggccgccctgcaggtacagcaggtgcaggacgccgcggtaggtgctcagggtcgccgccgacagaggcttgccttccttcatgccgggacgccgggccacgtcggcgaagaactccagcgccgtgtcgcggtgcaggtcggcgaagcagcgcaagccccgcgcggccatccagcgcaccagcgaacgcagcacgcggaaggtggacacgagcgtgccgtcgtgcacatgcctgcgccccggcggaggatccaccttgaggctccacaggaaacgcttggccgcacgcgaccaggcatgccatttcggagcgctgaagcggctgtcgtcgtgcagccggaagctccagtccagagagaagtcgctgggattggcaccag

SEQ ID NO: 50319 - DNA, 208 bp, Glycine max
  Peptide Sequence Number=SeqID_167097
cgcttcaacacgtttcaactcaacttcaacgttttcaaatcaacttcaacgttttcgtgtgaaaataaaacggagggcaaggggttttatagggaagagggacgtgccagggggccaaccactagtggacgcgcctggcaggctaccactagtggtcgcgcctggggccccaccactactggtcgcgcctggggccctaccactactg

SEQ ID NO: 50320 - DNA, 273 bp, Glycine max
  Peptide Sequence Number=SeqID_167098
atgactctgttcacagtaatctcaaacaacaccttaacagccttaagacaacaaatggatcacatgcaaacaactaatgacaattttaggctattggctaatcaaatgtctggaataaggaatcttatggctatccttcaagtacaacctcaaaatgggattccttcacacaatgccatgacacttgggggcattgctaataaaaaaaagacaaaattcatgggatacatcaaccacatgtcggaggaaatggtggagggccaaaattattaa

SEQ ID NO: 50321 - DNA, 129 bp, Glycine max
  Peptide Sequence Number=SeqID_167099
atgactagtatatatgtgaggggtagagggtgtcacagtttacgcatggggaagtttttggggtcgacaagagtgttgcccttactcctacgtatcctcaagtgcgatgagggattcagacctaagtag

SEQ ID NO: 50322 - DNA, 393 bp, Glycine max
  Peptide Sequence Number=SeqID_167100
atggctgcagtagtggaggctgtggcaacaatggtgatcgtcgtggcgacggtaatgggaggggctgattcaaattatcatccccatgagtctcttgtgctctatgatccccagactctacaacttgtgcagattaatcattctcagtctaacaatagaacttccaacacttgggtgaatcccaatttgaaaaactccagtcaagatattaatgtcacctcagctactcctagtgtcatgcttgccaatgtctcttctacaggtgctgcccattctgcatggatccctgactcaggcgcatcatttcatgtcaccggtgagcctcagaacatccatcaactaggtcactttgagggtccggaccaaattttcattggaaacagtcaagactaa

SEQ ID NO: 50323 - DNA, 177 bp, Glycine max
  Peptide Sequence Number=SeqID_167101
atgccagagatgcagatgctcaaacttggagagggccaagcgtgggtggtgtttgcggctgataggaggaaaatagcggtgtcccgtagtgatgggcggccacaggccaatgcagtggtcatcggaaacagtggagaggaagggagagtaaaatttggtgggaaaggtgtacaatag

SEQ ID NO: 50324 - DNA, 539 bp, Glycine max
  misc_feature (478)..(478): n is a, c, g, or t
  Peptide Sequence Number=SeqID_167102
gcggcgccaagtggatcgccttggccgactggcgcgcctgcgaggacaagagcctgaagctcgatgacttcgcaggcaagcgctgctggatcggcctcgacctggccgagcggcgcgacatcgctgcggtgtgctacgtgttccgcgagaacggcaagtactacgtgttctggcgtttctaccagaacgagtaccaggccagcctgctggagaacaagcactaccagacctgggccaatgcgggcttcctgcacatcacgccaggcaacgcgacggacttcgacgtgatcggcgaccagattgccggccgccgagccgagcacagcatcgaggtgatcgagaagcccggcgacctgcagcagttcgccgtggaggagctcgattacgaccccaagttcgccccgtacttcgtcaagaagctgatggagaagggcgtgccggccgttgaaatcgggcagaaccccagcaccttcaccgncccgatcatcgaggtggagaacctcgtgctgaccggcaagctagtgcacgaggaaagcccg

SEQ ID NO: 50325 - DNA, 234 bp, Glycine max
  Peptide Sequence Number=SeqID_167103
atgcaaaccaccctagaaactcctcctccaccacccacgaccactggtggcaaccacgagccaccgttgcttgccaccaaaccaccacaccgagaggaacgttttaatcgaagcggaatcctcagaatccacctcaaggatttggtggagaaaaatccttcaaccctttcttttgtagcttctctgaggtactgtaatagggtgccttttacagttcttttgaaaaacccttga

SEQ ID NO: 50326 - DNA, 264 bp, Glycine max
  Peptide Sequence Number=SeqID_167104
atggcattctctgttgcctttgtctatttggagggagaacgtctcaataatgttgtttgggctctacaaaggtttcaaggtcttcttctcagacgtgatgcactccctggagttattgttaccggtagagatatagcattgataaatgtagtgaaaattgtagtccctgaagccatgaatttgttgtgtcggtttcacattgataagaatgtgaaggcaaagtgtaaaacctttgttgggttgagtctgctcattgggccttaa

SEQ ID NO: 50327 - DNA, 644 bp, Glycine max
  Peptide Sequence Number=SeqID_167105
aggcttgcttagattgggaaataagggtagagcaacaacttaaaagaaagtctacttcaaaatctaatggttctcgctcttatccaaagaaaaaccaaggtctaggaatcttaggggcagcaccttctaagcccaaatatgataaggggaagacaatagaaaagcaaccccttaaggctagtatgcaagagaagactggctctataaagtgctttaaatgtcttggaagaggacacattacttctcaatgccccatcaagaaaaccatgattatgaggggccaagacatttcaccttcctctagtgaaagtgaagaagcaaaaggggaagaacctagtgaagaaatctacccccaagaagaaagacaaccattaatggtcaaggaggagtgtaaggaggtaagtgtctcctccaagaggttagctatgaaagaaagtcattttacaataaagacaaacattaaagaaacttcccctcttagaaaacctctacattttctccttggtaaaaagacacttgttagcattgccatagctcttcggcttgaggttcttcctcaagtaaaggagttgttggatgagggtttcattcgtaagagcttaaatgcttttgctttgttggtgtctaaaatagggactcattag

SEQ ID NO: 50328 - DNA, 201 bp, Glycine max
  Peptide Sequence Number=SeqID_167106
atggcacgcagagacaaattatggtcattttgcgcctttccatccaggctcgatcgtgtccgatggcacgcagagacaaattatggtcattctgcgccttatgtcaaccaagggaaacgaattcggaagtatcaggatgatgttggttccgctggaggggagattgaccggccaaatggtgtttcgctcgaacaaaattag

SEQ ID NO: 50329 - DNA, 243 bp, Glycine max
  Peptide Sequence Number=SeqID_167107
atggccagtgaatatttggagtccactatggctaagatcacaaggtttggtattatgaatcagattctcaaccaaggagatactcaggttattcaaaatatgtctcttttaattattgctgatgatgatactcatgtttggcaattcacttcaaatgggaactattctgtcagatcttcatatcaccatatcatggaatcaatgctctcgaatgatatatacaaagtagaaggtgattggtag

SEQ ID NO: 50330 - DNA, 191 bp, Glycine max
  Peptide Sequence Number=SeqID_167108
catcgttaggcgcaccactagttacaattaagctaacatttctagctagagtattcaatatacatgaggccgagcaatacgtggaggctcatgtcatccttgagaagtataagtgcttgatcagatcacctcttatacctaacaacgatgaccaacatcctatcaaggttgattccgagggagtagattag

SEQ ID NO: 50331 - DNA, 633 bp, Glycine max
  Peptide Sequence Number=SeqID_167109
atgtatatccccacacattttgcggctccaggtaaggatgcgttacacgacttgatccgtgcctatcccttcgccacgttggtcatgacgacagcgacgggtgtggaagtgaatcatctgccgttgtgtttggatggaaatggtgtgctgactggtcatctggcgagagcaaatcggctatggcaagcggttcaaggcgacactgatgtcttggctgtttttcacgggccgcatacgtatgttagcccttcgtactaccctagtaaggttaggacaggcatggtcgtgcccacctggaattatgtggtggtacatgcgcgtggcaagttgcgggtcatagaggatgtgcactggttacgcgcacatctggaggccttcacggcccagcatgaagccggctttgcagagccttggcagcttgaagatgcacctgctggctttatcgacaagttgatgcaggcggtggttgggattgaaatgacgatcattgagctcaccggcaaatggaaggtgagccaaaatcagccactggagaatcaaatgggcgtggtgcggggcttaagtacgagtgacgatgagtatgcccaaaaaatggccgcggtggtcaaggccgttaaccacttaactggttag

SEQ ID NO: 50332 - DNA, 228 bp, Glycine max
  Peptide Sequence Number=SeqID_167110
atggagatgacaaaaggatgtcgggtcttgccagtatatggcacaacatcgggattgaagttggctaatagcagtaccaaggttgggcatgatcaacaaaggctaacaaggtgtgggatgtttccagcattgggggtcgaatctggggtgggaataggccaagccaaggctttgaaaggcctgcgcctagcctacgatgaatctttgaggcctgagcctggcttatag

SEQ ID NO: 50333 - DNA, 252 bp, Glycine max
  Peptide Sequence Number=SeqID_167111
atgggatgttacaactccagtcctcttaaaagaagtttcttctccgaaacttcatcgaaagatcgagatggaaaagattacacatatggttcccaataccaggctatgtgcccagtcaaagtgtttttcagtgacttcgaccataagactcctttaaacttagcgactaagcctggcgattctcacttcctcaatgatagtacttcgacactggtcacatcaaaggtttcatactcaagctcaaactactaa

SEQ ID NO: 50334 - DNA, 498 bp, Glycine max
  Peptide Sequence Number=SeqID_167112
tctcggccgaaagacgctgacatctctgggaaaggtgcagcaaatgagactttatcgaagtcagagccggaggacgcaaacatctctgggaaaggtgtaggtcacgaatctccgccgaaagaccctgacatctccgaggaaggtgctagtgatgactctcggctggaagacgcagacatctccgggaaaggtgcagacgttaacatttccgggaaaggtgcagacatctctgggaaaggtgctggtgacaacgttagtcactgtatgctatcggggtttgagtcttacggataccaaatgagactttttcacagtctcggtcggaagacactgacatctttcggaaaggtgctgatagtgaatgagactttttcgcagtctcggccggaaaacactgatatctttgggaaaggtgcagaaaatgctgatatcttcgggaaaggtgcgggtgatgactttagtcactgcatgctatcgggctttgagtgttacggatag

SEQ ID NO: 50335 - DNA, 246 bp, Glycine max
  Peptide Sequence Number=SeqID_167113
ggggtgcaaatagaaaccaggtccacttgggccttccaggaagttctccagatggcggtgccttctggaggaagcaacctagctcacctcggcgagctgggtggcaagctcctccctcgttttcctataaacaaggggaggagggaagaacaaaaatgttcaaccctcctagtatctgagaatcacttaaaattagtgagaaaaattgtttccgtgaagaaaatccaagtcgaggcgcttccgtaa

SEQ ID NO: 50336 - DNA, 231 bp, Glycine max
  Peptide Sequence Number=SeqID_167114
atgttcctccgggataatctcgctttgaccagacacatggacaagacgggtaggaatggggtacgggtatacttgatactctcagcgggaacggaactaaagaaaaaatttctatccatcagaaatggaaataggtatggggatgattttgaggaagctgaaacaataaaccacgtacccgttcctgactcacgtcgttacaatatctacatcatatgtttcgttccataa

SEQ ID NO: 50337 - DNA, 1089 bp, Glycine max
  Peptide Sequence Number=SeqID_167115
gggcgtgctattggtttgcatccattagttgctaagggattcaatgcagactttgatggggatcaaatggctgttcatgggcctttatctttagaagctcaagcagaagctcgtttacttaggttttctcatacgaacctcctgtctccggctattggggatcctatttccgtaccaactcaagatatgcttattggactttacatattaacgagcgggaatcgtcgagatcactttggaatggcatatacatcacatatcctggatcaagtaaagactctgggattccgtcaagctacggatacatccatttcattaggaattgatgaccttgtaacaataccttctaaaggatggctagtccaagatgctgaacaacaaagttttattttggaacaacatcatcattatgggaatgtacatgcagtagaaaaattacgccaatccattgagatatggtatgctacaagtgaatattttcgacaagaaatgaatcctaattttaggatgaccgacccctttaatccagtccatataatgtccttttcgggagctagaggaaatgcgtctcaagtacaccaattagtgggtatgagaggattaatgtcggatccacaaggacaaatgattgatttacctattcaaagcaatttgcgcgaagggctttctttaacagaatatataatttcttgctacggagctcgtaaaggggttgtagatactgctgtacgaacatcagatgctggatatcttacacgcagacttgttgaagtggttcaacacattgttgtacgtcgaacggattgtggtaccattcaaggaatttcggtgaatacccagaatggaatgatgccggaaagaatatggatacaaacattaattggtcgtgtattagcagacgatatatacagaggttcacgatgcattgccgttagaaatcaagatattggaattggacttatcaatcgatttaaacccttcaaacccaaccaatatctatccgaactccctttacctgtaggaatacatcttggatctgtcgattgtgttatggccaaagtcctactcatggtcacttggtggaattag

SEQ ID NO: 50338 - DNA, 255 bp, Glycine max
  Peptide Sequence Number=SeqID_167116
atggcttctggtaatcgattaccaaagaggaataagccactggtaatcgattaccagccatgtgtaatcgattacacagtgcagtttgcaggttttcacgtcctgaagctatgtaattcgagtttggcctctggtaatcgattaccaatgaggtgtaatcggttaccaaagatgaaaagccttgagataccctttaacttgcatgtagtggttatgggacgcattgtgttgctaccacagttagatctctcatga

SEQ ID NO: 50339 - DNA, 342 bp, Glycine max
  Peptide Sequence Number=SeqID_167117
atggagcatgaaacattccttgcaacttggttggcagagattgattcctctcccaatggcttggatggtggaagcagtcaatactgtatcatcatcgtgattttgcaaagaatattactctgtgaaagagcagtctatgcaatgatgctggtgtttccgcctgaattttctcctttgaaaactattttatttggaaatccttcccaagacaccattgaaccactgatggaggctttggaggaagattataaagatggaaataagataaatgaatcaaggcagtttattgaaggagtattggatcttgaaaagagaatcaatagactagatacattgacttag

SEQ ID NO: 50340 - DNA, 225 bp, Glycine max
  Peptide Sequence Number=SeqID_167118
atggagatgataaggaaggatgaattggtgttgtgggtgctccagatggtccgtggcggcgatggccagcagcagcagtggtggaggacgttccctttcgcttcttcgatgatttttccatttgatgagattagggaagaagaggcacgtcaaggggagtgtggctacgcagcgcttctggtttatgctgctgtaatcgattacaggctatctgttcttgtgtaa

SEQ ID NO: 50341 - DNA, 291 bp, Glycine max
  Peptide Sequence Number=SeqID_167119
atggtgcctcatgaatccttctatgctcgtgccatcggtgcccggaagaacccttatcctcatgacgtgtccaaaaaaagggaacgagatgtttattacttgagcaagaagttcacgacgtgcgagatgaactactatttgctagaaatgacgtgttatgctttggtatgggtggctcatcgtttgaggcagtacatgctgaattacattacttggttggtatccaaaatagaccccgtcaagtacatctttgtaaagcccactctcactgaacggattgctcggtggtag

SEQ ID NO: 50342 - DNA, 874 bp, Glycine max
  Peptide Sequence Number=SeqID_167120
agccacgactgccaaaacatacatctatcgactgaccgaggatatggacaccaactgtcccagagatatactcagggaaattgaatggtttccagccaaatgtcacctcgtagggagttgtacccgttcccgcgttccacgaggtgttgtgttaccattctatccatggaaggaacttgccccacctattgggtcgccggtgaacaaaggctcacagttattgctccacaatcctattgaggacttctgtttgaccatcactctgaggatggtaagcagaactcatcctcaggtgagtaccgctagcccgaaaaagctcttgccaaaaacagttaatgaaaagggggtcacgatgaatccccttcaaaaagcgatccaccacgacgagaatgatggtgtttccatggtaagggggcaagccaacgataaaattgagggagagatcctcccatggccgatgagtgtggtattccatgagcagaatggaagtgattggcaatcctcgaggcaaccaaatacggccattggtcatcaccaaatcctgggagaccgtgaaagtgggaaaattggccggattgtggataatatcttgtcggcgctgagtatagtccggatgtgcattcaattgacggcgaagttcctccaggaagtcatagcccaggaggcatgccaggtacatgtgttgctccggcgtttggatgacctgagtgagaatttccttgagacttcgatggtcagtcaggatggtcaagcattgaccaagaagggtttgatgaagaaagcaatggggtggttgttctacgagaggaccgcacccatgccaacgccggaggcatcgatctccacagtgaaaggaagcttaaaatttggtaaa

SEQ ID NO: 50343 - DNA, 447 bp, Glycine max
  Peptide Sequence Number=SeqID_167121
atgttgaatccaactcaatttcaggccaaagaagagaaggttaaagctgctgatgactcgctcagcgaggtagatccactcagcgagatgcatccacttagcaaggcatccagcttgcttagcggatgggaaaccctagaagaggataagttagagatctgtatgcccagcacgcagccagcccgcccagcgagccttcagaaactgaaaagtccaagagcctttaaaaacactgaagttggtggagttaaaaaaggagaaccagttgagagcaacaaggagagcttagtttcgctaagcctctttgttagcgagttctgtagacaaaggatcaagctgaaagttttgatgatgccaaaggattacatgaatcatatgcttctcaaagatttactcaagacaaagcaattagagttaatcaagatggatgatcaagacagtctatag

SEQ ID NO: 50344 - DNA, 246 bp, Glycine max
  Peptide Sequence Number=SeqID_167122
atggagaagcagatttgtgagtccagatctgtatgtggttatcagcttgaccccgaacttgagcaacaggatgtggaggttcatgtagatttaggtcgaggggggtggtcgactggttcgcctatgggtttcaggtcgctggcggcaccatgcaatggtctgggcaggggtaatggtgatgcatatgcaagtattggtgattgggacatggtggttgttattgttttgggaaaggagaaaggatag

SEQ ID NO: 50345 - DNA, 246 bp, Glycine max
  Peptide Sequence Number=SeqID_167123
atgtcgcaacctacccttcggcgggaaggtgaggcgaggtttaaagatgcgtcttccaaaaaaggagaatgcgcgggaatcaccaccaacgtttattcgaggaaaacgttagaaaaaacgaaaagggcttgcccaggcaagctgttgcttcaacctgaagtaaccttgctcgcccaggtgttttccatattctttactgaaatgttgaataatctttcgtcttgcgtggcaactggtgtcgaataa

SEQ ID NO: 50346 - DNA, 750 bp, Glycine max
  Peptide Sequence Number=SeqID_167124
atgaggaaggtgaagcagttaatcaatacatactatgaggaagacctaaaggaaagcttctaccagtctgagatagccaagaggttggagaaacagcagaacacctctgatatagattgggaaattatcttctacttgtatcgacaattaacacaacagtattatcaagaggctaaatgcagtgcactcacaattcacaaagcttattcgaaagcgggaagagaaaaaagaaaatccatagaaaaactaaacccaagccgagaagcaactcatggtttgcgaatacttttgaaaaggagagtattagaggctaggagaggtgcagcagagagtacccgcggcaacatcgactgcacgcatctcagctcctgcaaaatcctgcaacagaccaacgacaacaaccacaaatcgataattctaaggcttggaaacctggccaataaggattggcaaataggagaaaaggaggaagctggtttggagaatgaagaagcgcgaatgttggatttgatggctgattttatagatgaaattgatgttcgttgcgcgattctgctgcatgcgaaagccattgatgatgagatcaaattggaagaggaaccgaaacaaggcaaggaagtggacagagaagagaaagaggcagcaagagtgaaccgcctcactcagtgccgcaatgaagaagcgcaaccagtgcgctacccgagagagagaaagcgagaatatcaaggaaaaagagtaacagctgtatga

SEQ ID NO: 50347 - DNA, 132 bp, Glycine max
  Peptide Sequence Number=SeqID_167125
atggctggtcctaggattgtccatgctatcttgaaaggtccgagtgtggttaaggacatcataattggaataacacttggcttagctgctggtgagaaacctactaagatcagtttagcgacggaggtttga

SEQ ID NO: 50348 - DNA, 306 bp, Glycine max
  Peptide Sequence Number=SeqID_167126
atgctgggtgcacctagcaacacccatgttttaaacatgaaaaagggaacgagagacccaattttctatacccgtgctaatatcaggttcaaggaatggggatttcataaaggtttgggcaacactactctggttttggaaaaagtggtatatattcttgatcaagtaagggccttagaggaagagatactccataagattgagctgcaaggcttggtgttattttgtcttttaaggtttgtgtccttgtactatctataccatgctaatagccatcatatcttccttcttgtttctcatttgtaa

SEQ ID NO: 50349 - DNA, 297 bp, Glycine max
  Peptide Sequence Number=SeqID_167127
atgacgttttgtggcaatgaaatgcaaaatcaaatcaaggaaatgatgcaggagaccaagcccactttggagagggcctccaaagttcaagcacaagcgtgttatgaaggagtcggggtctatgctatgccaatgatgcacttgccaatgcagcctgtgacggtgaaggaccaaaaggattggaagattcctccgtgcatttcaaattggaagaatttgaaggggtataatattcctcataataagaggcttgctgctgatgggagaggccttcgggaagaatcaaatggttattaa

SEQ ID NO: 50350 - DNA, 258 bp, Glycine max
  Peptide Sequence Number=SeqID_167128
atggctccagcaccagggcctaaaggtgacgatattcttattttggcggcaaacaagaccaataggcctggcattctggcggcaaacaagaccaaaagtcatgatggccattggccactgcagtataataatcagcaggagatgtcacctaaggttgatagtatggatagaagaagtgtgaatgttgttcaaactgctttcggcctaaaaagtgacgttaaagcagagaaaggaaaagaggtgtgtcctgactcttga

SEQ ID NO: 50351 - DNA, 1476 bp, Glycine max
  Peptide Sequence Number=SeqID_167129
atgacagctgagatcaaagctttggaatccaataacacatggactttggttcctcttccaattggtaaacaatgcattagctacaggtgggtgtacaaagtgaaattcaaacctgatggcactatggatcgccacaaagctagattggtagctaagggttacacacaacaagttggtattgattttttttatactttctctccagttgctaaacttacatcagttagagtccttttggctgttgcaactgctaaaaactggccaatcttacaacttgatatggataatgccttcttgaatggtggtctatttgaggaagtttatatggaacttccaaaagggtacacttcagttgataaaaatcttgtttgcaggctcaacaaatccatttatggccttagacaagcttctagacaatggttttgtaaactctcaacaacattaattgctaatggtttctctcaatcaaagaatgactattctctttttaccattgacaaaggtgcttccctggttgttctgttggtctatgtagatgacattttgcttgctggcccaagtgctacatgtgttcattctattcaggccaagcttcaagctttgttcatactaaagatccttggttccttacaatattttctaggcctagaagttgcaaagtctagaaagggcgttgtcttgactcagcatttacttggtcgcctcatgtacctaactatttcaaggccggatattacatttgttgttaacaagctaagccagtacattcagcatccaaggacacctcatctagatgttgtgcatcatctcctacaatatatcaagggcactccaggtcagggtctccattttccagcaagtaactcctttaacttatctgcctatgctgatgctgattggggaggatgtttggacacacgcagatcgaaatctggttcctcagaggcagaatatcgggctctctcctcagtctctagtgaagtaatttggctaagacgattgctactacactttgagattaccatcccatatgccatgcttttctgtgatagcaaatttgcaattgatctagcatccaatccagctaatcatgagcaatctaaacacattgatattgattatcacttcattcgtgagttagtgcagtccaacatccttaagcttgttcatcattcattaaccgtctattcgggttacgatcaagtaaccgtcgtattacagcgggaatatgagagagagattgtgtaccttgattcacggaggaccctttgtgccattggtgctggccagggtcctatcaccacaaacacaaccaatgcaacaaggaagctaaagttaccatctttttgtactgggatagaagaaggagtcaaaaagattgataccttaattgacagagaggttttcggaattcctctggtagcagaggtaaaggagaatgcaagcaataaagaaaaagaagggaacggagtgtga

SEQ ID NO: 50352 - DNA, 129 bp, Glycine max
  Peptide Sequence Number=SeqID_167130
atgactctcgacgaaggcacaacgactcctcagtctaactctcgctctctacgtggcaacacttcaagtccccaatctcactctcactctctatcacgtctcctgtcagactctataaactctaagtaa

SEQ ID NO: 50353 - DNA, 1341 bp, Glycine max
  Peptide Sequence Number=SeqID_167131
atggatgattctaatcccttcctcatacaaaccagtgataatcctggtttgagcctcgtcactcatcctttatctggagagaattataattcttggaagaaagccatcaagatggcacttcttggcaaaaataaattcggttttgtggatggttccattctcaaacctccattagagcactccagtaatgctttatggcagcaaaatgaaagcatcattgcttcttggcttctcaactctcttacaaaggagatacaattgaaacatgaactagcaaatctacagtacggttctatgtttgtctcatcctattattccaagctacgatccatttgggaatcaatttctgaattaaagcctgcacatttatgcacctgcaatggcattcgtccttggcatgactatgcacagatggagtatgccatacatttctttatgggactcaatgaatcctatagttcaattcggggtcagattctttctatggatcctttcccttccattaatcaaaatttttctctagtggttcaagaagaaaaacagagagagattggtacttctgtttctgctctccactccacaaatgatgcttcacgatctcatgcttttgctgttaaggattctagatatcagtttgatcacaaggttagtgctacttccagaaatcgacctctctgtgcacattgtgttcgacttggccatactcaagataagtgtttcaagttacatggttttcctcccaattacaagaagaataaaccttcttcttctaatactaaaagcaaaacagtgaatcaagtctcaacatccacttttgttcctgactttcatctcactgctcagcaatatagccaactcatgagtttgcttcaagcacacacttcaaatgttgttactcccgatattggatcttctaacactagtatggtcttgtctgcttctttaactaagtttcctcaaaattcttggattgttgattcgggtgcaagcactcacattgtttgtgccattgatctctttgattcctatcactatgtctcaaatcaaattgttaaattacctaataatgcagttgtcccagtcattgcagttggcactgtgcatttatctccttctctaactctccataatgtgtctttcattcccaactttacatttaatgtcctttcagtcagtgccctccttaccaattcatcttattctgtttgtttttcttccaaccaatttgtcatacaggaaatgcctcattgcaagaagattggtagaggggatctccttcatggactttatgtcttgaacctcaaggatactcattccacttgcaatgtttttttatcataa

SEQ ID NO: 50354 - DNA, 165 bp, Glycine max
  Peptide Sequence Number=SeqID_167132
atggtagactcagaggtggtgccttcttcaattgctgtgcttgtgcctattctcagagcagcaaatgagattgaggaggagaatcctagagttgcgtatctttccccttgtaagctgaaagttgaagtggatcagagagtcactagaatggaggttgactactaa

SEQ ID NO: 50355 - DNA, 339 bp, Glycine max
  Peptide Sequence Number=SeqID_167133
atggtgatggatcagactgcttcaatgcataccatttttataatgtttaatggcttttcaaatacatttcaaaaagaacggcaaagatcccaccgacaaaatgaacagcctagatatcaccgattggagcaacacacgttgaacaaccaagatccttttgacaaaatcaatggccaagatttcaccaattggagctgtcgcaacctacccttcgacgggagggcgacgcatgactcgcaggtgcgtcatccaagaaaggaatacgcgcggagtcgccaccaacgtttatttgaggaaaacgtcggaaaaaccggaaaagacgtggtctacaaactttaa

SEQ ID NO: 50356 - DNA, 630 bp, Glycine max
  Peptide Sequence Number=SeqID_167134
atgcctttcatggcctccgaaactccttccactgaaaattctttggaccccacttcagccatgacgtttactaacgtcccattcattccatgtgaaaaattgactggatccgccaattatactacctgggcagccattgtcaaactttggtttcatggtcaaggacatgctgaccacttgacagctaaggttacggacattcccaataaggatctagccctttggcgccaaatagacacctctttgtgcaacgtcctttggtactctattgctcttaatcttcaaatttcataccaggcatttgacacagagactttttatcggcaacgtaaccagtacttcatgcttctaactcttcctagtctcccacatgacattgattcggtgcataaccagattttgttggcccctactgttcctactcatgacatagttagtgaacagttattgtgtctctccactcctcatgtttttggtcattcctttgccttttcctcttttgttgattcctccaccgttgtctcacacttatatcatggaggaggttgtgctggcaagaatcatcgttcgaattattgtaaaaattatggccacattgaatcgaagtgccacaccaaagttcaaaactag

SEQ ID NO: 50357 - DNA, 654 bp, Glycine max
  Peptide Sequence Number=SeqID_167135
atgaatattagtaaaagggaaatgaaacaacaaaatggaacggaagcattccttcagcatgtcaaaggccgcttccatgcatttaagaaggcccattcaatggatccaacatcaagtgggcctggtgttcgtcagttcaaatgttacctattgcacaaactggaaaaggaagaggagcttacagcaagacatgctctaagaactgatgctagggagctgcagacctactaccaacatttctatgaaaagaaaatccgggatggagaatttaatcaaagaccggaggagatggctaagaatgttcagattgccactgtattgtatgaagtgctaaagactatggtatctccacaaaatattgaggaaaagacaagaaggtacgctgaggatgttgagcataagaggggacgatatgaacactataatatccttccattatatgctgttggtgttaaaccagcaatcatggaacttcccgagatcaaagcagcaattgctgctttatgtaacgtggataatcttccaatgcccataattcatgcaagacctgacgattctacagtgcctatggagaggcttaaagaagtgaatgatatacttgattggattgcctttgtttttgggtttcaggtgagaattaggtgccacacctag

SEQ ID NO: 50358 - DNA, 738 bp, Glycine max
  Peptide Sequence Number=SeqID_167136
atgcaaatcccatgctcgtggaaccaccacaacatggtcaaagccgttcatctcccaaccacagcctgtgaaatccacggcacaaacatggtctgttccattattcagatccacagaggtttatcttctaactctgtggacaccttcaacaacgtcatcgaagctgttatgacgaagatggaggcacaactcgatcccctcctcgaccgctttcatgcgccgccgacgttcatcatctacatgtttctcttctgggccgttgccatacgcaaacagaggggtattccgatgagcgcactctggatgtggatgacaaacacatcagaaaaagatcttaggaacttcagttctactgctcaggctgcaattgtctctaatggccataggcaaaccagcactggagttggtaagaggaagcccaaaacaaattttgttgaagttcgtacgtttttgcatctgtatagaagttttgatcgaatgtggatattctttatattggctttacaggcaatgattatcatagcatggagttccttgagacctgttagagtgttttttgatgcagatgtcttcagaaatgttatgactatattcattacatatgcttttctcaattttcttcaagctaaactagaaagcatctctatagactctaaaggcctgcaacttgcagagcatatgcaagattatcaaactcgacttgtaaactcaacacacagacttgtgagagtttcgtaa

SEQ ID NO: 50359 - DNA, 246 bp, Glycine max
  Peptide Sequence Number=SeqID_167137
atgggaaaatcaggtgtaagagacattgttggaggttcatttggaaaaggagatgatgctgggggatcattagctagaaccactagtggatgtgaaggcatgcaattgatcatggaacatgcagtaagggagaaaggtaggagtggtttcaaccagcatttcattgtcaatcttgtcattccgcctcgctatctcgtggaggatgatcgtgttgcagatcatgtgaatcctgagtatgaagcttag

SEQ ID NO: 50360 - DNA, 183 bp, Glycine max
  Peptide Sequence Number=SeqID_167138
atgcacaagagcttgccaagaatccggtgttccatgaacgaagcccgattatcgattcagtcgaggtcggtccatgtaatgagtgaaaagagcaaacgtgctctactagggtttgatggcgaggtggagcatgttggtaatgttgttatagaggtcgaggacctcaaggcactagaagcgtag

SEQ ID NO: 50361 - DNA, 201 bp, Glycine max
  Peptide Sequence Number=SeqID_167139
atgggcagaacaatgagaagaacaactagaggtttgtctccatcgatggaacaagtaaagaaaggagtggtctcaaagaagcaggcaagagtagccaaggaagagacacatgacaaacttggtagaaagtttgtctttgtcgagagtgagatgatggacaaaataagtgaaaccaaagacatggagaaagacaacgtataa

SEQ ID NO: 50362 - DNA, 417 bp, Glycine max
  Peptide Sequence Number=SeqID_167140
atggagaaggaaagaataaggaaacttgggattttatttctctccctgcaaggaagaagggctattcaatacaagtgggtttatacaaccaatatgagtcttgttgagtctaggactcatttaaaggcttgcctcattgccaacgggtatgatcaaacttacgaaattgattatgttgatgcttttttgcctactgcaaagctttcctctactcattcttatttctcttgcttctatacatcattggccgttgttttaattggatgttatgttcttgaagaaggggatcttcctatcacaatggaagaatggtctgggataggtaatctgatctcttggaaaagtaagaagtataatgtggtggctagatccagtgtagagacaaaatacaaggatataactcaaacaacttgttag

SEQ ID NO: 50363 - DNA, 885 bp, Glycine max
  Peptide Sequence Number=SeqID_167141
atggcaaaagattatacgaagaagaccgatgatgatttatataaaaagattaggagtgatggatatatgttttcagcagttattgaatgctatgagactctcaaggacatcatactgaagcttctgctagatgaagatgataggctggctgtaagtagcatatgtgctaaagtagaacggtccatacgagaagaaacatttgtcaaggaattcaagatgagtggcttgccttcactcattgacaagtttggggaattcgtaaccgaactggtttccgcaaacacttcaagaatatcatgtagacagaaggcagaggttattaggcttcatttgcttttaacagttaaggattcagccataaatgtaccccaaaatctagaagcccgtcgtcgtattacattctttgcaaactccttatttatgaacatgccaaaggctcccaaagttcggaacatgttgtccgtcagtattctgacaccttattacaaacaagatgttctatattctgatgcggatctcaatagtgaaaatgaagatggaatatcacttttattctacctaaccaagatgtatcctgatgaatgggccaatttccatgaacgactaaaaagtgaaggtcttgaaaaagatacggacgagttaatttgtcagtgggcatcttacagaggacagacactctatcgaacagctctcactgaaggctattccgacaaaaataagaacctttacgaagatgcacaagctatggccgatttaaagttcacctatgttatatcttctcaattgtatggttctctgaaatcgtcgaaatatgctagagacagaaactgctatcataacattctgagtctgatgttaaagtgggtcaatatatccattttctga

SEQ ID NO: 50364 - DNA, 597 bp, Glycine max
  Peptide Sequence Number=SeqID_167142
atggatgaaccaaaggttcagtctgttttggcttggccagttcctggatccattaatcagctccgtgaatttcttggtctgacaggtactgggattggggttgtactaactcaaggccatcacctgattgcttatttctcaaagcaattattgcctagaatgcagaagcagtctgctaatagtcgtgaactatatgcaatcacggaggctctagcaaagttttgccattatctgttggggcacaggtttatcattaggatcgatcaacaaagtcttaagtctcaatgtgatcagaccattcaaaccccagagcaacaggtatggcttcacaaatttttgaggtatgactttaccattgagtgcaatcccggcaaggaaaatgttgtagcggatgccctttccaggccctttttcatggccttatccgagccacaggcctccttattgtttcagattgtgcaagccatgcatatcgacccttccttgtttgttattcacaccaagtgtgtgcaagggaatgcccttggccctcactttcatgttgcaaataattttttgtactggaaacaaaagatagcggttccaaaccaactctaa

SEQ ID NO: 50365 - DNA, 450 bp, Glycine max
  Peptide Sequence Number=SeqID_167143
atggagaagaagcatttgggtagtgtcaagaaggtgccaatttttgtgttcagcaattgcattttactaaggggtgtgagcacccaagaggtagatagtgaagagaaaagggaacggttaccatattcgtggtcaagtgcacaagagtcaagtatccaggtgcctagagatggagactatgagacaagcaaaacaattaccaatatgtgcaaccaaagcagtggtgtcagaggtctaatgactcttataaagatggaggaaatcctcataagtagcaagtgtggcccaaggttgatcagtagttgggttggatcatttagagatcatttggccaaattagtagggcagggagacttgccatgcagtcttcaaccaacaatcaattgtatgtctgagtcgatggcaatcttcacccttaaggtggttcttcaagtgggatatttcacctga

SEQ ID NO: 50366 - DNA, 450 bp, Glycine max
  Peptide Sequence Number=SeqID_167144
atggtttggaagcacgttttggctgataactatgcagtcactgcggtgttgaaagaatgcatgcttcaacttgctttgggaagtgacattgatgaggcacaagcattgtttgatggggtgagggtcaaagatgtgtctacttataattccatgattggaggattggctttgcataggaagagcattgaagcagttgagttgtttagtgaaatgcttaaggagagggttaggccaaatgggttggtggatctgggtggtgaaatatttgaatcaatggaaatgattcatgggattgaaccagaggtagaacactatggttgcattgttgacattctcagtagggtaggaacctccacggaacctgaacttcctgagtttgaggaacctccacggaactttgggggattggatgatatagtcaaatgggcaaagcagcataaaaataattag

SEQ ID NO: 50367 - DNA, 399 bp, Glycine max
  Peptide Sequence Number=SeqID_167145
atgaagattgatcctcaagagtttgatgcccgtctctacatccctggtaggggttttgtgttgaatacagagggccatcctaggaagcttctgaggaaagatctctccactcttgcaaagacatggagtgtcctcttctatagcaacctgactcttacttcccacacctctgatcttaatatggacagagccaggttggtttacggcttagtcacaggcatggacatgaatatcggagccctaatctcagccttgatcacagccttatgtggagctagaggagttacctttgatagtctgacctatgagagcctgagcccagccattaacttggcctttattaagaaaaactgttggaatatggatgatctgacagttaacttcagaggggccaagaag

SEQ ID NO: 50368 - DNA, 204 bp, Glycine max
  Peptide Sequence Number=SeqID_167146
atgttgtcagtttctgacacgctggaaaacgaggaaacggtctcggccagcgaacccgattgccctgacatggaaattgagccctctgataacgacgacgttttgatacctaacacgggtgccatgtccgacgctgttctcttgggcttgaccaatgttgaacgcgacggcgtttcgacatataattatagttttagtttctaa

SEQ ID NO: 50369 - DNA, 675 bp, Glycine max
  Peptide Sequence Number=SeqID_167147
atgacggacaaaagaaaagttttaggaaaaaataatgaggaaacaagaatttattttacatggaatttggaaatggaacgtgtattggctggtgtacttagagatcaaaggaatttgggcaacaagggtgacggaggttggaaaaggccagcattgaatactgcagccgcagtgttgtctacaagcttcaatgttaatgtcacatcagataatgtcaaaaaccatatcaaattatggagatcgtggtatggtatttcgcataaatcggctaaaccgtttcgattcaaggtgcttcaaaattgggatgatatagtggatttgtgtgctaaagatagagccaccggtcatggagctgaaactgctatggatgctgatgaagcgatgagtagagaaacaaatgaagtggaattcacggggttaggtgctactgctaccatagatttagaagaaccaagctctaatacaaaaggaaaaagacaaggtttgacttcttctgtcacacattctcacaagagaaagatgggagaaaaagaaggaataacaacttctttggataaaatggccaactcttttaaccgaatggtagaaaaaatggatggtaaagttgatgatgaagatattcaagaagtattacgtgaggcagctttgataccagatcttaatagacaacaatag

SEQ ID NO: 50370 - DNA, 519 bp, Glycine max
  Peptide Sequence Number=SeqID_167148
atgtggcatccttattgcatctatccattacaggtgtcttccaaccttcgttttattgatgtagatgaagcgatggacttgttagttaagttgcttgaattcagtacgcaagaagcaaaagatgagactgagcaatgcagaggagcatatgtatgcctagcttggctacgagacatttatcgtagtaaatataatgcaagacagtggaccctagtagctcaagcatatttattgcatctagtaggttgcacactttttactaacaagagtgtcacacacatcagtgtcgtattcttggacgcatttcatgacctcagtcaatctggaggctattcatgggaagcagttgcactggtccatatgtatgacaatctgaatgttacgtctaagcatacgacaaaacatcttgcaggatacatcactctattacatcgttggatctatgatcatttccctataattgcttccattattgttgatgaggattaccatgagagaaaaccatgtgtttgtcgctag

SEQ ID NO: 50371 - DNA, 421 bp, Glycine max
  Peptide Sequence Number=SeqID_167149
cctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 50372 - DNA, 1266 bp, Glycine max
  Peptide Sequence Number=SeqID_167150
gcgtcgcgcgtggtcacggtggatacgctgccgccagcgattacgctcgataatctgaccgccgacaacatcatcaacgcggctgaggcgcagcaggatttagccttgagcggcaccagcagtgcggaagcaggccagacggtcaccgtgacgctgaacggcaaaacgtaccagaccacggtccagacggacggtacctggcagctgatcgtaccggcggctgatgtcggcgccctcaacgatggcatcgtgaccgtgacggccaccgtgagcgacgtggcgggcaacagcagcagcgccgaccgcgtgggtctggtggacgcgaccgtgccgcaggtgaccattaacgactttgtcaccgacactaacaccgttaaccagctcgcccattcacaggcgcagatcctgagcggctccgtcaccggtgcggcggcgggcgaccttgtgaccattaccattaacagcgtcgattacaccaccgtggtggatgcggcgggcaactggagccttggcctgccggcgtccgtcgtgcaggggctgacggacggcacctggaccatcgacgtctccgtgaccgacaggtccggcaataccggaagcacttcgctggacgtggtggtgaataccgtgacgcctgtcatcggtatcaacacgctggcggttgacgacgtgatcaacgcgaccgagaaaggccaggatctgcaggtatccggcaccagtaatcagccggacggaacgaccattacggtgaccctgaacggaatcagctatacggcaaccaccgacgcgagcgggaactggagcgtgaccgttccggcggcaaacgtctcggcgctgggcgaagcgagctacaccgtgacggcgagcgtgactgacgccgcgggcaacagcgcgagcaccggccacagcgtgctggtcgacagcgcgctgccgcaggtcaccatcaacccggtcgccacggacgatgtcattaacgccgcggaagtggctgccggacagaccctgagcgggaaagtgagcggtgcggcgagcggtgacactgtcaccatttccatcggcggcaatatctatactgcgacggttcaggacgatctgagctggtcggtcaacgtgccgtcctcggtcttaaccgccatcggtaacggcgatctgacggtgtcagccagcgtcaccaacggccacggcaacaccggaaccggcgagcgcgacatcagcatcgacgcaaacctgccgggcctgcgcgtcgataccgtggcaggcgacgat

SEQ ID NO: 50373 - DNA, 749 bp, Glycine max
  Peptide Sequence Number=SeqID_167151
ctgagggtgaaccacagcgccgagaacagcagcaccgcacggaacttgatgcgttcggcgaaggcaccgacgatcagcgcagtggtgatgcccgcgaaggtcgactggaaggcgacgaacaggtaatccggcaggcccttgatcggcgtgttgccgaccgactccggagtgaagcccttgaggaaggcgaattcggtgaacgagccgaagaatgggttgccggcgctgaataccgcgctgtagccgtacgccacccacagcagcagcaccagcgagaacaccaccaggatctggctgagtaccgacagcacgccacgtcaccgtggtcgaacgccggggccgttgcttcggcagcggcaggtgctgcggccaccggggcctgcaacggttcaaccgctacggtttcgctcggcagcggcgacacctgtgcctgggcatgggcgctgcccggccacgcaccggcggcgaacgcgctgagcagcatcaacagccacacgacatggaaccgggcttgccacccggtgagaaggcgcatcttcatgggggagtctccggaaggggggttacagcgcgtcggcaccgatttcgccggtgcggatgcggatgacctgttcgacggcggtgacgaagatcttgccgtcaccgatcttgccggtgcctgccgacgactggatcgcttcgatcaccgcgtcggcacgctcgtcggtgaccacggtttcgatcttgatcttgggcaggaaatcgacgac

SEQ ID NO: 50374 - DNA, 711 bp, Glycine max
  Peptide Sequence Number=SeqID_167152
atggacatgaacatcggagcccttatctcaggagttacctctgatagtctgacctatgagagccttagcccgaccattaacttggcctacattaagaaaaactattggaatgtggaagatttgacagttaactttagaggggcaaggaaggcaagggctcgactagctgatgttccctcttcttctgctcctccagctccttccacttctactactcctacaccagctcctccaggcctatctgcccaggactctcagtgctttgaagccatgcttcagagtcttcatcaaggacagattttgttaatgcagagcttgcaggtggtatctcctccaggatccactctgttactggaacagttcatggagaaggatgcatcttctgaagccaccatccctggagcttttgattttttaggtggaggattagagatgagacccgataaggctgcttctcctgagccaatactagtaccagctgatccaccatctccagtggtggatccatcttctctcgcgccagaagcagctctcccatctacacctcttattatctctgaagaccccacagttccagtacttggattagccactactcctcctactacccccgttctccatttttcagatgaggaggagggacagattactactccttcgaggactccagtgctacatttggataatgaggagcaagattgggatgaatga

SEQ ID NO: 50375 - DNA, 741 bp, Glycine max
  Peptide Sequence Number=SeqID_167153
atgaatgtgggagctctcatctctggtcagattacatctatggcccagtctaactcttctagacttgggttccctgctcttatcaccgctttatgtaagtccagaggggttgcttctaacagcctggtcttcgaacacctgagcccggttattaacttggcctatatcaggaaaaattgttggaaccctgatgatctgatagttactatcagaggggccaagagagtgaggataaggccagttgaggcctcttccacatctacaactcctcctccaacacgtacccttgcagctccttctgccccagatcctgcagattttcagcatcttgaagccatgcttcaaagcatcaatcaggggcaaattatcttattacaaagtttacagatggtgacacctccagactctattcctttagtagagcagtttaacgagtgggtagcctggcccgaaactcagtcttctcttcacaaggaagataaaggcccacagcctaggtcccacagcctagagcctttggttagaaggaagaaggcaaatcaaacacaagaagctgcagccacttctgagaaatctcttgaggccacttctgagccttcaaaaccagtggcagatacagcttcacttttacaggcaacagacccttccacccctgaggatcagactacaccagtcctgtctccgaacacttctcctacagctacccctgagcttcacttaacagacgaggaggacgtttag

SEQ ID NO: 50376 - DNA, 378 bp, Glycine max
  Peptide Sequence Number=SeqID_167154
atgagttttcaatatttggctaccaaacgcatgagatgtggctatgagaagctaacaagttcgagtcaaaagatgatgagggatggaagaagctgttgggtgaagtctttgaatggaagattacgtggcctaaggttgtcacggtctaggaaactttccttaggagttgtggtgttgtcgagcagaattgtaagactgtacaatgaggttgtcaaccaaatgatgaacatggaaaacaagtatcctgctatagctctcaccactcaatggggccttcccgttctctcttattcctcacacgtgtgcagaaggagggtcttccctcttgacagaaaagtcactctctgtcagcaacttggattatgttttggctcatag

SEQ ID NO: 50377 - DNA, 772 bp, Glycine max
  Peptide Sequence Number=SeqID_167155
atggcactccagaacttcgttgatttttctacaaactctgcgaatccatactatctgcatccgaatgagaatccagctctagttcttgtttctccttctttaacggccaagaactaccacacttggtcccgttcgatgcacatcgcgttaatttcgaagaacaaagacaagttcatcgatggatctcttcccaaacctcccgtttccgatccgttatatgcaccgtggatccgctgcaacactatggttctcgcttggattcaccgatcaatttctgattccatcgcaaaatcggtactttggatcgataccgctgctggtgtttggaagaatctacgtattaggttttctcagagtgatatcttccgcatttccgatctacaagaggatctgtatcgtttccgtcaaggaacgcttgatgtatctgattacttcactcaattgaagatctactgggacgaattggagaattatcgtccaatcccccactgtaagtgctcaattccctattcttgtggtggaattgattctgttagggtttatcgcgaacaagattacgttattcgcctccttaaaggcttgaatgaccggttttcgcattctaaatcacaaatcatgatgatgaatcctctcccggacattgatcacgttttctccctggttattcaacaagaacgtgaaatgctaggctctaattctgattcagtctctgaagctacttctgactctgctatggctatgcaagtcaattccaatcagagcaattttcatg

SEQ ID NO: 50378 - DNA, 3186 bp, Glycine max
  Peptide Sequence Number=SeqID_167156
atgtcctcttcaaggcccagccaatcatccagcaataattctggcagatctagaacatcaagactcagtgctaggaggatggctcagacaactttagatgcaaaactgcatgcaacttttgaggaatcaggtagttcttttgactactccagttcagtgagaatgtctcctgctggtactgtcagtggagaccatcaaccaaggtctgatagagcaacaagttcttacctccatcagacacagaaaatcaagcttatccagccatttgggtgtttgttagctttagatgagaaaacatgcaaggtcattgcttacagtgagaatgcacctgaaatgctcaccatggttagtcatgctgtccccagtgtaggtgaccaccctgctcttggcattggcactgacataagaactattttcactgccccaagttctgctgctattcagaaggcactgagatttggggatgtttcacttcataaccccattctagtccattgcaagacctctgggaagcccttttatgcaattatccatcgtgttaccggtagtgtgatcatcgattttgagccggtcaagcctcatgaagttcccatgactgcatcaggagccctgcaatcctacaagcttgcagcaaaagcaataactagattggaatccttgactactgggaacatggaaacactatgtaacacaatggttcgagaggtttttgagctcacaggttatgacagagtgatggcttataaattccatgaggatgatcatggggaagtgattgctgaggttaaaaggccaggcctagagccatatctggggttgcactacccagccactgatattcctcaggcgacacgctttttgtttatgaagaacaaggtgcgtatgatagttgattgttgtgcaaagcatgtgaatgtgcttcaagacaaaaaaattccatttgatttaaccttgtgtggatcaaccttgagagctgctcatagttgccacttgcaatacatggagaacatgaattctagtgcttccttggttatggcagttgtggtaaatgacaatgatgaagatggggatagttctgatgctgttcaaccacagaagagtaagagactctggggtttagtagtttgccatcacactactcccagattcgttcctttccctcttaggtatgcttgtcaatttctggctcaagtatttgcggttcatgtgagcaaagagctagagatagagtatcagattattgagaagaacatcctgcaaactcaaacactcttgtgtgatatgctggtgcaaggtgagcccctaggcattgtttcacaaagtcctaatataatggatcttgtgaagtgtgatggagcagccctgctatataaaaacaaggtgtggcgattaggggtaacaccaagtgaatctcagataaaagagatagctttgtggctctttgagtgccatgaggattccacaggtttttgtacagatagcttgtctgatgcaggcttccctggggctgctgctcttggtgatattgcatgtggaatggcagctgccagaatagcttccaaagatatacttttctggtttcggtctcacacagcctcagaaatccgatggggtggtgcaaagcatgagcctggtgaaagggatgatggtaggagggtgcatccaagatcatcattcaaggctttccttgaagttgtgaagacaaggagcttaccctggaagacctatgaaacggatgccattcattcgttgcagttaatactgagagatgcattcaaagagacacagagcatggagataagcacatatgctatcgatacaaggctaggtgatttgaagattgaaggaatgcaagaactggatgcagtgacaagtgaggtggtaaggttaattgaaacagcaacggtgccaattttggcggttgatgttaatgggatgatcaatggatggaacacaaaaattgctgagttgacaggtcttccagttgatgaagctattggaaagcatttactcacacttgtagaggatttttcagtagatagagtcaagaagatgttggacatggcattgcagggtgaggaagagagaaatgtccaatttgagatccaaacacatcatatgaagattgattctggtcccatcagcttggtagttaatgcttgtgcaagcagggatcttcaagataatgttgtgggagtttgttttctggcacaagatataactgctcagaaaacaatgatggacaaattcacccgaattgaaggtgactacaaggcaattgtacagaacccaaacccattgatccctccaatatttggcacagatgaatttggttggtgttgtgaatggaattcagctatggcaaaattaactggatggaagcgagaggaggtaatggataaaatgcttttaggagaggttttcgggacccaaatagcttgttgtcgcctaaggaatcatgaagctgttgttaactttagcattgtacttaatacagccatggctggtttggaaacagagaaggttccttttggtttctttgctcgtgatggaaagcatgtagaatgtattctttctatgactaagaaattggatgcagaaggtgtagttactggtgtcttctgcttcttgcaactagcaagtgcagagctgcaacaagcattacacattcagcgcatatctgaacaaacttcattgaaaagactgaaagatttaacttatttgaaaaggcaaatccagaatcctttatatgggattatgttctcccggaaattgttagagggtactgagttgggagctgaacaaaaacaatttctgcaaacgggcattcggtgtcaacgccagattagcaaaattctggatgactcggatcttgacagcatcattgatggctacatggatttggagatggttgaattcactttgcatgaagttttggttgcctccctaagtcaagtcatgacaaagagtaatgcaaaaggtatccgagtagtcaatgatgttgaagagaagatcacaacagagaccttatatggtgatagtatcaggcttcagcaggtcttagctgactttttattgatttccatcaatttcacaccaactggaggtcaggttgttgtagcagccacgctaacccaacagcagttagggaaattagttcatcttgctaatttggagttcaggtaa

SEQ ID NO: 50379 - DNA, 1551 bp, Glycine max
  Peptide Sequence Number=SeqID_167157
atggctaaccatgatgcaaaagaagaacaaaggccactcaaccaatggagaagaagcaaagggggattcatggcttccatgttcatttttgtcttgtcagcattggacaacatgggttttgtggcaaacatggtgagcatagtcctatacttttatggagtgatgcactttgatttggccagttcagccaacaccctcacaaacttcatggcttcaacctacctgctttcccttgttggaggcttcatctcagatacttacttgaacagatttaccacatgcttgcttttcggatcactcgaggttctggctttggcaatgctcacagtccaagcagcttcaaaacatttacaccctgaagcatgtggcaagtcaagctgtgtgaaaggtggaatagcagtgatgttctacacatcactgtgcttgttggcattgggaatgggaggggtgagaggatccatgactgcatttggagctgaccaatttgatgagaaggatccaactgaggcaaaagcccttgcaagttttttcaattggcttttgctcagttcaactgtgggagcaatcacaggagtcactggtgttgtgtgggttagcacacaaaaagcatggcattggggttttttcattataaccatagcttcctctgttggctttgtgacccttgctcttggtaaaccattctaccgcatcaaaactccaggagatagccccactttgagaattgctcaggttattgttgtggcttttaagaaccgtaagttgtcactgccggagtcacatggagaactatatgaaatcagtgataaagaagctacagaagagaagattgcccacaccaaccagatgaggtttctagacaaagctgccatcatccaagaaaactcaaaacccaaggcatggaaggtttgcacagtgacacaagttgaagaagtgaagatcctaacaagagtgttacccatagtagctagtaccattatactaaacacttgtatggcacaactgcaaacattctcagttcaacaaggaaatgtgatggacctaaaacttggctctctaacagtgcctgcaccatccattcctgttatcccccttgttttcataagtgtcctagttcccttgtatgaactattttttgtgccatttgcaagaaagatcactcaccacccttcaggcataacacaactacaaagggttggtgtggggttagtactctcggcaatatcaatggcagtggcagggattgtggaagtgaaaagaagggaccaagggagaaaagacccttctaagcctataagcctattttggctttcattccaatatggcatatttggcattgcagatatgttcacccttgtgggactattggagtttttctacagggaatcacctgctagcatgaaatcactttcaacctctctcacgtggctgtcaacatctcttggttacttcttgagcacagtctttgtcaatgtcatcaatgctgttagcaaaaggatcacaccaagcaaacaagggtggctgcatgggttcgactttgaaccaaaataa

SEQ ID NO: 50380 - DNA, 333 bp, Glycine max
  Peptide Sequence Number=SeqID_167158
atggagatggagagagttttgtgggttggcattgctataggacttgttttcagcaactgggtcgtaggatatgaacaatatcacttcaatgaaacagagttgtctttattagaggctcatgaagcttccttgtcctacgccgggaccgagagaaataatcttctgctggtaggactcacccttattcaaaatgctgctgctaaaggagcagtctgcttggatggaacattgcctggttatcattggcatcggggatatggatcaggagcaaatagctggcttattaatttagagatttgtgtagcaaataatatatgccttgcaaaaggttga

SEQ ID NO: 50381 - DNA, 804 bp, Glycine max
  Peptide Sequence Number=SeqID_167159
atggaagatttgatgtcaaaaggaatgcgttttgccaatcaggctcttctttcgggatgctctgcgggtggcctggctactattattcattgtgatgaatttcgtggtctctttccaaggaccaccaaagtgaaatgtcttagtgatgctgggttgtttcttgatgtgattgatgtatctggagggcatacccttaggaatttatacagtggtgttgtaggattgcagggagcacagaagaatctgccacaaatttgtactaatcaccttgatcccatctcgtgcttctttcctcaaaacttgattgccagtgttaagaccccgctattcattcttaatgctgcttatgattcatggcagatccagtccagtttagctcctccatcagcagatccccatggctattggcaacaatgtagattaaaccatgctaaatgtactggaccacaaattcaatttctgcaaggattcaggaatcatatgctgaatgctattaaatacttctcaagatcaaagcagaatggcttgtttattaattcttgtttttctcactgccaaactgagaggcaggatacatggtttgctgacaattctcctgttattaggaacaagtgcctattgagaagtttatccaaacatgacttaaatcctatagcactcactatagaacatcgattcacctgtagaaacattatggcaattgctctggctgttggagactggtatttcgatcgagcaggtgttaaggccattgattgtccttacccttgtgataatacatgccatcatctgattttcagatga

SEQ ID NO: 50382 - DNA, 1902 bp, Glycine max
  Peptide Sequence Number=SeqID_167160
atgcctctgcatgagttataccgtgtggctaaagggaagcttgatcctatagagatgaacaacaacacatgtgcagttgatcaatcttctgtacccaataatgatttgcttgagttggtttgggaaaagggccagatttcagtgcagggtcagttcagtagagctagagtgagcccaaattgtaaaactttgccatctcactgcttaccatctcacactccaataggatatgctaataatgctatttctaccaatacaaggatggggaagtgtgggaatttaggtgttgaattgaatgaaattagaaggcttgtcccttcaggtgaagtggatttgagtgaagaagaggaagacatggtgatgccttggttcaattatggaatggaagactctttgcaacacggatatagtactgattttttccatgaaccatcatcatatggggtcaccatgaatgagctttcagcatcaaataatttttctttgctagatagaagaaataattgtactaagatatttagggacactcataaacactcttcatatgcacctgttagatccagcgtagcagatatagctgaaaacaatgcaaataatgttccatctggctcaagtggtttttctagcttaaagatggagaggcaaggtccagttatgtgtagcagtagttccaccatgatgaatttttcccattttgcaaaacctgctgctattgtcaaagctaacattgagaacattggcttggcatcaagatcaggaaatgagggaatacagataaaaagtgctgctgcaactgtgaccaatcctgctgaatcaacaaaagttgaattaagtggagagtgtccaaagaaaccagccacacacaatcaagatcaagatgtcactgtttctacaaagtgtgacccttcttgcaaagatgtgtccaaggttgatcaaaatcaaacttcaaatctagttgttggggaaagtgtgaataaaggacacgaagctgttgaaaaaggagtggagctagctgtggtctcttcctctgtttgctctggcaatggtccagagaggggttcggaggatccaaatcaaaatttgaagcgaaaaagtaaagacactgaggactttgagagccaaagtgaagatgttgaggaagaatcagttggtgtcaacaaggaagttcctgcacgacgaaatggagccaagaaaagccgttcagccgaagtgcataatctatctgaaaggagacgaagagaccggatcaatgagaagatgcgtgcgttacaggaacttataccaaattgcaataaggcggataaagcttcaatgttggatgaggcgatagagtatctcaaaacacttcaactccaacttcaaattatgtcaatgggaactagtttatgtatgcctgcaatgatgttacatccgggaatgcaacacatgcatgcaccacatatgggtcctttttcacctataggtgttggcatgcaaatgaggttaggagtgggttgtggaatgggcatgcctgatgctaatgatattgagtcctctagatttattcaagtgccccaaatgcaaggaactcatcatcctagtcagggtcaccccattccaatgccacatgctcccatcttttctttcccaggagaaccttttatcaacccatcaactttaggacttgtggaaactgtggataaggcttcttcagcctttggcttaattaaggatcagattccacaacttgcacagaacaccaacaacggttgtaattcaacaaatcagatgtcaacagtacagtgtgaagcaaccattggtggatttgaacactcaattttggtacttaatagtggtcatgcaacttcggtaaatgacagaggagctattaatcccagtacagaagataacccttatcattga

SEQ ID NO: 50383 - DNA, 465 bp, Glycine max
  Peptide Sequence Number=SeqID_167161
atgttaactgcgaagtgcgaaccacctttgacagcccaaacacggaaacctgccgctagccccactgcactaagaaagagaaatggaatagattcagggtttttttttctaactatggttaatcaagtgattgcatttgcagtggttaagttggtgtggggtccattatcttttgtgcaatctcatacaaatccaacggtcaccttcaacaaaggtgaaggagccacacccctcttgagtcttgagcgagtgaagcacacgcatgttttaagtgtgcaagaccatgatgagatgagcagtgtcgcgtccctgttctgcgtacttggaagaaaggaatatcatcatcatattcttttccgctctttgaatttgttgtccatgcaagatctgataaggcaccatcatatcgatacctgttgggacaaagtgaccccctttgttgtgtatggttatgagcttggatga

SEQ ID NO: 50384 - DNA, 309 bp, Glycine max
  Peptide Sequence Number=SeqID_167162
atggataggtttcgcaccaattggagaacgcatttctcatcgccatcattgatatgtgaggagaaagtacagaaaagcatagccagcattattaacagtaattatacccttcacaaaaaagcttgtcctggtcaaagtaataagaaggcgaaaggagggcgtagtgatcatggtggtggccgtgagatagttcgtgattggcctagcgattacgacaaagggacttggggggtagcttcgcccaatattgacaagaaagctcgtattttcatcgacaagcaaaagaaccgtgttcaccatcaactttga

SEQ ID NO: 50385 - DNA, 324 bp, Glycine max
  Peptide Sequence Number=SeqID_167163
atgtggagctttttaaagggtgaaatgaatatcttgacatcacacgatcaaaggtgggagcaggagttaagtctttacaatcaatatgaaaaagaaagaactcctaatcttgaaaataaattgttgatgcacttcatggaaacaactaaatcaactcaacaagcactccaaagtgtagaaatccaggttggtgagctggcagaagcagtaactcaatttatggtcagacaagaaaaatccttcgtagagattgaagctcaaaagaaaagccctgtaacagagcatgagccaagagaaaaagatgatgagaaagatgaggaataa

SEQ ID NO: 50386 - DNA, 270 bp, Glycine max
  Peptide Sequence Number=SeqID_167164
atggactttggcaaagcaactagtgagattaccaaaaggcatctcaagaagcttggaataagagagccgacaactagaaactttaatcagctggaagaagatgctgaagctgaagctccacaagagcctgtacatcaatggagtccttttaagtcacctatgattcagaaaatggaggctatgcttcaccttcatcaagagcactcagttgaagttcatagttcgttggagaatataactacccgactggaaaacattaaactaggctga

SEQ ID NO: 50387 - DNA, 126 bp, Glycine max
  Peptide Sequence Number=SeqID_167165
atgccttggaaaaaccagatcatgctccttctttcagtgcttctcatgatgaaacctcctaagctactaataccggctaatggggatgatggttacattgggccaagtcagtgtgctcattcctaa

SEQ ID NO: 50388 - DNA, 300 bp, Glycine max
  Peptide Sequence Number=SeqID_167166
atggaaagaaagaaggaaaaagaaaaaatgaaaataaagaaaagaacaaaagaaagaaaaggaaggattcccgatcaaagatcgaaaggaagcgaaaagggaaaagaagcaattctcgatcaacgaaagaaagaggatagaaagtctccaaagccagattgccactcagaatcattcgtgattggcaatatcccaccccagatgaacaaagaggaaaagaccgaaacacccagcttcctctccaaaaacgttgacctcgagaaaatcctattggttcgtgatcgtacgtttgatctatga

SEQ ID NO: 50389 - DNA, 498 bp, Glycine max
  Peptide Sequence Number=SeqID_167167
atggaggggaatgaacataaatgtaaatctgatagcaagatatggctcaaggagtgttgggtggggtatctgagagatctgagcatgtacgaaaaaattgatgaagtaaacttctttgggagtttaggtgaagctaaactaagacatatgggaggaggaatggaattccacttcatgcgtgatgcaagcatattcgctaaagtagtcgaaaggtgtaggactttggtagatatagataagagtacagagaacatgaacaagatcaattttgctcgtattcttgtccaaacatccgcgggcatgcacatgtattttgcacaaggtgaagatggtagaagaaattggtgtcacaatatcatgtgcagatgcaacgaatggaagttcaggaagccgaatacacgaatttcgtcaatagcaaatgatatgggtatgcatgtgcaatctatattctcagagttcaacagagaagtggatgtggcaatggctgaggtggtttag

SEQ ID NO: 50390 - DNA, 234 bp, Glycine max
  Peptide Sequence Number=SeqID_167168
atgaaaatcaaattcgaaaacagttccgggagggggagctgtttcaaagggttcagccccttaggcacttctctctctttcgaatttgcttggaaaaattgtttccgtgaagaaaatctaagcgaggcgcttccgaaacgtttccgtaacgttttccgtgaggaatctcgcaaaggtttcaaccgttcttcgacgttcttcattcgttcttcatcgttcttcgatcttcaacgg

SEQ ID NO: 50391 - DNA, 201 bp, Glycine max
  Peptide Sequence Number=SeqID_167169
atggagaattggcaaacagcgctacgcaataacttcgcgggactccggactcgaaggtggagtacacatgaacaacgcaaggcaataaattcatggggctccgaaaaaagtggagaatggagaattggcgaacagcgctacacaatgacttcgtggggctctgaactcgaaggtggaggacacatgaacagcgctaggtaa

SEQ ID NO: 50392 - DNA, 279 bp, Glycine max
  Peptide Sequence Number=SeqID_167170
atgtcttccgcgagacaccacggaagaagttttcttccattgttgaaattacacctgcggaagaatgcttcttccgtggagtctcgcggaatacgacttcttggagactccacggaagaaacagtcttccgcggttgttattttaacaatatggacgaagatcaatgggcatattatagtgcgatgtccgaagaagttgatatggattttcaagatgaagaagattatggtgtgaatgaagcacatgttgattgctcagatgcttttaatacttctcag

SEQ ID NO: 50393 - DNA, 489 bp, Glycine max
  Peptide Sequence Number=SeqID_167171
atgctgccttggttggttattccgttcattggtctctgggctctctctcagcttctgccgccagcttttcgcttcgagattacttcgcctcgtcttgcttgtgtctttgtgttgctgattactctcttttggtatgagattttgatgccttggctgtcggcttggcgggtgaggaggaatgctaggattagggagaggaagaggtttgaggccatagaaatgcagaagttgaggaagacggctacgaggcggtgtcggaactgtttgaacccgtatagggatcagaaccctggtgggggtaggtttatgtgttcgtactgtggccacgtttcgaagaggcccgttttagacttgcctgtgctgccagggtttgggatttcaaattctggtatagttaaggacttggttgggaaaaatggcaagatagtgaatagcaagtcaggaatggttggagaatggcagttgggttggtgggtctattctaggtaa

SEQ ID NO: 50394 - DNA, 414 bp, Glycine max
  Peptide Sequence Number=SeqID_167172
atggtggttcctgtgggtcttgaggagcctttgaccatgctcgctaagggtggtgatcgagactttgccatctcatcctccctaacctcccttttggcacactctgattcttccaatcctaactctgctaggattcttaaagaaggaacctctaactctgatgtaagcgtgcttgtggggcttctatggaggctggatcttcgagcttcaattgggtcctttaatggtgattttccaccatggagatgcagtggaagacaaaggaaaagaattgagaggaggcgccatccattaaggaataagccatggaagaaggagcttcaccaccaagatgagccttggataagaagcttggagaggatgcttcaatggaggaaaagaaagagggagagaaagagagaggggggagcatga

SEQ ID NO: 50395 - DNA, 264 bp, Glycine max
  Peptide Sequence Number=SeqID_167173
atgggtaaaggctggggtcctagcgctgctagagcagggtatatcggtagaagctgtcattcaactatacctggcccctatgagtggccgcctactggtatgccaaatgctgcatgtagagctccatcctctgcatgtgagttgagatggactctagagatggtggctgcggtagaggtggcggtggtgcgtctatggccggctgctgctgctggtcctgcccgagctgttgtgcctgccttggcatgcagtacttctcaatga

SEQ ID NO: 50396 - DNA, 159 bp, Glycine max
  Peptide Sequence Number=SeqID_167174
atggatggctctagacctatccttgattctgttgcaatggctccaaagaagcttcttactaaaagggctaggaaggccaccgcaggggagggatccagtgtagccctgcaagcggagattgagtttgacaaacatcgtttccgaagtgaggagcattag

SEQ ID NO: 50397 - DNA, 318 bp, Glycine max
  Peptide Sequence Number=SeqID_167175
atgggggtagcgctcacaagacacccagtggactcggaggagtccaacagggccctggggtttccagctctagttatgggcctctgtcagtcctacaaggcgcccgtccccccagcaagttcatgccatcatgacatagggatcacgcccgcaagacactctattgacccggagaagtccaacagggtcttggagttgccagctctgattacgggcctctatcggttctacggggtgcatgtcgcccccagcaaggtcatcaggccctctactaatcgagttttcatcaagaagtactgtgcccccaggcaggcgtag

SEQ ID NO: 50398 - DNA, 336 bp, Glycine max
  Peptide Sequence Number=SeqID_167176
atggaacttagtaatggaaagggcccatcaagggtgaatcttgggtttgtcgagccttggaccaaggacgtgtttgccctgggttttgtcacttccatggagttgtgtcgaggcttaccaaggacgggccttggattttgtaaacccttatggatcagcaagcgcgaaggtactggagacacggtggtgtctatcagtggggactcaccaaaggaggaccttgggtttcgcaagccctttggaggattgaccagggcattttccgacttgggttttgagcaccgtactcttgcatacattgcatacatatcactcgccatgggtggtatgcactga

SEQ ID NO: 50399 - DNA, 729 bp, Glycine max
  misc_feature (107)..(107): n is a, c, g, or t
  Peptide Sequence Number=SeqID_167177
atgggagatcggttggaggacatgattcgtgaccttggacaagagtctttccagcaagcgcacgcccttgtgtatgaaggattgcagagtgattcaaagaagccttngtatacggggtgtaagaattccttaaccctgttgtctgcggtgttaagtctggttaatgtgaaggctaggtatgggtggagtgacaaaagtttcacctcgttgcttgaggtagtccataatctgcttccaaaggacaacacgttgcctaaaagttactataaggcggaaaatatattgtgtccgatgggtatggagtatcagaagattcatgcttgccccaatgattgcatattgtacagacatgaattccaagaaatgtcgaaatgccctacctgtgggacttcacgttacaaagtgaaggatgaaaaggaaaacagttctgatgaaaactccaacaaaggccccccagcgaaggttttgtggtatctttcaatcattccaaggtttaagcgtcttttttcaaatgaggacgacgcaaaagaccttacatggcatgcaaatggaaggatttctgatggaatagtccgtcatccggctgattgctcgcagtggaagaagattgatggtttgtatctagatttcgggaaagagccaagaaatcttagacttggactagccattgatggaatgaatccatatggcaccttaagcactcaacacaattcatggctagttctgcta

SEQ ID NO: 50400 - DNA, 405 bp, Glycine max
  Peptide Sequence Number=SeqID_167178
atggagcagaagtatggtgacaccatgaatcataagaaattggtggcaactcaagttggaaagttacatggagaagtgtcaaggctgaaaggagaggtgaagaagtataaggaggagttaaaattggccactgaggatttggggaagtatttttctgaaaaacttcgtcttgaggggaaagaagtgggtttacgtgaagaagtggaaaaatggaaagcagagtgtgccacaaacgatgcggctacatttaatgatcatgcagatggcttcaatagggccttagcccaagttgtttccttttaccctactgttgacctttccaacattgaactttacaaagatgttgtggatgggaaggtgattgactcatcctcccctcctggaactcctactcctaaagtttga

SEQ ID NO: 50401 - DNA, 630 bp, Glycine max
  Peptide Sequence Number=SeqID_167179
atgactggaaatttgattattcgagtcatgatgctcgtcgcaatggtctgcaatgatcaagctgagatgaccggtagattgctggccgggattttgcttcctcggtcttcaaatttagcacaagcctctgaggaggatttgattcttatgtgggcttttcttaccggtcgtcagattgactgggcccatttggttcggtaccgaatgcataaggcattacgggctaatgcacctcttccttatccacatttgattactctgtttttgcgtcattttcaaattccgcttgatgatgaaccctttattcaagtcaagcgttcctttgcaattggtgctggtgcagtgacctcctttgggtatcgtaaagatcggaatggtcaatggctgaagaaggatgcacttcctcctcaagatgaacatactccttcacctcctcctccacgcgaagatttcgcactcatgaatgaagtcctctccgaattacggggtcttcgttcttatgttggtgaccgcttcgaatcgttagatacacgctttgctggtatggacattcgcctcacacagcttgaagaggatgtcggatacattcgtcagagtttcgatcttccaccaccacctccgtcttcttag

SEQ ID NO: 50402 - DNA, 294 bp, Glycine max
  Peptide Sequence Number=SeqID_167180
atggctaagtttgaccctgagatagtcctggagttctatgctaatgcttggcccacagaggagggagtgcgagacatgcgttcatgggtgaggggtcagtggattccctttgacgccgatgttctcatccagttcctgggtgacccactagttttggaggaaggccagcagtgtgagttcagccagaggaggaacagggttgacgggtttgacgaggagaccattgctcaactgttatgcataccggggcaggatttcgctcggaccactacacgcctagtgtggcgtccctaa

SEQ ID NO: 50403 - DNA, 105 bp, Glycine max
  Peptide Sequence Number=SeqID_167181
atggcgctaagcgcgccttcacggacagaaagcccttttttaagcctgacttgcggagaatgggagagaggaactttagcattggaaaatgtactatttccgtag

SEQ ID NO: 50404 - DNA, 132 bp, Glycine max
  Peptide Sequence Number=SeqID_167182
atgattttcgtgggtattgggtttttgggagatatgatgggtagttctactagaaaactgatagagatgaagggtagagttaacctagggttaaaaagtgagaatggtagtgatatgagtggaaaagtgtga

SEQ ID NO: 50405 - DNA, 348 bp, Glycine max
  Peptide Sequence Number=SeqID_167183
gccgcagatgcaccgccaccacctcatcaggctgatcccgttgggtcatttgacacggagcggtatttacgacatttggttcgccagcaggcggccaaccacagggcgcatgtgcagacccatgactgtctctaccagctcagtctcagtctgcagagccagggtttcacttcttttccgtgccctactccagatcagttcagggcagaggtcgcatggcccggagattggcctgaggcccaggcaggggaggcgcccgcagaggctcccgacgatggagaggaggcccgcatggatgaggagatgacaaatttgctcgatttcttggaaggcagtggagccacgtga

SEQ ID NO: 50406 - DNA, 449 bp, Glycine max
  Peptide Sequence Number=SeqID_167184
actttgtaaaggattttacaaagatagtggaaatctcaagtgggttgcttgagtactggacgccacaaggtccaacagaaaaatggaagctatttagcaattcaaatggtcataacttttcactcggaggtccgattcaggcgcataatatttcaagacgctcgaaattgaacaacggaagctctcgagaagttcaaatggtcataacttttcactcggagaagctctcgagaaatgcaaatggtcataaattttcactcggaggtccaattcaagcgtatgatatatcgagacactcgaaattgaacaatggaaagctctcgagaaattcaaatggtaataacttttcactcggaggtccgattcaggcgcataatatatcgagacgctcgaaattcaacaatggacgctctggagcaattcaaatggtcataacgtttcactcggag

SEQ ID NO: 50407 - DNA, 1335 bp, Glycine max
  Peptide Sequence Number=SeqID_167185
atgagtctgactgaaaaaattagcgcgcacgtcgatgccagcgcgcagcgtatcgcgcagacattatgcgacctgctggcatttccctcggtggtgaaagtcgatccgcgcgaggccgggccaggcgagcgcgactgccagcgctatctgcagcagcggctgatggcgctgggcatggacaccgatttgtgggatccggatggcccggcgctgtaccagaagtatcagggccgtccgggcgccaataaaggccgcaccttcgaaggtcggccgaatctgggcggcactctgagcggatccggtggcggcaggtcgctgatgcttaccggccatattgacgtggtaccaccgggtccggctgagcactggcacagcgatccttttgtgccggagatccgcaacgaggcggtgtatggtcgcggcgcggtcgatatgaaaggtggcgtggcctgcatgctgatggcggtggagctgctgcaggatctcaacgtgcagctggccggcgacgtggtgttcaccacggtagtggatgaagagatcggcggcatgggctcgctggcaatggtggatcgcggcttcaaagccgatgccggtatcatgacggagcccactgccaatcgcatcgcgccgatttgccacggcattttgtgggcgcgcatcatcctcgatggcatcggcggtcatgcggaattaacgccgaacagctgggacagcagcggtccggttgatgccgtgatgttgtgccgccagatgctggacgggctcgatgtgctgaaccgccgctggcagacgcagcccgataaaaatcatccactcatggatctgcccaaccaaattatcgtgacgcagctgaaagtgggcgagcatccggcgtcgattgccggccgcgccgaaatcgtcatagacgtgcagtatctgccggcagaaaaggatgagatggggctgggcggtaaggtaaaacaggagattgaggcgcacgtggcgaaggtgtgcgcgctggatccttacctggcaaagcatccggcgcgcgtggagtggatactggacgccgactgcgccgagatcccggccgatcatccttttgtcagcgcttttcagcagggtgtgagtgacgcggcactcagcccgcagctggccggctttggtgcccacagcgacattggcctgcccagcacgctgggccagacgccgacggtcaactttggtcccggcgatccggcgctgtcgcatcagcctaacgaacatgtgccgattgccgatctggtggcctgcaccaaagccattgcgctgacgctggtgcactggtgcgggctggcgaaggaagcggggcgctga

SEQ ID NO: 50408 - DNA, 996 bp, Glycine max
  Peptide Sequence Number=SeqID_167186
catgtccccaccttcagagggcaacacgccctcgcctttagaggactacatgtcctcaccttcagagggctacacgccctcactttcagaggactacacgtcctcgccatcagagggctgcacgccctcgccttcataggaccacacgtccttcccttcagaggactacacgtcctcgcaatcagagggctacgcaccctcgccttcagagaactacacgtcctcgccttcaaaggactacaagtcctcgccttcagaggactacacgtcctcgccttcagaggactacacatcctcacatacagaggactacacatcctcgccttcagagggctgcacgccctagctttcagagggctacacgccctcatcttcagagggttgctcgcctcaccttcagagggctacatgccctcgcctttagagggctgcacgccctcgcctttagaagactacatagggcaacacgccctcgccttcagaggactacacgtcctcgtcttcagaggcctacacgtcctcaccttgagagggctacacgccctctccttcagagaactacaagtccacacctacaaagggctacatgccctcgccttcataggactacacgtcctcgccggcagagggctacacgtcctcgccttcagagggatgcacaccctcgccttcataggtctacacgtcctccccttcagagaacaacacgtcctcgccttcagagggctacatgtccccaccttcagagggcaacacgccctcgccttcagaggactacacgtccccgtcttaagaggactacacgtcctcaccttgagagggctacacgccctatccttcagaggactacacgtcctcaccttcagaggactgcacgtcctcgccttcaaaggactacacgtcctcacctacaaagggctgcatgcccacgtcttcagaggacaacacgccctcgcctttagaggactacacgtcctcaccttcagagggctacac

SEQ ID NO: 50409 - DNA, 561 bp, Glycine max
  Peptide Sequence Number=SeqID_167187
atgggatcaagtcaaacaccttcgcttaaaaagaggttctatcaagtcaaggtcaagagcctaggaatcaccagtttaaaagagctagggcagttgatggtcagctccaacggcaagctttttgcaaagattacgcaattgacgcttttcttgcctatcatagccacaaggaaagcccggtacgaccgaagatgtgagaaaagcagtacgaggattgtttgttgtactccagctctttatgtatggttggtttcacacctttttcgccaagaggtgaggcatgcttgcccgcaagaaggtcaccgttcatgcacagagaaaggaggcacaaattgggaccaactcttagcaaacaaagaaagagcgtctatcaactggttccctcgatggaaagaaggaagaaccggagttcttatttcatgcggaggatatccgaatgttcccttgatggggacgaagggttgcattagttacaatcccgttcttgctataagacaacttggctaccctatgagaggggcaccgctagaggaagagatcgcacctgtcctttcaacgtag

SEQ ID NO: 50410 - DNA, 849 bp, Glycine max
  Peptide Sequence Number=SeqID_167188
ccagatggtgcagctcaacggcaagagcggcgtgctgagccaaaaggtgacgcaggatccggcggggacgccgcttgcgctgccgctcgagggggaactgcgtgcgcatctggaggcgcttgtgccgcaggaaaactcacggccattggcgcgcaggttgcaggcggcgcactcgccgcagccgtcacccttgatgccgttgtagcaggtcagcgtatcctggcgcacgcgatccagctggtggtaatagtccgccagcgcccaggtctcggccttgttcagccacatcagcggcgtttcgaagcggatatcgcgggcgatgcccagcgtcaccgccttgttcaacgctttaacgaactcgtcgcggcaatcggggtagccggagaaatcggtttcacacacgccggtgatcaccgcttccgcttccacctggtaggcgtagatcgccgccagcgtcaggaacaggatgttgcggcccggcacgaaggtgctcggcagcgcatttttctgattggggtcgtaggcgggaacagggatattgtcgcgtgtcaggctgctgacggccagctcgttgagcagcgttacgtccagcaccttgtgcgccttggcgccgagggccaccgacagctcctgagccacttcaatctcggcgcgatggcgctggccgtaatcgaacgtgacgcagtgaacttcgtcatactgttgcaatgcctggatcaagcaggtcgtggagtcttgtccaccgctgaaaacgacaaccgcgcgcttcataaaatcacctttttgggctttggcctctcccgatacacattcgggcggcaggataaaattgcgttgcggcgacaatag

SEQ ID NO: 50411 - DNA, 1413 bp, Glycine max
  Peptide Sequence Number=SeqID_167189
atggatgtagaaagtgaaagagatgaatgtttgaattggactagtaccatctctgttggtgactttgctattgataaccgagcaggaatcagcaggacattgcatcggattagtgccatccgaaatcgcaagggcacaattattggtctaacttgtcgagttggcagggcaatttcaggaagtgcaaagttgttgcaagatttgattcaagatggggcttctttgttgctcattggacctccaggggtaggcaaaactacaattattagggaaatagctaggatgctggcaaatgattacaagaagcgtgtgatgattgttgacacctccaatgaaattgggggtgatggcgatataccacatgctggaataggcaatgctcgacgtatgcaagtccctaactctgatatgcaacataaggttagggttctcggatataattatgatacttccatttgtgcatattctaatttaaacattgaggtattgatagaagcagttgaaaaccacatgccacaagtgattgtaattgatgaaattggtacaaaacttgaagcaatggctgcgagcacaattgcacaacgtgggattcagcttgttgccactgctcatggaatcacaattgagaatctcattatgaatccttcattagagatgcttgttggaggaatacagagtgtgacactaggggatgaagaggccagtcgcaggggtgttcagaagacagtattggagaggaaaggcccatctacatttagttgtggagtagagatcatttcaaagacagagttgcgcattcaccgtagccttgaagcaaccgtggatgctattctttctggtcgttttccaaatgtagaaatacggaagatgaagtctcaagaacaggaagagattttacaagatggacttgttagtgacagttcacttcaaaagaatggtgaaatcatgtttgaaaaagctacaaaggggtctgatgaccaaaccaaccaaaatgaatcacttttaaagttgcctattgacttggtggaagattcctggcagcttaaattgccacttagcctgttttgttatgggctttctaccaatgcactagaatttaagattttagaggcaactgttattcaaggggttaagcagttgaaaatgaatgatgcggctattcaattgactgataatattagtgaagcaaatgctttacttgccttacaatccaagcttaaaaagaatccagggatccaggctgccgctaaatctcatgatattcccatttatgtgacaaagacaagttctttggagcatgtagcaaaagccatacgggcattagtaagtgatcatgaagatggtataaaggattctgaactaacggacaagataaaatcctcagagatgattgatgctttggaggtaatataa

SEQ ID NO: 50412 - DNA, 276 bp, Glycine max
  Peptide Sequence Number=SeqID_167190
atggcttgggggaactatctcacacaaaacaatgaggaaggtggattgggtattggagaaaatggaagtggagatgcgtttgtgggggtagatccaggtgttaggatgcaaggtgaggaaaaattggtgctttctgatgtagttgtggaaaaagaaaatcacttatttgggaagacttttgtcagtaatggaagattcaagaagagggaattgacaagggttgaaatctttaggagcactttacctggcatttcaatttcagatagtgatgtataa

SEQ ID NO: 50413 - DNA, 276 bp, Glycine max
  Peptide Sequence Number=SeqID_167191
atgatttatttcgaaagaaagattgaatggaatggatgggaaatagtgttggggtgtgatggagctcgcggctcattgcagtttgaagggtatgaagcaatgcttgccgcagttcgttgcggttgcaatgctattgagttgcagctgctacgcgtgaacagaaatcactctaattttgacgtggtgcattcgcaggagaagaaaatgaaaagaattaaggaggtaaaccaaatcaaatttctcacatacattaaaatcaacttacggaaaagttag

SEQ ID NO: 50414 - DNA, 417 bp, Glycine max
  Peptide Sequence Number=SeqID_167192
atgaaatttgtagattatccttccaattacctgggcagtggcgtgctcgatatcctgaaccgtgataggatactccgatatcacgaaatccccggtcggaaaccttgcgagaggtttccgtcccaaatccatgacaacctctatcagctgcggcagctcggggtggtcgctcacgcgccgccgcatctcctccggcagcagcgccaacagccgccccagctccacgtccagctcatcctcggaaaaaaccggaccggacccggctggaaaactcgcgcgcaggctggggccggttcggagccggggaagggagggaacgaggggcgggtagaagggtttgggcgaaatcgggttgggaagtggcggttgttgcgggaggtggcagcagcgaagctggagcgggagagtgaaccctag

SEQ ID NO: 50415 - DNA, 971 bp, Glycine max
  Peptide Sequence Number=SeqID_167193
aagcccctcaattctacaactccccaaactgcccctccatcgaacaccacgacatattaagctcctccgaggaagccgtccacgtggcaatgacactcgacacgacatacatccgaggttccatggcggcgatcctctccgtcctccaacactcttcgtgcccccaaaacaccttcttccacttcgtgtgctcctccaacgccaacgccaacgccaacaccaacaccaacgcgtccctcctacgcgccacaatctccaacgcattcccctacctgaatttccaactctacccctttgacgacgccgtcgtttcaaacctcatctccacctccatccgcgccgcactcgattgccccctcaactacgcgcgcagctacttgccaaacctcctccctccccgcgtgaagcgcgtggtgtacctcgactccgaccttgtactcgtcgacgacatcgccaagctcgcgacaacctcgttgggacaaaacagcgttctggcggcgccggaatactgcaacgccaacttcacctcgtacttcactcccactttctggtcgaacccttctatgtcgctaacgttcgcggagagaaaacgaaaagcgtgttactttaacacgggggtgatggtgattgatttggaacggtggcgcgaaggggattacacgaggaaaattgaggagtggatggagcttcagaagaggatgagaatctatgaacttggttcgttgccgccgtttttgcttgtgtttgcggggaacattgtttcggtggatcataggtggaaccaacatggtttaggaggggacaattttcgaggtttgtgtcgggatctgcaccctggtccggtgagtttgttgcattggagtgggaaagggaaaccgtggatgagattagacgctaatagaccttgtcctttggatgcactttgggcaccttatgatctattgaaaacctcattttctttggactcttga

SEQ ID NO: 50416 - DNA, 237 bp, Glycine max
  Peptide Sequence Number=SeqID_167194
atgaaaagtgaaacaacagatgttttaatgccccttcaatgttctgggactaggaggaactatacacctcttcctgcttgtgggaacatgtctgataatgtggccatgcaagaagggcctgaattgtacattgatgaaagttccattttgcttcagtcgatatccaatatgatgaatgtggactgtcaggaatttgaagagatgacacctctttatgggacgaagtatgaaggatga

SEQ ID NO: 50417 - DNA, 537 bp, Glycine max
  Peptide Sequence Number=SeqID_167195
atggaaaatggggtattccttcctattcttacccacgctttatacggttacttcaatttgattgttatagcagagatgtgttatcagggtttagttatatctattggtgggttgaaaaattctttgaagagggtatcactctcggcactgttagagtatctagaagaggttgaatcaaaagatcctaatacaagaacatctaggaaatctgacagaattatcgtacccactttaaagaccattgaggttctgttcagaaaaaagatattcattgatatggaggcttacactccagctttttgtggtgctgttttggattctctgtcatttgaattgaagagatcaaaagacttctctaagttgtatgctggtattgcaatacttggttatgtagcttcagttcaggaacctatcaatatgagggcattttctcaacttcctgttgttgtccctgcaagctcggcaatcgtatcctctgcatgtgctgatctagggattcaatggccagcttctactctcaaggctggtttgccatga

SEQ ID NO: 50418 - DNA, 2963 bp, Glycine max
  Peptide Sequence Number=SeqID_167196
gtcatgaccttcgaagtcagtttggcatcagaggtcctatcattggtgctctcgttgtcctcatgggtgatcccaacaaagtctcgggatccttagacagactcgaggcaacgccacctccgttacctcattcccatcctgtccctgcatcaacacacaaaatgaaattagatgtacccaggtttgaaggcactgaaccacttggttggatcttcaagatcaaccaatttttagagtaccatggcactccagaacacgatcgtttaaccattgcctcgttttacatggaagccttgcaaacccgttatgccccttcccaatacgaagaccctacatctaccctatttaagctcactcagaggggaacggtgggacaatacttgtcggagttcgaggatttgtctaactgcatcatcggccttccacctcctttccttctaagctgcttcatctcgggcctaacgccaaatattcaccgtgaagtgcaagctcaccaggctttgactctgccgtcgcggacacacgcttcgcaacccactccaccaggccctcttcatgccacactgttaccaccacttcttccttcgcctcctcgaccgccgccacccaccttgaagcgcctgaccccggacgagataacctcacaccatgagtgtggggttttactcctaatcgtggaagaggaagaccctttgtggtctaatatagacccaattgacctgcctcctgacccgcccgacagccctgacccgtacccgatccaaatcagtctcaattcgttaacgggccacttagcatcggaagggcatgatcaccgaccaccacacgatccttctggtcaacaatgggagtatccacaacttcattcaacaacagctcgtcacccagctgggcttaccttatcgggaaactacacctttacgggtgatgtcatcattgacattcagactactaaattcacagtggatctttatgtcctgccgatatcgggtgccaatgtagttttgggggagataacgatgccacctaggactccttaccccaccgcaacttcgccatttatgtcgcaaacaggacaatgctctatactttcacattgcggtgctctacctccgacaagggacactgaccaccacattcacctgattctgcactcaacctcggtcaacgtgcaccactactgctatccttactatcagaagcatgaaattaagcttcaaaaaggccttatccaacccagtacgagcccgttctctttgccggtattgctcgtgaagaaacatgatggttcttggagattctgtgtggactatcacactttgaatgcactcaaagtccgagatagatttcccattcccacgattgacgagtttttggatgaattgggaggtgctagatgtttttcaaataccttgtgtcatctcgtgtctcagaagggggttgaactagtggctttgaaggtggcagccattcatcaatggtcagttcctcgttctaccaaagccttgaggagcttcttgggcctcacgggattttatcgtaggttcatcagaagttacgctaccattgcagctcccttggtcaaggtcaccactatcgagccattccaatggatgactcaagctcagacaactttcgagcaacttaaacaggccttatcgtcagcacttgttctagccttgcccgatttccagctgcccttcaccatcgagactgatgcttccagggtaggaatgggtgcggtcctatctcaacaggggcaccccattgcctttttcagcaaacccttcagcccgaagcttctttgtgcttctacgtatgtacgagaattatttgcgattacaacgacggtaaagaaatggcgccagtaccttctcggccaccgtttcaccattattaccgaccatcgcagcctcaaggaattattaacccaagtgattcaaaccctggagcaacacatgtatttggcacgattaatgaggtatgactatcaaattcagtatcgttccggcatacataaccaagatgctaatgctctatccagattgccagaacaagatccatcattgtccatgatcctgtctgtgtcgtccttaacttttttggaagaacttcatcgacaacttgacaatcatcaagaatatatctgccattgccaagatgtcctcgataatctggccaaacacccacaattttcaatttcggatgatctggtgttgaacaagggtcgggttggaaaggctatagcccacatattggaaaacttctattggcccggactcagagatgatgttaaacaatttatggccaaattcccatacagaccttggaaagatctctcgttggacatcattgtcggacttccatcgtaccatggaaatacaatcatactcgcggtcattgatcatttttctaaagaggtcttgaatcacatagttgagcaatacttgtgcgcctttgttcatcaccggtcgggcacatggggaaagcttctcccttgggtagaatggtcccacaacacctcgtggaatgtgggaataggaaccactccatatgagataacctttggtcacaaacccttcaattttccagaatacattgtatggtcctctaatatcgatgttgttgaagatatattgattgatacagaagaaaccttccaagccattcgcaagaagcttatgaaagctcaagatgccatgaagaagcacgctgacagtaaacgccgagaagtgagttatcaggcaggtgataaatctcacataaccggaacccaacacccacaccccgtcgttgtcgttcttgctccagcgctcaccgctcctccattctcagatctgcaacactcggagtttggctttaatggccgccttgagagtctcccactcgctctccttcttgagctggttgttgggagttgcgacgccttggttttcaaatactggttctggaacttcaattag

SEQ ID NO: 50419 - DNA, 735 bp, Glycine max
  Peptide Sequence Number=SeqID_167197
atgaaggaacgtgttttacttattgctaatcacagaactgaggttgattggatgtacttgtgggatctcgcacttcgaaaggggaggctgggatgcataaaatacatccttaagagcagcttgatgaaactacctatctttggttggggatttcacattctggagtttattgcagtggagaggaagtgggagatagatgagcaaatattgcaacaaaaactttcaacctttaaggaccctcaagatcccttatggctagctctttttcccgaaggaactgattatactgatcagaagagtaaaactagtaaaaaatttgctgctgaagctgggctccctgtgctgacaaatgtattacttccgaaaacaaaggggtttcatgcttgcttggaagctctgcgaggctcattggatgcagtatacgatgtgacaattgcatacaagaatcagtgtccttcctttctggacaatgtttttggtgttgacccttcagaagtgcacctgcatgtgcggcgtattccggtggaggagattccagcttctgaaaccaaagctgcttcttggttaatcgacacattccagatcaaggaccaattgctttcggatttcaagattcaaggccatttccctaaccaactaaatgaaaatgaaatttctagatttaagagcctactctcttttatggtctatcttgtgcatatcttactcttgcaacccgcttcaattttcaattga

SEQ ID NO: 50420 - DNA, 756 bp, Glycine max
  Peptide Sequence Number=SeqID_167198
atggccctgatcccaaactcaaaaaccccgccactcttccacctgctcctcttcttattaggcaatgtagcaaatgcgacagtgtttaccctggaaaatcattgcagttacacagtttggcccggcacactctccggcaacagtgccgccattctcggcggaggcggtttcgccctggcacccggttcggcagtccggctcatcgcgccggccggctggtccggccgcttttgggcccggacagggtgccgcttcgacggctccggtgccggaaaatgcaccaccggagactgcgccggcggactgaggtgcaccggaagcggtgttccgccggtgaccctggcggagttcaccatcggaagcgccagcaacggcaacaaggacttctacgacgtgagccttgtcgacggttacaatgtgggcatgggcgtgcgggctgccggcggaaccggtgactgccagtacgcggggtgcgtggcggacgtgaacggcgtttgtccggcggagctgcaggtcagagacggcgccggctcggtggtggcgtgcaagagcgcgtgtgcagcgttcaacacggcagagttttgctgcaccggcgaccactccacgccgcagacatgttcgccgacgcatcattcggagatattcaagaaagcttgtcccacagcgtacagttacgcatacgatgatgcttcgagcacttgcacgtgttctggatctgattaccgtatcacattttgccccacgggatcgtcttaa

SEQ ID NO: 50421 - DNA, 4150 bp, Glycine max
  Peptide Sequence Number=SeqID_167199
atgtcgagagggcgagggaggccgaaaaagacggcgccatcgtcaccggcgagccaaacaaacattgttgaacaagcgatcgtgaacaaccaagatgaagattcaacaaagcaccaagttgtggaggaaatcgaagttgtcgatgacgattcatctgtttcaatgccagaaacccttattcccaaattaacatgtgatgcacagggtgatctgaaagaagagaggaaattatggatagatgttctcaatgataatagaaaccctgcaaaaggaatggcgattgagtatgttcaaccaaccttggtggatggggagattgaaatcgctatagatgaggaggatatcgtgtctgagaaaaaattctgggaaaatgccttggtcatgtatgtccttggtggagaattgagcatgaatggggtaaagcatttcatcactaaagcatggaactttgtccaactgcctgctatctattaccacgatgatggctattttttgttaaagttcaacacgcacaaagacatggatgacgttatgttaagaggcccttatacagtcagaaatatgcccatgctgcttagagaatggaaaccgggattcaacctgaaacaagatatgctgcgaacattgccgatctggatacaactgccacagctgccactccatctttggggagcaaggagccttggtaagataggaagtgcccttgggaaaccgataacaacggatgagtgcaccgctaaaaaatatcgagtatcgtacgctaggatattggtggaggtggatgttactcaaaaattgccaaatgatataaccatcagagatagcgagggaaagaaactaaagcagcctgtgcattatgaatggaagccgatgttttgtgataaatgtcaaaagtttggacatcactgtgaagaagtgaaagcaaagaaggtctggcagatgaaatccaagcaaggtagcacttctcacgctcaaccaaaggaaaatagcactggtttgtataatatagaaactgttgacaatggcttggagagtaaaaaaagtgttgaaaatgggctgaaaagtacacaggctgctggaaaaaatgcaggctcatctggtgtgaaaggtacaaacagtgcagattttcaagcgaatacatctacaactgtccttaatttggtagcatctggtgatattgggaatgtggctgaatatacccatgagtggtctagcaggagaaaaaacggtaaagataacgggaaaaaaattgtagttgattgcacgcctaacttgatccgatgcacgaatggctttgaggcactagaggatttgaatgaccctctagtgtatcaagatggtaagctaaaggagataggctctcgtcttctagagcttcggcctacgatcacgatcttaattgagacaagggtaaaacaagttaaggctcgcaatattcgaaataaactcaggttgcaaggtgagtttttggacaattattctagccattccaacgacagaatctggttaaattgggatactaacaaggttaccataaagtatattagggagacaagtcaactgctccattgtggcgtttatgatctgacagctaaagatagagttggtggtaatttggtcaccgagtcagaatatgaagacttggcaaaaatgatgcgaaatacgggaacttttgaaaaggatagcatgggtgactactatacttggtcgaataagcaaactgatggtatgatctattctagaatcgatagggtgttggggaatgtggaatggttccaagacaacatggacacaatgctccaaatcctgcctccgagcgtatcggaccacactttactttgtttggctgatccagggaatactacaggtcggcaatttcattttaaattctcaaactgtttgacagatttgaaggaatatcatagcactgttagtaatagttggaacgaaccattgaatggtagaccgatgtatgtgctttgggagaagctcaaacggctcaaacctgctttgaataaaatcaacaggcctctgcatcatatccagtctagaataatggaggctagacaaaatctgcaacatgcccaacaaagccttgtagaagatagatggaatagcagtaaaattgatactgttaagcggtatacagaggaggttatcaattggaattccctggaagagaaaacattacaacaaaaatccaaaattgattggcttcgattgggtgatggaaataactcatatttccatgctaccataaaagctaaaaagagttccaaaaggctgaatttgctgcataaggatgacggtacggttattacatctcatgacgaaattcaggacgaagtcttaaatttctatgagggtttaatggggacaaaagatggtaatgtgcgtcatattaatattatggccatgagaggggggcctcaacttagtatggaacagagggaacaacttgtagcccccattaccgaccaagaaatccgtaaagcgttgaatggcattggtgacacaaaaagcccgggaatagacggttttggagcaaaattcttcaaaaccagctggaatattatagggaaagatgtggtggctgctgttagagatttctttgagaatgatcggatctacaaggctttcaattgtactttggtaactctcattccaaaaaatgaggaagccaaaactattaaggaatatcgacctattgcggggtgcactacagtatataaaataatttctaaaattattaccgctagaatgggtagggtgatggatagtatcgttggtaagaaccaagctgcttttgtccccggccaacaaattcataatcacattctacttgcttacgagctgattaagggttactctcggaaaggtgggactccccgctgtatgatgcaaatagacctccagaaagcttatgatatggttaactgggatgcactggaatgtattcttaaagagattggtgtgcctcaacaatttatcagatggatcatgatagctgtgaccactatttcttaccgtttcaatgtcaatggctgtcactctaaccttttgcaggctaagcgtggactccgtcagggagaccccatgtcccccctcctctttgttattgttatggaatatctgaatagaattctgtatgacatgcagaagaatcctaattttaaccatcatgctaaatgtgaaaagcttagtattactaatctggcttttgcagatgatttacttcttttttcgagaggtgatccaatatctgtggatcttatggtgaaggctttcaagaatttttctgagtccactggtcttattgctaatcctagtaaatgtaagatttactttggtggtgtgggggacgatagcaagaggaatattctcaatcttactggttttactgaaggccctcttcctttccgttacttgggggtcccgctcactagtaaaaaactttctattcaccactatatgcctttagtggataagatagtggggagaatcaatcactggagcactaatcttttgacttatgcaggccgtgttcagcttataaggagtgtgacgtttgctattgcaaattactggatgcaatgctttcctatcccgaagtatgttgttcacaaaattgaagctatttgcagatctttcctctggacaggagggcaagagataaagagaaaaagtccagttgcttgggactctgtgtgcaaaccgaaggattatggagggttaaacatcattgacctttcggtttggaataaggtaactatgctgaaactcctttggaatcttagtggcaaatctgatagtctttgggtgaagtgggtaaatgcctactacttgaataaggacacactgatgaatgtgagtgtaaagattcacaactcttggattatgaaaagtatcctgaagcatcgtagtagcattttggatatccaatctatatgggacagcatgctagagaaaaatcgatttggtatgaaggaggtttataaaagtctttgcaccaacacttcaaaagtgcgctggcgtaatctgtttcgggggaatacagcgaggcctagagctctgatgactctatggcttgcttgtcatgggcggttagccactaaaaaccatctgaaaaaatttggtatgattgaagata

SEQ ID NO: 50422 - DNA, 741 bp, Glycine max
  Peptide Sequence Number=SeqID_167200
atggccctaatcccaaactcaaaaacctctgcactcttccacctgctcctctttatattaggcaatgtagcatatgccaccgtgtttaccctggagaatcattgcagttacacagtttggccgggcacactttccggcaacggtgccgccaccatcggcgacggcggttttcccatggcgccgggttcatcggtccagctcaccgccccgtcgggctggtccggccgcttatggccccggaccgggtgcaacttcgacgcctccggcaacggaaaatgcttaaccggatactgcgccggaggaatgaggtgcacaggaggcggcgttccgcccgcgacgctggcggagttcaccatcggatccggcggcaaggacttctacgacgtgagcctggtggacggttacaacgtgggcgtgggcgtgcgggctaccggcggaaccggtgactgcaagtacgcggggtgctcggaggacttgaacccggcgtgtccagcggagttgcaggtgaaagacggcggcggcgcagtggtggcgtgcaagagcgcatgcgcggcgttcaacacggcggagttttgctgcaccggcgatcactcctcgccgcagacgtgttcgccgacgcgttattcgaagatttttaagaatgcgtgccccgcggcttacagttacgcttacgatgacccttcaagcatttgcacttgttctggatctgattatgttatcactttttgcccttctcattaa

SEQ ID NO: 50423 - DNA, 285 bp, Glycine max
  Peptide Sequence Number=SeqID_167201
atggattcactcggtgggagtcctcccctcaatgctccaccaaaaactaaaattcaaggtgaaggggcacttagtcattgtttcgggggaggaggatgttctaaatccctcccgatgtggccctgcatgtctggcgcaacaatgatggtggcccgtgtgatgttaaggcatggctatgagcccggaatgggcttgggaaagaataatgacagcatggccaacttagtggacatcaaggaaaaccgcggaaagtttaggctaggctataagcccacacggacggat

SEQ ID NO: 50424 - DNA, 237 bp, Glycine max
  Peptide Sequence Number=SeqID_167202
atgtttcttcatgtcggactcagccaacaagttgtgattgcgaagcataaaggttatgtgagtggtagcttgtcggatgaggggaaggttgaacttggaggagattctggtaaatcagaaagttctttggagaaaggcttagttgatcgcagtgacgcttcagatgttgatgctaaagtagataacatggcgaggtgtttcagaaccaaccagaggatactggtgagaaaggggtaa

SEQ ID NO: 50425 - DNA, 181 bp, Glycine max
  Peptide Sequence Number=SeqID_167203
atgattgagtttcaaatgattgatgaaaaatctatttcagatcagatccatgaatttgaaaacattatttatgacatgaaattgaaaggaattgttttgcctgacattatgcttgtggctttcatgatttcaaaattgcctccttcgtggactaattttgctcgaagcctaaaacataaac

SEQ ID NO: 50426 - DNA, 585 bp, Glycine max
  Peptide Sequence Number=SeqID_167204
atggctcttcggaaactgttatcgaagcgtttcttcgacggtgtcaaaatgacgacgccgtttgaacgcagcgtcgtgttgtcttcgcctctgcaacaaaaagcaatagcgcctccgagcacgacgcgagcgagttccgacgatggaggatttcttcggcggttttttctccttcggcgagctgtgtaccactccggtccggcgcggctcccagagttcctgtctctccccgtcggagagaagctccggcagaaactcaaagacatcaacgacatcgcttcagcgccgatagccggcgatgcggtgttcgggaatggaatgtctgtgagggacgccaggaagattatgagggcctctcaaatggagaagttgaaggcgaagctgaggaactttcctgaaagttccgttcagtactctgagtttttgcggatctgcgttgaggcgtgtgagaatcctgagcaaggtgctgagttcgcgaagatcttggatgactccggagacgtcatcgttttggggaacgccgtttttctccgaccggagcagttgcagaggaggaggatggatccttatcctagtgtggcgtaa

SEQ ID NO: 50427 - DNA, 210 bp, Glycine max
  Peptide Sequence Number=SeqID_167205
atggcaaggagaagttggggttggacaaaatcggagcacttaccatcgcctgttgaagattggaaaaagttgtgtgtggttcaggtgaccagcagaactagtccctgcatttcattaggagcgattttagccattgttgatcctgtggtcattgctgtttcaaaattcaagctggtcttgcggtcattgctagaaagtcaattatgctga

SEQ ID NO: 50428 - DNA, 729 bp, Glycine max
  Peptide Sequence Number=SeqID_167206
aggcctacacatcctcgccttttgagggctccatgtcctcgccttaagacggctacacgccctcgccttcaaaggactccacatcctcaccttcagaggactcacgtcctcccctttagagggctacacgccctcgccttcagaggactacacgccctcaccttcagaggactacatgtcctcacctttagaggactacacgtcctcccctttagagagctacaaaccctcaccttcagaggactacacgtcctcccctttagagagctacacgccctcgtctttaggggactatacgacctcacctttagaggactacacgtcctcgccttaagaggactacacgtcctacccttcaatggactacacctccccaccttcggaggactacacctcctcaccttcagagggttgcacgtcctctcctttagaggactacatgtcctcgccttcagaggactacacgtcctcaccttcagagggctacacgccctcacctttagaggactacacgtcctcgccttcagagggctacacgtcctcgccttcagaggactacacgtcctcaccttcagagggctacatgcccttgccttcagagggctgcacgccctcgccttcagagggctgcacgccctcgccttcagagggctgcacgccctcaccttcagagggctacacatcctcgccttcagagggctacacgccctcaccttcaaaggaccgcac

SEQ ID NO: 50429 - DNA, 951 bp, Glycine max
  Peptide Sequence Number=SeqID_167207
atgaattctctgggaacttctatagcaaatggaatatacagaattgtaatcaatcaaatattgcaaagccctggtatttattaccgttcagaattggaccctagcggaatttcggtctatactggcaccataatatcagactgggggggtagattagaattagagattgatagaaaagcaaggatatgggctcgtatctattacaagatcaatttggattggcccctggttcgtttagaaaatatggttagaggaactatatgtggagcaattagacataaattgataccgactcctcagaatttggtgacttcaactccattaacaactacttatgaatctttttttggattacatccattatctcaagttttggatcaaactaatccattgacccaaatagttcatgggagaaaattgagttatttgggccctggaggattgacggggcgaactgctagttttcggatacgagatatccaccctagtcactatggacgcatttgtccaattgacacgtcggaaggaatcaatgttggacttattggatctctagcaattcatgcgaggattggtagttgggggtccatagaaagtccattttatgaaatatctgagagatcaaaaagaatacgcatgctttatttatcaccaagtagagatgaatactatatggtagcaacaggaaattctttggcacttaatcgagatattcaggaggaacagactgttccagcccgataccgtcaagaatttcttacgattgcatgggaacaggttcatcttcgaagtatttttcccttccaatatttttctattggagcttctctgattccttttattgaacataatgatgccaatcgagctttaatgagttctaatatgcaacgtcaagcagttccgctttctcagtccgaaaaatgcattgttggaactggattggaacgccaa

SEQ ID NO: 50430 - DNA, 379 bp, Glycine max
  Peptide Sequence Number=SeqID_167208
gtcgactctagaggatcccacgcattgcgctggcgctgaacgtgggcgcctacaacgccgaagccgtgcgcgccggcctgcaggccgtgccgcgcggccaggccgaggccgcacgcgccctgggcctgccgcgcatctgcgtcttcatggacgtggtgttcccgcaggccttcaagatctcgctgccgccgctggtgagcaacttcgtggccctgctcaaggattcgtcgctggcgtacgccatcggcgtggtggagctgaccaatgtgggcaaccgcatccagtcggccaccttccagcccgtggagaccctggtcaccgtgggcgtgacctacctggtgctgaccacgctggtgacccaggtcacggctgccgtgga

SEQ ID NO: 50431 - DNA, 399 bp, Glycine max
  Peptide Sequence Number=SeqID_167209
atgtacttccatcaaccaagctacaagggtaaagcgggaaataataaacaccacacctaccttggacagcagggcagcctagggcacggcggggcacgcatgacacaatgcaaaacagccaaccgcgacacaggcaacaacggttgggcaggctatggcatggtggttcggcgaggcaggcaacgacacaacggatgtcaacttcgaggtccttcaagaaggttagctattgacacccgtagtagaattacgtcttcaaaataccaaaatgccatcacgacatggctacaaagacgggtgtcgaagaccgtcgttgttacgttgccgttaattacaaaaatgccactgacgtacattctatatcggttccttggaaccgccttagaatgtgcgtcataa

SEQ ID NO: 50432 - DNA, 183 bp, Glycine max
  Peptide Sequence Number=SeqID_167210
atgtcaatttcaaggttgaatcaccttgaggataccatggatcttgattatgtttttaatcagttcaagggagatcaaattattgctactaaagtatctttggtagatccacaaggaaatatgagttgtgttttgcttccaaaagatgaacattgcattgcatattttgcacaaggtatttga

SEQ ID NO: 50433 - DNA, 411 bp, Glycine max
  Peptide Sequence Number=SeqID_167211
atggatctgaagaagctttctgctaagagagctaggaaggccactacaagggaaggatccagtgcaacccctgaggagcatcagtgccgctttgaggtgattaaggattggtttttcctcaaagaaagacgggtccaactagaagagggagagtatgcagaattccaagccgaagtttccaggaggtgttggacacagctgactcagcctatggtgaaatatgatctgaaagtagtcatggagttttatgtaaacgcctggcccactaaagaaggggtcatggacaagtgctcttggaagagggacaacgatgtgaatatgctgaaagaagaagccaattctcaggttttgatgaagaggtcatgggtcaactactttgctccccggtacatgattttgcatggagcgtag

SEQ ID NO: 50434 - DNA, 447 bp, Glycine max
  Peptide Sequence Number=SeqID_167212
atggcattgatcacgggtctttgccaattctacgagatatcggtcgcaccaacaaagctcatccgacctcccattaccaagtccttcattgagaaatattgcatgccaaggcaggcacagcagccagggcaagaccaccagcagcagccggccgcagacacaccaccaccgcctccatatcaggcaccatctctagagtctatctcagctcacatcatcgccaggacctcaactattatcagtggcttactcccaagcagttcagagccactgtcgcatggcctggggataggcccaatttttaggagcaggcacgtcctacgggtgctcaaggagcctcccaagaggacgaaggtggagttgaggaggatggagacatggcaaatttgcttgatttcttcattggaggaaactgagctccccaaccatgatcttctaaatttgtga

SEQ ID NO: 50435 - DNA, 1794 bp, Glycine max
  Peptide Sequence Number=SeqID_167213
atggggccttcaccttccttcctttacacttgcaatggcttcaacaaaacctgcatgtccttcctcatcttcaaatccaaacctcctttcaactccataactacaatctccaacctcacatcatcaaacccagaagagcttgcaagaatcaatgatgtcactgtgctcaaagtgtttccaactgggaaagaggtgattgtccctttgaactgttcttgtttaactagggaatattaccaagctgaaaccaaatatgtattggggcaatccccaacatatttcacggtggcaaatgatacttttgagggtttgaccacttgtgataccctcatgcgtgctaattcatatggtgaacttgatttgcttcctggcatggaactgcacgtgccactcagatgtgcttgtcctacatggcatcagatcacaaatggcaccaagtatttgctgacatactcagtgaactggggtgatagcattaaaaatattgctgcaaggttcaatgtagcagcaggtaatgtggtcgatgccaatggtttttccacacaaacacaaactatttttccattcacaactgtactaattcctttgccaagtgaacctgtgagttcaatggccataattgtcaatggtccaccagctgtgtcacctcttcctgtttgcagctcagaaaagtgcaactcaaggaggaaactttacattgttattgccaccactgggggttccatgctggttctttgtgttgtcttatttgggggttttctgtgcagaaagagatcagcaaggttcattaagagaggtgagcaaagtgagaaagcaaagaagttgtcttcggaagatatccgcggcaagatagccatcattgaacatcactccaaggtgtacaagtttgaggaaatagaggaggccactgaaaactttggttcaaagaatagaattaaaggttctgtgtttcgtggagtattcggtaaagagaaaaacatattggctgtcaagaaaatgagaggagatgcatccatggaagtgaatttgctggaaaggatcaatcatttcaacctgataaaactgcaaggttactgtgaaaatgatggtttcccctatcttgtttatgagtttatggaaaatggctctttgagagaatggctaagcagaaacaggtcgaaggagcaccagagtttggcatggaggatcctgattgctctggatgttgccaatggtcttcagtatcttcacaacttcacagaaccttgctatgtgcacaggaacataaacagtggaaacattctactgaacagagatctaagggccaagatagcaaactttgctcttgttgaagaatcagaaagtaaaataacttctggttgtgccgcatcacatgtcgtgaaatcgaggggttatacggctccggagtatctggaggcagggatggtcactaccaaaatggacgtttttgccttcggagtggtgctgttggaattgatcacgggtaaagattctgttaccctacacgatggaagagaagtgatgcttcatgcaatcatagtaaatctcattggtaaagagaatttagaagagaaggtgagtttgttcattgatccttgcctcactgtcactggaaacagtgagatagtatgtgctccccagctagttaaacttggtctggcatgcttgatccaagaaccagcagagagaccaaccatggtagaggtagtctctagcttattgaaaatatatacaagttatatggagcaaataataccacctagcatcagcaacagtcctagcatggagaggtga

SEQ ID NO: 50436 - DNA, 483 bp, Glycine max
  Peptide Sequence Number=SeqID_167214
atggatagggaggagaaggagtatgtgggaagagttgagggagataaaaagagtgagcaatattgcacattggtgtattgttggtgtgatctcaattgtatgaggaaggcatgtgagagggtgggagtgggtggtgaagatgatggaagtggggagaggttggagttcaacaatttcatccatgaattaggggtagatgacttacctttggtaggaaggaggtttacatggtatcgacctaatggaagagcaagaagtagattacaaagggctttgacctcaagtgattggtgtcatgtatggccgagatgtacacaatttgttcttgatagaaatattttgaatcattgtcctttctcttcaagaataagattgtggattgaggacctaagtcattcaaggtccttgattgttggtttgaagataaaacttttgtcaaagtttgtggaagatgcacggaggaagctaaactttgaaggatga

SEQ ID NO: 50437 - DNA, 327 bp, Glycine max
  Peptide Sequence Number=SeqID_167215
tgatggaatttgcggtactcatttgcagatcatggttaggaccaaagaattaggtcatgccttaggtcacgttgctggcagaggtgtgggcataggagatcgtgatgattccaatgatgctccgcagtgtcaacgacctaccgcatccgcacggaggcagcgagtacctgtgactgtggcgcacgatgagccaatgctccctgcgatggaggctgacggagcttcggttgagactaaggtatttccggatgacccaatggcaccagctgatgtagaggacattggggcagacattcctgtagacataggtgcccaggctaccgagga

SEQ ID NO: 50438 - DNA, 207 bp, Glycine max
  Peptide Sequence Number=SeqID_167216
atggcgggacagggaatgccgctattagcatttgcgggacagggggagcgagaaaagtggcctcagtgcataccgccattcctcctggcaggacatgcctacgtgggcagtcccgccattggagctggcgggataggttcaggttgcggcattggagctggcgggataggcttggctcacgtgaaggctgcagtgtttagaagatag

SEQ ID NO: 50439 - DNA, 1071 bp, Glycine max
  Peptide Sequence Number=SeqID_167217
atgaatgtgaagtgtaatcatctccatactcagcttcatcaacttactcttgatggatgcactatttttgaatttctatcaacgagccaagatttagtggattcacttaatgctattgtcgatcctattttagtgcgtgaacacattgctgtcattggtgaaggtttgcctgaaactaatgggttggccatacttcaacagcaattacgaaggggccctctcagccttcgcgcgatgaggcaagttatagggttgacacctagttcaagacgcccctcaagttttcaggatccaccttcggctccattggccgtccacgcttatacttctgctgttgttgttgttcccgctcctccacctcctcttgttgcgcttgttcaggaggttgctcctgctgttgaagttagtgcacaaactactttgaccggtcctgtcgtggctcctctatccatcatcggtacacctttactaagtgctggtgtggcgacaacgagtgctccaaagatgtcatctctttcttcttcagctcctccggttcccccctcggctgtgtttgcatcggcgttgccttccacctcttctcaccccaaagagaatgggcaaaggcaccaagaaatgctaagcaaggtggcatctttagacgctgtggttgccaaatggagggtcactgctcgtacagtttggagagttgagcaccctaatatggccaatgccattgccacctttgctgaggctgtaagggagaagaatgaattggctgacaaggtagagatcattgcggttgagaaggacgaacttgccaaggtggttgtggacctcgaggtccaactgaaggaatcagagtctaggctagaggagttcgaaatgcgggcgtgcaaggagagggaggccaacaaagagcttaaagaggagctactggtgttcaagaaggaggtcgtggagcaacatgaaaagggctttcataaggccgtttggcaagatgtgaaggacgatgttttgcttgacaaagaagatataactgttgaggaggagtatgccaatgaggagcagggtgttagggccagtgtttag

SEQ ID NO: 50440 - DNA, 459 bp, Glycine max
  Peptide Sequence Number=SeqID_167218
atgagccacacatcttcagcagcatcaactgaaactatcatactgattccatcattctaccataaacaatgggcaccagactatccccagcatgttgacctgaaatatgatggaaccatctataaaatacgagccaggcagcacaaaacaagatgctatttgggagatggactcgaaaacttcaaaagagaattagaaatatacgagtcgaccatcatcaacttctttgcatgcaatcatctctacaagtttgacatacacttcacccctccactacaccgacaaacatgtggcagaccaagacatctgtgcagaaagcatatctggagtgttaaaattacacgggccatggccgctgctcctcatcccctgaaacttccaccatctacagaaatacctcttaatgcttgcggccatcatattaagacgatttggccctccattgcaatggcctattga

SEQ ID NO: 50441 - DNA, 231 bp, Glycine max
  Peptide Sequence Number=SeqID_167219
atggctacgcctgtcactagtggtggtggtgacccccatacaccgcatggtgatgttacgctacctgtgcatcttgctccggtgaacaccgatctgaatcacattattattgagaagcttgatttgaaaaattatttgttttggaggttgcagattccacaaaggttttccactgttgaagatgtgaatgctagcaaagtcactgaaacattcagactttgggatcaatag

SEQ ID NO: 50442 - DNA, 264 bp, Glycine max
  Peptide Sequence Number=SeqID_167220
atgaaccctaagcgcaagggatcccaatcgcaccacaaaaaattgggaaaagtagagcggaacgaaggaagaggggtcatgtttggagttggagggggagatgtgggcattgaggggcttcaaggttccaaggaagatgtggtagttgacaaggaactgacatatggcaaagatgaagataaagggggagtcaaagtggaagttatcaatgtggacaaaatggaggtgattggaaaggatgagatcatggagttctcatcataa

SEQ ID NO: 50443 - DNA, 320 bp, Glycine max
  Peptide Sequence Number=SeqID_167221
atggagttttcttcttacctcagaggaacagaggccgcacctttttttgggtcctggactgcatcttcgaaaggacaatttggtggagaggacaggaaggaagcgggaataggcaagtcgcagagtgcaggcgccatgccactgggtctttgtctgccaccgccactgtccgcgactacaacgtgcacgctgagaagaccggacgggattggaggcaacgacatgggcaacgatggcgatagtggtagtggtgtagtgacaacatcgttgatggcggtggtggaggttgtattggtggtagtagttaggggtggaaatag

SEQ ID NO: 50444 - DNA, 417 bp, Glycine max
  Peptide Sequence Number=SeqID_167222
atgttggaagcagtggacgattgggagctcatggtaataatggttagtgggttgattcatggagaagaagtgaagtgtgaaaatgaatttttgggtggtgagaaggatataggaagcaggtctggtgggcctcatcattcaagagaagatagactgatggcaatctctttctacttggcttttacatgtatgcgtggtggttggattttgaagccaggggcactgtgcttaattgctcattcgtttaggtttcaccaaatcgtccaccacatcctcatgactcatcatcttcctattgatgagaagacatcccttcccgacatgcgttcaaagactagcacaatagtgtcgatgtcatcattcatgaagaaagaattgagggttagtgcagctaacaatggaaaacagtcactctga

SEQ ID NO: 50445 - DNA, 705 bp, Glycine max
  Peptide Sequence Number=SeqID_167223
atgcctgaaattgaagaattcaaacaaaggcttaccgaattagacattgaagtccactcagttatgacacctcacagtcaaccaacttcacaagtttcagctttcatccattgttacaagaaaacggatgtagacaccactcccttcacatgtgcatgcagcaaatataatcaacaagttgttttgaggtatagacttgaggtcatggttacccacaaggagaaatgcacgaaatttttgctctgggatcgtgaatgcactgagttaattggacaatctgccgaagaagttaataggttaaagataacagatggtgatgttgatttgaatgcttcaccagaagcacttgataagctcctgggatattcacttgcatttaaagtaaaggttcagccaaagttcaagaattctgttgttctaaaatactcatctgacttagatttgattaggaccatagtagacttactacccgatgctgaggcatcttgcaagacccatattccactcccggattccgatgatcctcctcactatgagactcaatccctatctgaaatagtagatcatgatccgcttctcaaagtcccccttacaccaacgaagcgacaaacatttcagggatgtgacgatgaagcactaagttctcagatttcacctgctcaactttcatctaacaaattaggaaaacatgctaaaattgaatga

SEQ ID NO: 50446 - DNA, 969 bp, Glycine max
  Peptide Sequence Number=SeqID_167224
atgaggaaccaggatgttctatcacatctgctgaggaacctagcaagtctgactggtacaattaatggaagaaatatagtgtctttattggagggatctcaagatttggtaaaagctgggacatctggagctgcacagaatgttccaaacacaaattcaaatggtcctgaaccgtcccgtcctttatattcttctatcaaaatggatgatggtctaatccatcgggaccctccagagtctttggtacaatgtgagacgactcctgctaatgatatggctaaagaatgtatagcttcaggcaatgatgaagtaggaagtttaaaatctccttcagttccactgtccacaaatgattatgttgagaacacgaggaattgtcgtcctcctctgccttcaggaaatgggtctcttgatcatcctttattggtccaatgtgactctctcaagtcaagtccaccacagacaagtagaaactcagattcaacctctacccagtcaccatctagttctagtggagaagctcagagtcgcacagatcgaattgttttcaaactatttggcaaggctccaaatgatttcccccatgctctccgatcacagatccttaactggttatcccacagtcccacagagatagagagctatataaggccaggttgtatcatgttgactatatatctccgcctagaaaattctgcttgggaagagctatgctacaatctaggacccagcttgagaaagcttgccgcgtcaaatgattgtttctggagaacaggatggatatatacaagagtgcagcattctgtagcttttctgtataatggtcaggtggtcttagatgcaccattgcgcctcaaaagtccgcaaagttgtcaaattttatgcgttaaaccacttgctgtttctgctagttcttgtgctcaatttgttttgaaaggattcaattttttgctgtctaactcgaggtaa

SEQ ID NO: 50447 - DNA, 384 bp, Glycine max
  Peptide Sequence Number=SeqID_167225
atggcggcaacaacaacactagaggcaatagtgacgatgaaggaaaaaaatgttgtgatggcaactacaacaggtaatggtgacaacaacaatgatggtgacaatatgatgataatgatgatgaaaatggcaatggtggtggtagtgatggcaatgataatgtcattgatggtgatgatgaaaaagttggtggaagtgacagtagtaatggtaatggacatggtggtagtggcaacaaagacaattgtgatggaggtatggcattggcaatggtgtggcagggacgacaatggtaaaagtgttagtgacaactatcaaggagatggtgtgagagacaatggtgatgagtatttttgccttttgagtattttgtatgtgggataa

SEQ ID NO: 50448 - DNA, 1575 bp, Glycine max
  Peptide Sequence Number=SeqID_167226
catctagaagttggggattgcgtgaaagaagcatgcggcggctgcactatacacgttgtgtttagcgaaggagaacaaggtggtgggtctcgcatggtggacaaggcggtgggtgacgttggtggagtaagggggattccggttcgtctagttcgtgttgtttacgaacttggcactacctattcagcgaagatttggaatacacaacaagatcttgttacgaggaagtatctggtacaagataattgttatgatttgattgacagtgttgacgcagccaatggacatcatgagcttcagcatctcagattctcttgtcatgtaccgaatgtgactggaagagggtttatcgaggtggtatctactcatgctgaagctcagaagaaactggagaatgcttttgagacttcattaatttatctcaatgattggatatatactgctgttgatgcctggtatttggtgactttaagaaactctgaaggtcctgtggaagacaatggtcttagcagctgttcctttccattcatagttgcagagcaagaaatttgctcagagatctgtaagctggagaatgtcattgaggcagcagagactgctgatgacatccaaataaaaactaaactaatggaagaaaagactcaagcattgtatttcatacaagaaatgggttggctccttcatagaagtcgcgtgaaagttaggctaggtcctgtggcacctgtccaagataacttccattttaatcgattcatgtggcttgttggcttctctatggaccatgactggtgtgctgtgatgaaaaagctcttgaacattgtctttgagggcactgttgataccggagatcatgcctctgttgagttagctttgttagagatgggtcttctacacaaagcagtaaaaagaaatttccgacctatggttgaactactattaaaatttgtgccagttaaggcttcagatggtggagacagtaatgagaagcaaatcaacaagtcccctgacagattcttattcagacctgatactgttgggcctgccaggttgactccccttcatgttgcagcaagtatgcatggctcagagaatgtattggatgcattaactgatgatccaggaatggtgggaagtgaggcatggaaaagtgctcaggacgctacaggtttgaccccctatgactatgcatccctgcggggctactattcttacattcaacttgtccagaggaaaacaagcaacacatgcaaaaaccaacaacacgtgcttgatatcccaggcaaccttgtagatagtaacacaaagcagaagcaatcagatgggcacagatcatcaaaagttttaagtttgcagactgagaaaattgaaacaaccgcaatgcgtcattgtgggctatgccagcaaaagctggtgtatggtggcatgagaagggcactggttttcaggccagcaatgctcccttcagctgggaatcattggagtatgggtcaatctaatgttgtatatcagggaaggtttaccttcacttcagatgttcggcacaaaatgctcactgttctatctagcaaatattag

SEQ ID NO: 50449 - DNA, 978 bp, Glycine max
  Peptide Sequence Number=SeqID_167227
atggatgcgccctttcgatcaccagaagactacaaaaagtcttttttttctgatcaccctcttgccttccagttacacactttcgaccctcctcctctcttcattatgtcttattccaaggagggtttagtgtgctctggaagggttggtggcactactcttcctttcatcggtgctaccactactgctgaggaagggcctcacccaaaccctatggttcactccctccctagggaggatgaagttgagtccccttttctagttcctcctcataatgttattgacctagactcggaggctactatcgttcaagtcttggtttgtcatcccttcattcctctttctcctcctcctcctcctcctagcaaagctagtaagatcagaaaaaagttgcctcttataacccttccgaactactcctgggttcatgaggaagttagatcctatgaaagtgatgccatgttcaattatcaatccatcaagaaggctcaaaccaagaaggctaaaaaggctacaattcagaaagtccaggccaacaaggccaagggaaagcaacaggaccacaccgaagatgattgggttcctcctccccctcccattagcccgagtgacactaagagggcaaacacaattcctcaagatgaaggtccttcaaaatggtcaagggtggactcgatactgattgttgttccttcttccattgggagtcaccctgcctttctttctatgaagaaggggactacttctctttgggggaaggatttcaatcctaggaggcttgccccctatgtgtcattggacttcgttgcttgcttcacgacaaaaacttgggggattattgagttttgggctgaagagtttgagaaagttgatgctgagtccgaaaaggctcaagctgagtgtgctaaggccgagaaggccttggctgaagctaccatgaccaacgagaccctactacaatccaccaaggattcttga

SEQ ID NO: 50450 - DNA, 372 bp, Glycine max
  Peptide Sequence Number=SeqID_167228
atgtggactgcacaaagtcaaagagcacaaggtggtgatgacatacctcaagggctatactccactgcctcttgtgaatttgataggataagattcggggagaaagtgaacccaggcctaccactctttttttcctctttcatctttttcttcttaatttgtgtcttctccatgctctcaaaaaacaatgtttggagaaattctcttactttcggggatttcggtgctggagcaggttttcgggtagaagatgcagagatagaagttttcgacgctgaaaatgagacgagggttgtgaggttcatgttgggtttggcatggggaatgggagaaggaagaatggaagatgaaagtgagagggacattgaatga

SEQ ID NO: 50451 - DNA, 339 bp, Glycine max
  Peptide Sequence Number=SeqID_167229
atggtcattcccaagttcaaggtgtcggactttgacaagtacaaggggactacttgccccaagaaccatctaaagatgtattgtcggaagatgggggcatacgcaaaagatgaagaacagctgatacatttcttccaagaaagtattactggggtagttgttacttggtacactaacttgggaccttctcgagtccactcttggaaagacctaatggtgccttcgttaggcagtatcagtagaattctgatatggctctggataggatgcaactacagaacttgtgcaaaaaggggcatgaatcattcaaagaatacgcctaaaggtggagagacctag

SEQ ID NO: 50452 - DNA, 246 bp, Glycine max
  Peptide Sequence Number=SeqID_167230
atgtgcagtcctctgacggtgagggcatgtagccctctggaggcgagggtgtgcaaccctcttaaggcgaggacgtgtagtcctctgaaggtgaggacgtgtagccctctgaaggcgaggacgtgcagtcctctgaaggcgagggcatgtagccctcttaaggcgataggtgataattcatgcaacctcatcctatcttttgcaaatctcttccggggactccctcaaagtgtatgccctatatga

SEQ ID NO: 50453 - DNA, 705 bp, Glycine max
  Peptide Sequence Number=SeqID_167231
atgggaacaaatcaaaccggcaagaggttctaccaagtcaaggtcaaaagcccaaataccaccagcatcaaggaattagggcggttgatggaacccctccaaatgcaagccttccgcaggacttacggaaagatcttagagttgaccatagcagaggtgtccatagaagccattgcatcacttacccaatactacgaccagcctttgagatgcttcacattcggggacttccaattagtaccaaccattgaagaatttgaggaaattctaggatgtcctctcgggggaaggaaaccatatcttcctccggccagaggtttggaccgcgtaaaacagactcggaacggcatagcgggcctgccacagaagtacctagaagacaaggcgaggggtatggccaatcaaggagactgggtcccgtttatggatgtgttagctttgctaattttcggggttgtcctctttccaaatgtggatggtttggtagacctagcagcaatcgacgctttccttgcctaccaccatagcaaggaaagtccggtggtagctgtcttggcagatctgtttgacacatttgaccgaagaatggattgggaccagctcttggccgggataggaagtagaacaatcagttggttcccccgatggaaggaaggaaaagaaggagtccttttctcatgtggaagatacccaaacattccgctg

SEQ ID NO: 50454 - DNA, 572 bp, Glycine max
  Peptide Sequence Number=SeqID_167232
gcataccagaaagccagactaagccattcctagagcaactcataggtttcgcaagagagacatcagacacaataggatatgttcatttgctaactacttttggagatgaaacatggtcacaatccatcatgatcaaataccgcacattcgatgccttgactgcttacattatattgataggacatcctttactcaatgagttagggaccattatttcaaatcctcatctggcgatgaagttcccgagtgaggatgggaaaattatcattttcaaagttaatcaaatgaccgcaagagaatattatgttgcaaacctcatgatttctaaagggaagaatgtggcagagcccaaaactagccatctgccagaggctagaccagtcgcacaaagaaagaggaaacttggccctgaaaagggaaaagttgaggatgaagaagcaaagaaactcctaagtttaggattcactaaagaagataaggagaaaaccgcgtttatgcctgatatgactaattattgctattcagtcatccattcaatctacagaatgctagagcaacctgccaaaggctga

SEQ ID NO: 50455 - DNA, 336 bp, Glycine max
  Peptide Sequence Number=SeqID_167233
atggcctcgatcagtagccctcagaaggcaagggcgtgtagccctctgaaaatgaggaagtgtagccctctgaaggtgaggacaagtagtgctctgatggtgagggtgagtagccctttgaaggtgaggaagtgtagtcctctaatggtgaggacgtgtagacctctgaaggtgaggacgtgtagtcctctgaaggcgaggacgtgtagtcctctgaaggcgaaggcgtctagccatctgaagttgaggatgtgtagtcctctgaaggctaggacgggtagtcctctgaaggcgagggcgtgtagccctctgaaggtgaggacttgtagcccttag

SEQ ID NO: 50456 - DNA, 1224 bp, Glycine max
  Peptide Sequence Number=SeqID_167234
atggaaaaattgatccaaaaggggcacttgaaaaagttcatcaaagacccatcacgtgataaggattgtgaaaaagagagagatagaagcctggaatgcagcacgactcgcgaggcaatagaaacacagtgtcaagacgagaatcccctacctaaaactcaacttcgaggtgtagtcaacacaatagccggtggattaacagagggaggaagttcaaactcgacaagcaagcactatgtctgcaaccttaagtctattaactcattcgcaactgaaaagaaggtcacaaggagcctaccctccaccattttcacagatgaggatttcgaggggataaaccaatgtcacaaggatcccatggtgggcaagatagaggttgctaccttcctagtcaacacctcgacttcttataatatactgataggacgtctttcactcaacgagttaggggtcatcatttcaactccccatctgacgatgaagttctcgagtaagaatgggaaaattatcactgtcagagctaatcaaatgaccacaagggaatgttatgttgcaagccttaagatttctaaagggaagaaggaggaaaagcccaaagtacaaatggtagcatacacctctctcaatagaaacctaggagaagctaaaatcaatccaagagaggcagagccaaagtataacccattgaagaagctagccatctgtccggaggctagaccagccccaaaaagaaagaggaaactcgatcctaaaagaggaaaaactatggatgaacaagcaaagaaactcctaagtatcggattcattaaagaattgcaatacaccacgttgttagccaatatggtaatggtaaagaagtccaataggaagtggaggatgtgcatcgacaacacagacctaagcagagttttccctaaagacttgttccccttttcgagtattgatcacctagttgatgaagcatttggattccccaccctaagttttttagatgcatatctcgggtataatcagatctcgatgtttaagcaggatgaagagaaaactaggttgatggacaagatattagtgaaccaactcggcaagaacctagaagtatatgtagatgtcatggtggccaaaaacataagcaccacctctcctataagacctagaggaaagttctttggcttcatgcttacccacatacggattgaggccaactcgaagaaatgtgtgaccatg

SEQ ID NO: 50457 - DNA, 222 bp, Glycine max
  Peptide Sequence Number=SeqID_167235
atgttgatgatgttgaaaatgcactgtgatgatgttatgttgtgtatgtacatgggtggtgcagtgaccttgttggatatccctggtgggggaaatagggtggaaaaatacttgtacatgagggcttgtcactcggtttggaactcccttgagactcaggctgatcaccttgggggagagttgcctgtgcacgacagggtgacctcaacacttactgcctag

SEQ ID NO: 50458 - DNA, 471 bp, Glycine max
  Peptide Sequence Number=SeqID_167236
atggcgcgtgataaccgatgtagaaagacacttttaactgatgtagaaagcattactaggaaaatggaggtggagtttaagtggggagggagattatctttggagataggtgttgatatcaaaatatggaagttggagagatttagagagaagagctctttgaaagacaaatatcctaggccttttcttctttttgaacaacatgatgcaatgttaaaggacatgggtttgtgggaggagggagtgtggcagtggagtcttagtgagagaagacatttctttatatgggaagaatgggatattagggatagtctagaaggtgacataaatgcaatagctcctatagaggggaagtgtgatggatggaggtgggaggtagaaaatttaggattatacatggcaaattcatcatattgtgttattcacaagttcattgttgattcaatcgcaaatgagtttgagatagcatag

SEQ ID NO: 50459 - DNA, 420 bp, Glycine max
  Peptide Sequence Number=SeqID_167237
atggaagacactaggactcacaggcaagtgggacaaagtttgtttgtgcgagttgacaagcttcagttagttaaatatgcaaaacatccgtatggttctctaggcaagaaggggatggtagcagttttaaccgctgctattttcttgtttttgttgttggcgatcactttcgtgtattggtttattaaagcaaggagacaatttgccgcaatagacaatttctctgatgctaacaagcttggccaaggagtttttggttctgtttataaggcaattgctactgaagttggtgctaacttcatcaacatttctatgtcaagtatcacatctaagtggtttggtgagggtgagaaatatgtgaaaactgatttggtgaggaatgttgaactttctaagacggttattgaacaaccatcttag

SEQ ID NO: 50460 - DNA, 669 bp, Glycine max
  Peptide Sequence Number=SeqID_167238
atgaagattgaggaattggatgatggagagtgtagtagggacgaggaagagaagtgtcagaggcagattgtgagcattgatgcaaagagagcgttggttggagcaggtgcttggatcttgttctaccccacactcttgtataatgtgcttcgtaaccagattgaagttgagtttaggtggtgggatcatattgacgagtttttgttactgggcactgttccattccccaaagatgttcctcacttgaataaggttggtgtgggtggtgtgattactctcaatgagccctacgaaaccttggtgcagttgtatcaggctcacgggattgatcatttggtgattcccaccagggattatctctatgccccctccttcgtggatatcaatcgagctgtgcatacttattgtcttgcttttcaaaaagatattgttgccacttgccaccagcagaaactcattaggtggaagttgcattcctgtttattgaaacgctttctaacgttacccctttctaattatctcaactatgctagatggcataagagcaggctaaagctgtgttgcatgaagttattaggctggcaccaaaattgcatgagtcgtatcacacccttggacttgtctatacttcactctaggattatgaaagagctatggctttttacttga

SEQ ID NO: 50461 - DNA, 216 bp, Glycine max
  Peptide Sequence Number=SeqID_167239
atgattacaggattacaagactctttgccaaaatcaattgggcctcttcctttcgatggaggtgtgacagttcctagaaacttcagattgctagaggagcttgaacgtggtgaaaaaggaattagagatggcacaattagctatattcatccttatcgatgtgtgtccaatgatagttatcagttgcatgtaagaggctgcccccaaaaatgttaa

SEQ ID NO: 50462 - DNA, 519 bp, Glycine max
  Peptide Sequence Number=SeqID_167240
atgcttacggtgtgggtggaaatagctttgatggtcgcaacttggattgggcaaattcagaagataaggcttatggtggtcgaaatcaaccaccgtggcggcggagcagagagactgagggagcgaggtcgagcaaaggccccagagaaggaatgggaaaggcatatccctcttgcggtagcgacaacgaggacgatgatgcctaatatgtccatgaccatggaactggccataatttaccctgacaacgttgtgggtggccttttagagcaagaccatgacatcatggtcgaatgtgcggaggttgatggcagggaaatggatagggttgtagtagatgatggtgatgacatgaaagaagttgttgtgccactgtggagtttttggtggtcatctatttggattattaaggcactgtttgctttgagggtttggagggtgacctccatggttttgggattttggggaagggaagatgaagttggggactgtggaaagtttgtgggcgagggaatttga

SEQ ID NO: 50463 - DNA, 225 bp, Glycine max
  Peptide Sequence Number=SeqID_167241
atggtgtggcatcatcaggtatgggtgctggggatggctctgggatctggctcaagaggggtgagcacatcctccccctctactgctgctgctggctcctcagaagtaggctcctgggctgcggaggccccaccccctccaaaaggagaaggctgggctcgtggtcaggccacttgtgcatcaaactcctccatgctcatgatggatggcaagcctaagccctga

SEQ ID NO: 50464 - DNA, 480 bp, Glycine max
  Peptide Sequence Number=SeqID_167242
atggcaacaggtggtagcaccccctactcattgacaagtaaaggcttatgtggagcgaacgagtttattagctcttgctacattgcgatattctgccacaaacaagggcttggcatttcaacaaagacaaaggcttatgacgttggcaaacgtaggtgccaaggtgaggttgatatggctagcagacctttaccaccgctatcttacatccatgttgcctaccttcagtaccttggcaacctagatgcttgtcatgagtacgcattgggagtagttgcactatgtacctctaggaccatctctcctatgcaagccagtagagcaataggcaatgtggaggtgtttgcacattttcccactattggctactcaaagagacaggagaattatgtggtggaggacccgatagccaccagatggaagccattgagaggttctgggcttctcctttcgatcagggatatatgggataacctatag

SEQ ID NO: 50465 - DNA, 177 bp, Glycine max
  Peptide Sequence Number=SeqID_167243
atgagatgctacaatcattgcaggagggctcaacagcttggtgcaactcaggcacacaaagacccaggaagagggctgactaggatggtggcagagttggttgatattatcattattagactactaggacattcaaacaatatccattcagatgatgacatcatgtcaccatcataa

SEQ ID NO: 50466 - DNA, 550 bp, Glycine max
  Peptide Sequence Number=SeqID_167244
gagacgacgttagtctctgcgtgctatcaggcttttcgtcttacagatagcaaaaaggtttatacggatgaccactcgggtatctccgcccgtcagcgtgactcaaaagtcagtatgacagatcttgtgagcgcggaagatgacgcttttcgtcttaccgatagcaaaaaggtttatacagatgaccactcgggtatctccgcccgtcagcgtgactcaaaagtcagtatgacagatcttgtgagcgcggaagatgacatagcaaaaagaatgtatacggataaccactcgggtatttccgcccgtcagcgtgactcaaaagtcagtatgacagattttgtgagcgcggaagatgacgcttttcgtcttacagatagcaaaaaggtttatacggatgaccactcgggtatctccgcccgtcagcgtgactcaaaagtcagtatgacagatcttgtgagcgcggaagatgacgcttttcggcttacagatagcaaaaaggtttatacggatgaccactcgggtatctccgcccgtcagcgtgactcaaaaa

SEQ ID NO: 50467 - DNA, 644 bp, Glycine max
  Peptide Sequence Number=SeqID_167245
gaaaacgcggccactgcaagagcccttgaacaagaaaccaaaagggcccgcaaagaggaacatggtcgagataaattccgaggagctttgtggggtagcaacaatgagctcaagctccgaagagaggaaagagaccagtcatgggtacatggcatgattttaaaggaagaattagctacttttgcaagatccaagaggagtttggctcaacatttggaagccacgaagcaaagcatgctagctatcatagggcagtacaaggaagagttaaaccagcctgtgacccatgaacaaaacctagtagaagatttcgcacaagtgtacaccgaaaaggaagcaagagggagagtgattgatgcattgcatcaagaagcgactatgtggatggataggtttgccttgaccttgaatggaagtcaagacgtcccacgactactagccaaagcaaaagccatcgctgaagccgacctatcggccttaaaagatcaaatggcttctatcacggaggccatgctaaaactccagaaaactatagaggataatgccacggcgaccgcctccaatacagctagggaagcggaaccggtgctacggcccgcaataaacttgggccgagatagaaacacgacggtgttcggtcggag

SEQ ID NO: 50468 - DNA, 534 bp, Glycine max
  Peptide Sequence Number=SeqID_167246
atgaccactattacacagatatggatgacgttgttacttagcaacattctgcccagtgaccacaataacgatctccctctgcggaaggatcacgcccacaagacacccagtggacccagaggagcccaacaaggccctggggtttccagctctggttacgggcctctgtcagtcctacagggtgcccgtcccccccaacaagggatcgcgcccgcaagacacccagtggacccggagaagtccaacagggtcttggggtttccagctctgattacgggcctctgtcagttctacggagtgcctgtcgcccccaacaaggtcatcaggccccctactaaccgagctttcatcaagaagtattgtgcccctaggcaggcgcagggcgagacactacagcagcctggggatgtccggcagcgggtaatagacactccgccgccacctccaaagcctctcagctcatctacaaaggctggagcattgccaacgacccgtggccgaccagcaggcgaccaagtccaaagcaaaaggtaa

SEQ ID NO: 50469 - DNA, 381 bp, Glycine max
  Peptide Sequence Number=SeqID_167247
gatttgatttgggcaagattggatgagaggaaggctgattttgcgaaatctgcacttatgcagagtttttgctgtgaaattgtgcagcagaattttgcacaagtgcagaaaaatgcttgtgtgtggttggctgtggaaagtctagtgcagaatgagttctggatgtttgctagtagatcccaacggtcaaaatgtaggcttatacactatagacttccacttgagaggattgatggggacccggtgttgagagaaacgaggatatgggctacgtgggagtacgtgagctcagttggaggtgggcaacaggggatggtgggtttatgcgcgcattgtggatgtgaaaagcttgttgtgcaccatcgcccgaccgccacctag

SEQ ID NO: 50470 - DNA, 271 bp, Glycine max
  Peptide Sequence Number=SeqID_167248
cgttctctgaagaactcactaagcgcactgaccgtgctaagcgagttcatcctgtgaggatgaacactcaccctcttgctgaactacctcgagcttcactcgctaagctcccaacacttagtggaatttatgaagagttggtgcccctaagcgtagcctttaaggagcttagcgcatatccttgcggccggccaagcgggccatgtctcgctaagcggccagtgacttttgtagaagcaaagcttcatggtgaatcaaaggtgattcaaag

SEQ ID NO: 50471 - DNA, 360 bp, Glycine max
  Peptide Sequence Number=SeqID_167249
atgacaagtgaacttcaaatgctcataacttttgctatgattatctgtttgaggcccactatatatcaaaacgctcagaattcagaggagaatgataggatagaacctgtatcaagagccgaagctctgataccagatgatgtgaacctgagtaggagtggattgtttgatacaggctacggaggtttggatgacgccacttccggtgaaaggaagataagtcagggtagacgccacaaggattaccttgataagtctgagattggttcaacaaggaactcagagagaaactctcaccaaattttatcaaatgtcaaaagttttttctattcaaatcaaaaaccaatacttatagtgtag

SEQ ID NO: 50472 - DNA, 399 bp, Glycine max
  Peptide Sequence Number=SeqID_167250
atgtaccctcccttgttctctttgaacctagttgatgtactctccactagaactgatccacaagagatgtaccctctcttgttctcagtcaaacccaaggaatgggaagaatcaaaagaattctcagactatgtcgttttgaattctttgacaagggagaagggagacacaaaagaattcaggcagttagtcctttgttcttttggaaaagagagaagagagacacaaaaagaattcaggcggttagtccttggcgaattctttttggcaaagggagaagagaatgaaaagatgaatagcagaagttttcaaggtttggaaaaccagaaaacttcagaaagcttttggtacaaagaagaagaagaagttcaaagagattcaaggcttgtaaaggattga

SEQ ID NO: 50473 - DNA, 738 bp, Glycine max
  Peptide Sequence Number=SeqID_167251
atggagtttatctctaatgcaatgatactttcattctcaatactattgttgctaccaagtacatcatattcactatatcaaaagcctgaaaatcatatcaagacagctatttttgtaactgggagttttgaaatgggaccaggatcaattgcaacaaaaacatttgagaatataaagtttccaaaaggtcatgttggaattaagagttttgatgcgaaactagttgaccaagaagggaactctataccttcgtatgaaacttaccttcatcattggtttgcaataaagtaccaccaaaatattaccatgtcacctaatcctaagcttcgtcgtcctgaggatgcttttttccaaagaaacgaaggcacatgtaatggtggcattcttccacattattggggatttggagtagaatcacgaggaacaacctcaaaaattcccgatccttttgctatagaacaagttaaggtttacatacttgattccaccgacaaagtgaggtcaaatggttccaaaatacttcatgattgtctggcagagtataccattccagctggtggtggtggtgattctcctcatgtccaaaaagcaaacatcccaatggaaaatggaggttatctaatttatggcactgctcatatgcattcaggtgttgtaaatgcaactttatatggacaggatggaaggactttatgtacatcaacaccaaaatatggaacgggaaagaggctggaatga

SEQ ID NO: 50474 - DNA, 345 bp, Glycine max
  Peptide Sequence Number=SeqID_167252
atggctaaaccaagcagccccgcaaacttggcatcagccatcattggtttctttgcctcaaagaagttcccccatagactaaaagcatcaccgggaaggtttgcaaggcaaaacccttcaccacacccttccgtcatggtccatgttcatggatttttcaaagtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgagggtgcatga

SEQ ID NO: 50475 - DNA, 288 bp, Glycine max
  Peptide Sequence Number=SeqID_167253
atggggaagaacaagggtcgtcaatcgcacttagctacaaagcaaattatggtgaagggtactacctcaggttcacgtaaatcccaaacatctgctacttctggtctggctggttgcttggatgttgtccaagcaaatcagaatgcttatactgcttcacaggataatcttgtaggcaaggtgcttgtaaaaaaggcagggacaagttctgcaaaaactgatgatgtcgcacaccaagtgtttgataatttgtcagaatgcaatgctgaatctgaatcttccccatag

SEQ ID NO: 50476 - DNA, 351 bp, Glycine max
  Peptide Sequence Number=SeqID_167254
atggcggtaccccttgcctgtcccgctgctgcgactggcggtacccactatcccgctattggcactagcggttcaagtttcccgctagtgtcaatggcggcacccacaatacacgatctcatcattacaaaggattctgatcctaacaacctaatggacatagtcctcccacccttgaggcttccttcccatacccttgggcctgtggtcataatcattatgcacctacaacaaacacagaaacttactatggatggagaaaagaaaatcagtgaaaaagaaaaaatagaaggaagaaagattgaaaaagaaggagaaggagaaaagcaccagaaacttactatggattga

SEQ ID NO: 50477 - DNA, 327 bp, Glycine max
  Peptide Sequence Number=SeqID_167255
atgctgtgtacatccccctgttgtgctttttcgcatctacatcatatcgtcacgcatgcgttgtatgttagtctcgtcttttgtcatgggaagccggaaggtccatatcaccttcttaactgcacacatggggcattgtgtccccgaatgctcaatattgacgatcagaattgccattccttggattatagggttgaaccaagctcatgcttttacgaaaaggttcgtcaagtcaagttgaagcatggaagtaaccatcttgcaaaaattggggtaaaagatggatcgagttacatcgctgcttcgtctactgccaaacacatttag

SEQ ID NO: 50478 - DNA, 1455 bp, Glycine max
  Peptide Sequence Number=SeqID_167256
atgagtgctctgaataggaccattatttccttcaacaaaacttcatccttcaaccgaaggactctcggcattggaagtcccagagcgattcacaacaaccgcttcggatgtgtctctctcaggtttcaggttcttatcatcactgtctctgtggtttccttctttgtagccgtaggtggttacatgtacgtgcttccaagccttagccgcgcgtttttcaatggccaagttcccttattatctgaacataacagcaacggatcagtgagagaatgtgatgtctttgatggaagctgggtgcaggttaaagatcacaccttgtacaatgccacagagtgtccttttgtggaacgaggattcgattgtttagggaatgggaggggtgacagggattatcttggttggaggtggaagccgaggagttgtgatattccaaggtttgatgtgcgtggtgtgttggaaatgttgagaagcaaaagggttgtttttgttggtgattcaatgagtaggacgcagtgggagtctctgatttgtatgctcatggctggggttgaagataagaggggtgtttatgaagtgaaccagaatcagataacaaagcggatcaggttcttaggggttcggttcagtgccttcaatttcaccattgagttttttcgctcggttttccttgtgcagcagggtcgggtgcctagacatgcgccaaaaagggtccaatccacgcttttgttggacaaattggatgatataagtgaccagtggcttaattcagatattctgattttcaatactggacattggtgggttccatctaagctttttgatatagagtgggagccaagggtaatttcaggttggactgagacatttaatgtagttgctcctgaatcctcttatgcaatctgttacatttataattacattcaagagtacttccctttgaatgttcctaactgtcaggataagctctctgttggaagctctctgaaacttgggatgacaattccttctgcctttagaatagctcttgaaacttggtcatcatgggttgacagagagattaataaaaatagaacacgcatcttctttagaacttttgagccttctcactggagtgatcttacccgtaggatttgcaatgtgacccagtacccaacatttggaactaatggaagggaccaaagcttgttttcagatacaattttagatgttgtaaagaatgttactattcctataaatgctcttcatgttacttctatgtctgcgttccggagtgatgcacatgttggtagctggagtgacaacccatctattcaagattgtagccattggtgtcttcctggggtacctgatatgtggaatgaaattatcctgtcccaactttttgctgaatctgaaatcccttctcagcaaattgaatcattcagtaagttcagttatcttctaatagactaa

SEQ ID NO: 50479 - DNA, 1848 bp, Glycine max
  Peptide Sequence Number=SeqID_167257
atgaagggtggcacggttcagattagctggcacgagagcaagcccgtcttaaccctcgatttccaccctctctccgccactctcgccaccgccggcgccgatttcgacatcaagttttggcaaataaaacccgcggggtcgccgaagaagcttcccgtagtttcctatcttagtaacctctattaccacagctctgcagtcaatgttattcgcttctcttcttccggggaattgctagcctctggtgctgatggaggggacttgataatatggaagctacattctactgatgctggacagacgtggaaggttctcaagatgttacgatctcatcacaaggacattctggacctgcagtggtctactgatgccacatatatcatttctggatcagttgataattgttgcattatatgggatgttaacaaagtacttgatccttgcgtgtcaggaactaaccttcagacattggatgcccatgcacactatgttcagggggttgcatgggaccctctagggaaatatgttacttctcttagttctgataggacttgccgaatatacatgaataagcctcataaatcaaagggcattgagaaaatcaattatgtttgtcagcaagtcatttccaaggcagatcagccattattaaagaattccaaggagacaaaatttcatctcttccatgatgagacattgccatctttcttcagaagattagcatggtctcctgatggttcatttctacttgtgcccgcaggctcttacaaaattagtactgcatctgaatctgtgaatgcggcttacatattttctagaaaagatctttctaggcctgctatacagcttccctgtgcaagcaaagctgttgtagctgtccgattctgccccatattttttaaacttcgaggaacacactcagattgtactgttacaattgaattgcctgagtggcctggggttcagcttaaatccaagctttcactgccaattactgggttatttaagctcccatatcgcataatatttgctgtggccactttgaactcattgtacatttatgacactgagagcacctctccgatagccgtattagctggtcttcactatgccgcaataacagatattacctggtcatctgatgctcattatttggcattgtcatcacaagatggtttctgctctttggtggaatttgaaaatgacgagcttggatcaccttactctttatcaggaaaagtctcaaacgaggatggtaagagcactgtacagacaaccaatgacactgtcactgtaccaactgaggatgttagtgcagttttagcagagagcaagaaaatggaatcagaagagaaggctgatgacatggtcattgaagcctctggcaatattgatgctgtcgtaacagaaagcggggaaactataacacaagagaaggatgagatgatcaagtcaactgggaatttagcagattttaggaaaaatgaagcagcagagaaagctattgacatggccattgaggcaaccgggaatgttgaaggggttatagcagatagtaggaaaaaggaggcggaagagaaaactgatggcatggtcattgaaacaactggaagtattggtgcagctgaattagatagaagaaaagctgaacaggaagataagacagagaaacagccagctaatctagattcagatggtaaacaaaaggaagcaaaggagaagacagagattctgcaatcaagtttagacggtataaaatcagggccacaattgttcagtccgaagagtacacccatttcaaataagccagccaagaagcgtattactcctatcgccattgatccatga

SEQ ID NO: 50480 - DNA, 165 bp, Glycine max
  Peptide Sequence Number=SeqID_167258
atggctacagccaggtgggcactccagcatcctgtttatggcattgtgatactacggttgggaatttacacagacagacccaacgtttccaagacgacgttcctaaatgaaaaactctacacggttccggaatttcaacaaacactattgacaacaacgaagtaa

SEQ ID NO: 50481 - DNA, 497 bp, Glycine max
  Peptide Sequence Number=SeqID_167259
gaaggaagaatcaggattctatcttcatgcgaaggatgtccaaatgttcccttgatggaacaaggggttgtattaattataatcccgtcctcgccataagacagcttggctaccccatgagaggagtgccatcagacgaaagcatcacgcctttcatcgcacggggtttcagtgaccacaacgcgagggacagagagcttaggggaagcagtaatgggatcatcggcggctatcataagtggctgagagtccgaacacaaggattggattggctcccaaatctaaagactgtgagagacgatgaggttaaagcttcggaagaaagtgatgaggtacaagccctaaaggcagagcttgaaagagcccgggtagtcgaagagaagttcaagtccatagccatcaaagcagcaatagtgagctcaagcttcgaagaggtgaaaggaatcatcatgggtcaaaggcatgatcttgaaggacgagctaaaggcttgccttag

SEQ ID NO: 50482 - DNA, 795 bp, Glycine max
  Peptide Sequence Number=SeqID_167260
atgatgcaatccggttatagagcgccaatatcccggaaatcagtggttgataccacgcccgcgacaccggcgcggacggacagaaggactgtatctatggctcaacaattgctcatgccaaaagctacggctgtatggctggttgacaacaccgcgctgtcgttcgatcagatcgccacgttctgcaaactgcatccgcttgaagtcaaggcaattgccgacggtgaagccgcgcagggcatcaagggcctcgatccgatcgcgaccggacagctttcccgcgacgagatcgcccgtgccgaagccaatccgaaccataagctgaagctttccgagccgaaggtccgcgtgccggaatccaagcgccgtggcccgcgctacacgccggtttccaagcgtcaggaccgtccgaacgctattctctggctcgttcgcaaccacccggaactgaaggatgcgcagatttcgcgtctcgtcggcaccacgaaatcgacgatcgagcagattcgcgaccgtacccactggaactcggcaaacctgacgccgatggatccggtaacgctcggcctctgcagccagatcgatttggccctagtagttgaacgcgcctcgcgtggccgttcgctgccgaccgccgaagagctggacaacacattgcagccggcgacggcaacggaaggcctggattacaacttccagcgcgaagaagacgaacagatcgacgccgatgcggtcttcaagaagctctcctcgttgaaatccacgcagaaggacgaagacgaggacgatcagtag

SEQ ID NO: 50483 - DNA, 210 bp, Glycine max
  Peptide Sequence Number=SeqID_167261
atggcttttgtgcataatacacgatgcctgtggttagatgccatgaaagaagagctaaattccataaaacataatggtgtttgggacctcgtagaattgctaaagggttgtacgagagttggtcgtaagtgggtcttcaagactaaacgtgactctcatggaaaccttgaacattacaaggctagacttgttgttaagggatttacttag

SEQ ID NO: 50484 - DNA, 363 bp, Glycine max
  Peptide Sequence Number=SeqID_167262
atggctgtggtcatggttgggattggaatggccaatggcacctccacttctctctatttgtcttctcagttgcttggcactgccaacaaggattccaccttcaaaagggtgctgaaggagtgtgtagaaaagtacaagtatgccagtgatgccctccaagcttctgcacatgatttggctaatgaggcatgtgactatgcttccatgcacatcactgcagcctctgattaccccaatgtttgtcacaacttgttcaaactctacccgggtttggtttatcctactgagcttgctcccagagaggatggtttgaagtgtttatgtgatgttgctttgaggattgtcgagaatcttaattggtag

SEQ ID NO: 50485 - DNA, 426 bp, Glycine max
  Peptide Sequence Number=SeqID_167263
atgtgggttggatgttggccagagggaatgcagatggagaggatccaagctgcacctcttatttcatattgcatacgtaaacaacgtcacattattaaacccagatccaaatatgcagtagctgatgagggcaagaacaagaccaatgatatagaagaagaaagatctcatgatgatttttgcatccattccgagtcatttaagaagctcgtggagatgggtgtgccgtgtaatgaatgcgtggaagaaaagctgcgctggttgcggtctcagattattggtaaccatctggacttttactctcctcttggaagaagaatacttgtatatgctgatcacaccgcctccgctcgcagcctcaactacaacgaaaacttcatctccaatcatcttcttcctttctatgcttgtgacatctacacttaa

SEQ ID NO: 50486 - DNA, 468 bp, Glycine max
  Peptide Sequence Number=SeqID_167264
atggtacacgaagcaagggagtacattaaaaagtgtttaggtggtggagaagatgatgcactcatattatgtggctcgggcacaactgcagccatcaagaggctgcaagaagtgatgggaatcgctgtgccatctgttttgagggaaagggttttgaagagccttggcacagaagaaagatgggtggtttttgttggacctcatgagcaccattcaaacctcctttcttggaggcaaagcttggctgaggtggtagagattggtcttgatcaaaaagggttgcttgatattgatgctctaaagctacaacttgaggcctatagagataccaaccgacccatgttgggatctttctctgcttgtagcaatgtcactggaatttactcagacacacgagcaattgctcagcttcttcataagtacaaagcctttgcatgctttgattttgcagccagattttatgtttga

SEQ ID NO: 50487 - DNA, 354 bp, Glycine max
  Peptide Sequence Number=SeqID_167265
atgttgttaattgttaccagagctttggtcaagtctgagttggattgccctgccttgatcaagttgcttgatgtgggagtcagaccacgtgacatgaaagtcttgcagaaaagtggctggtcgacccagagcagacacaccaaagagaagaacacaaaggaaaaagaagacaccagaatttctaatttgagtggcattgaattgaaatattgtgtcaaaccaaaacgggccttagctttccatacagctaatggattgccgtcattagggcctacccaacagtttgtattcttgtttgccgcctttaatcctctgctgcctaaatcactttctcaacgtgtgcatcctttatag

SEQ ID NO: 50488 - DNA, 1830 bp, Glycine max
  Peptide Sequence Number=SeqID_167266
atggaccaaagcgtggacaaaaccaactacgaggttggagtgttatccaaaacaagcatatcagaaacatctcatgacttttgcaaccactctgagtccttcaagaagctcgtggagatgggtttgccgtgtaatgaatcagtggaggaaaagctgcattggttgcggtcacaaatcattggtaacgatgcagagttcgattccccatttggaaaacgaaaagttgtctatgctgatcacactgcttcaggccgcagccttcactacaatgagaatttcatcatcaaacaccttcttcctttctatggtaacactcacacgtgcgacagttacgtgggaagcaggacaacaaaaatggtacacgaagcaagggagtacattaaaaaatgtttaggtggtggagaagatgatgcactcatattatgtggctcgggcacaactgcagccatcaagaggctgcaagaagtgatgggaatcgctgtgccatctgttttgagggaaagggttttgaagagccttggcacagaagaaagatgggtggtttttgttggacctcatgagcaccattcaaacctcctttcttggaggcaaagcttggctgaggtggtagagattggtcttgatcaaaaagggttgcttgatattgatgctctaaagctacaacttgaggcctatagagataccaaccgacccatgttgggatctttctctgcttgtagcaatgtcactggaatttactcagatacacgagcaattgcccagcttcttcataagtacaaagcctttgcatgctttgattttgcagccagtggtccatacgtggagattgacgtgaggtcaggtgagagtgatgggtatgatgctgtgttcctgagtccacataagtttcttggtggtcctgactctcccggggtgctcctcatgaataaggccctatacctgctaggatcttcaccaccgtccacttgtggaggtggaaccgtgacttatgtcaatggcttcaatgaacaggatacattatatttggagaacatagaggaaagggaaactggaggcacccctccaataatccagacagtgacagcagcattggcattttgggtgaaggaatacataagctatgaagagattgaaaaacgggaacaactgtacattaacaaggcattcgagaggtttggttcaaaccccaacattgaggttctaggaaacttaaaggccaagagacaagccatattgtcctttctgatatactctaccaccaccaactcttcctcagctggtgagtggagtgatggtaacaaagaaaatgaaggggagcttgatttgtgggcagaaacggggaaccaaagaggtaaaccacttcatggcccttttgttgcagcattgctcaatgacctctttggcattcaagctcgaggagggtgtgcttgtgctggaccttatggccacgaattgctccacatcaacaagtctcaatcccttgccattagatcagcagttcaagagggctatattggagtaaagccagggtggactcgagtcagttttccatactacatgagtgaagaagattttgagtacattctaagagctatagagtttttagctgtgtatggccaacgattcattcctctgtatagtttcaatttgataaatggcagctggagattgaagacagagaaatttgaggcactaaccaaggaagacatgcgaagggacgaatcatactttgaggtggctaaatgtgttgctagtggcctcccaaaattcccttctcagggtatactccaggaggatgtggatcccaatatcttctgctttagagtttaa

SEQ ID NO: 50489 - DNA, 108 bp, Glycine max
  Peptide Sequence Number=SeqID_167267
agtgtggacagcttagagaagttgattgatcacgaacaggtcctattggcggtttaccttcaactgggacctgctcattgctcgaagctagaacatactattgaataa

SEQ ID NO: 50490 - DNA, 501 bp, Glycine max
  Peptide Sequence Number=SeqID_167268
atggatatagcaactgccaatactaacagaggtaaatatcatcatatcggtggtgaaaacgctggaaggaagaaagaagcagaaactttgagagggatacgaaaggtccatgacatgcgtacacgtttagatcgacgtggcccaagcccatggcggtgcccgtccaccgtttctgaacacgaaaaaatggaggcacccattatgttaccccttgaaaggacttcgtcaattgaaagagagcccaggactcttaatatcaaccaaatccaatccgctagggagttagcaatatatatattgaacacaaagaccatagaagaagcgtccagaattttcacggaggggttgcagccagtggttagtgctgcttgctgcatgagatccggcacaacaatggacatggatttgggtgaagaacttgaagtgttgaactccaaagacgcaacaacacaagtagccccagcagcagcattcagagacatagcatctgcacctttctag

SEQ ID NO: 50491 - DNA, 1059 bp, Glycine max
  Peptide Sequence Number=SeqID_167269
atggaagttgagaacttgggagtgttcagagacaccattgagcttatgtttgaagacgacgatcgcatcaccaagaccctcatcaacgttggtgtttctcgctccattgatattttggaggtttcagcaggaattgtgtttgctaagggcgttcgttgctgcttgaagtaccttgaggcggttccttggactgaggaggaagaagagaaattgaggagcctgttcacaagatttgagttcgatgatgcaacaacaagagacatcttaggaagactgtacttgaatgactcggtagattccaggccaaatgtggctcaacaacttgtttggtctatcagcacttgtgaggatgcaaatgccagaaatgaaatgaagtcactagtcaagggtcttctttgcaaaagctctgtgtatgagaagaaccatcttgacctcagcaaggaggatctatatgctgtttgtgactcgtgtttgagttcacttatcagtctctttgaggaggcatctgacaccacccctcctgaaaggttgatgaagaaggactcaaacaagcctctgattgagcgaatatcaagacaggttgacaacatcaactggttgctggaaattatgcttgatggacaagtggcagaggactttgtggatatatgggcacatcagcaacaacttcttaaaatgcatgacattgcatcccctatgatcagatatgaactcagtagagtgtcagcaatcttatttgttgcaatgggtacaagaaaactgcaatgccctttggaagctagatcagggcttctccaagcatggtttggacctatgctgttggactttggttggctgcagagatgcagaaaagggcttgatatgaggaccttggaagaggctatggggcagacacttcttactctacctttaaagcagcagtatgtgctgttcatggaatggtttcgccatttctcaaggcatggaactgagtgcccaaatatgagcaaggcattccagatttggtggcgcagatctttcttaagaggctctgagacttatgctgttgaatcaagataa

SEQ ID NO: 50492 - DNA, 704 bp, Glycine max
  Peptide Sequence Number=SeqID_167270
aactgattgggttatgcatgatcattcataggcttgaagataaggacctcgctgacaaagggattgctcaggattcctatgtagtctgcaaggtcttccaaaaggaaggtcttggtcccaggaagggggcacactgtgcgagaccatttaatgaggaagagtgggacgatgaggaaattggaataccttgtgctgctttgactgcaccagttcccatcttgcctatgacatctgatggttctgttccaaatgacaatctccctgctagtggatgtactgtgtcagcatccatatcatgtctatcaggatcactgccttctcctggtacagtaaatcctactggtccaaatgatcaagctgctaatgataatgatattttaccaatgcttgatatttttaatgacgacaaatggtttgaggaggtctataatcctggtcaggaaaacattgttgaaggtgcatcaccttcagatgatttttttgagggcttggaagactacttggctggtttctcctctggccagaatactgaattcaacacaaacggaatgcggctactacagggcttgaaagactactgggctgctctggctggtttctccgctggccagaatacaggtgatattgggaactctgataacttggacttcatagagttgaatgacctagataccccattgttctatccgatcacacaaccttga

SEQ ID NO: 50493 - DNA, 1824 bp, Glycine max
  Peptide Sequence Number=SeqID_167271
atgatgtactaccgccgagcaataaagctccaggcatttcttgatatggcttccgaacaagagatatttgatggctataaagctattgctgttccatctgaggaagaaaaaaagagtcatagatccttatatgccaatatagaggctatggctgacttgaaattcacatacgttgcaacctgtcagaactatgggaatcagaagcgttgtggcgaccgtcgtgcaacagatatcctgaatttgatggttaacaatccctcacttcgtgttgcatatattgatgaagttgaagaaagagaagctggcaaaatacagaaagtttattattctgtattgatcaaagctgtggacaatcttgaccaagaaatatatcgaataaaacttccgggtccagcaaagttaggagaaggaaagccagaaaaccaaaatcatgccatcatttttactagaggggaagctcttcagactatcgacatgaaccaggataattacttggaagaagctttgaaaatgcgtaaccttctggaagaatttaatgaggatcatggagtacgtccacccaccatactaggtgttcgtgagcatattttcactggaagtgtctcttccttggcctggtttatgtcaaatcaagaaactagctttgtcacaattggccaaagagttcttgctagaccgctaaaggttcgattccactatggtcatccggatgtttttgatagaattttccattttacccgtggaggaatcagcaaggcttcttgtggcatcaatctgagcgaggatatatttgctggatttaactcaacactaagacgtgggaatgttactcatcatgaatatatccaagttggaaagggtagagatgtagggctcaatcaaatctctctttttgaagcaaaagtggcctgtggtaatggagagcagacactaagcagggatatctaccgactggggcatcgatttgactttttccgcatgctatcattttattttacaaccgttggattttatgtcagctcgatgttagtggccatcacggtttatgctttcctctatggcagattttacctgtcattgagtggattggaggaggcaataattaagatagccaggaaaaagggagatgatccattaaaggcagcaatggcttcccaatcccttgttcaaataggtcttctgatgactcttcccatggttatggaaattggactagagagaggattcagaactgcactaagtgacatcataataatgcagctgcagctagctcccgttttcttcactttctcactagggactaagatgcactattttgggcgcactctcctgcatggaggggcaaaatacagagcaactgggcgtggttttgtagttcgtcatgagaggtttgcggacaactacaggatgtattctaggagtcactttgtaaaagggatagagattgctatactgcttatatgttatgggctttatggatcagcaacttctgattcaacatcatatgcccttctgtcattatcaatgtggtttttggcatgttcttggttgttcagtcctttcctttttaacccatcaggattcgagtggcagaagatagttgaggattgggaagattgggcaaaatggattagtagtcgaggtggtattggtgttccttcaaacaagagctgggaatcatggtgggatgaggagcaggaacatctgcagcacactggcatttgggggaggatttgggaagtcattcttgccctgcgtttctttgtctatcagtatgggattgtatatcatcttcatgttgctagaggtgacaagagcatctcg

SEQ ID NO: 50494 - DNA, 1209 bp, Glycine max
  Peptide Sequence Number=SeqID_167272
atggatcttttgctagttccttactcatcgggtcataatctgaaaataattcagtggccaccatttttgcttacgagcaagattactgtagcactggatatggcatctcagtttcgagggagggactctgatctttggaagcgcatatgtgctgatgaatatatgaaatgtgctgtgattgaatgctatgaatcctttaaacatgttctacatgatttagtgataggagaaactgaaaaaagtataatttcctctatcattaaagaagtcgagagcaacatctcaaagaatacacttcttacaaatttccgtatgggctttctaccctccctttgtaagaagttcgtggagcttgtggaaatcatgaaaaatggagatccatccaagcagggtacagtggtggtattgctgcaagacatgttagaagtggttactgatatgatggtgaatgaaatcagtgaattggcagaactcaatcaaagtagtaaggatgccggacaagtttttgccggtacagaggcaaaacctgctatactattccctcctgtggttacagcacaatgggaggaacagattaggcgcctttatctactcttgactgtgaaggaatctgctgttgaagttccaacaaacagcgaagtacgcagaagggtttcattctttaccaattcattgttcatggatatgccacgtgctcctcgagtacgtaaaatgctctcattcagtgtcctaactccatactacagtgaagagactgtatactctaagaatgacattgaggttgagaatgaagatggtgtgtcaatcatatattaccttcaaaagatcttccctgaggaatggaataacttcttggagcgacttgagtgtaagaaagatagtgatatatgggagaaagaggagaatatattacagctacgtcactgggcctcattaagaggacaaacactttgtaggacagttaggggaatgatgtactaccggcgagcaataaagctccaggaatttcttgatatggcttctgaaaaagcagagatattcgatggctataaagctattgctgttccatccgaggaagaaaaaaagagtcatagatccttatatgcccgtttagaggctatggctgacttgaaattcacatatgctgcaaccgacagcaatatgggaatcagaagcgctctggagaccgtcgtgcaacagatatcctga

SEQ ID NO: 50495 - DNA, 216 bp, Glycine max
  Peptide Sequence Number=SeqID_167273
atggacaacataagattcaccgcacctttcagagttcagaagacacttcctgcagcagcttccaaatttgtctatggctcaaaaaaaagtattaccatccaccacggacttccaaaatccaccaaatggccactcagcattcacaatcacatgccagctattacagaaccatggttcaacctgattcatgaaaaaaatttgagacccagagatgag

SEQ ID NO: 50496 - DNA, 759 bp, Glycine max
  Peptide Sequence Number=SeqID_167274
atggagattgatttctcatatctcaaactcaaccaacaggttaatgaacttttagaaattctagctccttgtatttcccatggactcacagcacttgcagttcagagttcacgactttcaggcaatctgacagatcatattggggcatttaaaaatattgacacgttacttttttccaacgactcaattggtggtgctcttcctagatcatttggaaaactttcatcattaacatatctcgatctgtctattaataaattcagtggaaatccatttgaaagtcttagatcgctttctaagatgtcatctcttcagattgatggcaataattttcaaggagttgtcaaggaagatgatcttgcaaatcttacaagcttgatggagtttcatgcatcagggaacaatttcactttaaaagttggtcccaaatggcttcctaattttcagctttcctatttggatgtgacatcatggcagttaggtcccaactttccatcatggattcagtcacaaaaccaacttcaacattttggactgtctaacacggggattttagattctattcccacctggttctgggaagcactttctcaggacgagccaatgcaattaaaatttttgaatcttgcatcaaataatttgtcaggagagatacctgattgctggatgaattggacatttcttgcggatgtaaatttacaaagcaaccattttgttgggaacttaccccaatccatgggttccttggcagacctgtag

SEQ ID NO: 50497 - DNA, 465 bp, Glycine max
  Peptide Sequence Number=SeqID_167275
gggaaaggaaaacctttccatttggggtcaagtgtggccagtgcaaagtatgcaaatgcgcaatggatgacacgtcgattaaggattctagcatggacaacatgtggtcatggctattgtgcccgagatgtggggccattgggcttgtgagggagaagaagtcttcgtgtatgaactctcctcaaagattggatgatcacatagagtggtatttgggaaatgatcgtatggagggaccatccttgggcgtatggcaccaagttgtggctttgagtcacaccccaacttggcaaccccaactaaatgtgagacattatcttgttggtgagagcttgccattgtatcatggtgagggattgaatggagtggctacgttaagcactaccactgaagatggacttgcttatggaagaagaaccttccgaggatatctcatgattttagacgagtatttaatgggttatg

SEQ ID NO: 50498 - DNA, 811 bp, Glycine max
  Peptide Sequence Number=SeqID_167276
gatcgtcaagacactcaacgatgctggcttccccgccggtgtggtcaaggtgatttccaatgcccctgaggacgcgccggaaattgtggcggcccttgttgctcatccgtccatccgccgcatcaacttcaccggctccacccatgtcggcaagatcatcgccaaacaggccgcggagcatctgaagcccgtgctgctggaactggggggcaaggcgcccttcatcgtgctggaggatgccgatctcgatcaggcggtcgatgcggcagcttttggcgctttcatgaatcagggccagatctgcatgtccacggaacgctttatcgtgcatgagaaggtggcggatgcctttgcgcaaaaacttgccgccaaggcaaaatcccttcccgccggtgatccgcgcggcaatgtcgtgctcggttcgctggtcgatctcaaatccgccgagcgcatggatgcgctcatccaggatgccgtgtcgaaaggcggcaaggttctggcgggcggcaagcgcgaaggctccatcgtcgatgcgacgatcatcgatcacgtgacgccagacatgaacatttatacgcaggaatccttcgggccggtgaaacccatcatccgcgtccgggatgccgatgaggcgatccgcgtggccaatgacaccgaatatggcctttcatccgcgatcttcagccaggatgtgaaacgggcgctggcgctttcgaaaaagcttgcgaccggcatctgccacatcaatggcccgacggtcgcagacgaagcgcagatgcccttcggcggcgtgaatcttccggctatggcc

SEQ ID NO: 50499 - DNA, 1206 bp, Glycine max
  Peptide Sequence Number=SeqID_167277
atgatgctggcccaactgcccgccggtttgccctggatccaggccggcccgagctgctgcagcttatccagcacctgttggcgcatgcgctggcggatcacctggccacaccggaaaccgacccgttcccgcagccagctcaacagcgcccgcagcgcgaacgcggcggccagccagataaacgaagggatcagctgttcgcgcggggtatgctcgatgatcagggcgtgcagcaggctggccaacagccacgcttgcgccacgatcagcaggccgctgaacagccccaacagcatggaaaggcgcagccaacgctgcgctaacgaactctgggttttaagccaacggatatgcgtctgcgtcgccggcgccctgtttggcgcaatcggcgacaaacaagcgaggccccatgttacctcgtcacccggcagactgaaaataataaagcggccaaatgtggctataacagacgcgagaaggggagtgcggaggggggaaacaaaaaaagcggctcgagagccgctttttgctgatgaagagaacgttttagcagacttctgcgccggcgatgccgtccaggtaacgctccgcgtccagcgccgccatacagccggtgccggcggaggtgatcgcctggcgatagatgtgatccatcacgtcgcccgcggcgaacacgccggggatggtggtttgggtcgcattgccgtgaatgccggactgcaccttgatgtagccgttttccagctccagctggccgccgaagatgccggtgttcgggctgtggccgatggcgatgaacacgccggccagttccagttcacgggtttcgttttccgctttggtgctgcggatacgcacgccggtcacgcccttttcatctcccagcacttcgtccagcgtatggtcggtgtgcagcacgatgttgccgcttttcactttttccatcagccggtcgatcaggatcttctccgagcggaagctgtcgcggcggtggatcaggtgaacctcggcggcgatgttggacaggtacagcgcttcttcaacggcggtgttgccgccgccgaccactgcgactttctggttgcggtagaagaagccgtcgcaggtcgcacaggcggaaacgcctttgcccttgaaggcctcttcggaaggcaggccaagatagcgggcggaggcgccggtcgcgatgatcagcgcgtcgcagct

SEQ ID NO: 50500 - DNA, 657 bp, Glycine max
  Peptide Sequence Number=SeqID_167278
atggatcacatctatcgccaggcgatcacctccgccggcaccggctgtatggcggcgctggacgcggagcgttacctggacggcatcgccggcgcagaattcgttagcgcagcgttggctgcgcctttccatgctgttggggctgttcagcggcctgctgatcgtggcgcaagcgtggctgttggccagcctgctgcacgccctgatcatcgagcataccccgcgcgaacagctgatcccttcgtttatctggctggccgccgcgttcgcgctgcgggcgctgttgagctggctgcgggaacgggtcggtttccggtgtggccaggtgatccgccagcgcatgcgccaacagggcaaaccggcgggcagttgggccagcatcatcgtcgagcagatcgaggatatgcaggactattactcgcgctatctgccgcagatgtatctggcggtcttcatcccgctgctgatcctgatcgccgtcttcccgatcaattgggccgcaggcatcattctgctggcgaccgcgccgctgatcccgctgttcatggcgctggtcggcatgggggccgcatacgcccaccgccgcaacttcgtggcgctggcgcgattgagcggcaacttcctcgaccgcctgcgcggcctggacaccctgcggct

SEQ ID NO: 50501 - DNA, 483 bp, Glycine max
  Peptide Sequence Number=SeqID_167279
atggataaattgttgatgcaattcatggaaacaactaaatcaactcaacaagcactccaaagtgtagaaatccaggttggtgagctggcagaagcagtaactcaatttatgtccagacgagaaaaatcctttgtagaggctgaagctcaagagaaaagccctataaaagagcatgaatcaagagaaaaagatgaggagaaagatgatgaacaaacacaacaacaatgggagaagtactcaacagtagaaaaccaacaaggaaatattctccaaagcaataaccttcctcatcaactgattgacaagaaaggaaggcaaggagagcatgaggaaaccttaagtgccatactttctttaataactaacacatttcttgaaatgatttggaatgtccttccagattatatgaagttcatggaatttctagctaaaaggcgaaacttcaaggaagatgtgttctttgtgactttcatgccaccttaa

SEQ ID NO: 50502 - DNA, 687 bp, Glycine max
  Peptide Sequence Number=SeqID_167280
cacgccgcgcgatttcaggccggatcgtcgccgtgcaggccgtgctcgacggcgtagaccgcgacctgcacgcggctggtgaggttcagcttcttcaacacgttctgcacgtggatcttgaccgtgctttcgctgacgtcgagttcgcgcgcgatgaccttgttgctggcgccgcgcgccaggcactgcacgatctggcgttcacgcgccgtcaggcgatggcgttcggcctggccggccggcgcctgcgcggccaggctggcctggccgcggaattgttcgaccagcttggccgtcatgctctcggcgatgacgggttcgccggccgcggcgcggcggatggccgacgtcagggcctcggcgtcgatgttcttgagcagatagccgcgggcgccgtcgcgcagcgcctggcccagctcgtcggcttcttccgacacggtgaggatgatcaccgcacaggaaggcagatcctgcgtcagcagttgcagcgtctccagccccgacaggcccggcatgttcaggtccagcagcaccacgtcgggcttgagttccttggcgcgcttcaggccttcgacgccatcgccggcctcggccacgatctcgaaatcgggctggcgctgcaacagcaggcgcatgcccgaacggaacagggtgtggtcatcgacgagcaggatacggatgggcatg

SEQ ID NO: 50503 - DNA, 207 bp, Glycine max
  Peptide Sequence Number=SeqID_167281
atgattttagttaaagagagaaagctgttggagttcatgtgtatggtcaagagggaggctggcaccgacagcttcaatgctgaatttccaccgacgcatgcaaagaagggtcggggcagctccaggaagcgtcgcaacggtggataccgccggggctccacgtcactgccggacgtcacgacgatctttggcgggttcgacgggatg

SEQ ID NO: 50504 - DNA, 429 bp, Glycine max
  Peptide Sequence Number=SeqID_167282
atggctgcaatatctgtattagatgcactgtgtttaatggtccttggaaaccaggaggtggcccttccaatttatgatgtaacccggcgagatacatttacaaatctttctgaaatatgggcaaaggaaatagacctttattcaactaatcaagattgcatcaagatgcttgttggaaacaaagtagacaaggagggtgatagagttgtgacaaagaaagagggaatagactttgccagggaatatggttgcctatttattgaatgcagtgctaaaactcgagttaacgttcagcaatgcttcgaagagcttgttttgaagattttggatacacctagcctcatagccgagggctcaaagggtgttaaaaagaacatttttaaggagaggccaccccagtctgatgcatccacaagtagttgttgctga

SEQ ID NO: 50505 - DNA, 2001 bp, Glycine max
  Peptide Sequence Number=SeqID_167283
atgccggcttggtggaatagaaagtggagcaagagcaaggaggaggatgaggaggatgagccacgtgccggttttcacttgaattttatgaaatctccggtttctgttacatcgtctaagagcaagagtaagaccacgacgccgacgccgatgaagaagaagaagaagcccaagagcttcgacgagaaggtggagggtgttcccttgcctcgtccggcgcatagtcacgccgatcctcttggatctgtttcggtgtcggggggttccagcgtcagctcctccacctccttcgacgatcatccaatttcgtctcccaacaccaaccccaaccccaacaggaaattacagacaaatgcggctgatgtcgtcacgaagaggccaaattccttgacctcgcgaatgaaatcatggttgtggaccatttttgaaaccttgttttttaggaattgtattctaggaggacatgatgaggttagggtcaatgtaaggtcaaaaagtccgggtcctgggtcaagaggacctaccagtcctacctcaccgcttcatcaaaggttgaataatttgagccttgactctcctacggggagtcagtgtcatccattacctcttccacctggctctccaactagtccttcttctgtgctttccaacgcacgagcaaatgcacatttggaaaatgctactagcaatgtgtccaagtggagaaaaggaaagcttctaggacggggaacatttgggcatgtatatctgggattcaatagattgtgtattcgcctcaatgtctatattctggacagattactgaaacccatttcttttccgcttcctatgtttgacagtgaaaatggacaaatgtgtgcaataaaagaggtcaaggttgtctctgatgatcaaacatcaaaagagtgcctcaaacaacttaaccaggagataaatttgctaaatcagctttcacaccctaatattgttcaataccatgggagtgaactggtagaagaatcactttctgtatatttggaatatgtctctggtggttctatccataaattacttcaggagtatggttcatttaaggagcctgttattcaaaattataccagacagattgtctctggacttgcctatctgcatggaagaaatacagtacacagggatattaaaggggcgaacatactagttgatcctaatggtgaaatcaaactggcagactttggaatggctaaacatataaattcttctgcctcaatgctttcattcaaaggaagtccatactggatggcacctgaggttgtaatgaatacaaatggctatagtcttccagttgatatatggagcttgggatgcacaattattgaaatggcaacatcaaaacctccatggaatcagtatgaaggggtagctgccatatttaaaattgggaacagcaaagatatgcctgaaatccccgagcatctttcgaacgatgcaaaaaatttcatcaagctatgcttacaaagagacccattagctcgcccgacagcccataagttactagaccaccccttcattcgagatcaatcggcaacaaaagctgcaaatgtcagcataaccagagatgcttttccttgcatgtttgatggaagccggacaccgcctgtgttagagtcccattccaaccgaacaagtataacttctcttgatggagattttgcatcaaagccagctcttgcagcaccacgagcattaaggagtcctagagataacacaagaatgatcacatctttaccagtatctccctcttcaagtccattgcgacggtatgggccaacgcatcagagctgttttttctctcctcctcatccagcttacacaataatgggacaaagtagttacactttgaatgacatatcatcatatccaatgacatcaaatgccacgtttgctcttgatccttggcatgaaacatctcgatacagagccaatacaccacctggtggatctccaagaatgagactcatttga

SEQ ID NO: 50506 - DNA, 216 bp, Glycine max
  Peptide Sequence Number=SeqID_167284
atggcgataaactcaacctttacctctaagtgggctcatgttttgggtctctacgggaaaagagaaagctacaatacaaagggaatctttatcacctctgatgacattgtttcgcaaattctaatggtgagaatgttcagagatgagttccaaacctggtgctcaaatttcttgatgatccaacggttaacaagtttgagatcgtcattttactag

SEQ ID NO: 50507 - DNA, 306 bp, Glycine max
  Peptide Sequence Number=SeqID_167285
atgaagaggaaatccagaacaaccaaaaacaaagatttgagattgggaaatctagaggcaagatctggtgcggcgctccctgaatcgcagttgttctcgtcgctgctctctcggtggtttgaagaggtgacggcgtttccggttgaaactatggttttgggatttggggaagaaggagatggtggaggtcagggaggaataaaaaagccgcagcgaacagtgacgggtaagattgttggggaaggttgcggatccagtataaactgtctcatagtaataaataaatccaacggttcaaaattataa

SEQ ID NO: 50508 - DNA, 3858 bp, Glycine max
  Peptide Sequence Number=SeqID_167286
atgataacaacagaagggatatggaataatgatgaccctttgaaatattctctccctctcttcatcctgcaattaatgttgattgtcattgtcacccgtttatttgtcttcatactcaagccccttcgccagccacgcgttatctctgaaatgttgggaggcatattattgggtcctacgtttcttgggaaaaacacagtattttttgatgcagtttttccttcaagaagtaggatgttgattgaaacaatgtcaaacgttggtatcctatactttatgttcttggtgggagtggggatggacgcatcagcattaagaaacataggtagaaaagcagtggccatagcaattcttggcatgatcttgcctttctcattaggagctttatttgcctcctttcttatcagactcagcgaagaagatagcagaagtggcgcctacatcatattccttggtgctattctctctgttgcgtcatttcccgttcttgccagaatcctcgccgagctcaaattcatcaacacagagttaggaagggttgctctttcatctgcgctcgttaatgatattatttcttggatgctcttgattgcgtccattactatggtagagaatgagaagccttctctgtctatcttgatggttttcggttcatgtgcagcgtttattgcttttaatatttttgctgtgagacctctgatcttgttgataataaggaaaaccccggagggtgaagcattcagtgatttctatatttgcctgatactatcaggtgtcatgatctcaggtctgatcacagatgctattgggacacatgctatctttggagcatatatttttggtttgacaatcccaaatggaccactcggactcactcttgtggaaaggctcgaggacttcatctcattacttttgctccctctatttttcgccactactggcctcaggactgatcttggactcctcagagggttctactcatgggctattttgatcagtcttattgctttgtcttgcattgccaaaatcgttggaactatggtcgctgcagtctattatcaaatgtcaattcgtgaaggagcagtccttggcttgctcatgaacacaaaaggcgttattgaagttattgtgcttaacattggcaaggatcagaaggttttgactgacgaatcatttgcatcgatggtgattataaccttactaatgactggtataattgtacctgggatatcagctatatacaaaacatcaaaggggatcataccttacaaaagaagaaatattcaaatgtctcaaacagacacagagttcagagtcctggtgtgcatccacagccctcgaaatgtgccaacaatgattaacctccttgacgcctctaacccaacaaagaactctccaatatgcatttacgtgctccatttgaccgaactcgccggccatgcatctgcattactcgttgttcacaatcaatacgggaagaaatcagatcaaattggcaatggaggctacaacagaactcaagctcaatctgaccacataatcaacgcctttgaaaactatgtgcaacaagcttcacacatctcagtgcagcccatgtcagtagtctccccttactccaccatgcatgaggacatatgcaatgtggctcaggacaagcgtgtggccttcatagtcgtccctttccacaaacaacaaatggttgatggcggaatgcaggatatgaacacgtcgtttcgcaccgtgaaccgaaatgttctgaccaaagcgccttgctcggttgggatccttgtggatagaggcttcaatttctgcaaccatttggctccagatcaaaaggctcaccatgtggcagtgttgttctttggagggcctgacgatagagaatccttgagctatggatggaggatgtcagaacatcaatccataaacctcactgtgatgcgttttgttcatgaagaagaagtgatgcattgtcatagtcatagtggcggcgaccgtgatgatgaaccaagtgtactaacagtgaaaacggataaggacactcagaagcaaattgatgagaagtttatacattggtttatgacaagtcatgcagatgatggtggttcagttgtttatgttgagaaaagggtcaacaatggggagcagacagtggcagcaataaggtcaatggatgatgtgcatggccttttcatagttgggagaagctatggaattagttcaccactcacagcaggattcactgattggagtgagtatccagagttaggggcaattggggacttgttagcttcatcagattttgcagccactgcttcagtgttgatagtgcaacaatacgttggggaagggatagaaggagatcatgttgtcaaaggaaatattaccgcattgggacttggtgctggtgatggtgtctcttctgaatcggttgtagcaatatcgtcagcaagtggtgctgggggacttctccgaataatagttgtaggtgctggagccagagaaagtgctggtgctggtgttggcgtttcaatcgctggcgttggtgctggtgtcggtgtgttacttagtggtgctggtgctggtgtttctttggctggtgttggtgctttggatggtgttggggatacttttggagtaggcaatggtggtgcatcagctggtggtaatggcagtggagggggtgaaatgggagctttcttgggtgggattttgggggatgggggttttggacttaatgctggtgtaaccttggggactggtggcttcacaggagcaatttttggaggcaaagttttgggaacaggtggtttcaccggagctatttttggaggtgtagttttgggaactggtggtttcagtggagtggaggttggtggtaaagccttgggaactggtaatttaactggagcagatgatggtggtaaaggcttggtatcaggtaatttcacaggagcagaagttggagttgtaactttgggcactggtaatttaacaggagcagatgttgttggagatgtagcttttggaagtggtgatttcactggagcagatgttgttggagatgtagcttttggaagtggtgatttcactggagcagatgttgttggagatgtagcttttggaagtggtgatttcacaggagcagatgtagttggagacgtagcttttggaagtggtgatttcacaggagcagatattgttggagatgtagcttttggaagtggtgatttcacaggagcagatgttgttggagatgtagcttttggaactggtgacttcacaggaacatatgatgttggagatgtggttttaggaactggtgatttcacaggagcagatgatgttggagatgtggcttttggaactgtgggggaagctgcagttggcaatttggagggtgcagctgttgttgttggagtagaagtgggagaagttgctgctgttggtggtttctttgaggtggaaggagttgcagccacaacgggttgttgtttggctactgatggtttgctagaagagggggaagttgctgttggcaatgttgagggtgcagttggatttgtagttggcaatgttgagggtgcatttggagttgtggttggcaatgttgagggtgcaactggggttgtggagggcaatgtagagggtgcatttggcgtggttgttggcaatgtagatggtgcatttggggttgtggagggcaatgtagatggtgcatatgtggttgttgttggcaatgtagaaagtgcatttggggttgtggttggcaaattggagggtgctgaaggggttgaaggttgccaattggagggtgtacctgttggtgcttgggcattgattgtggctagcgggtag

SEQ ID NO: 50509 - DNA, 618 bp, Glycine max
  Peptide Sequence Number=SeqID_167287
atggcttgtggaagtgtcaaccttcctcctggcttttgcttctctccaactgatgaagaactcgtccttcactttctctgttccaaggcttctctaccatgccatcccaacatcattccagagcttgacctctctctgcttgatccatgggaattaaatggtaaggcgttgtcaagtggaaatcaacactatttcttcaccaaagtgaaggagaacagatccacagaaaatgggtattggaaggaaataggagtcatggaaccaatagtatcctcttctgaaaaagtggggatcaagaagtaccttgtgttcaaccttggtgaagctccacaaggcactgaaaccagttgggtcatgcaagaatatcatatttgctcatccgggtttaacactactactgcatctaattgtgcaagtactcgcggaagacgaaaaactgatcaatgtgggagcaaatgggtattgtgcaaagcctatgaaaagaaaagttgtcaatcccaacaaggtgtaaattgttacagcgatgaggatgactgcggaactgagctttcatggctagacgaattttatatgtcgttagatgatgatcttgaagaagttatgagcctgcctagctaa

SEQ ID NO: 50510 - DNA, 669 bp, Glycine max
  Peptide Sequence Number=SeqID_167288
atggcgtttgaagactttgatcctatcttcagtaaacccaaagtgaagtgggattctgaaagttgttcttcctcgtgtccctttttccttcatgcctatgcccctgattcttctcaccttgtaattcatgtcaccaatatctacgatgcctgggaaactcgtctttcgctctccatgcttgaggacattagggatattgttggtatagggggctcttggtcagactttgccgattattttctaacatccctcaagtcacaagatcttaagctggttctagagccagattcaaattctgatggtgttagtcatgtgaaattagtagctcagaaatcaaaagggatgcctttgatcaccattcctctcaccaaacttatggactccgctgctatggaggttaagttaaatttttgttcgagcctctttgaggcatttgaaatcaaaagcacagagtgttctcttgaaaaagctaatatgaacactctttctatacctatcaggaaagaaatgaagccatacaactggaacagcgacaaaagtttcaaaagattagcaactcagagaatggcgtttctactgatggattgcaaaactctccaggttttaccaacttctctgtggtactatggtatacatggtgagcttgtgagtaaaatgtctcaaggctga

SEQ ID NO: 50511 - DNA, 159 bp, Glycine max
  Peptide Sequence Number=SeqID_167289
atggttttggactcagctactgacagtaaaacaatgtgtggctccaagggacttagctgcaaagacactcagctatacactaaacatagcttaacttccgtggcgttgccaattgccaatagtaactgcaaaacgaaggatgctaaatcagcactgtaa

SEQ ID NO: 50512 - DNA, 1950 bp, Glycine max
  Peptide Sequence Number=SeqID_167290
atgatgcaaggctgtgaggttgatgccattggcataaactacacgatccacacacacaaatcggagcacccttttaaaatcttcagcaacaaatctgcacatcttgacactgaacaagatggtaaagagccagaagaggaagcagaagttgaacaaagttgcagtggagtaaggcatgtgctgaagaatgtgagtttccaagccaagccatgggagatcctagcaattgttgggccaagtggagctggcaaatcatcactgcttgagattcttgctggtaaacacagccctcaaagtggaactgtgtttctgaaccacaagcctgtagacaaagctcagttcaggaagctttcagggtatgttacacaaaaggacactttgtttcctttacttacagttgaagaaaccctcatgtttagtgcaaagctgaggctgaagctttctcaagagcaactttgctccagggtcaagtcactgattcaggagcttggacttgacaatgttgctggcactagaattggtgatgatagggtccgaggcatatctggtggtgagaggcgcagagtctccattggtgttgaagtcattcatgatccaaaagtgctgattcttgatgaaccaacttcagggcttgacagtacttcagctttgcaaataattgacatgcttaaggtcatggctgacacaagagggagaaccataatccttagtattcaccaacccgggttcagaatagtgaagctgttcaattcattgttgctgttggccaatggaagtgttttgcaccacggaacagctgatttgcttagtgtgaatctaaggctgatgggtctggagcttcctcttcatgtcaatgtagttgaatttgccattgagtccattgataccattcagcagcaacagaaatgtgtgccagttcaggtagaaactccaaggcaactgccagggacaatacaacagaagaaaggtggtgatggtgaagcaggtgagggtaggaatggtaagctcactttgcaacagctctttcagcaatccaaggtaattgatgaacaaaccatgtatgctggaatggatttcactagtgagtttgctaattctagattgagagaaactatgattctcagtcataggttctccatgaacatattccgtacaaaagagctatttgcatgcaggacagttcagatgctggtttctgggctggttgtggggtccatcttttgtaaccttaaggatgatctagagggagcttttgaaagggtgggtctatttgctttcatattaacgtttttattgtcaagcagcatagaagctctaccaatttttctgcaagaaagggagattctaatgaaggagacatcttgtggaagctatcgtgtgtcatcctatgctattgcaaatggcctagtttacttgccatttcttctcatcctagccattttgttctcaatgcccttgtactggcttgtagggctcaaccggaacttcttggcttttttgcactttctgttgctgatatggctgattctttacacggccaattcagttgtggtgtgtttcagtgctctggtgcctaattttattgttgggaactcagtgattgctggtgttatagggtcattcttcttattctctggatacttcatatcaaaacaggaaattccaaattactggattttcatgcattatatatccttgtttaagtatccctttgaagggttcctgatcaatgagttctccaactcggggaagtgcttggaatacatgtttggggcatgtataaagagcggagaggatgtgcttaaagaagaagggtacgggggagagagtaatagatggaagaatgttggggtcactgtgtgcttcatcttggtttacaggttcatttcttatgttattcttagatacagatgttcccagaggggatttggcagggttgtcaccaactaa

SEQ ID NO: 50513 - DNA, 232 bp, Glycine max
  Peptide Sequence Number=SeqID_167291
atggccactggtggagaagagagcccagaggttcaaaatgtgggatgggaatatggtctggtaaaaccacgtggagctattcgtccagatggctgggcttacagatttcccaagactaataccactatcttatattattggtcggctagcttatgtgatctgcagccttttaacatcacagacaaacagaccaatgacaccactggaaccgggggaagcttaatgcgaacag

SEQ ID NO: 50514 - DNA, 354 bp, Glycine max
  Peptide Sequence Number=SeqID_167292
atggctttgtgttcagtttttctcaatcttcatcttctgctttttgtttctttgaccatagaagcattaggtgtggcaaagcctttagtagctagttaccttagccaggagatactggcagagcaagaagctgatagagtgcatggattacttgcgcagcctccggtgaagttcaacaatatggtggttatatcactatcaatgaaactccaggaagagcactgttctattggggttgtgattgtgatcaagcatttaatttttcttgatgtcaagaatcacaaaccagaaggtctggaagtgagtgcagtaggagtaaacattgataatcacataaatgaaggcggtggctga

SEQ ID NO: 50515 - DNA, 207 bp, Glycine max
  Peptide Sequence Number=SeqID_167293
atgaggcacagagtggaagtgtcgggtgtttcacaattgcagatccactgcgttgtaggtggaaaagacgaagttagccctgcacttgaagaagaagaagaagatggtcgtggtggtgatgatgctattgttttactggttctgtctcattcattattcacgacaccgccacggatccaattaaaagatgccgtgtttggtcgatga

SEQ ID NO: 50516 - DNA, 621 bp, Glycine max
  Peptide Sequence Number=SeqID_167294
atgtggtttgctaatgacacacaattggacatcgacatcatcaccacaattcgaaagaaatgggcaacattttttttaaagacaacaataactatagtaccaccaagcttgccactgcagcagttaagtgaacaaatgaagtgtcgacagtcattggatggttgcttggtagaggctcctgattttcagtttcctcagacttgtgctgtcatgtgcgataagcaacatgctccctgctatgacatttgtcatggctgctattttcaggtgattggaactgtagtaacacttgctggggccatgttgatgacattgtacaaagggcaagtaatcagtttcttggggtctaagtacatgcatcacccaacaaactatgtacctaaaaacaacactgattctggtgaaaaggattggttcaagggttctgttcttctcgcagtgacattaaggaaataccctgctcaactctccctcacagcacttccctttgatgatgattatcgtagccatcatgggtgccttcatccttgcagaaaaaatatatcttggaggctgatttcaggggtcattagagctattctcatagtaatgggacttcactctttcaggttggagcagtag

SEQ ID NO: 50517 - DNA, 108 bp, Glycine max
  Peptide Sequence Number=SeqID_167295
atgctggattccgtgattgaggttggtgcgacaagggtgatggtgaagtgcggcgagagtgacaacggaaataggagtagtgggggcaagatacgcgggttagactaa

SEQ ID NO: 50518 - DNA, 192 bp, Glycine max
  Peptide Sequence Number=SeqID_167296
atggaagaaaggcttctcgtgagtgatagtgttgatgagagacagaggtccccatggcagcccgttcatgttcattcctctaattctctaacatgtttcatggagttaaatatggtgttggtggatgagagcttgggagttgagaggcctttgatagggaaaaggaagaagttgaaaatgtcaagattttag

SEQ ID NO: 50519 - DNA, 991 bp, Glycine max
  Peptide Sequence Number=SeqID_167297
atggctactaccacattctgtacatacctattccttcttctctctgtgtacctctcaatcttcataaatcttagttcatcttcatcagagggtgatattcttctctccttcaaggcctccattgaagactccaagaaggccttgtcaagctggttcaacacttcctcaaaccaccactgtaactggactggaatcacttgctccaccacaccttcactctcagtaacttctatcaaccttcaaagcctaaacctttctggagatatctcatcttcaatatgtgaccttccaaatctgtcttatctcaaccttgctgacaacatcttcaaccaacccatccctcttcatctctctcagtgtagttctttggagactttgaatctcagcaccaacctcatatggggcactatcccttctcagatttctcagtttggttcattgaaagtgcttgatttgagcagaaaccacatagagggaaacattcctgaaagcataggctccttgaagaacctccaagttctcaacttgggaagcaacttgctttcaggtagtgtacctgctgtctttggaaatctaaccaaacttgaggttcttgatttgtctcagaatccatacttggtgagtgagattcctgaggacattggtgagcttggaaatctaaagcaacttctgttgcaaagctcttcttttcaaggtggaattccagaatctctggtgggccttgtcagcttgacccatttggatctctctgagaacaacctaacaggtggggttacaaaggctctacaaccatcttctctcaagaacctggtttcattggatgtttcacaaaacaagcttttggggccatttccaagtggcatatgcaggggacaaggccttattattaacctcagtctccacacaaatgccttcactggttcaatacctaattccattggtgaatgtaagagccttgagaggttccaagtccagaacaatggtttctctg

SEQ ID NO: 50520 - DNA, 1480 bp, Glycine max
  Peptide Sequence Number=SeqID_167298
atggctactaccacattctgtacatacctattccttctctctgtgtacctttcaatcttcattaatcttagttcatcttcttcagaaggtaatattcttctctccttcaaggcctccattgaagattctaagagggccttgtctagctggtccaacacttcctcaaaccaccactgtaactggactggaatcacttgctccaccacaccttcactttcagtaacttctatcaaccttcaaagcttaaacctttctggagatatctcatcttcaatatgtgaccttccaaatctgtcttatcttaaccttgctgataacatcttcaaccaacccatccctcttcatctctctcagtgcagttccttggagactttgaatctcagtaccaacctcatatggggcactatcccgtctcagatttctcagtttggttcattgagagtgcttgatttgagcagaaaccacatagagggaaacattcctgaaagcataggctccttgaagaacctccaagttctcaacttgggaagcaacttgctttcaggtagtgtacctgctgtctttggaaatctaactaaacttgaagtccttgatttgtctcagaatccttacttggtgagtgagattcctgaggacattggtgagcttggaaatctaaagcaacttctgttgcaaagctcttcttttcaaggtggaattccagattctctggtgggcattgtcagcttgacccatttggatctctctgagaacaacctaacaggtggggttccaaaggctctaccgtcttctctcaagaacctggtttcattagatgtttcacaaaacaagcttttgggggaatttccaagtggcatatgcaagggacaaggccttattaacctcggtctccacacaaatgccttcactggttcaatacccacctccattggtgaatgtaagagtcttgagagattccaagtccagaacaatggtttctctggagatttcccccttggattgtggtcattacctaaaattaagctcatcagagctgaaaacaacagattctcagggcagatacctgagtcagtttcaggagctgttcagttggagcaagttcagcttgacaacaacagctttgctggtaaaattcctcaaggtcttggccttgtcaagagcttatacagattttctgcttctctcaaccgtttctatggtgaacttcctccaaacttttgtgactctcctgttatgagcatagtaaatctctcccacaattctctttctggtgaaatcccagagctcaaaaaatgcaggaaactagtttcattgtctttggctgacaacagtctaacaggagacataccctcttcccttgctgagctacctgtgcttacttaccttgatctttcacataacaatctcactggttcaatcccacaagggcttcaaaacttgaagcttgctcttttcaatgtgtccttcaatcagctatcag

SEQ ID NO: 50521 - DNA, 800 bp, Glycine max
  Peptide Sequence Number=SeqID_167299
ctgtgaagaagttggttaattttggaaaccagtcctcaaaaagtttgaaggctgaggtcaagactttggcaaaaatcaggcataagaatgttgttaaaattcttgggttctgccactctgatgagtcagtgtttctcatttatgaatacttgcatggagggagcttagaggatttgatttctagtccgaattttcagttgcagtggggaattcgattaagaattgccattggagttgctcaaggactggcatatcttcacaaggattatgtccctcacttgcttcacagaaatgtcaagtcaagtaacattttgttggatgcaaactttgagccaaaactcacagattttgctcttgatcgagttgtgggagaagctgcttttcaatcagttttgaactctgaagcagcatcttcatgttacattgcaccagaaaatggctacactaagaaagcaactgaacaattggatgtctacagctttggtgtggtattgctagagctagtgagtggcaggcaagcagagcaaacagagtcaaatgactcacttgacattgtgaagtgggtcagaaggaaagtgaatatcactaatggggtgcaacaagttcttgaccctaaaatatcacacacttgtcaccaagaaatgattggagctttagacatagcgcttcattgcacttctgtggtgcctgagaaaaggccatccatggtagaagttctaagaggccttcactccttggagtcaagaacttgcattgcaaatttgcatgaaccaaatgaggaaccctccattccagtctga

SEQ ID NO: 50522 - DNA, 234 bp, Glycine max
  Peptide Sequence Number=SeqID_167300
atggtggaggatgcacaaacagcgcttgacagtcaattcatggggctccggactcgatggatgcacgaacaacgcttgaaaatcaattcgtggggctacggactcgatggtggaggatgcatgaacgacaatcaattcatggggctccaaataagatttgatgatggaggatgtacgaacagcgctaggcaatctattcgtggggatccggactcaatggtggaggatgcatga

SEQ ID NO: 50523 - DNA, 972 bp, Glycine max
  Peptide Sequence Number=SeqID_167301
atgggttttttgctgatgaagcaatttacgctggcttcggttgccggcctggtggaatctctgcgctttgcggcggatgaatccttctccagccggcagattttttgccagtgggagtggatgacctgcgacgatcggccggtcactgccagctgcggtttgccggtatcaccgactgcgaagctcgatttttccagagactgggactatttcgtggtcgctggcggattgctagaagagactcgcaacccgccagaatggttgttacaggcgctgcgggatctgcacgcccgcaatattccaatcattacgctgtgcagcggagcgttcgttgccggtaacgccgggctgctggataatcatcactgtgcgatccacttcactacccgcgacgagtttcggcttcgttttccaaaagccattccggtaatcgacaaaacctatattaaagacggcgggattatctcctgtccgggcggcatggcaattgacctggcggccgatctgatccgtcagcattgcggcctggtacgctcgcagaaggtactgaaatatctactgatggacgcgccacaacctgccggaaagacgaagcagaaagccccgcttaatgcgccggatgtgtatgagaacgaacgggtcagtaaggtcattgaatttatgaaacagcaccttgattcaccgatcccgctcgccgacgtggcggattttgcgggtgtgacctttcgtcagctcaatctgatattcaccaaatgcactggccactcagcagccgtttactggcgcagtatgcggttggagcaggcgcgaaagctgatggccgattcaagtaacagtattaacgaaattgccaccgcgaccggattttcggacgcgtcgcatctcatttcgtggtttcgtaagcaatacggtgagacaccgagttcgttccgcaagcgacgcagggaagtggaaaagttggtgaaggagtaa

SEQ ID NO: 50524 - DNA, 897 bp, Glycine max
  Peptide Sequence Number=SeqID_167302
cgcgcagaaccagtcgctcagcctgccaaaaaacgaagcgcacaagctgaaggcgcagtacgtaatcaataccgcacggctggaagcgccgattggcaaagggcagaccgtcggcgagatccgcatcagcgacaatggccaggtggtgaaaaccctgccgctggtggcgctgcaggcggtgccgcagggcggcgtgttctcgcgcctcgcggattacgtgaagctgaagctctgactcaccgggcgggcgacggcgcccgaacgggaacgccacttcggccgggcggcggaagccagcttcgtcagccagccgaccctgtccatgcgattgaaaaatctggagaaagagctgggcgggctgaagctggaggtggagtcgctcaagcacggcttgcacggcacgctgcgccttggcgtggtgccgcagtgcagtatctcggtatcggaaatgctcaaggcggtcagcgcgcgttacccgcatctcgattaccggctggcggtgctgagcgccgatcaactgctggaggcgctgacggcgcataccgagctgcatttccaatcgcaaccgctggtggaaaccggcgtcgagctgccgacgcgttatttccgccgctatctcgatcaacacttccgcgacgccgggttgacgctgcacacacggctggagacggcctcgatcttccaactgctggaggggattttcgtcggcctgggctgcgggctgttcccgcgcggccaactgcaatcgccactgatgccggcgttgcagcggcgcccggtggccatcggcgccatgccgcgtcatgcggcggtggtggtcgatatggcggagcgcgccacgccgttggcgcaaaaattcttcgacgccgccagcgagtggctgcgtcggcaaaatga

SEQ ID NO: 50525 - DNA, 216 bp, Glycine max
  Peptide Sequence Number=SeqID_167303
atggcagtaagcttcaaggacgaggactacccaaggttccttgacatggaaaaatttaagggcacgggacaaccaccgaaaggtatgaaatttatcaagagaaaaaggttcttcagagaagccaccagggagaacaagctagcatactttggcattaccacatctcaaccatttggaggccacttcaatagagaaagaaaagtagcaaagatctga

SEQ ID NO: 50526 - DNA, 162 bp, Glycine max
  Peptide Sequence Number=SeqID_167304
atggaagtagctcaacttcttcaagctccggtggtaagaagggtccaactacaaagggaattttttatcccaagaacagatgatctcgtaaaaggtatacgcatattgaagggaccaatatttgaagcatatatatacgaatgggaatgggaatggaattga

SEQ ID NO: 50527 - DNA, 150 bp, Glycine max
  Peptide Sequence Number=SeqID_167305
atgagttctaaaagcataaatattcaaaatgctctttgttatactacaaggcctgctccacggagcaataactccaactcttcatcctcagggactcaattgccaactattcaaaaagtcttttcaaggaggttctgtgatgatgagtaa

SEQ ID NO: 50528 - DNA, 234 bp, Glycine max
  Peptide Sequence Number=SeqID_167306
atggaaaaatccgacaaaagaaatgtcaaagagaagagagaaaagaaagcacacatcacttggaaagataatgacatggataattcaagtgatttagaaaatgaaatcataaatctgggtctcatggccaaagactatgaaagcgaagaagagatgcattcaatgatttgcataaagaatatgccgaacttgccaaattattctcatattctaagaaaaatatttcaagtttag

SEQ ID NO: 50529 - DNA, 438 bp, Glycine max
  Peptide Sequence Number=SeqID_167307
atggcgcggctcaacagagcagccgcaccgtcctacctatttaaagtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccggggatcctctag

SEQ ID NO: 50530 - DNA, 408 bp, Glycine max
  Peptide Sequence Number=SeqID_167308
atgcccttgcggggtaggattgcatcattgtgtcccctgccctcgacgggtatttctttgtcgacgaaagtgaggaactcagttgcttcctcagcggatattccctttttgctgaattcgttcccttcctcggcaatccttccaaccggaacctcgtcatttggggtcaggcccgccttatcgctctcacccacatccgcctttgctttcccttttgggtctttggattgcaccggtagttcgggtgctgtgaagatccgcccactacgagtcatgtcacttgtaccagatatgtttgtcactttagcagaggatacatcatccttaacatgcacgacggacacgtcttttctttcgtcgggccattgtgtgacgtacttccatggcaccgccttatcacttttgtaa

SEQ ID NO: 50531 - DNA, 426 bp, Glycine max
  Peptide Sequence Number=SeqID_167309
atggttgggcaggaagacagggaagtgaagccacaccaagaggaaacggaagttgtgaacttaggtgttggcgacgaaagaaaagaagtcaaagtcaccactggcatgtcctcaaacattcgagataaatcggtagttctgttgcgagattaccaagacatcttcgcttggtcccaccaagatatgcctggtttgagttttgatattgtacaacatagattacctctaaatcccgagtgttccccgataaagcaaaagatgaggaggacgaagcccgagatgtccctgaaaataaaagaagaaatgaagaagcaattcgaactggcctctaggccattgctcggtacccgaaatgggttgccaacatcgtgccagtccctaaaaaggatggaaaggggcaaatgtgcgtggactatcgggatctaa

SEQ ID NO: 50532 - DNA, 270 bp, Glycine max
  Peptide Sequence Number=SeqID_167310
atgggagagggagatatggaggacataaagagtgagaaaatggaaagagataaggttaaaattcctaattttcaaatgaagcgtgatatagaagcatactttgagtgggagatgaaagagaatgcaagagtgataaggaagcttgagacaacaacttggcaagaaatgaaagagtttatgagaaagacattctttccacctttttatgagaaagatgtttatgatgagctacaaagcctcacacaaggtagcacgagtattgataagtga

SEQ ID NO: 50533 - DNA, 222 bp, Glycine max
  Peptide Sequence Number=SeqID_167311
atgaagaagatgaaggtcagaagctgtgagaatcatccactaagcgagacactcagcctgcttagggagttgggagaatctggaggagaatctgccatgcatctgcgcgctcagtgcgtcatcagcttgctcagcgagtcgtttgtctcttcttgcgctaagcacacccatcttactcagcggaattccactaactcgccctcagtgcgaacatggcactaa

SEQ ID NO: 50534 - DNA, 207 bp, Glycine max
  Peptide Sequence Number=SeqID_167312
atgggaagcctttcacttttcacaggaaacaaagttgaacactgcccgtggtttgttacccatccctgtggttgcaggaaaaagaaaagcggcgggaaggatggaaaagacgagtgtgggaaggtctacgagtgtagattttgttccctcaagttctgcaagtctcaggctcttgggggacacatgaaccgccaccgccaaggctag

SEQ ID NO: 50535 - DNA, 501 bp, Glycine max
  Peptide Sequence Number=SeqID_167313
atgctggacaaaacgacgccgcacgttctccggcggtggatcgggtgcctggtggttgccgccgtgtacgtgctccgcgtgtacttggtccaaggcttctacatcgtctcctacgccctcggcatttacatcctcaacctcctcatcggcttcctctcccctcaggtcgatcccgagattagcgacggccccaccctccccacccgaggatccgacgagttccgccctttcgttcgacgcctccccgagttcaagttctggtactcgatcacaaaggctttttgcattgcatttgtgatgactttctttagtgcatttgatgttccagtattctggccaatactccttttctactgggtggttctattcacacttacaatgaggagacaaatatcacacatgatcaaatacaaatatgtaccattctcatttgggaaactggattacatccttgttgctaatagtaagcttaaattttctgttttacttttagcgctatga

SEQ ID NO: 50536 - DNA, 144 bp, Glycine max
  Peptide Sequence Number=SeqID_167314
atgcggaaaatacccaaaagggagggcaaaaggctcgcctggcgagcaaggttgcttcaagatgaagtaacagctcgactgggggagctcagctcgcctgggcgagctatcatgaccccagatgccttgttttgctataaataa

SEQ ID NO: 50537 - DNA, 387 bp, Glycine max
  Peptide Sequence Number=SeqID_167315
atggaagagttgttcctagtacccaacatggtcattcctccaaagttcaagacgctagatttcgataagtacaaggggactacttgccccaagaaccacctaaagatgtactgtcggaagatggggctgtcacctggtacactaatctggaaccttccggagtccattcttggaaggaccaaatggttgccttcgttaggcagtatcagtacaattttgatatggcttcagataggatgcaactacagagcatgtgtgaaaaagagaatgaatctttccaagaatacgccaaaggtcaagggatctgacagctcaagtagcgcccctaatgacagagaaggagatgataacaatgatagtagacacattaccggtgttctactatga

SEQ ID NO: 50538 - DNA, 1193 bp, Glycine max
  Peptide Sequence Number=SeqID_167316
ggttcacttctagaagcgtcagcagagatggctacgatatccactcgaatagcaggaactcatcagcctccatccccatgacccctcggagtgagggcgagatcttacaatcttcgaatttgaaaagctacagctacaatgagctaaaaatggccacaaaaaatttctgcccagacagtgtcttaggagagggtggatttggttcagttttcaagggctggattgatgaacattcgctcgctgttaccagagccggaacaggcatggttgttgctgtgaagaaacttaatcaagagagtttccagggtcacaaggaatggttggctgaaatcaactatcttgggcaactgcagcatcctaatcttgtcaagttgataggctactgcttagaggatcagcaccggcttctagtttatgagtatatgcccaaaggaagtgtggagaatcatctgttcagaagaggatctcattttcagcagctttcttggactttgagattgaaaatatcccttggggctgcaaggggtcttgcttttctccatagcacagaaactaaagtcatataccgcgactttaagacttccaatatcctgcttgatactaactataatgcaaaactttctgattttgggctggccagagatggaccaactggtgataagagccatgtttctactagggtcatgggaacccatggatatgcagcaccagagtatctagcaacaggtcacctcactgccaagagtgatgtctatagttttggagtagttcttttggaaatgttgtctggaagacgcgccatagacaagaaccggccatccggagagcaatgccttgttgaatgggcaaagccttacctttctaacaaacgcagagtttttcgcgtgatggatagtcgtcttgaaggccagtattcccttacacaagctcaaagggcagccacccttgcttttcaatgtcttgctgtagagcccaaatacaggccaaatatggatgaggtggtgagagcattggagcagctacgcgaatcaaataatgatcaggtgaaaaatggtgatcataaaaagcgtagtagagttagtggatctggccttggtcaccacaatggactccctgcatctactagcaaaggaagtatagatgctgctaaaaagtttaattatcctaggccctctgcttctctcctttattaa

SEQ ID NO: 50539 - DNA, 588 bp, Glycine max
  Peptide Sequence Number=SeqID_167317
atggcgaggaaggcgatgccgccattgacagcagcgggacagggtctgagtcactgcccataccgccattcaaactggcgggacatgctgactaagcatctcgccattggtactgtgttcagtctgaaaaagatgggtaggcttgcagtaggggttgcagtgttcagtctgaaaaagatgggtaggcttagggtttgcagttatgaaaagcttgcatttctctttctgtttcttcttgagtgtgagcttgtgcttgtgcttgctgtgtgcttcttgctttgtgctccttggttcaaatttggtgcgtgcttccttccttcaagtgtgtgcccttacccttacccttcctttctgaaggtgagaagaagtgcacgttggtctcgctggtgctattggcgggatgcccagtcagcacttgtctcgctggtgctactggcgggttgcccagtcagcacttgtctcgctggtgctaatggcgggttgcctgtaacgctcttggtgctggcggcacccagccacgtctcgccagagctagtggcggcatccatggagtcgctgatgcagctggcgacatcaaatgaaaaatag

SEQ ID NO: 50540 - DNA, 216 bp, Glycine max
  Peptide Sequence Number=SeqID_167318
atgaaattgagcttagctcatcagggggctaagcgtgcatccaccgctaaacgaagcttaagggtgcttagcgcaatagaagaatttgatagagcatcgatatcaatgtcgagcgctaagcgcgagattagtgcgctaatcgcagcagttgtcttcagccaggctcagcgcaagactggtgctaagctcgaatccacttactcgcgtgaagcgtga

SEQ ID NO: 50541 - DNA, 522 bp, Glycine max
  Peptide Sequence Number=SeqID_167319
atgggaaagttggatcatctagaggaaaggctcagggccattgaaggaggtgaagattatgcctttgctaacgtagaggagttcttcctagtacccaatatcatcacccctcccatgttcaatgtgtcggactttgacaagtataagggaactactttccccaagaaccatctaaagatgtattgtcggaagatgggtgcatacgcaaaagataaggaactgctgatacatttcttccaagaaagtcttactgggatagctgttacctggtacactaacttggaaccttcccgagtccattcttggaaagacctaatggttgcctttgttaggcagtatcagtacaattctgatatggctccggataggatgcaactacagaacatatgcaaaaagggggcacgaatctttcaaagaatacacctaaaggtggagagatctggcagcccaagtggcacccccaatgatggaaagggagatgataattgtgatggtagacacattactagtattctactatga

SEQ ID NO: 50542 - DNA, 510 bp, Glycine max
  Peptide Sequence Number=SeqID_167320
atgggtgacgtagaggaagtgcaagaacagatgaaagccaaaatgtcgactttgaaagatcaaatggcctccatgatggaagccatgctaggtatgaaaagattgatagagagtaatgtagccacagctgccgccgccagcaccgccactgaagcagacccggtccttctatttactgcaaatctagcacatcaactcgccccagatatggtgggacaaggagggaacatgttggggaataccaatagcctgcatttggggtacaatcaaagtgcttatccctacggtctaccccccaactttacgccacctaccatgcatgggaacatagatcatgccgctccccctacttttgaagggcaacctccccagcccatagggggtgctcgcgaagaccctcaagagcgtgcccaaggggacgtggactcctacccccttttcaccactgagggactgatgcccaatgccttgcctcagcccaatatcgcgggagtttctcaaccccgctag

SEQ ID NO: 50543 - DNA, 117 bp, Glycine max
  Peptide Sequence Number=SeqID_167321
atgggaagcttccttgagaagcaaggaagcatctctagctcaatcctcttggagtctcttgctcgtggctctggtaactggtccattcctagggaggattacatcaagatcccttaa

SEQ ID NO: 50544 - DNA, 624 bp, Glycine max
  Peptide Sequence Number=SeqID_167322
atgagggctacacgtcctcgccttcagaggctacacttcctaacctttagaggactacacgtcgtcaccgtcaacgggttgcacgccctcaccttcaaagggctatatgccctcgccttcagagggcttcatgccttcaccttcagaggactgcacgtcctccccttcagagggctatacgccctcgccttcagagggctacacgccctcaccttcatagggctacacgccctcaccttcagaggactacacgtcccctccttcagagggctacacaccttcgccttaagagggctgcatgccctcatcatcggaggactacacgtcctcgccatcactggactacatatccttgctttaagaggactacacatcctcacatttagaggactacacatcctcacattgagaggactgcacgccctcacctttagaggactacacgtcctcaccttcagagggctgcacgtgctcgctttcatagggctacacgccctcacctacagaggactacatgtcctctccttcagagggctacacaccctcgccttagagggctccacgccctcacctttagagggttacacgtcctcacttttagttggctctacatccgcaccttaa

SEQ ID NO: 50545 - DNA, 615 bp, Glycine max
  Peptide Sequence Number=SeqID_167323
atggagaagaatatgaaaaatggtcttgtctccctcttggatttgcctgaaccaaccttggatttgattctcaagtgcttttctccaaatgaactctgcacagtgtcagaggaatgggaatggcacataacaattgctaaagaaggaagtttcttgaatcaaaacaccaataaccaaactgggtcaatgggtacatttactggtgtatggcctaatctatatcttggttcatacttagaagattgcaaggtcctcaatggtcaacggccaaacaacttcttgatgtctttatatttctctcttgagagtggtaggttctggtttcctgctcaggtttacaagggactgatgcttcacaatgctttggttagctatgactctgaatctaatacttttcaagcaaggtatcaaactggaggttggagatgtctagggaggaacattgagtgggacatggtgagagttccctcggttgattcgcctccttatgttatgcacgtctctgattgtttagataatttgaaaccagaggatcatattgagattcaatggagaggaaatacacattgtccttacggtatttttctaagccctcaaggtcctgttaacctatga

SEQ ID NO: 50546 - DNA, 294 bp, Glycine max
  Peptide Sequence Number=SeqID_167324
atgaggttgattttgtgtttgtgtgaaaatgaaacggagggcagatggttttatagggaacagggacgtgccaggggccccaccactagtggaagtgcctgccaggctaccactagtggtcgcgcctggcaggtaggcacgactggtcgcgcctggcaggtaggcacgactggtcgcgcctggcaggtaggcacgactggtagcgcctggcaggcaggcacgaccacccctgtcacatcgccctgtccagacaagccacgtgtcgcgttctggtggaacgcgctcctcaggtag

SEQ ID NO: 50547 - DNA, 621 bp, Glycine max
  Peptide Sequence Number=SeqID_167325
atgggtaaatattctcaagctgcacaaaatgctaatgctgctagacagggttacgctttagggacagaagctgattggcgtaatggtttctatgacctaacaaaaacaactgatgctatgtggggagctgttattactggtgataatacttctttcgtagcaagtttctttgcacactttgataatactaataacagtggatatgcaggagggcttggaatttataaattaatcgataaaagattatatgataatatttcagctactgattataggaaaaaagcttttgtagcacctggaggaaatcctagttatcctgcgttacctgcttatgcaaatcttaaatttattgatcctaccgttactgatggggattatatttacttaagagcttctgaaatgtattatattgaagcagaagcgcttgctagatctggaaatgagcctcaagctaaggctgtacttgcccaaattacacaagctagagatgcttcttatacaacatctactaatactggtgcagcattaataactgagattacgactcaaaaaagaattgagatgtggggtgaaggttgtgcttggtttgatatgaagcgattaggtgttggattaaataga

SEQ ID NO: 50548 - DNA, 282 bp, Glycine max
  Peptide Sequence Number=SeqID_167326
atggtgggttacacaccttcaagttttacagatttggtcttcgccagcaaaaagatcgaagtggatccgaaaagaggcaaatttgatcatcctactaggacgactgagaaaactggggcaaatgaagaggccataaccctagccaaggttcatcaacctccatttatccgagaatacgactcgaacgcaacgtgtgcttgtcacggagaagccccggggcgttccattgagcatggtagggctctgaagcgtaaggtgcaaggtctaattgatgcgggctag

SEQ ID NO: 50549 - DNA, 225 bp, Glycine max
  Peptide Sequence Number=SeqID_167327
atgactccattgatgaagaagatccaaggcctacaagctccacatggagcttacatcaccatcctaggagcaccattggatttaaagcaaccaaagcctcaccaaattttgagtgaaacacttgagaaaaaccaaaaggtgggcacccttttgcttactttagtgagaaacttcatgatgccactctcaaccaccccacatatgataaggagttgtatgccttag

SEQ ID NO: 50550 - DNA, 384 bp, Glycine max
  Peptide Sequence Number=SeqID_167328
atgaaggcgagccccaggccaacggcaacgatgttgatcaggtcggtgtcatggtgcatcggcactcgcaggcaatcgggggatgccccgattttcaccgatgaagccagatacggcaaacccgccgtccacgtgccgtggcgggcgggtttgcccacgcatttctcctctacccccgccttcggcgcgccccttcaacaagaaggggctctcctccagatgcggcccggggttgccggccagcggccggcactaccagagcctcgcttaccaggtgtacttgatccgcccgtacacatacgcgccgttgaagccgaacggcgagtagttgctgtacggcagcatgccgaaggtggagttctgcaggtcttcggtgcggtccgg

SEQ ID NO: 50551 - DNA, 687 bp, Glycine max
  Peptide Sequence Number=SeqID_167329
atgtcctccttttcaaagggctacacgccctcccctccagaggactacacgtcctcgccttcagagggctacgcgccctcagcttcagaggactacacgtctaacattcagaggagtacatgtcctcaccttttgataaccacacatcgtcaccttcagaggactaaacgtcctcgccttcagagggctggacaccctcgccatgagatgactacacatcctcgccatcagagggctacccgccctcaccttcaagggactacaagtcctcgccttcagaggagtacatgtcctcaccttttgataaccacacatcctcaccttcagaggactaaacgtcctcgccttcagagggctggacaccctcgccatgagaggactacacgtcctcgccatcagagggctacccgccctcaccttcaagggactacaagtcctcgccttcagaggactacatgtcctaacatttggaggactacacatcctccctttcaaagggctacacatcctcaccttcagaggacttcacatccttcgcttcagagggatacacgtccgcctcttcagagggctacacgccctccccttcagaggactacacgtcctcgccttcagagggctacacgccctcaccatcagaggactacacgtcctcaccttaagaggactacacgtccttgcctttag

SEQ ID NO: 50552 - DNA, 292 bp, Glycine max
  Peptide Sequence Number=SeqID_167330
ggtttcaatttctctcccccttcccaaatcctcagcctcccaaactttgcttacatcgttgatggtcggctcgacggattgggacgtgaagcagatggtgacaaggttatcgaatgtggtgttggattgcgtgatgttgtacatacacgactccaaggaccgcgacatcgtgtcgcaggacaggttaaggcgacggttcctgcacctcgagttgctaaagctgaagggaaagccacaggtagcgatgttcaacctaatactggagggttggggaggtttcatcacaccttgg

SEQ ID NO: 50553 - DNA, 222 bp, Glycine max
  Peptide Sequence Number=SeqID_167331
atgtacaaagataagttgacccaaccttggcccatgggctcaaaaatatacgctgaggttcacgagaaccctagggccttcttcagcagctctagcctaatcctcttggagcctcttgctcatggctctggtaactggtcccttcctagggaggattgcatcactagttctgtgttagccatagggagtggaggtcaatatgtggtcatgttgggtccttga

SEQ ID NO: 50554 - DNA, 147 bp, Glycine max
  Peptide Sequence Number=SeqID_167332
atggctattctatgtgttattttgaagcttgaatgggcaatggctccaaagaagttttctgctaaaagggctaggaaggccaccacaggggagggatctagtgcagcctcgcaagcgaaaattgagtttgacaggcactgtttctga

SEQ ID NO: 50555 - DNA, 177 bp, Glycine max
  Peptide Sequence Number=SeqID_167333
atgaaaggcctttttgttacaaaacttgaaagcaataaagtgcttcttagtccaatagctcttaaggtggttggcccttttcttcttgactcaaattcttcaagggatggcactaatcctccttccaattccctatttggcaacccacaaacaaggaaacaaagagacaagcaataa

SEQ ID NO: 50556 - DNA, 419 bp, Glycine max
  Peptide Sequence Number=SeqID_167334
atggtcattctgcgccttttgtcatccagaggcggcgagcccgatgacatgcggagacaaattatggcggcaagcccgatgacatgcggagacagattatggtcattccgcacaccttttcgccatccggagacaatcgtgtccgatggcacgcagatacaaattatggtcattctgcaccttttgtcatccaaaggcggcaagcccgatgacatgcggagacagattatggtcattccgcacaccttttcgccatccggagacaatcgtgtccgatggcacgcagatacaaattatggtcattctgcaccttttcgccatccagagacgatcgtgtctgatggcacgcagagacaaattatggtcattctgcgccttatgtcaaccgagaggaacgaattcggcagtatcaggatgat

SEQ ID NO: 50557 - DNA, 216 bp, Glycine max
  Peptide Sequence Number=SeqID_167335
atggcacctattgtgaaaggtgataggttcaatttgaatcaatgtcctaaaaatgagcttgaaaggaaacaaatgagaaacattccatatgcttccgttgtaggaagccttatgtatgcgcaagtgtgtacaagacttgatattacttttgtggttggaatgcttgcgagatatcaaaataattcaggaatagagcactggacaacggcaaagaaa

SEQ ID NO: 50558 - DNA, 384 bp, Glycine max
  Peptide Sequence Number=SeqID_167336
atgactgtggcaatggtaggtgatggaataaatgactcgccagccttggttgctgctgatgttggcatggcaattggtgctggaactgacatagctatagaagctgctgatatagttctggtcaaaagcagtctggaagatgtgatcacagccatagacttatcaagaaagaccatgtcgcgcatccggctgaactacatctgggctcttggttacaacattctaggcatgccaattgccgctggagtcttgtacccctttgctggaatcagattgcccccatggcttgctggtgcttgcatggctgcttcctctcttagtgtggtttcctcatctcttttgctgcagttctataaaaaacctctgcatatagaatcctcttga

SEQ ID NO: 50559 - DNA, 315 bp, Glycine max
  Peptide Sequence Number=SeqID_167337
gaggagaagctccttgatagtcccgcccaggcacacaatcattcatccctctctgcgccgctaccgccagtacgacccctcctctcaccgcaaccaccactattgatagctcccccgaaaccttccctgtctgtggccttgccccttaagtgcctgtcgcaaaaagagctcgcctcccgctgggaacgcggcttatgctttaactgcgatgagaagtttcatcgcgggcaccaccctgggattgggtcatggttaaactccggccttaccggcagacctcggccacaaggatacacggtggttactccaaactag

SEQ ID NO: 50560 - DNA, 345 bp, Glycine max
  Peptide Sequence Number=SeqID_167338
atggcagacaaagctaaggaaatggccagctcagcgcatcacacgaaatccttcaggtatgctgttccttttgggcctgtttactgtatgcacctccttcttgctatcagcctccttcttgctatcgtccctatccgcttgcaaaataaccttgtcctcaaggtgagcttgatcgaagctgctcccagtcttcccaggacgtgtcttcaggatacaatccttcccattggaccaaaacctgccagatggagttctacgcagattgacaagtatttaaaatggctaaagaaggtagtggaagttgagggtcatcaccgaggccccatggaacggtttgagcaatga

SEQ ID NO: 50561 - DNA, 498 bp, Glycine max
  Peptide Sequence Number=SeqID_167339
atggaaccgacgtgcgtcgacacttccctcaaccttaacgttattccttcacccacacatcgaccacctcgcgagttgcggcgtctaagcagtgagaacaagaggctaactgagacgctgaaccacttgtgcgagagctatgttgccttgcagaaacatttgagtgaattcagccaacttaggaacgcaaattttgataaagaaggaacttgtgcagttccgtcgctaaagagaaagcccgagagtgagaattgtgtgaatctgtttggtactgagtgcaacaccatcacagaggaagaaacattcaaaaggcccaagcatagcaccgagccaaaggtttccaaagttcttacacggacagatgcatctgatactggcttatatgtgagggacggatatcagtggagaaaatacggtcagaaagtcactagagataacccttctcctagggcttacttcaagtgttcatatgcccctagctgtccagtaaaaaagaag

SEQ ID NO: 50562 - DNA, 237 bp, Glycine max
  Peptide Sequence Number=SeqID_167340
atggtgggttacacaccttcaagctttgcggatttggtcttcgctggcgaaatgatcaaagtgggtctaaaaagaggcaaatctgatcatcatgctttgataaatgcaaaaaaactagggcaaatgaagaagccatgtttcccaccaacccaacaatgtcattactcagctaatgacaaaccttctccttacccaccacccagttatccacaaaggtcatccctaaatcaaccataa

SEQ ID NO: 50563 - DNA, 495 bp, Glycine max
  Peptide Sequence Number=SeqID_167341
atgggagcaaaccgtgttcacttagtggaggagttgctaaagttgatgcaacctgaagaattgggattgcaagacctcaagggcaacactgtaatctggtttgctacagcagggctagctgaacttgtgtttagaggaaggaaaactggggttagaagtctgactgctggtttttacactggaagttattacacttacttgaactctcatgcttaccaattaccaccagagaatcagacagggttgcatgtcttggctccaactgtaggttgtggttgccaggatttgcaagaattcaaggaatgggatggggttgggctggcttggaataattttttggagaacaagactaccttcactataaagagactatggcaaagaagtgatgcaatcctccctaggaagggactagtcactagagccatgagcaagaggctccaagaggattgggctagagctgctgaagaagatcctaggattctcatgaacctcagg

SEQ ID NO: 50564 - DNA, 453 bp, Glycine max
  Peptide Sequence Number=SeqID_167342
atgaaagttggtcttctccttagcaaccaccaacaaacacaaaccacactactatcaccaactcgtcatcgctctgtcccactctcttcttccattcgtctcatccaaaaccttaaccttcatatttgttcttacttgactgaacaaagtatcatagatagtcatgagattgttctgtccaacggcgacacaggccatgccatcaagtacgagttggggtttctgatgtttgacaaagttgttgttgatcaatttgcagtattagagtctttggcggtcgatgttgatggtgccagaggagataagaataattttgtatccgatggagttgagcttttaatttgctcgcagagaatccctaattttccattcgtcaacctcatgaatttggtacaagcgcgagggtatgccattgaatgtggtggtggcgatgagaacaaccatgagcaatag

SEQ ID NO: 50565 - DNA, 961 bp, Glycine max
  Peptide Sequence Number=SeqID_167343
atggaattggcaatgaaggtggccgaggccgtccatgtgctgaaccacgatacgcaatcctgcaaccgcgtcgcagcgaatcagtggctcgtccagttccagcaaacccacgccgcctgggatgtcgccaccgccatcctcaccgccgatcgccgcctccccctccccgccaacttcgaggtcgagttcttcgccgcgcagattctcaaacgcaagatacaaaatgaaggttatctactgcaattaggagctaaggatgctttgttaaacgctctccttcttgcagtcaaaagatttagtactggtccacctcaggtgcatggtttctctttctttgtgatactgctaatcctcttttcaagggagcttttgacacagatctgtcttgcactctctgctcttgtacttcaagttgctgcacatggaaaccctatcgagcagcttttttacagtctccggaatctgcagagccaggatgatggcaattttgctgtcctggaaatgctcactgtcctgccagaggaagttgttgacaaccaacgtatcgattctaaaattagttcattacacaaaagccactatacccaagagcttctctcccatacacctatggttcttgagttcttgctgcagcagtctgaaactaattttgatggttctgtgcaacaacacgaaaggaataggaaaattctacgctgcttattgagttgggttaaagcaggttgcttctctgagatttctcccggaacattgccagctcacccacttttaaattttttgttcaactcattgcaggttcctttatcatttgatctagccatcgaagttcttgttgaacttgtgactaaacacgaggcatcttatgctaggggtggtttagcaagctataagttgatcattaaaggtcaattttatggatttttgggtgctgtgaattacataatggaagttggagttgaag

SEQ ID NO: 50566 - DNA, 207 bp, Glycine max
  Peptide Sequence Number=SeqID_167344
atggatgatggaagagggagcgacgcctggaagggattaattcagttaacctcgtcgaagggtgtgatcttcgaaggcagagcaaaattaatgggaattggagatgccttcaaagtggctaacgtggtggaggagggtgagagtggctcgacggattttgtcgtgagagaacttgacgcacgacataatcctttcatggctggttag

SEQ ID NO: 50567 - DNA, 1344 bp, Glycine max
  Peptide Sequence Number=SeqID_167345
atgggaaccacttgcctagaatctccaccaattctccaagacccaagggttactatcctcgaaacttcaatggtttttccatccaaagaaaccgagaagaggtccttgttcctatcaaacatagacaaggtcctcaacttcgaagtggaaacggttcacttctttggagcaaacgaagattttccacccgcaaaagtggccaagatgttcaagaacgctctagaggaagccctagtggtctatgacttcttgggaggaagattgaatctgaaccctgaaaccaaaagattagagatagattgcaatggaaagggtgctgggtttgtggtggcttcaagtgagtacaagttaagtgagattggggacttggtttatcccaatccagcttttgcacaatttgttcagaagagtaaggattttgtccaacaaaatgatcaaccactatgcgttgcacagttgacatccttcaaatgtggaggctttgcaattggattcacaaccagtcacaccacctttgacggtcttagcttcaaaacattcttggacaacctcgccgcattggctgctaacaagcccctggctgtgataccctgccacgacagacacctcttggccgcacgatccccaccacgtgtcagcttcccgcatcctgagctgatcaagctcgataagctacccacaggcagcaccgagtccggggtcttcgaggctaccaacgaagaactcaacttcaaagttttccaactaacctcacacaacatcctcagcctcaaggagaaagccaagggtagcaccaacgcccgtgccactgggtttaacgttatcaccgcccatctatggagatgcaaggccttatctgcaccctacgacccttctaggtcatccatcatactatatgccatggacatacgtccacggttgaaacctcccctccccaaatccttcgcgggcaacgccgtgttaacggcttatgccatagcaaaatgtgaggaattggaaaaggaagagttctcaaggttggtggagatggtgacagagggtgcaaagagaatgagtgatgaatatgctaggtctatgatagattggggagaggtgcatagtgggtttccacatggggaggttttggtgtcttcgtggtggagattagggtttgaggaggtggagtatccgtgggggaagccaaagtattgttgccctgtggtgtatcaccggaaggatattattctagtgtttcctccttttggtggaagtagtggtgatgatgatgggataaatattatagtggctcttcctcccaaggaaatggacaaattcgaaaacctcttttacatgttcttgaattga

SEQ ID NO: 50568 - DNA, 678 bp, Glycine max
  Peptide Sequence Number=SeqID_167346
atgacagaaggtctacaagggtatgtctttactcttacaggtgggcttgtttgttggaagtcaattattcaatcacttgtggcaatgtcaacaactgaaatggagtatatggtggtagcaaaggctagtaaggaagttgtgtggttagtaaggctagtgaaggagccgaacattgagcaaggtgaagttcaattgcattgtgatagtgagagtgttattgacttggcaaagaatcaggtgtatcatgctaaactcaagcatattgatgttaggaaattgatgacatctggtcagattttgctcaaagaagtgctggatgtgacaagacccccaacccaagagaccaaggtggatttgtttatttatcttccacgggaccaaatatttgccaaggtggagattgttatgcatgactcatattttatggacttgacaaatgttggagcagaacgtaaaggctacttgttgttgggttacgaagtggtgggaaagtttgataggactgggaatttcagattgtggcagagacaagctaaggatttgttggcacaacaaggtcttctaaaggcactgtgcaaatcaaagcctaataatatggaggctttggatttagaggagttgcaagaaaaggttgcggtaaccatacgtttgtgtttggcaaacaaggttgatgagtga

SEQ ID NO: 50569 - DNA, 354 bp, Glycine max
  Peptide Sequence Number=SeqID_167347
atggagtgctacaaatgcaatcagaaggggcatttcaagagggatttcttagagtcgaagaaatctagtgaagggacatctcgctcagcaaatgtggcagagactgacgattcaaactactacattgagggagatgtctactacaggagtggttcaccatatacaaatcaagtaattttggcaatgtctatatgggtgcagatcgctatggataatggtggagccaatggttttagttacagaattgatgaagatcgagataacttcagaggggaaggctaccatgtggataagacttactttagggaaagattgttggagtataacaatgaggtaaaggctcacatcgagtaa

SEQ ID NO: 50570 - DNA, 828 bp, Glycine max
  Peptide Sequence Number=SeqID_167348
atgaatatggcatgctacctactcaaccgatcatcacaagtatcattggatgcaaaagttacagaggaagtttggacaagttattccaaaggtgtgatgtggttcaagttttgggatccattttctaagaagatggtgatcagtagggatgtagtgtttgatgagcaatccatgttgccagagatagttgatacaactatgccaatgtctgatggagcttcccctaggtccttggaggttcaagtggacctagagcagttgttggtgattcttgggaggacagaaccatgcattccaagacctgagtacaatcttgtcaaagatagtgattgccacaccattaaacctgttgtccaatacggatttgaagtattggctaaattggctacttttgcccttttcactagtgctggagatccttctacctttcaagaggttatgaatagccaagaggaagtcaaacggataggtgctatggttgagaagatagagtcttcacagaagaatcaaacatgggagctagttgagtttcttgtagaagaaagtcatagaatgcaaatgagtgtacaagaagaaacctccagtattagaaaaagaaaggttgtgagacatacttctatcaaggcaatgctagccttggtagctagtcacgacatgcacttgaagcagatggatgtgaagacatcctttcttcatggtgatcaagaagggcaaatttacatggagcaactagagggattcaataaatatggattgggtcggttggtttgcaagttgaagaggtctatgtatggattgaagcagtctccaaggatatggtacaaatga

SEQ ID NO: 50571 - DNA, 222 bp, Glycine max
  Peptide Sequence Number=SeqID_167349
atgtctatgaatgccatgttcctcatagaatttatggaactgaatcgtatatgtgtcatacgagaaatgtcaaaaggttccaataagatgaactatgtaaagggcaccatcaaacccaatctgcttcgaaaattaatattcgagcatggttctggggccaatgctctttcggtctccaacttaaaagggaaaatcaaattaaagggttacaacggacgataa

SEQ ID NO: 50572 - DNA, 291 bp, Glycine max
  Peptide Sequence Number=SeqID_167350
atgaatctagtgcatatggtatggtcaaagttattgaggatcatcacaggcagcagtgacaaagtcacaaggttttttggtggcaaagtaggatgcaacccaaagggacatggtggcattgtgggtggtggttgcaatgtgtggtggttcacgagggcacaagggttcatgaaaggttgggcaaagcgtgggttctgtcgtccgatcacgatctcaattaccacaaataacaagaggatagcaacaaactggtccacatcttcagagtttactcttcaggtcttgacataa

SEQ ID NO: 50573 - DNA, 267 bp, Glycine max
  Peptide Sequence Number=SeqID_167351
atggcctcaaaaactatatgcactaccattcagatcaaagaaaaaagaactgtggaccccgcattggtggctgctgaagaaggtgttaaggttgtgaaggtaatgcaagatggaagtgggaaattcaagaccatcactgatgccattaacaacatacgtagtgggaacaccaagcgtgacaaagcctttaatcagcttgtatggggtactagagaaaatgccaaacttgacatatgggggaactgcgcagcaatatggcactgttga

SEQ ID NO: 50574 - DNA, 504 bp, Glycine max
  Peptide Sequence Number=SeqID_167352
atgtttaaagtaataaatgagaaacctggaggtattaatctgagagtgacaggtagggtgatcattgtaggagccgctgacgctggagtcggaaacagagccagatctgaaaacaaggccttgctcgatgccgaagctttgcgtggaggagacagaggggcgaggcaaggggaggccttggtcgacggcgacggaggaactgaaatcgcagctgcatcgaggggagtttctgacgacgtcgtcgaagctcttggtgggcctgtcggggctggtcttgttaggcttgatgaaattgaagttaaggacactggtggcgccgcctcctcctccgccatgaggggggtggtggtggtcttcttgcggttgttggtccttgttcttgctggactttttaccccaccaagtgggcatgttctgagttattggactaagcacaaagacagagtggttcaattcaaagaagaaggtgagagttgtttaattttgaatgataagtatgtctaa

SEQ ID NO: 50575 - DNA, 795 bp, Glycine max
  Peptide Sequence Number=SeqID_167353
atggttggtgctataaaagcagcgattggagacgcggtgttgactttcatgtgggtgttctgttcctctgtgttgggaattgcttcagggtacataaccaatgcacttaaccttcaacacataacctacaacgggttcccttacccttcttttcttgtcaccaccaccctcgtttttgttctcgtttttcttttcaccatcattggcaatgttcttggtggggccagcttcaaccccaccggcaccgcttccttctatgccgttggtcttggttcggatactctcttctcaatggcgcttcgtttccctgcgcaggcagctggtgctgcgggcggtgcactggcaattatggaagtgattcctgcaaagtacaggcacatgattggggggccttctttgaaagtggatttgcacactggggctgtcgctgaaggggtgttgacttttgtgattacctttgtcgttctcctcatcttcctcaagggccctcgtagtgacttgttgaagacttggttgctggccacggcaactgtagttttggtcatggttggatctgcctacactgggccagccatgaatcctgccaactcgtcagttgcacgctatagcaccactatagcggcatcgcgacaatgggctgctctaaggaagctcattgcattgagcattgtagctcactgttatggcttgagaggcaagaactgcagctgctatatcagctaccattgcagccgaataaaaaaccccttttttggctccttgagtgaggttgttttgtgctcaggtgctgtttaa

SEQ ID NO: 50576 - DNA, 333 bp, Glycine max
  Peptide Sequence Number=SeqID_167354
atggatgagaaagtcacattagtgataaactataatggaggaggaaatgcgataggaataaaggttctcacattatcaccagagaaatactgcaatcatgtaacccatggaaataacatacctttcgcaatgcacggtttgacagagaggtgtcgacgtaaacaaaaagatctacacatggttttcattgccctaaaaatggcctatgacaagatttggattggcaggaatgcagctgagagctctgtgccagatggtttgcatcgaagagagaaaagaccaatgagagtagtgcatgatttagtctgcaaaggagtgagagtgggaaaatag

SEQ ID NO: 50577 - DNA, 1839 bp, Glycine max
  Peptide Sequence Number=SeqID_167355
atgatcagaatcagatctaacttacctcttttctctgttgtgctatctcgcatcagccataactcaatcgctgttaatcattgtcatatagtaaagaagccccttatgggtgctactttcaatttctttgacccttttaagtctgaaacttttttagcaccacaaaagtttggtttctcagtcaagcctttttctacttcatcttcaaccagaagccttggggcttcaactgatgcccctgcacatggggccttgggtgacgatgatgatgatggggatggggatggggatgaggatgatgatgatcacgacaacaataaagataagaatgatacccattgtagtcagttacatttaagggatgatggtcttgccaaagatgttaaaaccattttggctataatgcatgaagtgggttctggaccatctcaaattaagcagaagcttgagcattgcagtattgttctatcacccgagctggttgtggaggtcctttcgagaactcgtaatgattgggaagcagctttcacttttttcttgtgggctggcaagcaaccggggtatgctcattcggttcgcgagtaccattctatgatctccatccttggcaaaatgaggaagtttgatactgcttggaacttgattgaggaaatgagaggaggtagaaatggtctatctcttgtcactccgcaaacactgttgattatgataaggaaatactgtgctgtacatgatgttgcaagggctatcaataccttctatgcttataaacggtttaactttcgagttgggctagaggaatttcatagccttctttctgccctttgtcggtataagaatgtgcaagatgctgagtacttactgttctgcaacaaagatgtattcccgttagacaccaaaagctttaacatcattctgaatggatggtgtaatttgattgttagcactagtcatgcagaaagaatatggcatgagatgataaagagaagaatccaacacgatgttgtctcctatggaagtatcatatcttgctattcaaaatcttctaaactttacaaggtgctcaggatgtttgatgagatgaagaaaaggaagattactccagataggaaggtttataatgctgtcatttatgccctagcaaagggcaggcttgtgaaagaagctgtcaatctcattggaacaatggaaggcaatgatgttactccagatgttgtgacttacaactccctgatcaagcctctttgcaaagcccacaaagttgatgaagctaaacaactttttgatgagatgttgaaacggcacctctccccaacaattcaaacttttcatgctttcttccgtatattgcggaccaaggaagaagtatttgagctcttggacaaaatgaaagagctgcggtgctacccaaccattgagacttatataatgttgataagaaagttttgccgctggtgccagcttgatgatgtatttaagatatgggatgcaatgagggaagatgaaataagccatgatcgtagttcatatatagtgctgattcatgggctgtttctaaacggaaagctagaggaagcacaaagatattatgcagagatgcaagagaaaggcttcctacctgaaccgaagacagaagaaatgcttcaagcatgggtttccgggaaacaggctacagagggtcaggagaaagatttagaaccaagtcaactggaaaatgatactcttaaaaagaaagtaaagggcataccgagtaaatttgacaggaaaaaagcctttcttcgtgaacctgagaccagaagagtaacaagagaacggggtttttctttctgggagcagtaa

SEQ ID NO: 50578 - DNA, 447 bp, Glycine max
  Peptide Sequence Number=SeqID_167356
atgagcaaggattatctaatcatactttctctccttctttccacggtgcttgcaactgcaagttcttcttcttcttcttcctccctctatcttgggaagggcttctcccatcgcaaattgtctcccagttatcacattcacaaaaccattgacgaatcctatgcagttatcttcgatgctggtagcacgggaagccgtgtacatgtctatcgttttaaccaacaattagatctccttcgcattggccaagaccttgagttgtttgtcaagactatgccaggtttaagtgcttacgctgagaatccacaagatgctgcagaatctcttattccacttttggaggaagcagaagctgctgttcctcaggagtttcaccccaggacgccagttaaacttggagtgcgtattcctcaacttaatatcatgaaaattattttatttaattag

SEQ ID NO: 50579 - DNA, 336 bp, Glycine max
  Peptide Sequence Number=SeqID_167357
atgcaggtaacaattaactatctactgggaaacttgggaaagcattattcagaaactgttgcagtagttgatcttggaggtggatctgttcaaatggcttatgcagtctcagagacagatgctgcgaaggctccacgagcaccggacggagtggaatcatacataacggagatgttccttaggggaaagaaatattacctctatgtacacagttacttgcgatacggtatgctagcagctcgtgcagaggctttaaaggttcgtgattctgaaaatccttgtattttggctggctttgatggtaaacataacttctctatttctttatacacctga

SEQ ID NO: 50580 - DNA, 402 bp, Glycine max
  Peptide Sequence Number=SeqID_167358
gctggttttgttgatccaaacgcccccaatgccaaagttcgtcctgtggattttgagaatgcagcaaaggttgcctgtaacacagaattaaaggatctcaaatccattttccctcgtgttaaggatggagacgttccttatatatgcttagatcttgtatacgaatatacattgctcgttgatggatttggtatggtttgcgttcccattggaatagctatacctatctatgtgaaagttgatgatgaatttcaccaacgcatagatccgcagcaagagattacgttggtgaggcaagttgagtatcaagattctctcgtggaagcagcatggccactaggcagtgccatagaagccatatcatcattacctaaatttgagaaattaatgtatttcatttaa

SEQ ID NO: 50581 - DNA, 633 bp, Glycine max
  Peptide Sequence Number=SeqID_167359
atggctaaattatcttgggtgtgtggagtgaaagcacgggagatgacaaaagtggcattgaactatctattgggcaatttgggaaaagtgatttcaaagacggtgggagtagctgatcttggaggtggatcagttcaaatggcatatgcagtctcaaagaatacagctaaaaatgcaccacaaccaccagaaggagaagaatcatacataaagactcttgtacttaatggaaaaacttatgacctctatgttcacagttacttgcactttggtaaagaagcatctcgtgcggagatgttgaaggtcactggtgattcagctaacccttgcattttagccggttataatgggacctacacatattcgggagttaaatataaggccttggcctccacttctgggtccaatttcgataaatgtcgagaggtagctcttaaagctctgaaagtgaatgaaccatgccctcatcagaattgcacttttggcgggatatggaacggtggaggggggagtggacaaaaagtcctttatgttactacatctttctattatctggttatacagttgcaaatccacttcttgaaagtcgattttgcttatgtgaaatcaatttctgccaattttgaccattaa

SEQ ID NO: 50582 - DNA, 189 bp, Glycine max
  Peptide Sequence Number=SeqID_167360
atgtggctaagcgagtgctgtctcgctaagcccaatgttgcttgcgctaagcgccgcctctatgggctaagcgctattcgttgcggcatgcataaggctaagccagtgctactcgctaagccgttgtatgaaataaaagtggtctacactaagcgagtgcctatctcactaagccaattatgcagataa

SEQ ID NO: 50583 - DNA, 1407 bp, Glycine max
  Peptide Sequence Number=SeqID_167361
atggtacttgtgctatggtcaagagggactaagaacatggacttcctaaccctcttcactcttctactcttgttattcattcatacagcactctcttctacccaatatcatgatgggaacatcttactcactcatcgtaagatcttccccaaacaggaagctatcacctcgtacgctgtcatctttgatgctggtagcactggtagccgtgtgcatgtcttccatttcgaccagaacttggatctccttcgtattggcaacgaactcgagttttatgataaggtaacacccggtttgagtgcatacgcagataatcctcaacaagctgcagaatctcttatcccacttttagaggaagctgaaagtgttgtccctgaggacctgtaccctactacacccgttaagcttggggcgactgcaggtttaaggcttttggaaggggatgcttctgaaaggatattgcaagcggttagggatttgctcaagaacagaagtaccctgaacactcaaccagatgcagtagctattattgatggaacccaagaaggttcttatctatgggtgacaattaattatttattggggaagttgggaaaaaggttttcaaagacagtaggagtagttgatcttggaggtggatcagttcaaatggcatatgccatctcaaggaacacagcaaaaaatgctccaaaaccaccagatggagaggaaccttacataaagaagcttgtactcaagggaaaggaatatgacctctatgttcacagttatttgcattacggtagagaagcatctcgtgccgagattttgaaggtcactgatggctccgctaacccttgtattttagctggcttcgatgggacctacacatattcaggagcagactataaggccttcgctcccatttctggctccagctacgatgaatgtagagaggttgttcttcaagctctcaaattgaatgagtcatgcccccatcaaaattgcacatttggtggtatatgggatggtggaaggggaagtggacagaaaattcttttcggcacttcatctttctattatctgcctacagagattggtatcattgatctaaataaacccaactccaaaattcatcctgttgatcttgagattgaagctaaacgagcttgtgaaacaaaattggaggatgccaagtccacctatccaaaccttgctgaggatagacttccatatgtatgcttggatattgcataccagtatgcattgtacaccgatggatttggccttgatccatggcaagagattacagtggcaaatgaaatagaatatcaggatgctcttgtggaagctgcatggcctttaggcactgccatagaagccatatcgtcattgcctaaatttgatcgattaatgtattttatttaa

SEQ ID NO: 50584 - DNA, 730 bp, Glycine max
  Peptide Sequence Number=SeqID_167362
cactggaagtcgagtttatgtcttccatcttgaccagaacttagatctccttcgaattggcaaggatctcgacttcaaggaaaaggtggcatttaactatctattggggaagttgggagaagagtttacaaagacagtgggagtagtagatcttggaggtgcatcagttcaaatgacatacgccgtctcagggacctacgcatattctggaacggagtatgttgtctatccctatcccccaatttctggctacagctatgatgcatgcagagagatagttcttaaggctatcaaagtgaatgaaccatgtccccattcaaattgcacgtttggtgggatatgggatgatgccaaatctgcttatccaattcttacagaagagagaattccatatgtgtgcatggattctacatacatgtatgcgttgctcgttgatggatttggcctggatccttggcaacagattacagtggcaaataaaattctgtatcaggatgctcttgtggcagctgcatggcctcttggcactgccatagaagccatatcagcaatgcctaaatttgaacgtaacgatgctgctcgtgccgagatttttaaggttgctgatggttcttctagtccttgccttttagctggctatgatggcctagatccatttcaagagattacagtggcggaaggaattgaatatcgagatgctattgtggaaacagcatggcctggcctctag

SEQ ID NO: 50585 - DNA, 369 bp, Glycine max
  Peptide Sequence Number=SeqID_167363
atggccacaacgatggaggtcatgatgagcatgaagaagataatgggagccaatgcggttacagttgccgctaccaacactattgctaagtgcaaaaacaagcatgccttcccaccatatgacttgccaccctactatacaccacccaatgtggcgtacactcccaatgggaatgtcaataactccactcctatactcgttgagagccagcaacctcaatctgatcatgcacatgtctctcgacccatgggggagacacatgaaatgccccaccacaatctagccaacttcgagccttgcctcggatatgtcgctgaagggcaagcagttggtgatatacccttgcaaaacactttggagggcccttag

SEQ ID NO: 50586 - DNA, 402 bp, Glycine max
  Peptide Sequence Number=SeqID_167364
atgggaaagttggatcatctagaggaaaggctcagggccattgaaggaggcgaagattatgtctatgctagcctagaagagttgttcctagtacccaatatcatcacccctcccatgttcaaggtgccggactttgacaagtacaaggggaccacttgccccaagaaccatctaatgatatattgtcagaagatgggggaatacgcaaaagatgagaaactgttgatacatttttccaagaaagtcttactggggcagctatcacctggcagtatgggtacaattctgatatggctccggataggatgcaactacagaacatgtgcaaaaaggggcatgaatcttttaaagaatatgcccaaaggtggagagacctggcagcccaagtggttccctcaatga

SEQ ID NO: 50587 - DNA, 924 bp, Glycine max
  Peptide Sequence Number=SeqID_167365
atgattgcctattcgaccgtcgccatcctcaccgccacgacctatgtctttgccgggttgatgcgggaacaggtctgcacctacatgtgcccttggccacgcattcaggcggcgatgctggatgagaattcgcttgtcgtcacctataacgactggcgcggcgagccacgctcacggcacgccaaaaaggccgccgcagcgggggagagcgtcggcgattgcgtcgattgcaacgcttgcgtcgcggtctgtcccatgggcatcgacatcagggacgggcagcagctggaatgcatcacctgtgcgctctgcatcgatgcctgcgacggggtgatggacaagatcggcaagccgcgtggcctgatcgcctatgccacgcttgccgagtatcaatccaacatggcgctcgcgaccggcaacggtcagcacgcaatccgcccagccaacgtgcgtgaggaagacggcaagttcagcaagcgcgtgcgccacttcaactggcgcatcatcttccgtccgcgcacgctgctttatactgccatctgggcggctgtcggcatcggcatgctgtctgcgctggtgacgcgcgagcggctggcgctcaatgttctgcacgaccgcaatccgcaatatgtgctggaatcgaacggatccatccgtaacggctacaccgtgcgcatcctcaacatggtgccgcagccgcgcacaatgagcctgaccatcaatggccttcctgatgccgtgatgaagataaacggtatgcccgatgcggccgcgcgtgcctttgaggtgacggtggagccggatgaagcgacgacgctgaaggtcttcgtcacccggccgggcgggcgcgtcgctcgggccgcggaaaatttcgagtttatcgtcagcgatacgggcggccatgagacggcccgctatgacgct

SEQ ID NO: 50588 - DNA, 385 bp, Glycine max
  Peptide Sequence Number=SeqID_167366
ctataaggcagacagaggcgatttcggcagcgggggggggggggggggagttcgcggtgtggatgatcccgcagctgttcgcgtacgcggtgaactacccggcgcagagcaggatcatggtgatggcgtggatcgcggcggcggcactggtgctgcacactttgttcagctggttgctcattctggagttctggtggggtctcgtcagcgccgtcgtggtgctgaacgcgtcgtggtggttcatcgacattggacagctgcacactttttcttcaatcttatagaagacgacacaagttcgccatcagagcttgaagatgagagggcaaagagtgtttcttctctctcccgcgctcactatgacggcaatgaagagtcaggatag

SEQ ID NO: 50589 - DNA, 357 bp, Glycine max
  Peptide Sequence Number=SeqID_167367
atggatgctgatgaagcgatgagtagagaaacaaatgaagtggaattcatagggttaggtgctactgccatagatttagaagaaccaagctctaatacaaaaggaaaaagacaatgttcgacttcttctagcacacatcctcacaagaaaaagatgggagaaaaagaaggaatagcagcttctttggataaaatggcgaactctttcaaccgaatggtggaaaaaatggatggtaaagttgatgacgaagatattcaagaagtattacgtgagacagctttgataccagatcttagtagacaacaatgggctaaagctattaaatggttagctgatgatccaaagcagctattgtga

SEQ ID NO: 50590 - DNA, 502 bp, Glycine max
  Peptide Sequence Number=SeqID_167368
atgagagagtggtttgcttatagactgcaatgcaggcccaatgaaggtcaaactctactgcattctagaaaactattccaacaatttgttgctaaaggatacacaatgattgaatcagaaagactttcctatgttagaaacaaccaaaagaaactcagagttgacaagttctgtaacttgcagcagtcatcgaatgctggaaatacagaaggtttaagtaaaggcaagagaatcatcataccttcaacctttgttggcagcccacattacatggatcaactttattttgatggaatagctatatgcagtcacgtaggcttcccaaatctttttattacttttacatgcaatccaaattggcctgaaattcatatgttgctgacacctttgaatttgacagcaatagataggccaaaaataatctcccgaattttcaagcttaaatatgagcagatgttatcagaccttacaaagaatcacttactagggaaagtcgtcgcat

SEQ ID NO: 50591 - DNA, 216 bp, Glycine max
  Peptide Sequence Number=SeqID_167369
atgccactcaataagaagttgggcatctacaaaggcaaaaactcttcaaagcttaatcttcatgttgccccctgttgcaacctacccttcggcgggagggcaacgcgagactcacgggtatgtcttccatgggaggaaaacgagcggagtcgccaccaacgtttattcgaggaaaacgtcagcaaaaacggaaaaggcatggtctgcaaactttaa

SEQ ID NO: 50592 - DNA, 489 bp, Glycine max
  Peptide Sequence Number=SeqID_167370
atgaagaagggcaagagtgaggccaatagagaaaagaagaaggaaactactcctattgaaggcaaggaggtaccctatccattggtaccttcccaaaaagacaaagagagacatttggccagatttcttgatatcttcaagaaactggaaattaccttgccttttggagaagcacttcagcaaatgtccctctatgccaaatttttgaaggatatgctaactaagaagaaccggtacattcatagtgacaaaattggtttggaagagctggagataatgcccacacgcataaccctccagttagctgatcgctccatcacaaggccatacggagtgattgaagatgttttggtgaaagttaagcaccttatatttccagctgattttgttgtcatagatatagaagaggatgctgacattcctctcattcttggccgcccattcatgtctatcgcaagctgtgtagtagatatgggaaaaaagatgtga

SEQ ID NO: 50593 - DNA, 597 bp, Glycine max
  Peptide Sequence Number=SeqID_167371
atggttacttacgaagcagagaaggatgtgagctcaccattgaagactgttgaggaggaaaaggcagctgaggttattgatccattgggagagttggtgaagaacttgttcgacatttaccaaaggcctgttgaggtgtcatgggatggtgctaaatttgggatcaataatgtcaaagatggcttcttcatcacacacgctgatgtgagcaagataatattaggagacaagtgtttaaacatctccattctacagctatggcttatgtttattcatgattggagtgcgagcattggttatggatcattgtatgggttccttgaacctcagtgtatccacaatgcaagcagtagacgtcaagagtgtgaaaattacattggaaggtggttgaaggaagcaggaaaacaaatttacatagcaccttatttaaaccaggcccattggcagctcgttgtattgtgcccaggcgacaatgtagtggtttggttttgttctttgaagaagaagccggatgctgccatcaagggtgcagtaaacagtgcaatgaaatcagtcaccaaaactgcagagggaaagccacctcagcatgggccttag

SEQ ID NO: 50594 - DNA, 381 bp, Glycine max
  Peptide Sequence Number=SeqID_167372
atgagtatggtagacgaaaattttagactcaccgcaatatcagaggatgatgtgtccagtcatcagtccgacaatggcgtctacatagatgatgttggaggtatgaacaaccaaagacagatatttggtctaagttcagaggctgtgaaattcagaccttcctcttgcacagatggcatctcacggtctgaatttgagcaactgagagctctagagcaactgaagacactacaagaggagtcacgtctagttcgagagcgatggcgtcagtttatggagagcttttctttgagtcctccatttggaccagttcgacattcggatcaagatgatgagcaagatgacaatgaatcagatgatgactttaatggagatgtttaa

SEQ ID NO: 50595 - DNA, 1779 bp, Glycine max
  Peptide Sequence Number=SeqID_167373
atgagaagcagtgatgaggttctgttctccttcttccttcttcttgctttggtgttatgcttccaactctgttccactggagatactttgaaggctggccaaaagataactctgaactcaatggagaaccttgtttcatcaagtcgcacatttgagcttggcttcttttctttaaatgatagcagccgtgttgtaaaaagctactactacttggggatatggtatcagttcaacccacaaacagtggtatgggttgccaatagagacaagcctgttttagattctagtggtgtttttcgaattgcagaggatggaaatctggtggtagaaggtgcgtcaaaaaggcattggtcctctgtaattgaagcaccctcgtccacaaacagaacactgaagctcctagaatcagggaacctagtactcatggacgataactcgggaaccagtaattacctgtggcagagtttcgagaacccaacagacacgtttcttcctgacatgaaaatggatgcaagtttagcattgacttcatggagaaaccccactgacccggcacctgggaacttcacctttcgactgcttcaaattgatgagagaccaaactacgcagtgctaattaaccattcacaactttactggacagctgatggactcgatgcagaaatgattcccaaagaaatacagttgaacgcaataagctttgggtggccgcaacaatcaaggctagtaatgaattatagcggggagatacaatttctcgagtttaatggaacggaatgggttaagaaatggtggaagccagaccacaagtgcgatatacgtgactattgcgggagctttgccatctgcaacaaaaataaccggattcactgcaagtgtttgcctggattcattcccgggcatgaaggagaattcccgctccaagggtgtaaaagaaaatcaacattatcgtgtgtcgacacgaacgtcatgttcctgaacttaaccagcataaaagtgggtaaccccccagaacaagaaatctccatagaaaaagaggaagaatgtaaatccttttgccttaacaccaacaagtgtcccgagtcgcaatgccaggcgtattcctatactgcgccttcatatgatcgtggttcctacacatgcaagatctggaaacaagatttatctactcttgtagaggagtacgatcgtggacgtaatctttctatcctgctcaagacttctgatatagcaccatcaattgcagctgcaaaattctgtgaaccttgcggcacatatattattccttacccgctaagcactgggccaaactgtggagaccccatgtacaacaagttatactgcaacaaatcaacaggccacgttacattcctgatgccaggaggaatatcgtaccccgttactcggatcgatgaagataccagaacatttttcattgaaacagatgcttcacattcctgtagttccagaagagatcaaaataacacacctaatattccatttaatgtagctgattgcatacaagatgttgtaataaaaatcaattggctaccagcaccagaacctccctgtattaagcctatagactgcaagaaatggtctcattcaacgtgcagaacaagtaaaggaggaaccaggtgcctttgcaatccaaactataagtggaatgactcaactatgaaatgtacccaagattttcttccgtatgcttatgaatgtcttactgttcccactggagcagagattagttctggtcctgaattttccaaactccgttga

SEQ ID NO: 50596 - DNA, 1103 bp, Glycine max
  Peptide Sequence Number=SeqID_167374
atcgggcaagcacccaaattcaggagagcttgtacgagagtgaaagacacgtgaaaggtttgattggcttaggaagtttagaagaaaaggacattgaaggaattgaagtaccctgttatacttatgcaagcattctagcagctacagataatttctcagattctaacaagcttggaagaggaggttatggacctgtttataagggaacgtttcctggaggtcaagacatagctgtaaagaggctttcaagtgtttccactcaaggcttagaggaattcaagaatgaggttattttgattgcaaaacttcagcatcggaaccttgttagactcaggggctattgcattaaaggagatgaaaaaatcttactttatgaatacatgccaaacaagagcttggactcatttatatttgaccggacacgaactttactcctggattggccaatacgatttgagataatcgtaggcattgcgcgaggcatgttgtatcttcaccaagactccagattgagagtgattcatagagacctgaaaaccagcaacattcttctagatgaggagatgaatccaaagatatcagactttggtcttgccaaaatatttgggggaaaagaaactgaagcatgtacagggagaatagtgggaacctatggatacatggctccagagtatgccttggacggattcttttcaaccaaatccgacgttttcagctttggagtagtccttctagagattcttagtggaaaaaagaacactggattctatcagtccaagcaaatttctagccttttgggtcatgcatggaagttatggacagagaataagctactggatttaatggacccatctctttgtgaaacatgcaacgaaaatgaattcattaagtgtgcagtcattggactcttatgcgtacaagatgaaccaagtgatcgacccactatgtcaaatgttttgttcatgctcgacatagaggcagcaagcatgccaattcccacgcagccaaccttttttgtgaaaaagcatctttctagctcagcttcctcttcgagcaaaccagatataggtcagtttgagagcagttatcaagaaggtcgatag

SEQ ID NO: 50597 - DNA, 776 bp, Glycine max
  Peptide Sequence Number=SeqID_167375
ggctacacatcctcactatcaggaggactacacgtcctcgccttcaggagggctacatgccctcccttcaaaggctacacaccctcgccatgagaggactacatgtcttcacatttagagggctacacatcctcgcctttagagggcttcgcgccctcgcctttacagggctacacgtcctcacctttagtggactacaccttctcgccttcagaggactacatgtcctcaccttcataggagactacacgtcctcccattctgaggactacaggtcctcaccttccgaggactacatgtcctcaccttatgaggactacacgtcctcgccttcagaggacaacacgtgctcgccttcagaggactacacatcctcgccttcagaggattacacgtcctccccttcagaggactacacgccatcaccttcagagggctacacggctgcatgccctcgccttcaaaggctacacgtcctcgccatgagaggactacatgtcctcaccttcagagggctacacgtcctcgcctttagagggtttcacgccctcgcctttacagggctacacgtgctcatcttcagaggactacacgtcctcgccttcagagggctgcacacccttgctttcaaagggctacacaccctcgccttcaaagggctacacgccctcgacatgagaggattagacgtccttgcctatagtggactacacgtcctcaccttcagaggactaaacgtcctcgccttcggaggattacacgtcctcgccttttaa

SEQ ID NO: 50598 - DNA, 2964 bp, Glycine max
  Peptide Sequence Number=SeqID_167376
atgagaactgatgaggttctgttctccttttctcttttttctttggtgttatgcttccaactctgttccactggagatactttgaaggctggccagaagataactctgaactcattggagaaccttgtttcatctaaccgcacatttgagcttggtttctttcctttaagtggtagcagcagtgttgtaaaaagctacttggggatatggtatcacgggttggaaccacaaacagtggtatgggttgccaatagagacaagcctgttttagattctagtggtgtttttcgaattgcagaggatggaaatctggtgatagaaggtgcatcatcagaaagttattggtcctctaaaatcgaagcatcttcgtctacaaacagaacagtgaagctcctagaatcagggaacctagtacttatggacgataacttgggaaggagtaattacacgtggcagagctttcaacacccaacagacacgtttcttcctggcatgaaaatggatgcaagtgtagcattgatttcatggagaaactccactgacccggcacctgggaacttcacctttacgatggctccagaggacgagaggggaagcttcgcagtgcaaaagctatcacaaatctactgggaccttgacgaactcgacagagatgttaattcccaagtagtatctaatttgttgggcaacaccaccacccggggtactgggtcgcacaatttttcagacaaaaccatctttacatcgaagccttacaattacaagaaatcgaggctgctaatgaattccagtggggagttacaatttctcaagtgggatgaggatgaagggcaatgggaaaagcactggtgggggccagctgacgagtgcgacattcatgattattgcgggagctttggcatatgtaacagaaataaccatattggctgcaaatgtttaccaggattcgctcccattcctgagcagtctgagggagagctccaaggacatgggtgtgtgagaaaatcaacatcgtgtatcaacaccgacgtcacattcctcaacttaaccaacataaaagtaggaaacgcagaccatgaaatttttacagaaacagaagcagaatgccagtccttttgcattagcaagtgtcccctttgccaggcatattcatataataggtcaacatacagtgatcgcagtccctttacatgcaacatctggacacagaatttatcttatcttgtagaggagtacgatcgtggccgtgatctttctatcctcgttaagagatcagatatagcaccaactgcaaaaacgtgtgaaccttgcggaacatatgagattccttatccactaagcactgggccaaactgtggagattccatgtacaacaagttcaattgtaccaaatcgacaggccaagttaacttcatgatgcccgaaggaatatcataccaggttactaggatcgaagaagataccagaacgtttttcattcaagcggatgcttcatattcctgtagttccagaagagatcaaaataacacacctaattttccatttaatgtagttgattgcatacaagattttggaatagttaaattcagttggcaaccagcaccagaacctccctgtaataggcctatggactgcatgaattggccccattcaacatgcagagaaaccaggtgccattgtgatttaaaatataggtggaacaactctatcatgagttgcacccaagaagagccgtcaagagagcatttaacccaccgactgacattgattcttacagtaactcttggttccatggctattctggcatgcataacagcatttgtgcttgtgcggagaaagaaaaaagctcataagcttgatcgggcaagcacccaaattcaggaaagtttgtatgagagcgaaaaacgtgtgaaaggtttgattggcttaggaagtttagaagaaaaagatattgaaggaattgaagttccctgttatacttttgcaagcattctagcggccacagataatttcaccgattctaacaagcttggaagaggtggttatggacctgtttataagggaacgtttcctggaggtcaagacatagctgtaaagaggctttcaagtgtttccactcaaggcttagaggaattcaagaatgaggttattttgattgcaaaacttcagcatcggaaccttgttagactcaggggctattgcattaaaggagatgaaaaaatcttactttatgaatacatgccaaacaagagcttggactcatttatatttgaccggacacgaactttactcctggattggccaatacgatttgagataatcgtaggcattgcgcgaggcatgttgtatcttcaccaagactccagattgagagtgattcatagagacctgaaaaccagcaacattcttctagatgaggagatgaatccaaagatatcagactttggtcttgccaaaatatttgggggaaaagaaacggaagccagtacagagagagtagtgggaacctatggatatatggctccagagtatgctttggatggacttttttcattcaaatccgatgttttcagctttggagtagtcctactagagattcttagtgggaaaagaaacacgggattctatcagtccaaacaaatttctagccttttgggtcatgcatggaagttatggacagagaataagctactggacttaatggacccatctcttggtgaaacatgcaacgaaaatcaatttattaagtgtgcactcattgggctattatgcatacaagatgaaccaggtgatcgacctactatgtcaaatgttttgtcaatgcttgacatagaggcagtaaccatgccaattcccacgccaccaaccttttttgtgaacaagcgtcattctagctcagcttcctcttctagcaaaccagaaacaagtctgcaatttgacagcagttatcaagaaggtcgatag

SEQ ID NO: 50599 - DNA, 2820 bp, Glycine max
  Peptide Sequence Number=SeqID_167377
atgagaactgatgaggttctgttctccttttctcttttttctttggtgttatgcttccaactctgttccactggagatactttgaaggctggccagaagataactctgaactcattcgagaaccttgtttcatctaaccgcacatttgagcttggtttctttcctttaagtggtagcagcagtgttgtaaaacgctacttggggatatggtatcacgggttggaaccacaaacagtggtatgggttgccaatagagacaagcctgttttagattctaatggtgtttttcgaattgcagaggatggaaatctggtgatagaaggtgcatcatcagaaagttattggtcctctaaaatcgaagcatattcgtctacaaacagaacagtgaagctcctagaatcagggaacctagtacttatggacgataacttgggaaggagtaattacacgtggcagagctttcaacacccaacagacacgtttcttcctggcatgaaaatggatgcaagtgtagcattgatttcatggagaaactccactgacccggcacctgggaacttcacctttacgatggttccagaggacgagaggggaagcttcgcagtgcaaaagctatcacaaatctactgggaccttgacgaactcgacagagatgttaattcccaagtagtatctaatttgttgggcaacaccaccacccggggtactaggtcgcacaatttttcaaacaaaaccgtctatacatcgaagccttacaattacaagaaatcgaggctgctaatgaattccagtggggagttacaatttctcaagtgggatgaggatgaagggcaatgggaaaagcgctggtgggggccagctgacgagtgcgacattcatgattcttgcgggagctttggcatatgtaacagaaataaccatattggctgcaaatgtttaccaggattcgctcccattcctgagggagagctccaaggacatgggtgtgtgagaaaatcaacatcgtgtatcaacaccgacgtcacattcctcaacttaaccaacataaaagtaggaaacccagaccatgaaatttttacagaaacagaagcagaatgccagtccttttgcattagcaagtgtcccctttgccaggcatattcatatcatacgtctacatacggtgatcgcagtccctttacatgcaacatctggacacagaatttatcttctcttgtagaggagtacgatcgtggccgtgatctttctatcctcgttaagagatcagatatagcaccaactgcaaaaacgtgtgaaccttgcgggacatatgagattccttatcccctaagcactgggccaaactgtggagatcccatgtacaacaagttcaattgtaccaaatcgacaggccaagttaacttcatgacgcccaaaggaatatcataccaggttactaggatcgaagaagataccagaacgtttttcattcatacgaatgcttcatattcctgtagttccagaagagatcaaagtaacacacctaactttccatttaatgtagctgaatgcataccagatgttggagttttattccgttggcaaccagcaccagaacctccctgtaataggcctatggactgcatgaattggccctattcaacatgcagagaaacaagtgaaggaggaaccaggtgccattgtgatttaaaatataggtggaacaactcaatcatgagttgcacccaagatcgggcaagcacccaaattcaggagagcttgtacgagagtgaaagacaagtgaaaggtttgataggcttaggaagtttagaagaaaaggacattgaaggaattgaagtaccctgttatacttatgcaagcattctagcagctacagataatttctcagattctaacaagcttggaagaggaggttatggacctgtttataagggaacgtttcctggaggtcaagacatagctgtaaagaggctttcaatatcacatattccatcatacaacttccctgaagtgctcttcaaccattacaatcataatttcactaaccttgttcttaatttgaaatgtgaaatgtatatcttgaaagacccgacacgaacttcactcctggattggccaatacgatttgagataatcgtaggcattgcgcgaggcatgttgtatcttcaccaagactccagattgagagtgattcatagagacctgaaaaccagcaacattcttctagatgaggagatgaatccaaagatatcagactttggtcttgccaaaatatttgggggaaaagaaactgaagcatgtacagggagagtaatgggaacctttggatacatggctccagagtatgccttggacggattcttttcaaccaaatccgacgttttcagctttggagtagtccttctagagattctcagtggaaaaaagaacactggattctatcagtccaagcaaatttctagccttttgggtcatcgatatgctgacttaccaataatttctatggacatattgtatcaggcatggaagttatggacagagaataagctactggatttaatggacccatctctttgtgaaacatgcaacgaaaatgaattcattaagtgtgcagtcattggactcttatgcgtacaagatgaaccaagtgatcgacccactatgtcaaatgttttgttcatgctcgacatagaggcagcaagcatgccaattcccacgcagccaaccttttttgtgaaaaagcatctttctagctcagcttcctcttcgagcaaaccagatataggtcagtatgagagcagttatcaagaaggtcgatag

SEQ ID NO: 50600 - DNA, 324 bp, Glycine max
  Peptide Sequence Number=SeqID_167378
atgaaatttacagcaagggaatgcctagtctcttcgacagtagtggtggagattggagaaggctgtgggagagacttgtgcagactggagagtgaaagggagtgtaattctaagggatatttttggaaaataaagtcaaaaggggagtgtcatagtaaaaatgggaatacaaataacaattccctcaagttaagaggttgtctcaagatcattgttgagtcggattctatggaggccatatcaaccatcgcctggggtggtgctgttgctaaggaagatagtcacattgtttcttcaattcacctgttggctaaacaggcttag

SEQ ID NO: 50601 - DNA, 279 bp, Glycine max
  Peptide Sequence Number=SeqID_167379
atgtctcatatgtcagttggagactgcacaatcacactccaagaagttagtactttgttggatttgcccattgacggtaaacctgtgactagtgctggtgtgcaagacagagcagaatacggtgtctttcaacaccacaacaagaggctgttagatgtccttgacaaaaatcacatcgaagcttgcatttttaacgttaaaagatacgatatcggccgaacaaaatttgacgttgaagagttgttcaatcatgcaacacataggggacagaaaacataa

SEQ ID NO: 50602 - DNA, 1465 bp, Glycine max
  Peptide Sequence Number=SeqID_167380
atgcctaaagctacaaagcacttatgccacgatccaaaggataatcttgatgatgatgatgatggtagtaacactagtaacaacaataagagcgcactcgaatacattgaagaggtcacaagcaacgctgatgtaattcaagaaaaggttcttgcccagatcctttctcgtagtgcacacgctgaatacctccaacgccatggcctagatgggcgcactgacagaaacactttcaagaagatcatgcccgtggtcacttacgaggatttgaagccatatattgatcgtatagccaacggtgatacctctccaattttatgttccaaacccatatcagagttcctcaccagctctgggacttctggtggggagagaaaattgatgccaaccatagaagaggagctagagaggagatcaatgctttatagcctcttgatgccggtgatggatcagtttgtgcccgctttggacaaaggcaaaggcatgtactttttgttcacaaaatcagaagccaagaccccaggtggactccttgctcgtccagttttgaccagctattacaaaagctcccatttcaagcaccgcaaacacgatccctacacaaactacacaagccccaatgaaaccattctctgccctgactcttaccaaagcatgtactctcagttgctttgcggcctttgccaaaacgaggaagttcttcgagttggggcagtcttcgcatcaggtttcattcgtgcccttaagttcctcgaaaagcacttcgtgtctttgtgcaatgacataagaaagggtaccttagacgccaaaatcaacgaccctttagtgagagaggccgttatgaaagtacttaaaccaaatcccacgcttgcggatttcgtagaagctgagtgcatgaaagggtcgtggaagggaattgttacgaggatatggcctaacactaagtatgttgatgttattgtcacgggaactatgtctcagtacattcccattttggattattatagcaatggtctccctcttgtgtgcaccatgtatgcttcttctgagtgctattttggtctcaatttgaaccccttgtgtgacccaagtgaggtagcttacaccctcattcccaccatggcatactttgagttcttgcccctcgatgagatcaacggacatactaattcagtttctcacctagtgcaagaacaattgttggatcttgcagatgtgaagctgggtcaagagtatgagcttgtggtcaccacttatgcaggactatataggtaccaggttggtgacattctccgtgtagccggattcaagaacaaggctccacaattcaacttcgtgtgtcgaaaaaacgttgttctgagcattgactccgacaaaaccgacgaagttgagctacaaaatgctgtgatgagtggagccgaccatcttgctcaatttggtgcatctctaacagaatacacaagct

SEQ ID NO: 50603 - DNA, 780 bp, Glycine max
  Peptide Sequence Number=SeqID_167381
atgtttgacacttatggaacattagatgaacttattctttttactaaggcaatcaaaaggtgggatcttgatgtgatggagcaactacctgaatatatgaaaatatgttatatggcattgtacaacaccacccatgaaattgcatacaaaattcagaaagaccacgggcaaactgtagttgcttgtttgaaaagaacatggatagacttaattgaagcttatcttaaagaagccaaatggttcaacaacaaatatgtgccaacttttcaacaatatttggataatggggtgatttcttcaggatcatacctggccttggtgcatgcatcttttctcattggggatgacttctcaaaagaaaccatttccatgatgaatccaccatatccaaggcttttttcttgctctggggaaattcttaggctttgggacgacttaggaacctcaagggatgagcaagagagaggtgataatgcttgtagcatacaatgtctcatgacagaaaataatatttcagatgaaaatgttgccaggaggcatataaggaaactcataaagaatttatggcctgagctaaatggtctttccatgaccacaaccacaaccactcttcctttgtccgttatgagggcttctctcaacatggctagaacttctcaagttatttatcaacatggagattatcaaagcatgcttacggttgatgatcatgtgcaagcattgctatttacaccctctatcaactatcaagatgaaagtgatatcaatcatgttatttga

SEQ ID NO: 50604 - DNA, 696 bp, Glycine max
  misc_feature (190)..(190): n is a, c, g, or t
  Peptide Sequence Number=SeqID_167382
gtctacagctacttcgccgtggcgctggcacagaccggtttccgtgtggtgatgccggatgcagagatgcatggcgcgcgctacaacggtgatatcgacgcgcgcatgacgcacttctgggagattttgcgccagaacatcgatgaagtgccgctgctggaagcagcgctgcgcgacaacgattgggtgncggatgagcgtttcgccattgccggcgcctcaatgggcggcatgaccgcgctgggcgcgatggcgcgctacccacacctgcacagcgttgcctgtctgatgggctccggctacttcatgcagctcagtcagacgctgttcccgccgctggtggcgcacacgccagagcaaaaagcggcgttacaggcgcgactggccccgctggcagcctacgatccctgtcagcagctggcgcagctggctaaccggccgctgctgttatggcacggtgaagcggatgaagtcgtaccgtttgccgaaacggtacgactggagaaggcgttgcgcgaggcgcagctcgatagccggctcacctttctggcggaaaagcagatcgggcacaaaatcacgccgccagcgctcaccgcgctgcgcctggtcagcggagctggcaagagcgggggtagacaggaagagacccatacgacgccagatcgtcgtgctgaacgcctcgttcagggattttga

SEQ ID NO: 50605 - DNA, 174 bp, Glycine max
  Peptide Sequence Number=SeqID_167383
atggttaaggaagagtgtatggaggtaaatgtctcctccaagatgttagctaagaaggaaattcattttgcaataaagataaacattaaagaaacttcccctcttagacaacctccatattttctcttttgtcaaaagacacttgttagcactgtcacacctcttgggcttaag

SEQ ID NO: 50606 - DNA, 375 bp, Glycine max
  Peptide Sequence Number=SeqID_167384
atggaacttatgagaatccatcaacatgaagagaatgacaaaaagaataaaggaattacactcaaagcctcatcatcttctattcatgaggaaaataacaaagaagacctgaatgaaaataacttagaagaagatgatgatttcagactctttgtgaagaaattcaataaatttatgagaaacaaaggaaatcaaaagagatcaaacttcaatccaaagaagaaaggagaagattcctccttagccccaaaatgttatgaatgcgatcaacctgggcacttgagatttgattgtcctgtctttaaaagaagaatgaaaaaatccaacaagaaaagtttcaaagataagaaagaaaagaaaccatgcaatacttag

SEQ ID NO: 50607 - DNA, 345 bp, Glycine max
  Peptide Sequence Number=SeqID_167385
tggaaacttcaaggaatctgtcactagagacatttggggcatgttaagtttgtacgaggcatcatatttaggtgcaaaaggcgaagaagtactacaacaagcaatggattactcaagggctcatttgtgtcagtcactctcagacctaagccctaaagtaggaagtatagtcgtcgaagccttgaagcttccaaggcacctaagaatgggtcggttggaagccaaaaacttcatggtagaatatagccaagcaagcaaccaaatacccgctcttctagaattggcaaggctagactatgacatgattcaatcgatgcaccaaaaagaattagcagagatctcgag

SEQ ID NO: 50608 - DNA, 171 bp, Glycine max
  Peptide Sequence Number=SeqID_167386
atggcaattacagaacttagagtttcatcgtttacaatctcacttgctagtcacaattcaaggccatctatgtatcaaccatggaacttgtcgttgcaaacatcaaaaccagggatggtgccaaataaattatccatcaagtccgttgctttcagtgagaagatgacgtag

SEQ ID NO: 50609 - DNA, 228 bp, Glycine max
  Peptide Sequence Number=SeqID_167387
atgaagcaattcatcaaaaaggaaaaggaatacaatctcacgacccctcccaagaacgcattgactcaatggcttcgtccaccacaatctctacgacaactcttgctatggcaaaagcttgattgtgatttaaaagataatctcaagtcatctaaagtccctgagttcaaaaactcaaaggggaaatataaaaatattgactttgagggactctgcacctattgttaa

SEQ ID NO: 50610 - DNA, 253 bp, Glycine max
  Peptide Sequence Number=SeqID_167388
atggaggattgccttgagggtccgcacttaggcaagcatgaaacacagctccaaactcgaaagtggaggacacatgaacgaaaacgcaattcatggagctctgaaaaaaggggagaatggaggattgccttgagggtccgcactaaggcaatcgtgaaacacagctccaaactcgaaagtggaggacacatgaacgaaaacgcaattcatggagctccgaaaaaagggggagaaatggaggattgccttgagg

SEQ ID NO: 50611 - DNA, 147 bp, Glycine max
  Peptide Sequence Number=SeqID_167389
gaaaagaagaaagctccaactaaagcaacgaatatgaagagaacaagaagagaccatggaaagatagaagagattgtgttcaagatatttgaacgacaaccaaattggagtttaagaaacctcatacaagaaaccaaccaacctgaa

SEQ ID NO: 50612 - DNA, 226 bp, Glycine max
  Peptide Sequence Number=SeqID_167390
atggcaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatctgcaccccttttgctaggcagacacagttgtgtccgatggcaagcagagaccaagattg

SEQ ID NO: 50613 - DNA, 804 bp, Glycine max
  Peptide Sequence Number=SeqID_167391
atggctggttacatttcactacttcggtgctggatttacgagcactttccatcagtccacaggtctgttgttgacgatggttatgctgaggctagcccatgtgcctgtaggtggcttacgggtaaggcccagatgaccgagattaagggagccctttacagagcacgtattgatgccctaacagtgaccgacgtctgttggatgtcatatgctgagcatcggggagttcggagctatgacttgatctcctcgtacacggggcaagtcagatggggtccgatcatcgtctaccttcgaccagagagggtggttcggcagatagggtacattcagaccgttcctccgccatcggttcgtgattcgttgacaggtactgatatagacgatcggtgggtacacttttcagaccatgtggcgcctacaggggagctctgtgtagttcctgggcaggtggccccagactacatggagtggttttttcagatttcgcacccctttgtgacgccgacggaggacactgttgagctgagacctacgcctccccctcccactaatgatgacttcgtcgagccacctgtcgccgaggttccaatcgcgtcagattcccctacgcattctgtggttgattgcacaacatgtgtcaggatgggaaggattgctgagcatttggagcgcgtcatcaacctcaggatggtgactgcagggactaacttatatgatatcatggatctttgcctgaggatagctagagatgacgacccaaatgacaatcttaggccgcgacagagaccctgcataaattag

SEQ ID NO: 50614 - DNA, 240 bp, Glycine max
  Peptide Sequence Number=SeqID_167392
atgccattgaggcatttcaccgaacacttggtgggcacgcgtttaggcatcaatagcaagagaacggggacaatgtggcatgccccattacttcaaaatagcaccaaaaggagatcaaaatacaccaatgaaaagctagaaagcttagggatggaatacttacttgttggtgatgaacaaaagcgcggaacggaatcaaaaaatgcgaaaagtgatgaccctaagactgcaaactcgtaa

SEQ ID NO: 50615 - DNA, 259 bp, Glycine max
  Peptide Sequence Number=SeqID_167393
atggaacgagatgagaaaagatttgaataccgtttctgctgttcttcggaagaaaaatatgtggaagaggataaggagggtggaattggtgctatggatgcgctgatttcaatcagtgaaatcaaaagaaaattgaaaaagaagaagattgcaagttacgagagtcgatttgatgaagaaatgagtaagataggaaggtttgggaatggaggaacgtcacaagggggaagaggctgcacaggggtttctgaaaaacgtg

SEQ ID NO: 50616 - DNA, 294 bp, Glycine max
  Peptide Sequence Number=SeqID_167394
atgacttgttgttcccggaggaacaaaaggtgcagaagactgtgtcagcccctgcatgctatcaagcgttctgtcttacagatagcaaaagaatgggtgcgaataaccataagaatgaccaaacttggtctctgcttgtcatcgggcccgccgcctctggatgacaaaagggtgcggataaccgtaagaatgaccaaacttggtctctgcttgtcatcgggcccaccgcctctggatgacaaaaagggtgcggataaccgtaaggtatctccgcgtatcatgggtgcagaatga

SEQ ID NO: 50617 - DNA, 468 bp, Glycine max
  Peptide Sequence Number=SeqID_167395
atgattatgaggggccaagtaatttatagtagccaagataaggctactacttcaccttcctttagtgaaagtgaagaagcaaaagcggaagaatctagtgaagagatctacccccaagaagaaggacaacctataatggttaaggaggagtgtaaggagataagtgtctcctccaagaggttagctaagaaggaaagacattttgaaataaagacaaatattaaagaaatttcccctattagacaacctccgcattttctcctttgtaaaaagacacttgttagcattgtcacacctcttagacttaagtttattcctcaagtaaaggagttgttggaagagggtttgattcacaagagcttaaatccttgtgctttgttggttcccaaaataggtattatttggcaccaaatccctaaaataggtgggattcaatacaaacttaggtactcatatgggacaccttag

SEQ ID NO: 50618 - DNA, 918 bp, Glycine max
  Peptide Sequence Number=SeqID_167396
gactgatagaggcccgtaaccagagctggaaaccccagggccctgttggacttttccgggtccactgggtgtctcttgtgggtgcgatccctgcaaacaatagatgggggagattggcgttgcggtcgctgggaagaatgttgctaagtagcaatgtcatctatatctgtgtaagagtggtcatgttggtgcgcatgatccgcactcgtctctttgcagcggcacgggtgaaatcttgcctcagtatgcatagtagcagtgcgatagcctccctctctagttgtgctcgcacagttggccctcctccaatatcagggggtggcccaggaaccgtgtggatatggagcccactgaaagtgaggacgcgtagtcctctaaaggcgagggcgtgtagccctctgaagttcaggacgtgtcgcctttcgaaggcgagggagtgtagtcctatgatggcaaggacgtgcaatcctctgaaggtgaggacgtgtagcgctctgatggtgaggacgtgtagtcctctcaaggcgaggacgtgtagtcctctcaacggtgagggtaacgagtacccaagccctctgatggtgaggacgggtagtcctctcaaggcgaggacgtgtagtcctctcaaggcgaggacggcgtgcagccctctgatggtgaggacgtgtagtcctcacaaggcgaggacgtgtagtcctctcaacggtgagggcgaggacgtgcaatcctctggaggtgagggcgtgcagccctctggtggcgaggatgtgaggacatgtggtcctctgaatgtgagggcgtgcagccctctgttggcgaggatgtgtagtcctctaaaagcgaggacgtgtagtcctctcaacggtgagggcgaggacgtgcaatcctctggaggtgagggcgtgcaaccctctgatg

SEQ ID NO: 50619 - DNA, 120 bp, Glycine max
  Peptide Sequence Number=SeqID_167397
atggccaattacctcggctatgatatttacgatttggagttgattgagtttaacaatgtgtcgatgctgtggaccgttgtcggtggcgaggtaggagacacatcgctggtggcaaggtaa

SEQ ID NO: 50620 - DNA, 354 bp, Glycine max
  Peptide Sequence Number=SeqID_167398
atgggggagacacatgaagcaccccgagaccacaatctagctgacttcaagactcacctcggatatgccactgaggggcaggaatttggtggcatacccctgccaaacaccttggggggacctcagtatcacccacaaccacaacccttgcattttgcggtgggaagagtccctcctactatgatggaaagggagaaatttgatcatataaaggaaagtctgaggactattgaaggaggaggagattatgtctttcctgacatggcaaaactgtgcctagtgcccaacgtcgttatccctccaaagttcaaggtgccggatttcgataagtacaaggggactacttgcccctag

SEQ ID NO: 50621 - DNA, 282 bp, Glycine max
  Peptide Sequence Number=SeqID_167399
atggaactcatgagactaaatcagcatgaagaaaatgacaagaaaaagaaaggaatgacacttaaagttttatcttcagttcaagaagaaagacatctgagagttgattacccgagtttcaagaaaagaatggaaagatctaagaggaaaactttcaatgacaagaaagcaaataaagcttacatcacttgggaagataacaatatggattcatccgaagactcagaaaatgaagtcatgaatctaagtcttatggcaaaaaattatgaaagcgaagaagag

SEQ ID NO: 50622 - DNA, 486 bp, Glycine max
  Peptide Sequence Number=SeqID_167400
atgaccactcttacatggatatggatgacgttgctatttagcaatattctgcccaacgaccacaatgccaatctccccctgcagatggatcgcacccacaagacacccagtggactcgaagaagtccaacagggccttggggtttccagctctggttacgggcctctgtcagtcctacagggtgcccattcccccagcaaggaatcgcacccacaaagacacccagtggacccggagaagtccaacagggccctggggtttccagctctggttacgggcctctatagtcctatagggtgcccgttccccccggcaaggtcacgtcatcatggcataggtaagtttgcagggatcgcgcccgcaagacacccagtggacccgaagaagtccaacagggtcttggagatgccaagctctaattacgggcctctgtcaattctacggagtgcctgtcgcccccagcaaggtcatcaggccccctactaa

SEQ ID NO: 50623 - DNA, 231 bp, Glycine max
  Peptide Sequence Number=SeqID_167401
atggcccgcaccaagaaaactgggcagatgacgtctgaggcagattctttggaggagcaggcgtcacagggatcgttcatccctcatggacgtcaggatgtcctgactgtcgccatttgggcgaccagagcaccctggtcatgtccgtgctgctggagccggtgtcaccatcaagaaatattttggatcggctccacgaacgtcccacaattcttcctccctgcctcctga

SEQ ID NO: 50624 - DNA, 317 bp, Glycine max
  Peptide Sequence Number=SeqID_167402
atgcttcctttcgacttccggcatgttgcggaacttcacgtgttgcctaacgatgagtggtatgacagctgggatgaccttaagagggtgttcttggagaaattcttccctgcatctaggaccactgccatcaaaaaagacatttcaggcatcaggcaacttagtggagagagcttggacttagcaatatgggagaggagtatgatatatgctgccagtggtggagctcttggtgatatgacccctcctgaggctaggaatttgattgaaaagatggcttccaactcccaacaattcaatgcaagaatgatgctatt

SEQ ID NO: 50625 - DNA, 255 bp, Glycine max
  Peptide Sequence Number=SeqID_167403
aaaaaaaaagaagaaggagtacagatgagagtcgtcatcacggaaagggcaggacagacgaaatcagtgtcttatctttactttcctcttatctccgatgagagattcttcctccaaaaggcttttgcttctggaggaagcaaccttgctcgccggggcgagctgggtggcaagctcctcccctatttttctataaatagggggaggagtgaagagggaagggttcagccttcttggcacttcgtattctcttaa

SEQ ID NO: 50626 - DNA, 357 bp, Glycine max
  Peptide Sequence Number=SeqID_167404
atggttgaggccctgagcatttacaagaagtgcaaaggttacagcttagactacgtaggatcaaggaagctgatcaacctaactaccttagcggatcaacctaactacagcagcgcaaaagtagaagaaatggaaatgacgcttgcctcaacggtggatggtggcaaagctcttcacaggaacctcctcaatgcacctcactgcaactccacatcactgcaaatggcaatgccccggaagaagaataccaaaagcgcgcaggaaaatgaaaagttgggtgaagaagaagaagaatatgaaaagcgggagagagaaactgaagcgttgggtgaagaagaagaagaatacgagaagtag

SEQ ID NO: 50627 - DNA, 4416 bp, Glycine max
  Peptide Sequence Number=SeqID_167405
atgaacttcgcaaatacagccactaatcttcagaagcaagctgtagtaaaaggcctatccaaaaatcctaaaactgtcccaagtaacccaaaagttggcctggctgataaatgttcagttactagaacacttgccaagcaggctaggaaacatttggataactctgtttcaaaaacacatctaccatccagaatgcatcaatcaggaactgaagcaaataaggagtcagaagcttgtcttccacaaggtgtttctgacatcagtgagaaaaagcaacagacacagattcaaacaacaaaattgtcgggcctgcgtatgccatctccctcattgggattcttttctctagaaaaaactcccagttcacatagccaattacagaaaagctctaaaccttgcaaacctgatagtagtaacattcctaaattacagaatttagaaacaaattctgttaatgaggcaagactaccgcatgcacctggaataaggtctcaaattgtcaaaggtgcagcaaagaattgcaccaatgtattaacccttttagatgtaaagtcagaaccaaggatgcaagtggataataagcaattggctggtgtagaagtggaacatagctctatgggctctgaaaaaataagcaagcaagaaaaggttgaaaacaatcttgaacatgtcaacataaaatctaaggatcaaggacaattacatagaagcgataatgcctctagcatggagaatgtgatattccctagacatgaaaagaagcttctttcagtgagtcaaacccaagagcagtcagagaaagaggctgatcaccctgacgttttgtcaaacgagtatcaatctgtatttcaggaatcacagtctatggatagtcatggcatgcagagaaatttactaatgaaagctagtatttcaaatactgtgcataatgccatgggacaagatgaagatgaacaactcaaactgctggcttgtgatgttcttacttccaatgaaagttttgtgctacaggaaaatcatgatacttcttttaaggatagtagactctctgaagagttcaaggaatacaatagtgtcgagactgcacttttaaattatagtcttgttgatttgagtgaaactgttttggggggatctatacaagaaatcccccttaagaatactgaacaggtgaatggtgatgctactgattttgttacaagtggaggagatgcacaagtgcatttattgaacgggaatctctcagttgagtgcaatgaaagcactgaaagtagtttagaggcagttaatcagcagttacagggggaacaactcaagactacaagtgctggtattgtaggagaaattagttcatcaaaagatgaatcacatgtaaatagttgtcaactagttcatatgacaaccttatcttccaaaggttctcctcagaagtctataccagaaatcaactgtcctgctgaaagtgaaccaaaagccgaaattgaagactgccagtttccagtagatgatcaatcaggtttcattctgacaagaccagtgttggaaggatgtgagaaggttattgacccaatagcaatgcatgagagttctcaagcatttgaattggatactttaagtgaagattgtgtggctgtttctgcacctgcttgcaacactgtggtaagcaatgtttctcaggaaagcaaaccttttcaagagaatctccactttacttcccaactatgtccaatggtaaaagctgattttgattcgagtaaaaatgaaatgtcagccaataactgctgtacgatttctgagttgcagcttaaagatgaggattcttctaaggatgcttcaatacacaatgatgtttcgtttgatatccctggaaactttgagcaacaaattagcaagaccatatattctaaatccagcaaaatactttgtgaaggtgagagtttagagctaaatcatggtcacttgcttgatcagggtgaattttgtgaagtatctgcagatttcatttcaaacaccaaagattctatcattattgaagctggaaaatcctctggctgtttacaacatacactactggctcagttagtccaagaagttgatcacagtaacagagagattgaagaatctcatgtggaagatgcacaagtacatttgttcaatgaaaatccagtggcatacaactgcaactgtaagcactgccttcttgttacaaatgataagtttccattgtcagataacaataacataaatgtaaattctcatctttctgattttcataggcctggtgctgttgttggtgtaggttcggagaatgttaataacatacaacacttagatggtgacaggctgcccacaagtattgcttcttctgaagaaatcaagaaaacaaatttatctgagggtgtcctagaaggatgtgatatccatacaagtgatcacaatgcttccaatcatcatattcaggttatgcctgaaaacaaagatgaaaatattgatgtggatgaaagggaagagcttttacgaatggatgatttaaaagaaggttcttctgacatattgccattagttgaagttcaactcaatgacaacgtgatatcttctgaatccaattcttctatagaagtgagcaaagattcttttacagacatggttgcttggaaatctgaggagcattgttctttgagtgaaaggtcaaacttcccggcttcagataatttaaccttcaacacaggaatcctgcagaagttgaatcaaaatgccccccatggagattggccggaaactgtttctgcaactgcttgcgacactaagcttagagatgatggttcttctagggatgcttcaatgcactatgatggtcaatgtgatgttactggaaactttgagcaacaaactagcatgattacatattctatagctaatgaaatgctttgtgaagatgagagttcagtgcaaaatcatgatcacttggttgatcagattgattcttctgaagtatctgcagatttcatttcaaacaccaaaggttctattggtaatggagctgaaaccccccctggccatttacaacatacactattggctcagttagtacaagaatttgatcacaccaacagagagattgaagaatcacatctggaagttgcacaagtgcagtcatttgctgaaaatccagtgacatacaactgcagcagtaaccaccatcttgctgttactgatgataaatttccattggctgataacaataatataaatgaagattttcatctttctgagtttcaaaggcctggtgctgttgttggtgtagattcccagaatgttgataacatacttattgcttcttctcaagaaatcaagaaaacaaatttatctgagggtgcattagaaggatgtgatatccatacaagtgagcagaatgcttctaatcatcatattcaggctatgcctgaaaacaaagaaggaaatcttgatgtggatgaaagggaagagctttcgcaaatggatggtgcaaaaaaaggttcttcagacatattgccattagttaaagttcaactgaaaggttcccagaaggttgataacatactgaacttggatgttgattggctgcccacaaatattgcctcttctgaagaattcaagaaaaaaaaattatctgagggtgcattagaaggatccgatatccattcaagtgagcacaatgcttccgatcatcatattcaggctatgcctgaaaacaaagatgaaactcttgatgtggaagaaagagcagagcttttgcaaatggatgatgcgaaaaaaggttcttcagatatattgccattagttgaagttctactcaatgataatgttgtatcttctaaatgcaatttttctatagaagtgagcaaagtctctgttactgacgtagtaacttggaaatctgaggagcattgttctttgagtgaaagttcaaacttaccagctttagatgatctaaccttcaacacaagaaccccacaggtctgcgaagttagttcattgaacagtacaattttttcagatgaagctgaaactaataatatctttgagaaatatgagtttccaaatacagacatgcagcaccagtcaagtggcaatatttattctgcagaagacagcagcaaaataatttgtttggaggattctgcaactaaaagcaagcaagaagttcctactgtgaagcctccaccaaatgctgctccgttttcagatgaatggttagctgcaattgaagctgctggagaggagattttaacgatgaaaagcggtgctgtacaaaattctccccctgacaagcctcagcaagaaccaggtccttggtccccggtgagacgcaagaatcaatcgattggaccctttgattgtaccaaacacaatatccagcattccagttcagaatga

SEQ ID NO: 50628 - DNA, 816 bp, Glycine max
  Peptide Sequence Number=SeqID_167406
atgagtcatcattcatctagtgttaatggcgagggtactaatcataaggaccctctatctagaatcttagatgagttaagttccctcaagttatggaaagaaaaactagaaagaaaagaaaaaggaaaagagagaagcctaagtgaagaacttcatgactattatgaaggaaggcataggtcacatcttagacctcactcccataggagagaaaaggaaagaaagcctcaagaggctaacattaacctcccatacttccatgggaaggacaatgtagaggcttacttaaattgggaaataagggtagagcaacaacttaaaagaaagtctactttaaaatcttatggatctcacttttatccaaagaaagaccaaggtctaggcatcttaggggcagcaccttctaagcccaaagatgataaggggaagacaatagaaaagcaagtccctaaggctagtatgcaaaagaagactagctttataaagcaaaaaggagaaaaattgaaaagtgttgcagctagtgtctcgctaagcgaggcccttgagcttagcgagtctcatccgctaagcgagacatcagcccacttagcgagtaagaggaatctggaagcaaatctaccatgcaagcacgtgcttagcacgtcatcagctcgcccaatgagtcatctgccccttctggcgcttagcgcgtctggctcgcttcgccaaagatcacttacttgtgctaagcgcgaaaatggcgctaagcatgcctttaaggacagaaagtcctttttaaagcctgaagtgaaagaaaagagagagcttggcagatag

SEQ ID NO: 50629 - DNA, 361 bp, Glycine max
  Peptide Sequence Number=SeqID_167407
attgagggcccaattggtggctagaaccacggtgttgctagcagagttctatgtcatcagtgacaacaccatcatcgtcacccaacgcatcatcaagaagcttccaatagaggccaacttcaggctcacaaattgcaagtccaccctcgcaaagcctccaccctacaccctcgcaaatctggttgtcgatgtagaggcatccatcggaggaagagacagtgttgaagaacaagttccacaaaatcttgaacctaccaagtgtgatggttgggattggtatgagtgggatcatttgccacaccctttggttgggcctcttgagaaaatggtcaaaggagctttcgacccatttccaatttga

SEQ ID NO: 50630 - DNA, 651 bp, Glycine max
  Peptide Sequence Number=SeqID_167408
atgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggggtattggtcacagtataaaagacattttagaggcacataaaggtccatttacgggccagggtcataaaggtctatatgagatcctaacaacgtcatggcatgctcaattatctattaacctagctatgttaggttctttgaccattgttgtagctcaccatatgtattctatgcccccttatccatacctagctactgactatggtacacaactgtcattgtttacacatcatatgtggattggtggatttctcatagtcggtgctgctgcgcatgcagctatttttatg

SEQ ID NO: 50631 - DNA, 123 bp, Glycine max
  Peptide Sequence Number=SeqID_167409
atgatgatttgggaacaacgtgcaaaattagtcatggctacagctaggtgggacgacgttcctaaaggaaaactctacaaggttccggaatttcaacaagcattaccgacaataacggagtaa

SEQ ID NO: 50632 - DNA, 147 bp, Glycine max
  Peptide Sequence Number=SeqID_167410
gtatggttggagtcaggtgtaggggttctggcaggggaagaggaaggtaaaggcagccatgggaggcaaccatgggcagcaggtcggaccaaattgttaggaacaaaggctaagctacactatgctaactacactaacagatattag

SEQ ID NO: 50633 - DNA, 2955 bp, Glycine max
  Peptide Sequence Number=SeqID_167411
atgagtgacgaaggagaaagaacttgtcctctctgtgctgaagagatggatttgacagatcagcagttgaagccttgcaaatgcggttatgagatctgtgtctggtgctggcaccacataatggacatggctgagaaggatgacactgaggggcgatgccctgcatgtcgttctccttatgataaggaaaagattgttgggacggctgcaaactgtgagagattggtgaatggaattaatatggagaaaaagatgaagactcagaaagcgaagtctaaatcatctgatgggcgcaagcagctcagcagtgtgcgagtgattcagaggaaccttgtttacatagttgggttgcctctcaatcttgcagatgaagatcttcttcagcggagagagtattttgctcagtatgggaaggtcttaaaagtgtcaatgtctcgaacagcagctggtgtaattcaacagtttccgaatgatacttgtagtgtgaaatatctctatgaccagccttgcagcaatccggattgtctatatttgcatgagattggctcccaagaagatagttttaccaaggatgaaataatttcagcatacactagaagtcgagttcaacaaatcactggtgccacaaacaatatgcaacggcggtcagggaatgtattacctcctccactggatgataatatgaatagttcatctgtaaagcctattgttaaaaattcttcttgtaactctgttaacattgtaagaggttcacctccaaatggaatatatgggaaaaatatggcccttcctgctagtgctgcatggggtactcaggcctcaaattgtcagccccctgctggaggtctatcatatccaaatgggccatccaagccgaaacctgatacaggctgcagcacactagcattttctgctgctgttacaggctcaattcaggcttctgatgttacaaagaggccaccatcaagtgatgggtgccatagtatgacacctacagtgaaaagtgaattgttgaaacctgttaaacaatataacaatagcgtgggcagtctggttagtgcaggagaaaaaacttcagcttctgatgtttctcctgtgctcgtgaatttgaacagccagttgtcttctctaccgttgtcccgagatagtgatggcaattgtactacagcaaacacaatatattctactaacatgactggacagtcttgtaactctggtcctgaggaagcaatgactgctaccaatgaagagattcagaatttgtccaatgagttgtcctcaattaacattgatagaaatgccgaacattgcggtataaccaaacctaatagcccgcctactgatcatgcattggttaaatcccctcaaattcaaggatcaaaatataatgttgacagatttagagatgtgataactacaaatgtgactggtaaagctaccttgaataatgtggcctgtaattctagggaacagtgtgattggaaattggattctcaatctctagtatcagatactgctgaaattgatgatgatgtgacatcttttgataatcaaagactcaaggatccagaagttgtttgccgttcttatttgccaaagtcaaccagtttccttcatgcatcaaaccattctagcccttgtcttctgcagcatggggaactttgtactgccataaatgcaggttctgtatctgctgatgatagagttcaaaatgaatctatgttacatgcatccaatatattatgtaatggccacccggaaaaattggtcagcagcagctcctatggtctgcttcacgatgaaagaaatgggcatatcattcaaagattagtcggtgatgatgttaattttgggcatgatgttgctagggataagggtgaaagtagtataatttcaaatatattgtccatgaattttgatacctgggatgactcactaacatcacctcataatttagctaagttgttgggtgacaatactgataaccggtctggtcctttaaacaaatctagttcttggaaaggtaatggtaacaatcaatcaaggttctcttttgcgaggcaagaggaatccaaaatccaaatgtttgatgcacatgcatcttatggtgtcagccatcaacggccaaaccatacagtcttccagaattttgcagaaagagacttgtatatggataagttgggcattgcaaatggattttctaccggtaactttgaggaagctgataatttggtcagtggtcatcccattgcatcttctaataagttttctgccatttcaagagcacaagtttcagccccaccaggattttccattccaagcaggctgccaccacctgggttttcttcccatgagagagtggagcaggcttttgactccatttctgggaattctttgcttgaccattcttccctattgagaaattcatatcagacaccttcagctggaaaccttggtagtgcaggggacattgaatttatggaccctgctattttggcagttggcaaagggagacttcaaggtgcactgaacagcccggcactggacattcgatctaatttcatgccacaattaaattacttcgaaaatgatgccagactacaattattgatgcaaagatctctcgcaccacagcaaaaccttagattttctgaaattgggaatactttttctcaacttggcgattcctatgctgtttcttcaaggttagatcaatcccaagtcagtaatctaggcccattccaacagctgtctctgcagcagtctacaaatgcagtcttgtcaaatgggcaatgggatgggtggaatgaggtgcagagtggaaatggtttgggtgtggctgagcttttgagaaatgaaagacttggattcaataaattttattcaggatatgatgattcaaaatttcggatgccaaattctggggatctttacaacagaacattcgggatgtga

SEQ ID NO: 50634 - DNA, 171 bp, Glycine max
  Peptide Sequence Number=SeqID_167412
atgaaggcaacaccaaatctggacaatggcgacattgaaagggagatggcggcgtgggtgatgctcaggggagaagaggttggaaagcacgatggtggcaagacatggttggcgatggtgacacaatggtggtggtttccattggagaatggaaagaagaaaagaaggtga

SEQ ID NO: 50635 - DNA, 306 bp, Glycine max
  Peptide Sequence Number=SeqID_167413
atggcactactaatagaagtaacagtgggagctgtgttcaacgagttgctgagaaccgagatagaacagcaaaacaacgagttgcagcttccgaaggaggaactccaatcgtttatcagaaagatggaggaggggacacagcttgttttcgagtgttcaaaaatccggtggctacactttgtgactagggcttacaaggacatgttacaaggacaaactggatcggttttccgacgagctcgtgaaactatttgccatcgacatgcaagctcagatggcaagagatcagaggagacattgcttaag

SEQ ID NO: 50636 - DNA, 405 bp, Glycine max
  Peptide Sequence Number=SeqID_167414
atgacattgtcagggcaaaactcaaaaacttcgacatccttaccttcaggaacactcgaaaggtggcaacgccactcaaaaaggcacgacttcggctacatggcggtggtgggagcagcaggtccacttcagcttcaagtacttcacggcgggaaacaaaacgtcagggtggtagcgggatggagttcacggcgggatgaagtagttcaggcaatagcgggggcgctaggtttttggagggacggtgtacctacaagcaccgtcttttatgacttccatcaaaactacaacgacggggttatagacaaatgtcattgtacaacaaacgtgccacataaaaacttatataattacgtaaatgccaccgtgttgacaactacgacaggttcttcaacactgacgtag

SEQ ID NO: 50637 - DNA, 1269 bp, Glycine max
  Peptide Sequence Number=SeqID_167415
atgttagatcttaatctcaatgcggaatggaccgattcgtttagtaacggtgactcgccgttaccgtcacagaagtttccagagggttcgaggaaccaaatggcggagtcagggacttcgaattcctccgtggtgaatgcggacgggtccagtaacggcggcggcgacgaggactcgtgctccacgcgcgctgacgatgtgtacaccaccttcaatttcgatatccttaaagtggaaggcgcgaacgacgtcgtaacgaaggagctcttcccggtgatgagtgaaggagctaaaggacacgctacgtcgtcattttcagcgaggaatggttttgtggatctctcgttcgatcgcgaaggaggggacagtgagatgaagatgcttcagcctcagaatcagcctcagactcagactcagactcagcaaccagcgaagaagagtaggagaggaccgaggtctcgaagctcgcaatacagaggggttactttttacagaaggacgggaagatgggaatcgcatatctgggattgcgggaagcaagtctatttgggtggatttgacacggctcatgctgctgccagagcctatgatcgagctgctattaagttcaggggagttgatgctgatatcaatttcaatctgagtgattatgaggatgatcttaaacagtttcttactgggcagatgaagaatttgtccaaggaggaattcgtacatatactgcgtcgccaaagtactggtttctcaagaggaagttctaaataccgaggagtaacactccacaagtgtggccggtgggaagctcgaatgggacaattccttggcaaaaagtatatatatcttggtctattcgacagcgaagtagaagctgcaagggcttatgacaaggcagctatcaaatgcaacggaagggaagcagtgaccaactttgagccaagtacttatgaaggagaaatgaaatctgcagccattaatgaaggtggcggtcagaatcttgatctcaatttgggcatagcaaccccaggacctggtcccaaggaaaattgggggcaacttcacttcccctccatcccttacaacacacatggtggaagaagttcaaagatggaaaccaatgttaattctggaattggtaatccatctttgaaaaggatggttgtaactgaagatcgtccttcattatggaatggcatgtctcctaatttctttcccaatggggtaatccatttggccttgattgcttatttctttattgagtacttcatttaa

SEQ ID NO: 50638 - DNA, 159 bp, Glycine max
  Peptide Sequence Number=SeqID_167416
atggatccgatcggaaacaaccgaatgaaagaggcaatactggttggttcggtgaccggtcaccgatattgcaaaaagggaacagatatttttcgttgctggttctctctctatgtggaaggtcaccgtctcgttgaaggaaactatcggcttcgttga

SEQ ID NO: 50639 - DNA, 348 bp, Glycine max
  Peptide Sequence Number=SeqID_167417
atggagccagtctcatttcgcaacgctatttcatttaacgaaatcgttttttctgactttgaatggaaaacacatggtatgggagctgctcgcaagttgaattcccaccgaagaaggcagaggaaggctgacaaatcatacaagaaatcacatcttggaaatgaatggaaaaagccatttgctggatcgtctcatgcaaaaggcattgatgaaatgcttattgctggttttgggcgaaaagggcatgcagttggagatattcctggagtccgatttaaggttgtgaaggtatctggggtgtctcttctcgccctcttcaaagagaagaaggagaagcctaggtcttga

SEQ ID NO: 50640 - DNA, 273 bp, Glycine max
  Peptide Sequence Number=SeqID_167418
atggaaagtattgaggaggagcaagaagaggtggccataaatgcatcaaatgaaacgatcctcaatgttgtgaacgaagaaacctatgtatttagagagagtgatgatgttagtggggaagaagataatggtgttgaagatgaaaatgaagatgtatttgaggatgatggtactttgttcagtaacaatttactagccaggttgtgtgaggaaagtgtaggaggtgaaccaatcatcatcaatggtttagttgacattggaaaattaatatga

SEQ ID NO: 50641 - DNA, 144 bp, Glycine max
  Peptide Sequence Number=SeqID_167419
atggcggatggcccaaaattccgccaactaaatactgcatttttcagggggttcatggtgcttatagtgaatcagcagcacagaaggcctacccaaattgtgaagctgtgccttgtgaacaatttgaaaccgcatttgatgtga

SEQ ID NO: 50642 - DNA, 1065 bp, Glycine max
  Peptide Sequence Number=SeqID_167420
atggaaagatgcgagtggacgaggttttgtatctgggggttgacaaaagatcgcaggaggaggagtggattatggagagggagtggtggatgtgtggggaccgttggtgaggtggggtccactaatagttgcatccacgcgagaggggacccacgagagaaggaacagaattggcaaatgtctagccagtcattggagaacatgttggcatgttcaaaagcacagcaagagaggaagccaaggcctcagccagaacaggctctgaagtgtcccagatgtgactccaccaacaccaaattctgctactacaataattacagcctctcccaaccaaggtatttctgcaagtcctgcaggagatattggaccaaaggaggtacacttaggaatgtccctgtgggaggagggtgcaggaagaacaaaaggtcatcatcatcatcatcttcaacatcaaagagagttcaagaccaagcattcacaccaaatcctaactctctcattggccttccttcattgtcctatgactcaagtgacctcactcttgcattggcaaggcttcaaaagcagtcatgtgggcaattggggtatgatgagcatgatctttcaatgttggggaaccaccacccaagcaccccatgtgataatatccttggcatgcatcatcactcatcatcatccacaaacccagggttcttggatgccctcagaagtgggttccttggaacacaaagtagtaatatgcagcagaatctgtactatggatatgggaatggagacatgggggaggtggacaatggaaatgcttcttgtggtggagagatgatgatgatgccttataatgatcaagaaatgagtgttgcatccacacaggcagtgacagtcaccaccatgaagcaagaaatttgcaatggaagggaaccaagtagtgagagtagggtgttgtggggttttccatggcaattcaataatgctgacacaaacatgggtgaacttgactcaggaagagctagttggaatggcatcaattcatcatggcatggacttctcaacagtcccctaatgtag

SEQ ID NO: 50643 - DNA, 816 bp, Glycine max
  Peptide Sequence Number=SeqID_167421
gctgttgaaaggtggcttgtggacagagcagttttgccaattgagaattctttaggagggagcatccacagaaattatgaccttttactccggcacagtttacatatagtaggagaagtaaattttgcagtttgtcactgtttgatggccaaccatggtgttaaacgtgaggatttaaaacgggttctaagtcatccacaggctcttgctcaatgtgagaacacactgacgaaatttggattggtgcgagaagcagttgacgatactgctggcgctgctaagcatgtcgcctaccacaaactacaagatgcaggagcagttgctagttctgctgcagcaaagatctatggcttgaatatacttgatcaagacattcaggatgacagtgataatgtcacccgatttttaatgttagcacgagaacctataattccaggcactgataggcgatttaagaccagcatagtcttttctttagaagagggtcctggtatacttttcaaagcccttgctgtttttgctttgcgtcagattaaccttacaaaggaagttacattgcaagcatgctttttaggcattctttgttacataatttatttgtttctccaaccgattgaaagtcgtcctttgcgtaaccaacctctacgagcatcagatgatagcaacaattccaagtactttgattatcttttctatgttgattttgaaacatcaatggctgatcagagtgcacaaaatgccctaaggcatctaaaggaatttgctacattcttgcgtgtgctagggagctatcctgtggacactagctcgatgtaa

SEQ ID NO: 50644 - DNA, 754 bp, Glycine max
  Peptide Sequence Number=SeqID_167422
ttgcataggtgatgatctagctaagcttgtcctaatttgttttcatcaggctagcctatatactgggatgaggaaatcaaaagcagatgagaagattctcagctacaacgatgtggtgcttaggcgatctgatttacacatccttagtggtccatattttttgaatgatcggattatcgagttttatttcagctatctttcttcatgtcatccctctcaggatatcctgctggttccaccatccattgcattttggataatacaatgccctgtcgctgaggctcttggtgatttcatagaaccccttcatttgcctgataagacactggttatatttcccgtcaatgacaatgatgacgttgacagagctgaaggtggttctcattggagcttacttgcatattaccgcaacgctaatttgtttgttcaccacgatagttgcagaagcatgaatgcagcacccgccaagcaactctataaaggcattgctggatacatgggatcctctggatcagcttctgaggctagctttctggaatgcactaattcacccatgcaagacaatggttatgactgtggcttatatgccacagccatagccagagtaatatgcaactggcatgtaaatcataaaaatgctgatacaaatgatctgtggttttctgcggtgaaggaacaggtttccccatctgctgtcgccagcatgcgaggcgagatcctggccttgatcagagatctaatggcaagacattga

SEQ ID NO: 50645 - DNA, 210 bp, Glycine max
  Peptide Sequence Number=SeqID_167423
atggcagcaacaatggtgcggtggtggtggaatagggatggtgacagtagtagtggtagaatgacaattccgaatggtggcgatgatgacagtagtaacggtggaatgtggaatgatggtggcaacaatgacaatgtggtggggacactagtggtagacgatagcaatagtggaatggtgttggtggtaacgacaacaatgatggggtga

SEQ ID NO: 50646 - DNA, 256 bp, Glycine max
  Peptide Sequence Number=SeqID_167424
aaacgcaaacgacacaacaaaagggagaagaggcttacctcgaaggtcgacggtggagcagcgcaatgcacgtcttgcgggaagagaagaacctccaaagcaccacgaacacgccgacaataatgctgaagaagaatggaataagaagataaatcgggcgcggactgaagaagaagaaggggctcaagaagaaggggcactcgcagacgcgaaagagggggcactcacagtcggagaagaagaagaggctggctga

SEQ ID NO: 50647 - DNA, 244 bp, Glycine max
  Peptide Sequence Number=SeqID_167425
atgaccccaaggaagctcgcctcaaagagatccaggaaagacaaaggatggtcattcctccgggagagacgcgtccagcttagggacgacgagtataccgacttccaggaagagatagttcgccggtggtgggcatcgctggttacccccatggccaagttcgacccagacatagtcctcgagttttatgtcaatgcttggcctacagaggagggtgtgcgtgatatgcgatcttgggtgaggg

SEQ ID NO: 50648 - DNA, 444 bp, Glycine max
  Peptide Sequence Number=SeqID_167426
atgtctccttattgggttgtctttggaaaggcatgtcatcttctagtggagattgagcacaaagcatactgggcagtaaagacctgcaacttctctatgaatcaagctggtgaggaaagaaagttgcaactgagtgagttagatgagatccgcctagaagtgtatgagaatgccaagttctataaagaaaagaccaagaagttccatgatagcatgataattaagaaggacttcatggttgggcaaaaagtgttattgtataattctaagctcggactcatgagtgttgagatcaaaagcgactcacgaacaagagcttcaaggtcaatggacaccgacttaagccattcctcaaacccttctttagtggacgtagtggtggaagagacttccttactccaccctacccttcctccaccctaccctccctccaccatgacttag

SEQ ID NO: 50649 - DNA, 399 bp, Glycine max
  Peptide Sequence Number=SeqID_167427
atgccaatcacccgctgcaaaagtatcagttggtttgtgtcgtcccgacatgggaatcgcacccacaagacacccagtggacccggaaaagtcccacagggccctggggtttccagctctggttacgggcctctatcagtcctacagggtgcccgtacccccccggcaaggtcacgtcatcatagggatcgcacctgcaagacacccagtggacccaaaaaatccaacagggtcttggagttgtcagcgctaattacgggtctctgtcagttctacagagtacctgtaacctcctgcaagggcatcaggccccctactgatcgagctttcatcaagaagtactgcgtccctaggcaggcgcagggcgaaacaccacagcagcattgggatggctggtag

SEQ ID NO: 50650 - DNA, 906 bp, Glycine max
  Peptide Sequence Number=SeqID_167428
atgggaaaaaaccaaattgttctgttatgttactgtgagaaattgagtgactctggaatctggattgatatggctatctcggttgcagccgaatctaaacgggaagaagagaaagccaagggagtgaatccagataatggaggagaaaatccagatattgtaccatttgaagacaatgaagaagaggaagaagaagagagtgatgaagaggaggagagcttcagtcatggtgtagggccagctggccaaggcagaggtaggggaagaggtatgatgtggccgcctcatatgcctcttgggcgtggagcccgacccatgcctggaatgcagggctttaaccctgtaatgatgggtgatgggttatcgtatgggcctgttgatcttttcggtgtgggaccccgtggttttgctccatatggtcctaggttctctggtgattttggaggtcccccagcagccatgatgtttcgtgggcgaccatctcaacctgggatgtttccaagtggtgggtttgggatgatgatgaatcctggacgtggtcctttcatgggtgggatgggggttggaggtgcaaatccaccaagaggtggtaggccagttaatatgcctccaatgtttccaccacctccaccgctaccacagaacgcaaaccgtgctgccaaaagagatcaaagaactgctgatcggaatgataggtttggttcaggatccgagcagggtaagagtcaagacatgctcagtcaaagtggcggacctgatgatgacgcacagtatcaacaaggatacaaagggaaccaagatgatcatcctgctgtgaacaacttcaggaatgatgatagtgaaagtgaggacgaggcacctaggaggtcaagacatggagaggggaaaaagaaacacaaactataa

SEQ ID NO: 50651 - DNA, 107 bp, Glycine max
  Peptide Sequence Number=SeqID_167429
atgacgaatatcggtagttacttgtacaaaacaaccgtgaaagtggagcctgatgagactggcaggcatgcggggatcagacagggaagcattcgtgagcacctcac

SEQ ID NO: 50652 - DNA, 303 bp, Glycine max
  Peptide Sequence Number=SeqID_167430
atgtctttggtcccctccatcaattttatgcgtaaaaggaaacgcagtttgaaatgtcaagctttccttatgggcactgataaatcaagagggtgtgacgcatcaattctattgaaccaaacggatgagatcgatagtgagcaaactgcttttccaaatgacaactctataagagggttggatgttgtgaacaagataaagaccaggttggaaaatgcttgtcctggcatagtttcttgtgctgatactcttgccctagcagctgaagtatcttctgagctggatatggatcatatgaagtga

SEQ ID NO: 50653 - DNA, 504 bp, Glycine max
  Peptide Sequence Number=SeqID_167431
atggattcttcgttgatagaatggaaagaattaggggaagagggatccccggacaatgaaaacgaatgggaagatcgaaaagttggaagaagaaagaattttttggttcgacgcatagaattagctaagcattttctccgaacaaatatagaaccagaatggatggttttatgtcttttaccagttcttcctcccgaattgagaccgattattcaaatcgatgggggtaaactaatgagctctgatattaatgaactatatagaagagttatctatcggaataatactcttatcgatttattaacaacaagtagatctactccaggagaattagtaatgtgtcaggagaaattggtacaagaagccgtggatacacttcttgataatggaatccgcggacaaccgatgagggacggtcataataaggtttacaaatcattttctgatataattgagggcaaagagggaaagatttcgcgagactctacttgggaaacgggttga

SEQ ID NO: 50654 - DNA, 966 bp, Glycine max
  Peptide Sequence Number=SeqID_167432
atgtcgaaaatttctagtgggaactacacaaatgttcaagaaaagaaattgattcttacttcgtcatgtgtatttgttgagaatgaacaagaaatgaattatgttgtttatgcttgtggcatgcaggggtgtgatgcatcaattttgttgaacaacactgccaccatagtgagtgagcaacaagctctgccaaacaacaactcaataagaggtttggatgttgtaaaccagatcaagacagagttggaaaaagcttgccctggcgtagtttcttgcgctgatattcttacccttgcagctgaagtatcttctgttctggctcatggtccttatttgaaatttcccttgggaaggagggatagtttaacagcaaatagaacccttgcgaatcaaaaccttcctgctcctttcttcaacctcactcaacttaaagctgcctttgctgttcaaggccttgacactaccgatcttgttgcactctcaggagctcattcatttggcagagttcgctgcttattcattcttgaccgattgtacaatttcagtggtactggcagacccgatccaactcttgacacaacttacttaaaacaattgcgccaaatatgcccccaaggtgggccccctaacaaccttgtcaattttgacccaaccactcctgatacattggacaagaactactactccaatcttcaggttaagaagggtttgcttcagagtgatcaagagttgttctcaacacctggtgctgataccatcagcattgtcaacaaattcagtagtgaccaaatagctttctttaagagcttttcggcttccatgattaaaatgggaaatattggtgtgctaactgggaagaaaggagaaatcagaaaacaatgtaactttgttaacaagaaatctgcggaacttgatataggtagtgtggcatccgaatcagaagagggtctggttagctcaatatga

SEQ ID NO: 50655 - DNA, 1280 bp, Glycine max
  Peptide Sequence Number=SeqID_167433
taatatgttccaatggtggacctgagtctgatcttaccaatttggacttaaccactcctggcacgttggactcgagttactattccaatcttcaacttcaaaagggcttgcttcagagtgaccaagagcttcttagtgcaaatggtaccgatattgttgccattgttaacagtctcactagtaaccaaacttttttctttgaaaactttgcagcatcaatgattaaaatggccaacattggagtgctaacgggatcagatggagaaattcgaacacaatgtaattttgtgaacggaaattcttctgcccttaccaccaaagaatcatcacaagatggcatggttagatgggcaaaggttatgctggaaaatgctgggattaaaggaggaaaacgtggttggaaatgtcaaggtttccttatcatatgggcactgataaaagggtgtgacgcatcaattctgttgaacgacacggatacgatcgtgagcgagcaaagtgcagcgccaaacaacaactccataagaggtttggatgttgtgaaccagatcaaaacagcagtggaaaatgcttgtcccggcacagtttcttgtgctgatattcttgctcttgcagctcaaatatcttctgatctggctagtggtcctgtttgggaagttccattgggaagaagggatagtttgacagcaaatcaaacccttgctaatcaaaatcttccagctcctacttttaccattgatcaacttatcaactcatttggtaatcaaagcctcaacattactgatctagttgcactttcaggtgctcatacaattggtagagctcaatgtagattttttgttgatcgattatacaatttcagcaacaccggcaacccagatcctactctaaacacaactctcttgcaatcattgcaaggaatatgtcctaatggtggacctggcactaatctcactaatttggacttaaccactccagacacatttgactccaactactactccaatcttcaacttcaaaatggcttgcttcagagtgatcaagagctgcttagcgcaaataatacggatatcgttgccattgtcaacaatttcattatgaaccaaactcttttctttgaaaactttaaggcgtcaatgagaaaaatgggcaacattggagtgctaacgggatcacaaggagaaattcgatcacaatgtaattctgtgaatggaaattcttctggactcactactactgccaccaaagaatcatcacaagatagcgtggttagctcaatgtaa

SEQ ID NO: 50656 - DNA, 201 bp, Glycine max
  Peptide Sequence Number=SeqID_167434
atgaaattggacttctcgctttttttgttcgtgattcatgcaaaggcttgtggtcctgtttgggaagttccattaagaagaagggatggtttctcagcaaatcagacccttgctaatgaaaatcttccagctccttctctttgcattgatcaacttatatccgcatttgctaatcaaggcctcaacattacactgatttag

SEQ ID NO: 50657 - DNA, 1608 bp, Glycine max
  Peptide Sequence Number=SeqID_167435
atggcccatctcaaaaccagtcgccattcgcccatggatttcacaatggcgactccatcaccgttgcagccactcaaaacaactatccaccaccaaccacccttgcacttatactaccctccacaggaccttttcccttcgttaccgtgcccacacccgtctccacaaccaattttaaaatcatcatcattatctcagaaattaactcatctttgcccttccacccaaaagctcaaatcccactataccaggatggaaccatttcggaaaaaccacattgacattcaattgttgtgcaatgatgaaactccccactcttatgtttgtgccctatggttcctcaagcaattggatgtctacttcctcttatttgatggttgggtagttgatgcatgccaactatttgatgatataggctgggtagcagatgcgacatctgcgcgcccctttatcaagtggttttgttctggtgctataaggagcaaatatttggcacatgcccaacccaatccacatgaaatgcttccacagcatcctacatttcatgattctgcatatccaaaaaggatgttggataagagagttgcaattctgttttgtgccacatggacctgtgtgctatttgggaaaggtggtatgatgtctatggttgttaagtctaagacaaaggattctgtgaaatatgaagttgttgatggaggaaagctcaagtcaagctgtggtgctgatatacatgtcatcgtaaaaattgaaagtgcagagtctataccaaattttcattcgattatcactgcatctaatggggctatggttgccagaggagatcttggcactgagctccctattgaagaggttccacttttgcagggagagataatcaacttgtgtcataccatgggaaaggctgttattgtggcaacaaatatgctagacagcatgattgttcacccaactccaaccagaacagaggtatcaaatatagcaattgttgttcgagaaggttctgatggaataatgttgtctggagaaacagctcatggaaagttcccactaaaagttgtgcaagtaatgcacacagtagcattgtggacagaagccactataccaagtggtaaaatgccacctaacatcggtcaagtgttgaagaaccacatgagtgagatgtttgcctaccatgcaaccatgatgtctaacacccttggaacctcaattattgtctccactggaacaggtttcatggctcaagtggtttttcttgaccacatacttattgtaacagacagagtgacagccacagaaaatggtcttcccccacacaaagcaacacctctgtttgataagcttgcatttgagaagacacaacaagcactaggtggacatgttcctatcctattactaggagctgcttcttcacctcgacttgtggaagagatttgtttctcatatacaggaattaacaaccttgtcttgcatttcatctgttgtagcagtggtgcttattgttctttatatatatatatatatatagtgaggggtttgaacttggttctcatttggcagcttgaccataactatcaccttgaggacaacaagatactacaggcatag

SEQ ID NO: 50658 - DNA, 813 bp, Glycine max
  Peptide Sequence Number=SeqID_167436
atggcaggcgaagacgattcgttgctcttcgatgtttccgcagcgtcctccaccgacgttttctcttgctcccctctcctacctctcagatctaatcctcctcaatccgaaggaagagaaggtggcggtgcggattccagaaatctgagttcctcggttagtgacagcgcaagcaaagagaacgctgattggaacacaccgcagaagcttagcttggagcctcagcaaatgaagaagaggaagaagaaaggaggcggtgttttgaacccggtagagctttctatgataagtggcactgccactcccaaggcagggttgaatttggaagtaatccatgaagaagagtgtgttggcaattcaatagagttgcaggacattgaagaaaatttgttcatgcattcatccgatgctgttcctgttaaagatagaaagattggcttatctccaaagcctgctgcattagctaaagcttctccagccccggtttccaaagtcggtctttatatgctctttgcgcaaatgatgatagcaaagaggaaagtgcttactgtcaatgactcagttggcaacagatctaaacgcaatgcttgtcctccacggatgccagtagcttcgtcctcatatccttcccattgcttgtttaggatagatattaagtggataaaagcgccaagtaaagaattgaaagttactaggatacctggtccaaaatcagatatttctgcaagtgcaacaactgctaggagtggaatgttgatcactggttcctcgaagagaaatcagcatgctcgtcctggtgtgttctgcaactag

SEQ ID NO: 50659 - DNA, 672 bp, Glycine max
  Peptide Sequence Number=SeqID_167437
atgtcgatgcgcatgatccgcacccgtctctttgcagcggcacgggtgaaatcttgccccggtatgcatagtggttgcacgatagcctcctcctctggttgtgctcgcacaattaaccttcctccaagatcaggggggttgaggaccttgagttctctgaaggaacagatatggagcccactgaaagtgaggacgcgtagccctctaaaggtgagggtgtgcaaccctctgaaggcgagggtgtgcagccctctaaaggcgagggcatgtagccctctgaaagggaagatatgtagccctttcaaggcgaggacgtgtagtactctgatggcgaggacgtgtcgtcctccgaagggcgttcagccctctgatggtgaggacgtgaagcctatgaaggggaggacgtgcagtcctctgaaggtgaggacgtgcagccctctgaaggcaagggcatgtagccctttaaaggtgagggcgtgtatccctctaatggccaggacgtgcagtcctctaaaggcgagggcgtgcagccctctgaaggtgaggacatgcagtcctctgatggcgagggcatgtagccctttgaaggacgtgcaatcctctgaaggtgaggacatgcagtcctctgaaggtgagggcgtgcaaccctctgatggcgaggacatcctctaa

SEQ ID NO: 50660 - DNA, 693 bp, Glycine max
  Peptide Sequence Number=SeqID_167438
atgccctcaccttcagaggactacacgtcttcgcctttagaggactgcacgtcgtcaccttcagagggttgcataccctcacctttagaggatgtcctcgccatcagagggttgcacgccctcaccttcagagagctacacacccttgccttcagagggctgcatgttctcaccatcagaaagctgcacgccctcaccttcagaggactacacgtcctcaccttcagaggactgcatgtcctcaccttcagaggattgcacgtcctcaacattcaaggactacacagggctgcacgtcctcaccttcagaggactgcacgtcctccccttcataggcttcacgtcctcaccatcagagggctgaacgccctcacctttagaggactacacgtcctcgcctttagaggactgcacctcctcaccttcagaggactgcacctcctcacctgtagagggctacacgcccttaccttcggaggacgacacgtcctcgccatcagagtactacacgtcctcgccttgaaagggctacatatcttccctttcagagggctacatgccctcgcctttagagggctgcacaccctcgccttcagagggttgcacaccctcacctttagagggctacgcgtcctcactttcagtgggctccatatctgttccttcagagaactcaaggtcctcaacccttaa

SEQ ID NO: 50661 - DNA, 387 bp, Glycine max
  Peptide Sequence Number=SeqID_167439
atggtacatgatgacaatgaaacagttccgcatgtaaacactccaaatgatgaaatcaaggaatatctggattgcagaaaaccttctgtagagaggctacagttccatcttccaggccaacatagcgttctctaccaagaccatgatgatattgatgatctcctctctaacccaagcatttctaaatcaaaatttatagctaggatgaatacaaaccaagcttttgttgaagaggaccaatctcatttgaagatatcagaacagttgatggtgttgaatattccatatatagagaagcatgttttgctatggattttttacaggatgatagagaattcattacagcaatccaggaagcaaaagactggggctcagcaccttatctaa

SEQ ID NO: 50662 - DNA, 225 bp, Glycine max
  Peptide Sequence Number=SeqID_167440
atgatgttgttgttgaaagttttccctatcaaggagagttcaaataatgacccttctcaacgtcacgacgactctaatgctgctagtgaccatgtttacaacattctcactagtgacgttgcccttattgatggcgtagctcctcctgacactgtcttcgccacctctattggtggttgtgacattgctgaaggagggactcatcctaattttgaccagcattaa

SEQ ID NO: 50663 - DNA, 660 bp, Glycine max
  Peptide Sequence Number=SeqID_167441
atgaagggtatcattcgtatcggtgataaaaccaccgggggcggccaggttatggatggctcaaagaaaatgaaatttgccggtattggtgtggcgcgtaaaggcgatccggtcagttgcccgatattaggccacagcccttcttttatcgctgaaggacatccaactatgaaggataatggtgtaccagttgcgtttcatgaatacaaatgtcgtgcaaaacgacgggccgcgccttcctttaagcgttgggggatgttcctgattgtgcttattgcgaccggggggatcgcggcttatttcatatctaccagtacagctgaccatacggctgcgttttggttctgttttcctggaattctcctggctattggagggggattattcgcgcttcgttggttggtttatcttacgggagaatggctggcagatggctgggattcggcacgagagtgggatcttgctcaggatattcggcgtggtcagcgtagtctctctttgctaggttacgttgttcatttgccgcatgttatttcggctgaatccatctcactgcaattgctgatgccggaaagtattatgttgccgctacaggtggatgagtcaggtgagcgtcttatccgccacgccagtttcagcgatgctggatcacctgcgctg

SEQ ID NO: 50664 - DNA, 115 bp, Glycine max
  Peptide Sequence Number=SeqID_167442
atggatgttcaggattacccgaagcatcgacccgataagggtcatctttatcaacccggcacagtgactcaatactctctggccagacgggcactctgcttgtcaccatcgccag

SEQ ID NO: 50665 - DNA, 1035 bp, Glycine max
  Peptide Sequence Number=SeqID_167443
gatcatgggaccatcaatgtgagaccctatagataccctcatcatcagaaggaggagattgaaaaacaagtgcgtgaactgctgaaggtaggagttattagaccaagcatgagtgcgtattcgagcccggtgattttggtcaaaaagaaagacaagagttggaggatgtgtgtggattatagagctttaaacaaagctacaattccagataagtatccgattcccgtcatagatgaattattagatgagctttttggagcaactattttttcaaaaattgatcttaagtcgggttatcatcaaattaggatgcacaaggatgatattcacaaaacagcttttaggactcataatggccattatgagtatcttgttatgccatttgggttaatgaatgccccagccacttttcaggccaccatgaatgatatttttagaccatttttgaggaaatttgtattggttttttttgatgatattctagtatatagcagagacacaacagaacatcaagatcatttaacacaagttttgtctgtgttgtcagcaaattgctttgttgcaaacccgtctaagtgcaaatttggctgcaagcaaattgactatctaggccatgttatctctggcgatggggtggcagtagatccagagaaagtcaagtgcatcctcgagtggcctgagccaaagaatgtgaaaggagtttgtggatttttaggccttacagggtattacagaaagttcataaaagactatggtaaagtggcaaaacctctgatagatttgactaagaaagacaactttgtgtggggagcagatgcaatgaaagctttcaatttaatgaagcaaattatgacttctcctccagttctggtgctcccaaattttgaactcccatttgaagtggaatgcgatgcggctggtaggggaattggtgctgtccttatgcaacagaggcagccaatagctttttttagcaaggcattatctgatggcaatttagctaaatcagtgtatgaaacagacttcatggctttg

SEQ ID NO: 50666 - DNA, 735 bp, Glycine max
  Peptide Sequence Number=SeqID_167444
atggtggagaatccaacgaaacatgtcccatgcgatggcgataagatactcacttacccagataatatcattttgatttgggctgaggctcatggccctgactggaaagttccactaggaagaagagatagtttaaattcaagtttttctcttgctcttcaaaatcttccgggtttcaatttcacccttgatcaactcaaatctacatttgatagacaaggcctcaatacgactgatctagttgctttgtcaggtgctcatacaattggtagatctcaatgtagattttttgctcaccgaatatacaatttcagtggcaatggcaacagtgacccaactctcaacactaccctctcacaagcactacgagcaatatgtcccaatggtggacctggaaccaatctcaccaatttggacttaactactcctgatagatttgactccaactactactcaaatcttcaacttcaaaatggcttgcttcggagtgatcaagtgttattttctacaagtggtgcagagaccattgccattgtcaatagtttcggtagtaatcaaactcttttctatgaacattttaaggtgtcaatgataaaaatgagcatcattgaagtgctaacggggtcacaaggagaaattcgaaaacattgtaactttgtcaatggggattcttctaatctggctactctagccaccaaaaaatcttcagaggatggtatggtgagctcaatctag

SEQ ID NO: 50667 - DNA, 516 bp, Glycine max
  Peptide Sequence Number=SeqID_167445
atggatcaaggaaggattctcggagtgcttgttgatgagtgctggataaaagagtcatgcagggtcaaagaggaaattagacagtttttcaagaggagatttgaggagattgagtgggagaggcctagactagatgggaaccctggactagatggaataaatttcaagtttatcaagaaattctgggatgttatcaaaacaaatttgcttcgttttttggatgaattctatatcaatggagtttttccaaagggaagcaatgtatcattcttagctttggtccctaaggagaaggatttgtttgaaggctttacagtaggcagaaatgtggaaatcagtatactacagtatgccgatgacatgattttctttgggaccacaatgatgacaaatgtaagagcaattaaggctgaagcggtggttcttgtggggaggacattcggatcagaagaagattgcatgggtgaattggggaacaatctgtctgccaaaggagaaaggtgtcttgggcattag

SEQ ID NO: 50668 - DNA, 204 bp, Glycine max
  Peptide Sequence Number=SeqID_167446
atggctcaagccccaatcagaaaatgtggatctcaacaggcttcagaaatcacgatgcatgataaacaaggtgcttccttgccatttggcaagccattttgtggatacaagaattctgtccaatctgcctttggttgtggtctatatcaggtgaattttctccccacacaaggcacatccagaatgaaaagctgctctaactga

SEQ ID NO: 50669 - DNA, 219 bp, Glycine max
  Peptide Sequence Number=SeqID_167447
atgggggcaatattagatgtaggctgggaaatagacatggctggaaaatttatggaggatatagaaggttacagcgatggcagacttggtggatctccctggcatggtgtatttggcatcatagaaaaaggattgttttctcaaatgacagcttcaaaggtcacacaaattgatggaggatgctttgttcttccgctgaacatggcttatatacaatag

SEQ ID NO: 50670 - DNA, 1279 bp, Glycine max
  Peptide Sequence Number=SeqID_167448
gcaccgaaccgggcctgtggcagaccgcgggcgccctgctcaagcgcgacctgcgcctgctctggcgccgccgcggcgatgcgctgcagccgctgctgttcgcggtgctggtggtggtgctgttcgcgctggcgcagggtcgcgagccgcaactgctggccgccaccgcaggcgcagtgctgtggcttgcggtgctgctagccgggcagctgtcgctggattcactgttccgctccgatgccgaagacggctcgctggaacaatggctgctggcgccggtgccgctggcctggctggtgctggtgcgcgtgctgctgcactgggcgaccaccgcgctgccgctgatcgtgctgccgatgttgctggcatcgttgctgctgggaacgccgttgctgagcctgatcggtggcgtggtcgccgcgctgaccgtaggcatccgacgctctggtattctcgtggcgttgctgtcgctgccgctgtacgtgccggtgctggtgttcggcgccggcagtctggcggcagccggacgcggacaggatccggtcggtgcgctgctgatgctgggcgccggcctgctggtcgcgctggtgctggcgccccaatccacccctgctggatagccgccacgcatgaatccgattgtccgctggttccaccaactcggttcgccccccacgttcgaccgattcgctgcccgctggtcgcgggtgttctacctcgcggcggtgccggtgctgctggtcggcatgtggcaggcgctgctggtggtgccgccggaagccaagcagctggacagcttccgcatcctctacatccacgtgcccagtgcctggatgagcctgttcgtgttcgcgctgatggcgctgtatgccgccatcgccctgatctggcggatcaaggtctgcgagatcctggccatggcctgtgcgccgatgggcgccggcttcaccctgatcaccctgctgaccggcagcatctggggcaagggtacctggggtacctggtgggactgggacccgcgcatgaccagcgaactggtgctgctgttcctgtacctgggcgtgatcggcctcgccagtcgatcaacgtgttcggtgaatcggcgatcagcagcgcgatgatcgcgccactgtggtggatggtcatcggcaccaagttctggttcgccggttcggtgctggccaaggcccgcgccgacaacctcgaccgcgaggccggcaaggcctgggtcggtggccgggtcgatgccgcacgcgcggccggggaggcccagccatga

SEQ ID NO: 50671 - DNA, 732 bp, Glycine max
  Peptide Sequence Number=SeqID_167449
atgggcaacggagatgtgtgggagggcggtgtgaagaaagataacagtggttcgcacgccaagaaaggtggagatgaaagtggttgggtctttgaggggaagagatggaagggggctggttacatggttttggctaacttggtgctctcgtctatccctacttatgccatgcacatgcaatggggaggtatgggtgttcgtattgctcgttttcatgatgttgtcctcttgggtaaactgatttgggacttgtgtcacaaccctaataagctttgggttcatctcatttctaccaagtatccttgggtccaatttgaagatttgttcttatacaaaggtctgtataccatgacttctctcccttatgttttcgagcatcaagttgttccttctaggaacttcctctgtatcagacacatcatcaacaatgaccgttgcccccaatgtggtgtcatgagtgatgatgttggtcatatcctttggcaatgtggtaatgttcacaacggcctactggatatggatagtggtttctatggtaatattggtgtgatggatattgtcaaagcaaagcttgtgaccatgctaaaaggtctggaaatgtatgcatccattattcttagcataagaaatttcttagaggaacaatggagtctggagtttgggcactcgctacatgagggaaacttttgctcgaatttgcttgctaagaaatgttcgaatgttggagtttga

SEQ ID NO: 50672 - DNA, 165 bp, Glycine max
  Peptide Sequence Number=SeqID_167450
atgaatagggaattagggatattagggaaaacccaagtcccacattgtttgtctggaagagcacaggtggaacaattgatacgttacattattgaagaagctcctgaggatgctgaaaagaagcgatcttttaagttggttgctcaaattggagattttgattaa

SEQ ID NO: 50673 - DNA, 1647 bp, Glycine max
  Peptide Sequence Number=SeqID_167451
atgaaggtggggttggtgattaattctgttatgagagatgttagggataagttggttgttgatttgataaaggatgctttggttacgccagtggttgttactactgtggagaagaaggagaagaagaagaagaggaagtatcagaagaagagggtgttggctgaggatgagcctaagcctgatccttattggttggatacttttttcgggtttgcgccggaggaggcagagagggtgcccaattgggggcactgtggggtgcttagtccgcttttggcgaatgtttgtttggacgagttggataggtggatggaggggaagattaaagagttttatgttccttccaagagtgatgttatatggaatagtcctgaagaggagcaggggaacacatcgtggccggagttcgtgcccacgagtgggccagataagacgaggaagatggatttcctaaggtatggagggcatgtcttgattggtgttagagggcctagggctgatgcggctgcattgaggaagcagttgattgagttttgtgatctaaggtttatgctcaagcttgataatgagagcctccctatagagcatataaccaaagggataatgtttttggatcatgtgttgtgtaggagggttgtgtatccaactcttaggtatactgccactggtggtaagatcataagtgagaagggtgtagggacgttgttgtcggtcacggcaagcttgaaacaatgtattaagcagtttaggaagttgagttttctcaagggggatagggatccggatccccagccttgttttaggatgtttcatgccacacaggcgcataccaatgctcaaatgaacaagtttttgtcaacaatggttgagtggtatagatatgcagacaataggaagaagattgtgaacttctgttcttatatcataagaggctcccttgctaagctgtatgctgcaaagtacaagcttcggtcacgtgcaaaagtgtacaagattggtgctcgtaacctgagccgtccattgaaggagaaaaaaggacagtctcctgagtaccagaatttgctgaggatgggtcttgccgagtcaatagacgggctacaatatacgaggatgtctcttgtgcctgagacagattactccccgttccctagtaattggaggcctgaccatgaaaagttgttgctagaatacataaaactggaagatccaaaaactttggaggaacaacgggattgcatcagagaacaaggtcttgtttcacctcaagactatatttcaaggcttgtgtggaattacaaaaggaattctcttcctatggaccagctgtccttagtaaggagcaacgaaagtgttgtaggaaatcagcatttgctagttggctcaaaccaggatgaccaggaccacacaaacaaagaggaagaaaatgatggaaggatgaatgcagcagcacaaatgatatttgcttcagtttcaagctttggtgcagtggtttcatctttgcaagacatcgactcggacaaaatatttaacactgccactctgctagtgaacactgactgggctatcaggaaggagtatgcagcttcctgtgggaagctaataaagcgtgttccttgtggatgcatagccagcataggacaaggcaag

SEQ ID NO: 50674 - DNA, 661 bp, Glycine max
  Peptide Sequence Number=SeqID_167452
ggatcctaacctggcacaaaggattggtgctgcaactgctcttgaagttagagctacagggattccttatgtatttgctccatgcatagcggtttgtagagatccaagatggggtcggtgttatgaaagctatagtgaggatcctaaaattgtgcaagaaatgacagagatcatacctggtctacaaggaagtatccctgccaattccaggaaggggtttccatatgttggtggcaagacaaaggtagcagcttgtgctaaacactttgttggagatggtggtacaacaaagggaataaatgagaacaacacagtgattgattggcatggattgttgagcattcacatgcctgcatattctgattctattattaagggggtctctacagtcatggtttcatactccagttggaatggtgtaaggatgcatgcaaatcgtgatctagtcactggtttcctcaagaatacccttaagtttaagctaccaaatgctttttacggtaatgctttgtttgattatcctattatctcatctagaaagaaaaacagacccagacatgggaggaacactgcacaacatgatttgaacatggcaacacaagaacctgatagtggcttgattcatatgatgtggcatagacctagatataaaattatataa

SEQ ID NO: 50675 - DNA, 150 bp, Glycine max
  Peptide Sequence Number=SeqID_167453
atggagaaaggggtgaatgatagaaataatgcaaatgatacagtgaagaagcagaaagcaggagagtggacggttttttctctgagaagtgttgaggttgctcaagaaaacgtggtgatgacaaaccatgtgggcaaaaagaataattaa

SEQ ID NO: 50676 - DNA, 687 bp, Glycine max
  Peptide Sequence Number=SeqID_167454
atggatcaaagttggatgaaaacaccacacacaagtgacgagtatgagaacggggttgaagatttcttgcaatttgcgcagcaaaatgcaccagtaatgggatccacaaccttcacacgattatcgacagtgctagctttcgtcaacttgaaggcaagatttgcgtggagtgacaaaagcttcactaaattgtttgtgttaatgaagaaaatgcttcctgaagataacatgttacccaaaaataactatgaggcgaaaaagatattatgtcctatgggtatgaagtactggaaaatacatgcatgccctaatgattgcatttattacataaatcagttttctgaaattctcaaatgccccacatgcggggtatcacattacaaagtgaaggatgaagaatgtagtgatgaggcaacctcatgcaacaaccatccaacaaaggtgtgctggtatcttccaattattccaaggtttcagcgaatgtttgctaatggacgtgatgcaaaaaacctaacatggcatgcagttggtagaaaaagtgatagattacttctccattctgatgattctccccaatggaagacaattgatcatttgtatctggattttggtgacgatccaagaaatctaaggcttggtcttgcttcaaatgaaatgaatcctgatgataacttaagcaccaactag

SEQ ID NO: 50677 - DNA, 909 bp, Glycine max
  Peptide Sequence Number=SeqID_167455
atgtcgtcaagatttggtcgacatgggtatatgatagcagttgcattcaatatcacaagagtcatggcaacacccttgaggtcccctatgtattcagatgatccttcagaggctacgtctagggagagtaggcaatccgctcagctgagaagcttgactgttaggaccttggatcagccaaggcctacagttaatctatttggaagggtggtcgctcaagaaaagagtccaattgttcattctatttggaaagttgtccccgaatctctaaaggacctaatatgggatgacattttgggaaaatttgatattctagaagctttaaatgccaagaagaagttcatgtcgacggttgccactagatggaggcaatttaagtcttcattcacctctaaatacatttatggtgacaataagggtgaagataaacaacatccttctgttaaatatgatctcgagccagatacttgggaggaatttgccaaaatccgccttacccctaattggctggaaattcaaaaattcaatgactgccctcacttactgtctcatgtggattatgatttgcttgaaaagaatctgatggaggagaaaagaaagctacgagaacaacaagcaatgaatactgaggatttagcgatgatcctcggcccttcatcccctattcgagacataagtgctaaagttgatgtctcgctaagcgagctcaatacgcttagcgagtgtcatccactaagcgaggcatcaacgcgcttaacggataggaggaatgtagaagggaatctgtcacgcaggcacgcgctcaacgcgtcatcagcttgctcagcaagtcgtttgccaccttccaggcttagcgcgagtttggcgctgagcgatcattcacttactcgcgctaagcgtgacgtccag

SEQ ID NO: 50678 - DNA, 129 bp, Glycine max
  Peptide Sequence Number=SeqID_167456
atggcgaatcttgttggtggcatgggtttacagctggaaatgggatcgatggagtatctaaaagagattttatctgtagcaggagatggggcccacccagtggacagtaacaaagaaaagaggctatga

SEQ ID NO: 50679 - DNA, 2304 bp, Glycine max
  Peptide Sequence Number=SeqID_167457
atgcaaattctcaccgccctctctttctcttccttctttcttcttctcttattccttttcctattcggtaacgcacacgggttcggctcaatgggaccaatctccgcgtcgttcggaagagacgaggttttttgctccatcgatgctagtggaaaacaggacgttatttgttgggggaacaacgccacgtcaccgtcgctctccgccgtcgcaaacgccatccctgctatgtcagcactctccggcggggagggctttctctgcggcattttagcgaacacatcgcaagcgttttgctggagcgctgtaacgaaaccgagcgcagatctaatcctcgtgcctccggcgtaccggaacaccgcttattcccacatcgccgccggccagaatcacgtatgcgccgtcaagggatcctacttcgccgatcgcgattccggcaccgttgactgctgggaaatcacgaaaaccgcgaacaaaactttgacggcgaaacagagcgataagttcaacgaccaattaatgtcgaatctggaggtgaagagggttgtttccggtgaagggttcacctgcggcgaggtaaacgacggtggactaatctgctggggacccacttcggaaaatttgggaaacattaacatttccaatgttaccgacagttttgcggttctggtggctggccggagcgccgtttgcggcgttttcaacgtttccggcgagttaaaatgctggggcgacccggtttcgtattcggatcctccgttggattcggttcggttagtctctctatcagcaggggctaaccatttctgtggcgtgagaatggataatcacgaagttgaatgctggggtgatttgaattcctcggttgttccaaaaggtaatggctttatggctattgcttcttcggatttcaccacgtgcgggatcagggaagatgatcttcttctggattgttggttggtcaacgcttcaaaacccgattttgatcctcctttggagctttcaagccctggactctgcagggctagtgagtgtggggttgatgagtttgctttcaatgttagtgttcttaacgagctagctttgacaagcttgtgtgttagagaagatttgaggatttgttctccttgtgggtcaaattgttccaaaggatacttcttgtctagtgaatgtactaggaatgctgatagagtttgcactgcttgttctctttgtcagaacagctcttgttttaatgtttgtggacttcactcttcatcggggcttcatttgcattggcattggcatgatttacgtaaatgggtggtgatagttgggtgtccagttttggggtttttggttattttgctttgtgggtgtcttcttatggttagaaagaggtctaagaagcaatccaagtcttgcatgggaaaaccggatcaggaggatgatcatgtgaatgttgctcttaactctacaccttcggttaattcttgccccggtgtgcctcaggttttcaggctttctgagctgaaggatgctactaatgggttcaaggagtttaatgaacttgggagggggagttatgggtttgtgtataaggctgcattagctgatgggagagtggttgctgttaaaagagcaaatgctgctaccattatccacactaataaccgtgattttgaaacggagctggagattctatgcaaaattcgccactgtaatgttgtcaacttgttggggtattgcgcggagatgggggagaggttgcttgtctacgagtatatgcctcacgggacgctctatgatcacctccacggtggtctttctccgctgacttggagcctcaggttgaagattgcgatgcaggccgcaaaaggacttgagtatcttcacaaggaacctgtgcctccaattgtgcacaacgatcttaaaagttccaacattcttttggattcggagtggggggcaaggatttcggactttggacttcttgcttcgagtgacaaggatctcaatggggacctagaaagtgatgtttacaattttgggattgtgttgcttgaggttctgagtggaagaaaggcttatgatagggattacaccccttccaacatggttgagtgggcagtgcctttgatcaaacaagggaaaggtgctgctataattgataggtacgtggctcttccaagaaatgttgaacctttgctaaagcttgctgatatagcagagcttgctgtgagagagcgtccaagtgagcgtccacctatgtcagatatagcatcttggttggagcaaattgtgaaggacggattgatcttatag

SEQ ID NO: 50680 - DNA, 243 bp, Glycine max
  Peptide Sequence Number=SeqID_167458
atgtctgctagtcttacttattttgacatcatcttacttgcatcaaactatgatgatgcaatttgctatgttgagaccatgaatcttgatgaagaaaccgagtttactagtgcaagaaagtggatgtatgtaattgtgaaagatgtggaggggaaactattactacttaggaaacgggccgacaatgtaatgtttgaacgaattgcaaagaatggaagggattttgaagagaagacaaagtag

SEQ ID NO: 50681 - DNA, 231 bp, Glycine max
  Peptide Sequence Number=SeqID_167459
atgactcctcatacgccatttgataaggccatcaccattgtgatggggtctacaaatggcatacagggagccaggcacacaattgatctgaaagtgatccaagctaggttaagaggaggaactgatgcagcatataagaaaaaggagagaattaagttaagtcccttccaaaatctcaagtttctcttccacaaaaaggacaaagaaggggtccctctcttagttccatag

SEQ ID NO: 50682 - DNA, 357 bp, Glycine max
  Peptide Sequence Number=SeqID_167460
atgagcacaattacaacctatcaccataactattgccatcatcatcaaccgctactatcatcggcgttaaccaccaccacctctgtcgtcatgaccttcatcgttatcgctgtcatcaccataatcattgatccaaccaccaccataattgtcatcgctatcatcaccatcaactatcactactatcgtcactataatcattgttgtcgtcattgtcaccacgacggtggtggtgacagcatcaacggcgacaacggtcatgatgacaaagggggtgacaacaatgatgactacgccgatggaggcggtgaccgtcacggtgatggtgataggttaactacaattgagatactttag

SEQ ID NO: 50683 - DNA, 150 bp, Glycine max
  Peptide Sequence Number=SeqID_167461
atgtggatatggatcatgtgggaatcggattcaaattccaatcattttgtcaattcattcaacgaagatatggcaaaagtttacccctttttagacattgatttggtgacggcttcttttgatggattcgaaagtagcaaccaattttga

SEQ ID NO: 50684 - DNA, 638 bp, Glycine max
  Peptide Sequence Number=SeqID_167462
atgtcatcttctggatgtgatgcatcagttttgttgaacaacactgccaccatagagagcgagcaacaagctctgccaaacaacaactcactaagaggtttggatgttgtgaacgacattaagacagcagtggaaaaggcttgtcccggcgtggtttcttgtgctgatattcttacccttgcatccgaaatatcttctgttctgggtggtggtcctgattggaaagttccattgggaagaagagatagtttaacagcaaaccgaaaccttgcaaatcaaaaccttccagctccattcttcaacctatctcgacttaaatctgcctttgctgttcaaggtcttgacaccactgatctagttgcactctcagagctcactgcaatttcattcttgaccgattgtacaatttcagtggaactggcaaacctgatccaactcttgacacaacttacttacaacaattgcgccaaatatgccccaatggtggacctaaacaaccttgtcaattttgaccctgtcactcctgataaaattgacagggtctacttctccaatcttcaggttaagaagggcttgcttcagagtgatcaagagctgttctcgacacctggtgccgataccatccccattgtcaacag

SEQ ID NO: 50685 - DNA, 249 bp, Glycine max
  Peptide Sequence Number=SeqID_167463
atgaatttgtcacctattagccgtggtagtctccattcctttggcatagaccttgttagcaactcaagaaaatttgtgtctatttcatttcaactatttggtgcagtcattcagacagaaaaacctgttgaaaatgggttgcaaggtaatgcttgcacttgcacaggagataaatgccaatgcaaagagcctcgacagatgaggattcttacttgtgaaagtatctgtgcctatgtgttgtacagatga

SEQ ID NO: 50686 - DNA, 450 bp, Glycine max
  Peptide Sequence Number=SeqID_167464
atgaccactcttacacagatatggatgacgttgctacttagcaacattccatctagtgaccataatgccgatctcctcctgcagaagtatcagttgggatcgcgcccacaaggcacccagtggactcggaggagtccaacagggccctggggtttccaactctggttacgggcctctgtcagtcctaagtgcccgtccccccagcaaggtcatgccatcgtgacatacgtaaggatcatgcccgcaagaaacccagtggacccggagaagtccaatagtgtcatggggtttccagctctgattatgggcctttgtcagttttacagagtgcctgttgcccccaacaaggtcatcaggccccctattaaccgggctttcatcaagaagtattgcacctccaggcaggcaagacaccacaacagcctagggatggccgacaacgggcaatag

SEQ ID NO: 50687 - DNA, 297 bp, Glycine max
  Peptide Sequence Number=SeqID_167465
atgcggggttaccatatggttacccgcacctttggtcaacaaggggcaaacgagcccgttggcgcgcggagactaacatcatcatctgcaccttttgtcgtcctgacccgtgaagtcagattacatgcagggttaccttatggttacccgtacctttcgtcaaccagggctgacatgcggggttacgttatggttacccgcaccttttgtcaaccaagggcaaacgaactcgatgacgcaaggagagtaacatcgtcttctgtaccttttgttgtcctgactcatgaagtcaggtga

SEQ ID NO: 50688 - DNA, 366 bp, Glycine max
  Peptide Sequence Number=SeqID_167466
atgcgggggtccggggaatttgtccccttcttagatacgacgtctaggggtagcaaaatgcctcaacgcacgtttttaagaaggcgacacggaccctccgttggatcaagacagaacccatatgcaatgcctatgcaaaagacacaatgcgggaattccccagtggagtcgccaactgtcgcaacctacccttcggtgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 50689 - DNA, 242 bp, Glycine max
  Peptide Sequence Number=SeqID_167467
atggccaatgagcctgttgacccgcagagatttacgtcatcttccgcacagacaatttctgtcatactgacattggagtcatgtgacagacggagatacccgagtgatacccaagtggttatccgtttaaaactttcctttgctatctgtcacaacctacccttcggcgggagggcaaggcgtgactcgcgggatgcgtgttccacgaaaggaatacgcgcggagtcgccaccaacgtttat

SEQ ID NO: 50690 - DNA, 1036 bp, Glycine max
  Peptide Sequence Number=SeqID_167468
atgcaaatcaaaatcaaccgtgaggttttgcttaaacccctcaacagtgtcactggcatcgtagaacgtagacatacactgcctatcctttcaaacctgttggtaaatatcaaacagcaagaaatgcatttgactgcgactgatctcgaaatgcagatttcgctgaaagtgcaagggggaatagaaggtgaattgagtacgacaatttcagcaaaaaaactactggatatttgccggtcattgccagacagcacgaccatcgaaatgaataaccaggataaccgtatcacgctgaaagcaggtaaaagccgttttaacctgcagacgttacctgctgcagattatccattgatgagcaaagccagcggacaaaacatcagttttagtcttgctcaatcggaactcaagcgtttgctgaaacaagtcgagtttgccatggcacaacaggatatccgttactacctgaatggcctgctgcttgaagtgaatggtaaccagttacatgtcgtagggactgatggccacaggttgagttataccaataccacgctggaccaagattttgaaaagaacgaagtcatcttgccgcgtaaaaccgtgctggagttaaccaagttgttggatgagcagtccgatgcacctgtcgtcattgatttattgaatggccaggtcagtttcgaattcggcgatatccagctcatcagtaaagtcattgatggcaaattccctgattacaaccgcgtgattccaacgggtcaccagaataacttcacagtgaatcgtgtggctattttaagtgccttacaacgtgcgtccattttgtcgaatgaaaaataccgcagtatccgtatggtgatcacgaatggcttactcaagctgatcagtaccaacactgagcaggaagaggctgaagaagaactggaaattgactacagcaaagtggcattagacattggttttaatgtcacttacctgattgatgtactcaacaacctgagcgatgagcagattgagtttgcatttgctgatgccaaca

SEQ ID NO: 50691 - DNA, 275 bp, Glycine max
  Peptide Sequence Number=SeqID_167469
aggaagaggcattgaaattcctaaaggtggggctgctttgcgtgcaagaaactgccaagcttaggccacgaatgtcagaagttgtagagaagttgaccaaggacattgatatgagagatgttcacatttcgaagccagggttcgttgctgatctcaggaacatcagaatcaaacaacaaaacctaaactcgtccgaggaatcaagttctgctggagcaacctttacaagctccatttcgagttcggccaatcttgctcgttatttattagattga

SEQ ID NO: 50692 - DNA, 792 bp, Glycine max
  Peptide Sequence Number=SeqID_167470
atgaagattccttgtttctcttgtttctcgccatcgaccactgaaaaaaacaacaacaacgattacccagatgaagagatcaacgatgggagctttcgtttattcactcacaagcaattgaaattagccacgcgcaattttcattcctcggagaaggttggagaaggtggctttggatctgtctttaaggggaagcttgtggatggatcttttgtggcggtgaaagtgctttcggttgaggtggaatccatgcgtggagagagggaatttgtggcggaattggccacacttgcaaacatcaagcaccaaaatcttgtaagcctaaaagggtgttgtgtggaaggtgcttatagatatttggtctatgattatatggagaacaatagcctctacaacactttcttaggttcggaagagagaaggatgagattcaattgggaaataaggaaggacgtatccataggtgtggctcgggggcttgactttctccatgaggagcttaagcctcatatcgtacatagagacatcaaagccaaaaacatacttcttgatagaaatttcataccaaaggtttcagattttggtctggcaaaattgctgagagacgaaacatcttacatcagcactcgggtagcagggacattgggttatctagctccagaatatgcaaattccggccaggtttcgcgaaaatcagatgtttatagcttcggagtgttgcttttacaaattgtgagtggcctagcagtggtggatgcctatcaagacattgaacgtttcatagtggagaag

SEQ ID NO: 50693 - DNA, 333 bp, Glycine max
  Peptide Sequence Number=SeqID_167471
atgggtgtcctaacttgtgctagcctattgaattgcataaccatgaacttgccttttacctactttggaatgtcggtgggtgtagatgcaaggaagatgacaacatggcaacctatctttgagaagatgaagaggaagatacaatctgagtttttatggggagcaaagagagatgcgaaaaaaagtatttggataaagtgggatgtggtgtgttctcctattgagagaggtgacttaggaattaaaaatctagaagtgttcaatagggctttggtggggaaatggatgtggaggttgggggtggtgaagggtggtttcaaagggaatatttag

SEQ ID NO: 50694 - DNA, 732 bp, Glycine max
  Peptide Sequence Number=SeqID_167472
atgactctagaagagctcgttgggattcttaaagtcgataagcaagagcttgctcaagatgaacgaacaaagaaagggaagtcgctagcccttacgactcaaagaccaaaatgtaactctgcatctaaagaatcatcgtccaaggcccttgctattaatgatgctttagaagaagaatatgatgatgacgactctgatgaagaagatgaaaagctaagtctgatcaccagaaagattagaaagatgtggaaaaacaagaactcctccaggttcaatagtttttccaaaagatcctttcataagaaggagaaaagtgcaatcatatgctatgagtgcaagaagcctggacactttaagaataaattcttcaagtctaaaaagaagagcctcatgagcacttgggaggacctggatgaggacaatgaagaagaagccaacctatgtctaatggctgatgcatccaccagtaaagatcctcagccttatgacactatcaactctgatggtgaagaggtgggtcatgagactcataaatgcaaggacttctctaaaagggcaacccatcaaagggttcgttcaatgcttaccaacacccatgagctaacaaggaaaaaggacccaaaaagatttagcaagaaagaaatactagtcatgatacctagacagcagctgctcatgacacatgataggcaaaaagtctatgttccaatccctaagccctatgcctggtag

SEQ ID NO: 50695 - DNA, 513 bp, Glycine max
  Peptide Sequence Number=SeqID_167473
atgctaactgttctcgataaacctaatttcttctttgattttccactattgttcaatttccctggaattgatcacgaaacacacggattgaattgtgaacctgttttctgcagtgtagtgtttggaatagtttcgtgtaatgttctgcgtagtgtgaagccacctcgtcaatggaagaatttgggacagtgtgattgggtggttgactctttgattaaaaaaacttcgtaccccattgctcagaggctcttcgctatgcgaagtatgctggagtatcaattttgcattcattcttcatacagaagattagaactgctaacaagtatagataattgttttgaatggttttgcgtttacagcctcatgcttgatttggtggtctctactccctggattctgatttatcagattctgcctttcgtttctacttttgggaagataagcaatggatatgaccggcatgggaggctgtggaaaagctgtgtggcggaagatttctgtgtgaagccttag

SEQ ID NO: 50696 - DNA, 315 bp, Glycine max
  Peptide Sequence Number=SeqID_167474
atgagaggcttgttcacaaaaaaatccttattccatcgtttcaagaatttcctttcctcagctttgtcaagagatcaacctagaggacctagagggcactacagaactccaaatggaatgtgtgagtatgtagaagcaaagcttcatggtgaatcaaaggtgattcaaaggtgttttgatgataacaatgatgatgacaaaggtgatgacaaaaagctcaaagatcaatcaaagaacaactcaagtgaatcaagaacaattcaagagttcatgataagaatcaagaagaattcaagactcaagaagaaagtttag

SEQ ID NO: 50697 - DNA, 150 bp, Glycine max
  Peptide Sequence Number=SeqID_167475
atgactttgttgttcccagaggaacaaaaggtgcagaagactgtgtcagcccctgcatgctatcaagcgttctgtcttacagatagcaaaagaatgagtgcgaataaccataagggtgcggataaccgtaagggtgcggataaccgtaag

SEQ ID NO: 50698 - DNA, 523 bp, Glycine max
  Peptide Sequence Number=SeqID_167476
atggagtctgttaatagaggcatttggagtgcagtggttaatggatataccattccagcccatgtagttgataacaagactatagagaaaccttatgaatcttgggtatccgtgtgcacaactgtcaaagagatgtgggatttaatccaagtaacacatgaaggaacactagaagtgaggaaagctcaaaagaattcactaatccaagaatacgaaaccattaggatgaagcaaggggaaactataagggatactagcattccatcaactaacaaaagtaaggatgacaatgcagaagggtcagatgctaaaaatctgaacttgctcgtgagaaggttcaacaaattccttaagaaaaataagaactatggaaatagaaccttttaccctaagaagaatctcaagaaaggagaaccatcttcctccaatggatacacttgcttcgagtgtgaaaaggcaggtcatattaaggtagattgccccatctaccaaaagaagcagcaaggagataagaagaataaag

SEQ ID NO: 50699 - DNA, 1413 bp, Glycine max
  Peptide Sequence Number=SeqID_167477
atggcctgggacagtaaacaaattagtaagatagtcgctgtcgtcggggacatggtagacgttgatgacgacgtagagctggttcgcaggatggacagagctcgggtcctcctaaagacaccgtggaagccatacatacatcacatagtcaatgtacacatccaaggggaggtgtacaatgtgcatatagtggaagcaatcctgaaaggtgccattgctggcgccggagcgaggacagggttcacggcgtcgcttggaaataacgaggcgaaggcaatatctgatgcggcggcgttcggaaatagtggtgtgcaggcaatattcgaagcggcatcgccggcgggggtatttgaagcgacatcgccggcgggggtaactatctcggcaaccacgaaggtaaaagatgggcgcatgtcggcaacctctcctaaagacggcgcgttggagtgcgaagcaacaacaccaccgtccggaacactgcttcccgagaacgcggctttacccgcgggacaaagggcaaacattcaacggcttttacccattcacaggtcagaggaagttgttcacaggggagcactacggagactccagcgtgccataggagatgatctggcagaaagtgaagataattttcacaaaattggtgaaaggcagtgcatagggaaaataatccagtccgtaagggaggacagagggtgcgaaataggaaataaacaaaaggagaaggctgatgatgtcaccagaacagaaattttaaatccaagggagtcacgtgactttgaaggcacaatggaaaatggtttgggctttgctgcccacaccccccttgattctatcaaacaacagctctccaacccacaagcaagtaaactccaggttttctcccgaaaaaggtatcacaaacagaaattgcagctgggctgcacagatgactcaaatacaatcataaataaggatacaaagtctatcaacccaagcccaaccaaccaacaacatgagttccatgataaatgtgaatctgcacaaggacaaataatagatattaggcaagcccagcaagaccaagaggagacagaaaatgccaataatcagaagcaggaagcagaagctttatggaccgtggcaaaggctttgggagtcaccgacgggtcatcgcaacagaattttgtgaacaaactaatggaaatggaggagagggataaaaaagaggcacggagattgggaagcaagaaagtcagttgggaggcacaacctgcttcaaattcagcaggcggacttttatgtatttggagcgaaagaacttttaagctggaagcgaaggttgtcggacctgggttcataatgctgaatgattgggagtctgccaaagagggatgggggaaagccacaacaatgagttcaacagatggatag

SEQ ID NO: 50700 - DNA, 372 bp, Glycine max
  Peptide Sequence Number=SeqID_167478
tctcggccgaaagaccctgatatcttcggggaaggtgctagtgatgacacatctctgggagaggtgctggtgacgacattagtcactgcatgctttcgggctttgagtctcacggatagcaaatgcgatttttcgcagtctcggtcggaacacactaatatctacgggaaaggtgcagtcttccggatagcaaatgagactttatcgaagtctcggccggaagacgcaaacatctctgggaatggttctcggccggaagaccttgacattaccggggaaggtgctagtgatgactctcggcctgaaaatgctgaaatcttcgggaaaggtgcagaagatgctgacatctacggggaaggtgcagatgatgac

SEQ ID NO: 50701 - DNA, 387 bp, Glycine max
  Peptide Sequence Number=SeqID_167479
atggacgaggctgtctcattccttaatgaagtggaaagcaagctaattcagccacaaagacgtgatgagtgggtatgggtggcagatcctagcgaccacttcataatcaaaagtgcttattatgtgatgaggaagggtatatcagaagggacagcggatgcagcttttgacgaactgtggaagataaaagaatatagcttttatttgaaggatcttggactaaagacaaggatacctgatacccgagggtatgaggatggggtaacaaattttaacctattgggtatcgggaaccgctacgggtgttggggggtcggggactggggatgcaatacccgtcctcaccccgttgtcatgtctaatttaagtcatgttggtaatttctag

SEQ ID NO: 50702 - DNA, 627 bp, Glycine max
  Peptide Sequence Number=SeqID_167480
atggactaccttactccttcttttggagaaaccaataccatccaactttccaatctacatgaagaagtcatatttgacttcaagcatgggttcctacaaatgttggagaacaacctatttagtgttgttgcccatgaagaccctatgcatcacctaaggaagttcatcaagttgaccaacacgatgaaacaaaattgtctatgttcactgccagagaatgacatcactacatggaatcaatgcaaaaatgccttcttaaagaggtacttctctcccgtcaagatagatcagtacattagggacattggaaactttgtggagagggagcaagagagtttacctaaagtttgggaaagtttgcaagagattatcataaggttttcacatcatgacattactaaacaaaggctagtttatattttctatggtggagtgtcctcgcataataggaggagtttggatgctacttgtgggggaaacctcatgttaaaaacccctgttgatgccatcaaaatcactaaagacatgtgttctaaaccatgcaacaactcaggggatatgaggattatgaagagaggcatcaacctggtggacacagctgaatcccaaactaaattggaaaaatag

SEQ ID NO: 50703 - DNA, 3887 bp, Glycine max
  Peptide Sequence Number=SeqID_167481
gaggttatggtcctcgaaaccagagtagcttgcccctaacatttggtgctctcgtcgccatgcctgatcctccccccaacccccttgaagttgccctcctcaaacttactaacctccatgcttccttgggtgaaaccgttcaaagcatggctcagaagtttgatgccctcttgctgcgctctccatcttccccttcgtcctcatccccaaacccgagcacaccttattttccctttgtccctgcatcacaacacaaaatgaaactcgacatttccaagtttgatggcactgacccttacgggtgggtgtttaaaatcaatcaatattttcaataccacgcgactcccgagcacgatcgacttaccattgtttccttctatatggatggccgtgctcttgcatggttccagtggatggctaacaatggccaattcacgtcgtgccctgcattcgtccaagcccttcagactcgctttgccccttctcactacgacgaccccacaggctcccttttcaaattgcagcagaccggcacggtggcccaatatctttcgaactttgaggatttagctaaccgaattaagcttcttgatgcgcgaccctcccttcgcactcgtgctccatcggttgtgcctctctcgctgcgtccgacggccacccctgccttgcttcctcttcccacttcacgcccaccgccaccacgtttacccgccacgttgaagagactctcatcggaggaaattagctcccgcagagaacggggcctctgttttaattgcgacgagaagtaccatagaggccaccgttgtacctctagggttttcttcttggtcgcggaggaagatgaagttgttgactctcatataggggaaattgacccgagccccgacccacccgagatccacgacccgggcccgacccaaattagttttaattcccttgcgggccagctcgccctggaaacgctgcgtttgattggcacggttgccggcaccaccgtagtcgtcctggtggacggtgggagcacccactatttcattcaggagtccctcgtcactcaacttggcctccaaactcagcccacaaccccacttcgtgtaatgattggtaacgaccaacatttggcttgtgatcgtctctgccctgacctctccctcaccatgcaacaattccattgtgtggtggacctgtttgtgcttccaattgcaggtgggaatgagtccaccttgacgatgctgacaccacatcaatttcgccggttatctcgcaactccgacactagctccttcttccatattgcagtcctcgctgagacaccgttacctgactccagttcacccctgcaccccgcaattcaggacttggtggaccattttgctattctgtttcaaccccccaccgcgcttccaccgaagagaatcactgaccatcacattcacttaattccacaagctaccccagtgaaggtgcgtccctatcggtaccctcactttcagaaacgtgagattgagctccaggtcgagtccatgcttcagaagggcctcatccgtcccagtacgagccctttctccttccctgtgctcctcacgaagaagcaatcatggtggttttgcgtggattatcgcgccctgaacgtcgtgactgtccgtgaccgctttccaattcccaccatcgacgagctcctggatgaactgggtaaggcttgttgtttttcgaaattagacttgttgcagggctatcatcaaatcaggatgcattcctccaatattgccaagacagcatttcgcactcaccatgggcattacgaattcaaggtaatgccttttggtttatgcaatgctccctcatcatttcaggcaaccatgaatatgatcttcagaccattccttcgtcgattcctgatcgtcttcttcgacgatatacttatatacagcgctacacttaaggaacatgtcacacatgtgcaacaagcttttcaggtccttttggataatcattttgtccttaaattatctaaatgttcattcgcacagcaacaggtggaatatctcgggcacatggtctcggagaggggagtggaaccagtagcagccaaggtagaagcagtccggcaatggccagttccccactccattaaagctttacgaagctttctgggccttgcgggcttctgtaggagatttattaaggggtatgcttcgatagctgccccgttggtggcagcaaccacggtggagccttttcagtggaccgcggcggctcagctcgcatttgaacttttaaagaaagccttgtctgctctggtacttgccttgccggatttccaattgccatttatggtcgagaccgatgcttccggggtgggcatgggtgtcatcctctcccagcaggggcacccaattgcatactttagcaagccagtcccacctaagctccaacactcgtccacttatgtccgagaattattcgctgtgacggcaacagtcaagaaatggaggcaatacctcctcggaaaccgtttcatcatccttattgatcatcgcagcttaggaactccttacacaagttattcagaccccagagcaacatatgtaccttgctcggttgatggggaattgcgagcacaattagctcagaaccagctttaccaagatagacttcaggcgattagatcctttccaaccaagtaccccgagctcactataaccaatggcttgatacttaaacgagaccgtatttggttaccattgatccccactcttcttcgagagtatcatgccacgctgacaggcggccacttgggcatcgcgaagaccattgctcgcgtaatggataacttcaattgggaagggttacgtgaagatggaaatacggttactctcgttgtggttgaccgtttctcaaagggtatccacctggggatgctgccgacatcacacacggcccacgcggtagcctgtttgttcatgaacatcgtcgaaaaaatccacggccttccacgcagtctggtttctgaccgagacccgctcttcatcagcaggttttggcaagaattatttcgcctaagtggaacacagcttcgtctcagctctgtgtatcacccacagagcgatggacaaactgaagttcttaatcgagtgattgagcaatatcttcgctccttcgtgcatcgccggtcgggatcatggggcaagctattactgtgggtggaatggtcccacaatacaacgtggaacgcggccacggggtctacaccctatgaagtcacctttgggaggaagcctttcaattttccggagtatctcacgggtacttccaaggtggacgcagtggatgaaatgttgaccaaccgcgaagaaaccttcttgctcatccgcaagaagctgctaaaagctcaagagcttatgaagaagtacgttgatcacaagcgccgggaggtggtctatcaaccaggggagtgggtgatgatcaaattgaggccacgaaggcaaatttcggctaaaccgcaattgggctcttccgggaaattgtcgaagcgctattatggcccatttcaggtggtgaatcgcgtggggcccgtagcttatcgtttgaaactccccgaaggcaccaacattcatccaatattccattgttccattttgaagccctttaagggatcaccggaagtagcgaactcagccccattacctgatcaaactcaattagctgaggaatatcaccttgaggacaaggtgcatttgcatgggccgtggaatgatagacgaacaggggtacaacaagtaatagatgaggaacccagcaaacacactaacaacaaggtgcaattaggaaacggagcaaagagggcaattgctaggcctgcgtacctgcgagactatgtgtga

SEQ ID NO: 50704 - DNA, 531 bp, Glycine max
  Peptide Sequence Number=SeqID_167482
atttacgagcactttccctcagtcgcagagtccactactgatcaggaatacgatgaggattccccgcgtgcgtgtaggtggattgcgacgaagaagactgtgaagagcatacgtacaccggcgtacagggagcgcctggaccgactccagattccggatgtctgttggatcccgtatggggagcaccaaccggtccaagacttccatgtggtatcatgctattccggtctcctgcgctgggggcctgttgctatttattatcgaccagagagggtcgtgcggcagtttggatacacgcagaccattcctgctcctcctatcgattcatgggtgtcgtatgatgatatacatgacaggtggatgcactactcgggtcatatcgttccagcaagtgaggtgccacgcatcagatcctttgccagatggtcatgccccgcaaccccgagtcgtccctcaggccccatagacggatatcccccacgtgccggagctaggagcactgtcgacatctacgaggcacgctgtagatga

SEQ ID NO: 50705 - DNA, 324 bp, Glycine max
  Peptide Sequence Number=SeqID_167483
atgcgtagtgattgcttagtgcaagtctccattctcaccctttttcggaaccccatgaattgtggtttttttcatgtgtcctccaccatcgagttcggagctatgcgtattgattgcttagcgcaattctccattctcaccctttttgggagccccatcaattgcgttttcgttcatgtgtcctccacactcgagtttggagctatgcgtagtgattgcttagttcaattctccattctcaatcttttcggagccccacgaattgcgttatcgttcatgtgtcctccaccttcgagtttggagctattcgtggtgattgcttag

SEQ ID NO: 50706 - DNA, 3129 bp, Glycine max
  Peptide Sequence Number=SeqID_167484
atggacgctgtgtcatccgcactactagagccagtaactaattctttgttggatctgcttaaaaagcaactggattacatccattacagtcgaaactttgatgaactacgcgagtgtgtaaagcagcttaaacttgtaaaggagaaagtagatcatcaatgtgaggaagctttcaaaaatggacacgaaattgaaggtaaggctagagaatggttagggaaagtgggtaaatttgagacagaagtggagaagtattggaacgatgatggccacaaaaagacacggttttccaactatttatttccttactttaggcatagactaggcagactagcaaagaagatggcagttgagggtaaaaagataaccgatgattgccccaagtctgatgaaattgcccatcgggtatacgtaacatctaatgatgccattttttctaataatgaccttatggattttggttctagaaaatccataatggaacaaataatggcaacacttgttgaagatcccactgtgaaaatgattggagtgtatggacgaagtggggtgggtaagagcactttaatcaaagcaattgctaaaattgctcgagacaagaagttgtttaatgtggtggctttttcagaaataacagacaaccccaatctaaaacaagtccaggaagatattgcttaccctttgggattgaaattggaaggagaaggtgagaatgtaagagctgatcatctacgaaggaggttaaagaaagagaaagagaacacccttataatcttggatgacctttgggacagattagacttgaataggttgggaattccacttgatggtgatgttgaagataaacagggtcccaaagggccgacaaaagaaaaatctcttggtgattataagggttgcaaaattttgctaacttcaaggaaacaaaatgtattaacggataaaatggaagttaaattaactttctgtgtagaggaattagatgaaaaagatgctctgaagttgtttcggaaggaggctggaatacatggtgaaatgtccaagtctaaacaagaaattgttaagaagtactgttcagggttacctatggcaataattacagttggaagggcattaagagacaagagcgactcagagtgggaaaaacttaaaaatcaagacctggtgggagatcagaatcctatggagatttctgtaaaaatgagttatgaccatctagaaaatgaggagctcaagtccattttctttctttgtgctcaaatgggtcatcaacccctaattatggacttggtgaagtattgctttggtttgggaatacttgaaggggtctactcacttggggaagctcgaggcaaaatatctacatcaatccaaaagttgaaaaactcaggtttagtgttggatggaagttctagtattcatttcaatatgcatgatctggttcgagatgcagctttatctatagcacagaaggagcacaatgcatttactttgagaaatgggaaacttgatgattggcctgaactcgagaggtgtacttctatttttatatgcaacagtgttatcattgatgagcttccagaagaaataaattgtcctcaacttaaatttttccaaattgacagtgatgattcatctttaaaaatacccaacagtttttttaaaggaatgaaaaagctcaaagtattaatgttgactggtattcaactctcaagcttaccatcttcaattgaaagcctatcagacctcagattgctttgtttggagagatgcactttagatgacaacttatccatcatagggaagctgaaaaaattaagaattctcagcttttctggatctcgaattgaaaatttgccagctgagttaaagaacttggataaactacaattactagacatcagcaattgttcagtagtcaagaggattccgcctcagcttatgtcaaggttgacttcgttggaagagttgtatgtaagaaattgcttcatggaagtgtcggaggaaggagagagaaaccaatgtcaaatttcatttatttctgaactaaagcatttgcatcaattgcaagtggtggacttaagcattccatgtgctgaagtttttcccaaggaattgttctttgacaacttaagtgattacaagattgagattgggaacttcgaaatgctttcagctggagatttcagaatgcctaataagtatgaaaatttcaaatctttggcattggagctgaaggatgacactgacaatattcactctcagaaaggaataaagttgttgtttaaaacagttgaaaatttgttgttgggagagctgaatggtgttcaagatgttattaatgagttgaatttggatggatttccacaactgaaacacttatccatcgtaaacaaccctagcatcaaatatatcatcaactcaaaggatttgttttatcctcaggatgtttttcccaagttggaatctctatgcctccacgaactaaataagatagagatgatatactttagttcaggtacagagatgatatgctttagtccatttacagattgctcattcaccaaattgaaaaccatcaaggtcgagaagtgtgaccaattgaagaatcttttctccttttgcatggttaaattgcttgcgagtcttgaaacaattggtgtttccaattgtggttctttagaggagatcattaaaatacctgacaattctgataagattgagtttcttaagttgaagtctttgtcacttgaatcattatcatcattcactagtttttataccatagaggggtcttctacagacagggatgagatacaaattactgttgcagagaatgagcatagtgagatggctcctcctctttttggggaactggttgaaataccaaacttagagaacttgaatttaatctcaatgaacaagatccagaagatatggagcgaccagcccccgtcaaacttctgctttcaaaacttaataaaattagttgtgaaagattgtcataatttgagatatttgtgttcattgtccgtggccagcagcttgaggaaactgaaaggcctctttgtaagcaattgtaaaatgatggagaagattttcagcacagaaggaaatagtgcagacaag

SEQ ID NO: 50707 - DNA, 378 bp, Glycine max
  Peptide Sequence Number=SeqID_167485
gggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggaagagccgacatcgaaggatcaaaaagcaacgtcgctatgaacgcttggctgccacaagccagttatccctgtg

SEQ ID NO: 50708 - DNA, 456 bp, Glycine max
  Peptide Sequence Number=SeqID_167486
atggttatgggggatttcatcagcagactctccttccccgcatgtttgcattttagcgaagaaaacaccgagactttttcaagtctcacaagttatccagaactacgtaggtctgagttcctcattggaggatacgtaggagcaagagcctcgcttttgtcgaccataccgccttttgttgccatgactcaagagctggtagtacgcggagataccttacggttattcgcacccttttgtcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatga

SEQ ID NO: 50709 - DNA, 255 bp, Glycine max
  Peptide Sequence Number=SeqID_167487
atgacaactgatccaactcagacccttatggattacctcactcctactttggggaaagccaataccattcaacttcctaatctacctgagggagtcacatttgacttcaaacatggagttttgatacatcaacaaatgactagaagttgtttgaagaattggagcagcacaatgtgcgagaaaccaagctggcagtcggctatatcatacatgggcactaagcgcacgtttggaggcttagcgcatggattttaa

SEQ ID NO: 50710 - DNA, 624 bp, Glycine max
  Peptide Sequence Number=SeqID_167488
atggaagagtggaacgcaaacatcaacacatccttaataaatgttgttttccatgaattcttctttcctttccacataaaccaaaacctctttactagcgaagcccagccaaactcacctatagacccaatttcatatacactacctacaccacctcactttaccccatccacacctatcacaacaaacattgacccaaccattcctcaacccaatggctcatcatcacctttcccaaatccttcaactcctcctgaaatcgacacaccaaaccccaacatcattgatcaacacatccaagaaccaccaaactcaccaccgtctaaccatgctttaccaagtcggcctagccgcgacacttatccttcttcttacctttctgattatcaatttcaaattccttccctcaagtttgctcaatcctcatcaacatgcgcatatcccattcagagtttcctctcatacactcatgtctctccatctcatcaccatttccttatgactctgtcatctgagcaccaacccaccagttttcatgaagctgtgaaacatcaatgttggcgtgatgccatgaaatacgagatcaaggctctacagttgaatcaaacctgggacattgtttaa

SEQ ID NO: 50711 - DNA, 364 bp, Glycine max
  Peptide Sequence Number=SeqID_167489
atggagatccctcctggattgcttggttacacatcaagtcagagttgcaaattgaagaaatcactctatggattaaagcaatccaacagaaaatggtatgagaaattatctaatctattgctgacttggggttattcacatgcccatgctgatcataatctgtttatcaaggctcataattatgaatttattgctctagttgtatatgttgatgacattatgctgaccggtaattcccttgctgagattgaacgcattaagtgtattcttcacactaattttcacattaaggatttggggaaactaaaatattttttggggattgatgttgcacattctgataaaggaatttcattgtgccaat

SEQ ID NO: 50712 - DNA, 804 bp, Glycine max
  Peptide Sequence Number=SeqID_167490
ttcaaaaggaaaatggaagagcaacaagtggcagaacactggtgtaggacaaaggagtgcaatagataagaataacaatcaaagtaaaaacaacaagaatggagaagcaaacaagagcaagataaagaagatggggcctgacttactgatggtaacaacaaaattcgaaggtgattattctaatcattggtatctggacacaagctgttcaaatcacatatcaggaagaaatgagtggttcattgttctcaatgaaaaagtgaaaagcaaggtgaagtttggtgacaatatagtagttactactgaagcagttgataaggtgatggttaaaaggaagaatggagtgaaggctttcattacaaatgttctttatgttccaaaattgaagaacaatttgttgagttttaggcaattggcagaaaaagggatattctatgagtctacactaaaactcaatgaagtacttgagaaagaatgctttgatgccaccttgaatgaagtgcattggggccatattactgaaactgaattatcaaaaattgttcaagctaaaagacctcaaagaaatcggcaacaacctcaaaggttgaatgattttaagatgcttcttgacatccttgtgacacaagaaggagatctaggatgcttgaaatgggtttacaaggttaaagggatgcctaatggaactattgctaagtacaagacaaggttattagtaaaggggtttctacaaaaggaaagagtggactttcaagaagtgtttgcaccagtggactttcaagaagtgtttgcaccagtggacaa

SEQ ID NO: 50713 - DNA, 276 bp, Glycine max
  Peptide Sequence Number=SeqID_167491
atgctcaacaccattagagaacttaaagcatttgtgagtgaccttagtcaatgtcttcaatcttgtcgtcgttgccatacagactatgaagaatattctgatcatgatgaccaatatcatcgcacccagtcattagagacatatcctcccattatagcccattgtattatagacaacttcatggtcgttgataaaatttacggatggaacttttacagacagactcgtagcccattagaagagaaggaacatcgtgttgtggaggactatggttaa

SEQ ID NO: 50714 - DNA, 1287 bp, Glycine max
  Peptide Sequence Number=SeqID_167492
atgccacatggtggtgggtctttgctggttgctttagagctgatgtgggcatcagatcatcttgtttctcttcttaactgtctggcctttcaaaatacatggattggattatatataagatttggaatgatacttgaaattgttgatttcttgggaagcagtttcagggccataagggttgttaatactgggccatctcaatacagaggtaggggtggcaggggtggtagaccatttagaggggccggtcgtggtcgaggccatggtaggggacatggagtggggggtgttagacacattccatttcattcttctggacctgttgtttctaatgtgccagctcgagtgcaaccaccagtaccaccacgtaaagtgtgttgtgaaatttgtaaggttgagtgcaattctccagaaatcttggagcaacacaaggttgggaagaaacatcagaagaatatgagggtgcatgaagaattgcagaggcgcaacgctataaatgaacaacagagtggggaaattcctacctctcaattgaatttaacagaccaacctaaggaagttcaggagtccgagaaaaatggacaccccacagaaaatatgggctctggggttataatcaataatcatgaggaggaaatacagctgcagaataacgtaggaaacatgtccgaggttccagctgaggtgcccgaggggaaaaccgtggataactctgctgcaagaggccgaggattgaagcggaagaagaaaggaggaaaaggaggtaaatacatgagaactaatgatggttcaaagccagtggagcctgcacaaactatgtcttttagatgtgagctgtgtgatgttaaatgtgagtcacaagttgtttaccagagtcatatgactgggaaaaaacacttatcaaaactaaggcgtgcttcatctggagtaggccagcagcaagccctgtctggagcactctcagggcttcaagcagtttacccacctgacatcaatgctctgtctaatgcaattaatgctcaagttcaacaaggtgataatgatccacaggtacttttggctcagctcctgatgaccgtactatctcaagcacaagttccagcaacagcaccagtgacaggtgccatagcttctcagataccagcaccaacatctatggctggaccaagttatgaaccccagttgttgcagacaaattcttctggggaaacaaaaactgagctgccaggttcaagtgtcagcacccaaattgaaggtggaggttctgaaaccaaacaacaggtgtga

SEQ ID NO: 50715 - DNA, 555 bp, Glycine max
  Peptide Sequence Number=SeqID_167493
atggattattcaggctacaacttccagcagcaaccacagcaacattcctatggttacgacccttctcagatcccaatccaaccctacgatcaatcctatgctgcgtaccaacaatactacgcttacaatccccaatacgcgtatttccccaacgcacaccaaacccagtttcagttccaacccgaacctgctccgcttcaccctcccggcgtcaacccctccgctgccgaacccgccccggtaaatttttccttttacctcttccaattcttaaatgatcaaggttttgtggttgcggtcgcggttatgtcgggtttcttgatattaaaggaaattgcagacaattgcggccgatatggccacaattgcggtcacggacacccgaaaagccttgaggttgtgatcggtatcgtgactgtggactgtttttattatagagatcgcgatcgaaaaccacaattgttgcgtccacaaatgcagtcaaaattgcggttgcattgcagtttgggactccctcaaaaccttgacgtagattgttttttgaaacattggtaa

SEQ ID NO: 50716 - DNA, 294 bp, Glycine max
  Peptide Sequence Number=SeqID_167494
atggattattcaggctacagctaccagcagcaacattcctatggctacgacccttctcagatccaaatccaacccaacgatcaatcatatgtgtaccaacaatactatgcttacaattctcaatacatgtattatcccaacgcatatcaaacccagtttcaattccaacccaaactcactcctcttcaccctcctaacatctaccccatcactcctgaacccgccctggcaaatgcggctgatgtgaccacaactgcagttgcattgtggtcactgccacctgaaaaaccttga

SEQ ID NO: 50717 - DNA, 414 bp, Glycine max
  Peptide Sequence Number=SeqID_167495
atgccggcgccgttgccggcgccatacgaccaccaccaccgtccggcggtggacccgatgtgggtgaggtatccgccggcggcaccgccggcaccggcgccgtacgtggagcaccagaaggcggttacgattaagaacgatgtcaacatcaagaaggagacgcttaggattgagcctgatgacgagaatcctggctgttttctcgtgtcgtttacgtttgatgccaccgtttcgggaagggaggtgaagaaattgcttattctattttgcatggggttttgttaccttttagagattgaaagtgaagttgatcagtgcactttaatggcaaatgaggtcgttactgtaattgattggctaagaatggaaggaggccatattagaggagaaagtgataactttgtagtagtttga

SEQ ID NO: 50718 - DNA, 586 bp, Glycine max
  Peptide Sequence Number=SeqID_167496
tgtctcctatttgcctaagtttgtggatgtttctaataagaagaggttggtgtatattgatattggggtgaaagagttggtgaatgcaaatgttaacgttaacgttactgattggttcccaccatcttatcccattgatcagaaggctttcagtgtttattttgttcattacaacgcttctgtgttgttgtcctatgtgaaacggcctcgtgtcacgtttatttatcatccgggtttggctgggaatattgcacacaagagtggtgtggatggaggaatggaaccttttttgggtgaggaagagtttgatttcctagtgtggttcatggaaactgtgcagcatgctgattttgtggttctgaagatgaatgctggggaagctgaaataaaattcctatcggatatatttgagaatggagctatatgctctgttgatgagttgtttcttagttgctcggagagtggaaatggtgaaagcgaaactatgagcagcagggaacgatgcatggatatttacaaaggtctcagaagcaatggtgtgtatgttcatcaatggtggaatgcaaaattgcatcaaggggcttaa

SEQ ID NO: 50719 - DNA, 570 bp, Glycine max
  Peptide Sequence Number=SeqID_167497
atgggattgtccattaacaaccagtcaccagatcaggctgcagcatctcctggtctcacaaaatgtggaaactttgtagccgcaaataaattaaatattctgaaaacaaacaaacttccctctctcactcactcactcggcaacgacgacggtcttggagttcccgtagctcatcaacgacagtcacatgtggcagatgacagggttcccgtcgcgccgaggcagagcagctacaatcaacaccgcgccaccactgcacacctcggagcgccaccacaaatccctcataacttcgaaaaaacctgtgcaaagaaaaattgtgttgtcaatgtcaggcatgtgttgatttctgctgttttgaaagattcccgattcattaaaaaacttcgtactccattgttcagagactcttcgctatgcgaaggtatgagggagggatgttgtacgcagccttacccttgcatatacaaagaggctgtttccggattcgaacccatgaccaacaagtcaccaaggcacaactttaccgctgcaccagggctcgccctcagattcccgactcactattag

SEQ ID NO: 50720 - DNA, 213 bp, Glycine max
  Peptide Sequence Number=SeqID_167498
atgaaattgaaagtagctaggcctttaaagatgaggattgacaacaaattcacaattgatttggcaaaacatctagtttctcatggaagaaagtgcaatatcaatttgattgcttttttcctttttttcctctattcttcttgggccaaagatgcaagagaaggccctaaggttctcatgagtcttaggatagatttcagacccataggctaa

SEQ ID NO: 50721 - DNA, 758 bp, Glycine max
  Peptide Sequence Number=SeqID_167499
atggattctaagagctccaaactccacgggctgagcggctccatagctcaacgcgttttcttccgcgcgttattcctcgcctccgctgtttccctcattgccctgattcgcttcctccccgccgtcgatttggaatctttgactcccaagacctacgttgactgcgtcattgacgactcagattcgctctccgaaaacaccaccttaaccgccggctcctacttgttccagagccgcatcctcaacaccttctggggctccttcgactccatgaactgcaaaaacgacacgagtttagcttccaccatcatcaccattctaaagggtaaacgactcttgaacttcggagctaaaagcctctgcgttggagaagggtctaatgtaattgtctccgcaatgcaaaggttgggattctccagtgttattggtctccacaagcacccttttttctccctcaacaaaaagaaaatcgcgtgccgctttgagtacgatgattccacattcgacttcgtgttctccaaggatgttgttgacaaggtttctgttcctgcgttgctggttcttgaggtcgagcgtattctcaagcctggtggaatcggtgccttgcttgttggctcttcttcttcttcttcttcctcaaaaagatctattttttataaccatgtgcttccagaagattgtgcaagtgttcaattcaccaagcctttggtgaaactaatggagcctcttgtggaggaaagagtaagaaacgatgtcaa

SEQ ID NO: 50722 - DNA, 174 bp, Glycine max
  Peptide Sequence Number=SeqID_167500
atggggaaaagaagtacaatagtacaaagacagggatcttgctttcatgaatgcattggagactggattttcttcttcaaccaacttgttatgtatgtttcacattacaaagaatgtcagcacaaaatgcaaaatcctgttgtggcacccatttaccacttagctaattattaa

SEQ ID NO: 50723 - DNA, 180 bp, Glycine max
  Peptide Sequence Number=SeqID_167501
atgagtattaagaaagaatatgatggaatgggattcagacatctccatgggttcaaccttgccatgctaaggaagggttctggtcaagatatcatcaaccaaatcttcaaccaacatgatgcacaagcaatccaagctacaccacttctcaataacctttatgatgatgctctgatctag

SEQ ID NO: 50724 - DNA, 1098 bp, Glycine max
  Peptide Sequence Number=SeqID_167502
atggagaagcacaagtgcaagctttgcttgcggagtttcgcgaacggaagagcgttgggaggtcacatgcggtctcacatgctgaacctacctgttcctccgaaacagagcgagttcgtgccgattcaactcagcttcgaggccgactcatctccttcgcagtcttcatcttccttctacggtctcagagagaatccgaagaagagctttcgtttcgcagatcctgaatttgcgtttgcagcagcagacacgggctcggtgatcctgcaggacagggagagcgagaccgagtcgtcgaggaatccgactaggacacgatccaagagagcgtggcaactcggtggcgacggtggtggcggtggcggcggttcaggtgaatcagaaaaaaagattatgaaagtttgtaaaattagtaaaactaacgaatctgcaagttcggtttcggacacgacgagggaggaagacgtcgcattctgtctcatgatgctgtctcgcgacaagtggaaggaggaaaatattaacaatttattatatgatcatgatcaggatgatgatgaagacgaggaggacgatgaagaagacgaaaacaatgaggacgatgacggttacgaatcggaagagaagtctcttaagaagagcaacaacaaggtgcgagggaggtacaaatgcgagacgtgtgaaaaggtgtttcgatcttaccaggctctcggaggacaccgcgccagtcacaagaagatcaagctcaacaacaacaacaacaacaacaacaacaacgaaggtgaactcgaagttcagcacgttgttgtggagaagaaaatccacgaatgtcctgtttgtttccgagtattcgcttccggtcaggctctgggtggacacaagagaacacatgtgattggttcttcaactgctgcaacaaccgtttctgttagaagttctgttgcaacggtttcggttagaacagcttctactactagagttggagatagtttgatagatctcaatcttcctgctccagtggatgatgatgaagaggaggaggaggatgttagtcagttcgacgactcagctgtttcggatgcagagtttgttaaactgtga

SEQ ID NO: 50725 - DNA, 615 bp, Glycine max
  Peptide Sequence Number=SeqID_167503
atgactgatgctcataatgttggagaagttgaagaactagaagatcaagatgttcaaagccatagtacttcttctccctcaaagacaacatcaattctagaacccataatcgaagagaatgccattgaggtggattctacccttgatgatcttctgaacattgaaactgaacagaaccctccagttacaaaagagcaagttggagtcgaagttgttactgatacttctactcccatgccacttgtcgagacaaatattgttgaagaatcaaccatggaagttggagagggtcttcaaagggaaacaaatccattggatgctagccttttttttttattgacgtctggtcttctgattcgatgccatcgaaagcctctgaatctagccacaaaatgccattcactcatttcgatgagacaaggatcaaaacaatttgatccagacccaaaaaggcttccaaaaggcctaagagaaaattatgctaattcaagggccgatcaaaaaaaccaaaaagctgaggcgaagctaatgaagaaggaagaggaacttatggtgctcctaaggccaattcaagaagaactttattccacttgcctcaagcttcaagagctttaa

SEQ ID NO: 50726 - DNA, 360 bp, Glycine max
  Peptide Sequence Number=SeqID_167504
atggctggttgtgagaggaggaatggtggaggtgttattgtgtttgttctcaacggtggggattggggggagaatgtaaatcatgcaagctttgatgatgtcgagaagaaatcacatgtttgtcatcatcaaaaagggggagaatgccacagggtccaacagacatgtggagggggtgggggagagaagaagttaggtgcactaatgggcggtggagatggaaaggtagatatggttttagatatgggtagaaggtgtaaggtggggattggtatgtctagggtatctaaggagaggtttctagaaaggaggttggggatgagccatggtaacgacaaagtagggatatgtgaaccatga

SEQ ID NO: 50727 - DNA, 435 bp, Glycine max
  Peptide Sequence Number=SeqID_167505
atgttgaagatcttaaagacctcgtgttcaaacttcttgagtcacttttgcaacagctccaaatcaagttcgccatgcttctttggagcatatggcatcgccacagcgacaagatttggaacaactctgacccacaaccacaagaatagtgaaggtcgtgccactcctcaatctcaaacaactaatttattttggaagaaacctcaagctcaattcttcaaattcaatgtggatgcaacactttttaaagatcagaatagatttggtgtgggaatttgtctgcgtggagacgaagagaactttatcaaggcaaaaacattcttcaataatggtattccaaatccccgaacaacaaaaacatgggagctacttcaagcgatgaatcggatgacaaagcttcaaattgaaaatgtgattttcgaagtagattgctag

SEQ ID NO: 50728 - DNA, 261 bp, Glycine max
  Peptide Sequence Number=SeqID_167506
atggggatgatggatattgatgccatcaaaaaagaaatggaaaggatggacattgatgccataaaaaaaggaaagggagtgatggataatgacgccatcaaagaatatgaagatatgtttggactcagtagagaattggtggaacttcttggattgccaatctgggaaggcatgaaactagtgaggcaagaaccaagaagatttgctcctaatgtcttagaggctataaaagtagagattgaaaaggctaccgaaggatag

SEQ ID NO: 50729 - DNA, 162 bp, Glycine max
  Peptide Sequence Number=SeqID_167507
atggggatttacatggggattttgaatttgccaatacaacatgcaacaagtgcatctagtggaggttatagaggaatgaggagaccattcaaacatattggtccatctgttgctcccaagatagacaaagtaaaacagtctgacgaaattcctcctttttga

SEQ ID NO: 50730 - DNA, 198 bp, Glycine max
  Peptide Sequence Number=SeqID_167508
atgatcaagagaagagaagaaaagaaaagattcaagagcttcttaccaaaaatttgggagaagaaatctcaagacattactatggagcttggaaaaagaagaaaatggtggtatcttcctccttcaaggtctcacgtatatggagacaatgaaggccatgggggatgtgcaagaggctgctacaaatgggtgttttag

SEQ ID NO: 50731 - DNA, 537 bp, Glycine max
  Peptide Sequence Number=SeqID_167509
atgcctttctctactcccttggatctacaacagttaatgggttttttatgtacttttaatgttgttcttccttgggatcacattaagtttggagagactactcagactgacgagattcaattggaagcacctgaagaaagtttgaactttcaagactgggggccattagactatggccttgagctaagaatgaagttatcggcctatagagaggagatcttatcaagagaagcttcttttcacatagttcgaaggctaaacactcacatgcctttcatgctagggtcacaattctcttgcctagctactcaagagactcaatttcacaaagtcattgataagcatgttctgtatcagaaggccaattgctgcaaaggtaaggacttgttaattgaagatgatgaagatgctccatcaatcagattggtcaaagctcgatgtagtcatgttttcaaacatgagcttaaagctctcaaacaaaagactgagctcaccaatatggattggtatgccatgaagatgttttacagattatag

SEQ ID NO: 50732 - DNA, 444 bp, Glycine max
  Peptide Sequence Number=SeqID_167510
atgcattttattgataatttgtttgaccattgtgacgtgcaagctatcattcgcgttcctattctagatgtatcgagagatgatattcggatttgggctcatactagtggaggtatgtatcaagtgagaagtgcatataaattgatcctgaaaaagttcaccaactatgacatgttgagagtgaatggagattggcggcttatttgggatttggatattcctccaagagagaaggggtggggtgttgtgagagatcacgatatatggtgctatgctactattgttggctgcatggattggatggaagctgaggcttgggtgttgcttacaactatggagtttgccatctcccttggtttgcaacaaggggatttcgaaattaactgtaagactgtggtggataaaattatcaaagttccgttgatcaatctgagtttggtgtag

SEQ ID NO: 50733 - DNA, 303 bp, Glycine max
  Peptide Sequence Number=SeqID_167511
atggcaaaaggttactcacagcagaaaggtatagattatactgaaacctttgttcttgttgctcgtctaaaggcaatacacattttattatcctttgttgcccagcatgccttttatggtttaaagcaagctcctcgggcttggtatgaaaagttcagctcttttctaactgaaaatgggtttaaagcaagctcctcgggcttggctttaagagagaaaaaggaatacaaggttcttggttactgtgatgcggatttttctggagatagagtggaaagaaaacgcaccagtggaggttgttga

SEQ ID NO: 50734 - DNA, 1593 bp, Glycine max
  Peptide Sequence Number=SeqID_167512
atgatgcccgctgaccccttttccttatccacttccatcggaggcttcactcaagatcagcaaaacacaaaccctaaccctaaacctaatgctcctcccaagaagaagagaaaccttccgggaacaccagatccagatgccgaggtcattgctctatccccgaagaccctcatggccacaaaccgattcatatgcgaaatatgcaacaaagggttccagagagaccaaaaccttcagcttcatcgaaggggtcacaaccttccgtggaagctaagacaaaggtccaacaaagaggtgagaaagaaggtttatatctgccctgaacaaacctgcgtccaccacgaccctgcaagagcactcggcgacctcactggcatcaaaaagcatttcagcagaaagcacggcgagaagaagtggaagtgtgaaaagtgctccaagaaatacgcagtccaatcagattggaaagctcacaccaaaacctgtggaactagagaatacaaatgcgactgtggcaccctcttctccaggaaggatagcttcattactcatagagcgttttgcgatgcattggctgaagagagtgcgaggctcacagcagttacaacaacaactctaaatttcaagagtgaagagggtgctaataatgtgatgaactcgcagcagcatggtttgggaggacatggactaattggagcacaacaaagtcttcaaaatgtttctggcattccaaaattcggaccacatagttttcgtttggatttcaatggaatggaacaacaacaaaggccaagtttgtcactatggttgaaccaggggaatccccagatgaatcataataataataacattaatagcagcaatagtacttccaatgtgggacccaattacatgtcagcatgctcttcttcaggtttgcctgagattgtgcaaatggctcaggctaatgctatgatgggttcttcatcgatggtgtccaattttggagttcatcatgcgggttctaataattcaagcagtgcaaatctttcactagggaaaagaggggaagcaggtggaagtactgtagtggacatggcttctatttataacaactctgagggtcaaaacaagaattcaaagcctgcttcacctatgtcagcaactgcgcttcttcagaaagcagcgcaaatgggttccaccagaagcaccaacccttccattttcagtggtagttttggagtgattaactcaccttcctcccaaactaccagtctcaataataacaacaacaatggtgatgcagccatgatgctgggaagtaacactactactactactactgttgctgcaaatgcaaatgatcactttagctcattgacgcattcatcaaacagttttgaccaacttgtgatgcaagtcaatgggcagttgcaaagtgagccagtgaagttgaagcttcattctaatgctgtggagaacaatttgacaagggattttctcggtgtgagtggtggaggaggtggtggtggacctcagtacctttcccaagagcttgcaaagtttgcttccataaattcaccaatggggttgatccaattcactagcaaccaatga

SEQ ID NO: 50735 - DNA, 1785 bp, Glycine max
  Peptide Sequence Number=SeqID_167513
atgatgaacaactcgaacggcatgatttcgaagacgtcgtcttcgtcgaatacggcacaatcgcaacaatcacaatccactggcctcaagatgcatttcaagactcccgagggccgatacaagcttcactgcgataagacttatccttccactcttcttcactacgctcatggcaaaaccgtctctcaggtaactctggcacatctcaaggacaagccagtgcctttgactccgactgggcagtcttcgactttcagtgccaccagtggggtacggtcggcagcagcgagattgtggggaggaagcaatggaggccggtctcttagttttgttggaggcaatggtaccagcaagaaccttggggggaactctaggattggttcaattggtgcttctagttcaagtaattcaaccactaattcaaattttgacgggaacggaacgtacttgatcttcaatgtaggggatgcaattttcataagtgatttgaattcacaagacaaggatcctgtaaagtctatccacttcagtaattcaaatcctacgtgccatgcatttgatcaggattctaaggacgggcatgatttgatcattggcttgaatactggcgacgtgtcactgagacaacaattacaggatgttggtaaaaagcttgttggggcccagcattacaacaaagatggttctgtcaataacaggcaacatttgatccctcgacactgcatggaaactagctctgattcatgcttttttgcttttagcagtcgttgtacttgtattgcttgggtgcctggaggtgatgctgcctttgttgtagctcatgctgatgggaatttgtataacaaagatagtgctggtgattcttcatttgcggttgtcaaagatcaaacacaattttctgtttcccatgcacgtaacagtaagagtaatccaatagccagatggcatatatgccagggttcaatcaacagtatttctttctcaaccgatgggacttacatagcaactgttggacgggatggttatttacgagtgtttgattacttaaaagaacaacttatatgtggtgggaaaagttattatggtgctttgttatgttgtgcttggagcatggatggaaaatatattttgacgggaggagaggatgatttagttcaagtttggagtatggaagatcgcaaggttgtggcatggggtgagggacacaactcatgggttttggtgtcttgtgatttggtggccatggattctagacttgtagtcatagaagcctcttctgaacttgtgttcataaaggtcagcggagtggcttttgattcatattggtcatcacctaattcaaatgatgatgaagagaccattagatatcgatttggttctgttggtcaggacacacaattgcttctatgggacctggaaatggatgagattgtggtacccttgcgacgtccttctggtggatccccaacttacagtgctggaagccagtcatcccaatgggacagtgttgtcccgttgggtaccttgcaacctgctcctagcatgctggatgttccgaaaatctctccactcgttacccaccgtgttcataccgaaccactctcaggcttgatatttacccaggaatctgtacttactgcttgtcgggaggggcacataaaaatctggattagacctgcagctgctgagagccaatcaagcaactctgaaactctgttatccaccggccttaaggagaagcctttaattttgagtaagattggcaattctagccacagacaatga

SEQ ID NO: 50736 - DNA, 662 bp, Glycine max
  Peptide Sequence Number=SeqID_167514
ttaaaaatgaggatggtggtgaagatattcctgaagaagaagctgtctgtagaatttgtatggttgaacttggagaaggtggtaatactttcaaattggagtgtggctgcaaaggtgacctttcattggcacacagaggatgtgcagtcaaatggtttaccattaaaggtaatagaacatgcgatgtgtgcaagcaagaagttcagaatctaactgtcactcttttacgagttcaaaatggtctggcacaaaatggtctggcacaaaatggtctggcacataacatgctaggggctgatgcttctcgatacaggttttggccggattttgccattcttgttgttatcaacatgctggcttacttttggtttcatgtgtctaatatgggatctggtactatagtccattgtctcgcattttcatgtgtattgggttctcttgcaagctttacagctacagtaatggttgtaatgtgtggaaattttattcttacggagattttgaagtggaggggaagatcactggctcagtcgaatcaacaacaaggttcccaagaagcagtaccgccacctgatcaatcatctacaatccctcatcaagctcagattggttctgaacaaactgaaagtaatttgggagagtctcatgcacagaggagttga

SEQ ID NO: 50737 - DNA, 405 bp, Glycine max
  Peptide Sequence Number=SeqID_167515
atgtaccccatctacatatacactgctgcaagtatcaacatcatcaagaataaccgaagacctgattacctactcactcctggacctggcaaatattttcttgtgaacaatttagccaacgataggaagctcgcttctcctgctgttgaagaagcttctctagcgtggggtgtgtatgatgatctacaacagatgaaagatactatggcactgatcgaagctgtgctattagatgctgagcaaaaaagatcgcagaacaatgcgttgaaggaatggctgagatatacaaagcatgtgttcagcgatgccgaagacatagtcgacgattttgagtgtgaagcattgcagaagcgcgttgtcgacactcacggtagcatttcagagaaggtgccgtttcttgactaa

SEQ ID NO: 50738 - DNA, 432 bp, Glycine max
  Peptide Sequence Number=SeqID_167516
atgactaaaatacaaggcccaaaagaaggaaaacctattccaatatttacaaagaaaagtgggctcatacttagcccatgggcccaaaatctacctaaggctcatgagaaccctagggccttctccgacatctctagtccaatcttcttgaagtcttctatccaatgcccttgcggggttacaacattaagagccatcaagaatcttgattcaataactcttgaagagcttgttggaattcttaaagtccatgagttggagcttgctcaagatgaaggaacaaagaaaggaaaatcgctagcccttacaattcaaagaccaaaacacaactctgcgtccaaagcccttgttgttaatgatgcttcaaaagaagaatctgatgaagaagatgatgagctaagtttgatcacaagaaagatcagaaagatatga

SEQ ID NO: 50739 - DNA, 231 bp, Glycine max
  Peptide Sequence Number=SeqID_167517
atgtctacgagatccaccatcacaagaagattttccatcatcctatctatagataatgttgagaacttgtctgccaataggcataattcaaacatggaagctatcacaaagaccattaagcaacaatttctttatctatggccttcatggggagcaatgaaagaccatgaaaaggatgccttcttccaatgcgttacaatttgtaagctttgggactggaaaactatataa

SEQ ID NO: 50740 - DNA, 192 bp, Glycine max
  Peptide Sequence Number=SeqID_167518
atgacgactctttgcaaatccaaaggaaggaaatccaaacatttccataaggattacctaaagtgcaagtcttggttcgaaaagaaaagtgagcttaatgctcgtagattccttacaatccaaaccataagcccaaatgagatggggaataaagtgaaactccagtgtaagcagtcgagacttattgcgtaa

SEQ ID NO: 50741 - DNA, 651 bp, Glycine max
  Peptide Sequence Number=SeqID_167519
atgactcttgacccatctgacattgtttggtaccaagcagctagtgacgttggagagattattgtgagttgtggtgaatatcccaacgtacctctttggacaaaaccaaacaaccttgccttgactaatgaattctatcttaaccatggagatcactcgaacaaaagggaaagattcgcacaagcttggagcgctatccgcagactcaacagaagtcagttgggaaagaaatcagactatgtgcacgaatcttatacccagtgggttattgataggaccaagagctttggtctaccctaccgcttacctagatacctatcgtccaccatcccaccatcatccttgcctatcccctttgatactaaggaagagtttcatgaacaattaaccaaagaaaggcaagaaaaagaaacttggaagaggagatgccaggagctagagcaagagaatgagactttgaagggaaagatagcccaacagagccgtgagctttttatccagaaccagaggatgattgagaaggacgacttgcttcgtcggaaagacgttttgctccaccaagatgctagaaggaagaggaagtttatggacttgttctcccgtgcacattcagattccgaggacccatctactccgggagttcgagtctga

SEQ ID NO: 50742 - DNA, 354 bp, Glycine max
  Peptide Sequence Number=SeqID_167520
atgccatatactatttgtagggatcacgcccacaagacactcagtggactcggaggagcccgactgggccctggggtttacagctctggttacgggcctctgtcagtcctacagggtgcccgtcccccccagcaaggtcatgccatcatgagacaggtctgtgaccgacaagtcatcatgcgtccagctcaagacgttaaagaaacgctactaggaggcaaccaagaattgactgcgaagaagctccccgcgaagagatccaggaaggacaccattgaagaggattctagtgtggccccacaagttgacataggctttgacaaacaccgattccagagcatggaacatcaatag

SEQ ID NO: 50743 - DNA, 111 bp, Glycine max
  Peptide Sequence Number=SeqID_167521
atgaaatcccaacaacaccttggagaccatgatgagcaatccggtggtggcagtggagatcatggtgatagtcatggtgatgaattaatgataatcttgaagagtagtgag

SEQ ID NO: 50744 - DNA, 1353 bp, Glycine max
  Peptide Sequence Number=SeqID_167522
atgagggctcatggcataggagatgaaagtggtcacatggatgatgatgaccaagcaagtgattgggaagataggttgggtggaaatgtgccaccaagcaacaaacgcatgtatgccttaagaacaaaccctaatagactaaagagctgtagggtgtgtgagaattgtggcaaagagttcttgtcatggaaatctttccttgaacatggaaaatgcacctctgaggatgccgagtccttggtctcgtgtcctggatccgatgccgacgatggcggcatcggcagtggccggagaggatgtggctggtccaaaaggaaaaggtcattgagaactaaggttggtagcttcaattacaattgcccatcaagcgaggaagaagaccttgcaaattgtttaatgatgttatccaatgccattgtagatcctcttatagccgagccagaagaatcttgtgcatcggctagcaaagaggaggaacaacgaagaaatcccatgaacttcattgcaccattgtcatacaaaatcaacaacaacaaccagcaccttgttgataacaaggccaaaggggttgccaagggcttgtttgaatgcaaagcatgcaagaaggttttcaattcccaccaagcattgggtggccatagagcaagccacaaaaaggtcaagggttgttttgctgcaaagctagacaaccttgatgacaatatcatggaggatgatgtcatcacacatgaagagttcttcccaacaaaatcaaactccaccctccaatttgaccatggaagctccaatccctcattggcctcttcctctaagagaaaacccaaagtgcatgaatgctccatttgccacaggagcttctcttcaggacaagcattagggggacacaaaaggtgccattggatcacatcaaatgctcctgacacctccacattaacaagatttcaaccatttcaagagcacttggatcaaatacccaaatttgatacctcttctgagcctcttgatctcaaattagaccttaaccttcctgcaccatccaatgaccttgcaagaaggaatgtgtcttcagaattttacttgcggccttgggttgcatcaaaggatgctaaagatgataacaaaaatagccagtgtcaaagtctccacaaccctaataacaatcttgatattgacaatgatgaggacaaaaacaacaacaactcaatgcaaaacttggacaatgaaggtgatagtaagatcaagttggcgaaactgagtgagctaaaggacatgaacactggtggcagttctttgccatggttgcaggtgggaatcggttcaactgctactgatgtggaaactgataactgctga

SEQ ID NO: 50745 - DNA, 3006 bp, Glycine max
  Peptide Sequence Number=SeqID_167523
atgggggtacccaatgatgtcattcaactcaacatgttttcattttctttggttggtaatgcaaagaaatggctatatttttgcaaaggtcatagcttgacaacatgggacaaggtggtggacaagttttttaggaaatacttttcggaagcaaagtttaccaaagggaagacgaagatatcttcatttcaccaattctcgaatgagtatcttagtgaagcttgggacagatttagaggtttgcattggaagactccagcacatatgtttagtgaaccatttcaagtcaacatgttcatcgatggcctaagacctaaaacaaagcaactccttgatgcctccactagtgggaagatcaagttgaagacttccgatgaggcaattgagcttattgagaatagccgctgcacactagtgcttgtgtcaactgtgaggtggcaaccattagagcagacacatccgagtaacacatacaagcaagatgaagggggtgcttctaataaacctcccaatttgtatgaaaaacaatccaagcttgaagacactctcactcaattcatgcaacaaaatgctagaggactctcggccaatgctaaagtcaatcctaaggagaattgtgatgctatattcataaagagtggtaaagagtgggagaaaaataaagatgatgaaaaaaatgataaaaaggaaaatgaaaaagagggtgtggaagctagcgtagatgagcagaagtgtaaaaatcatattgtgagagaaagaaaaaaggttgctaaggaggagtctattaagccattgccttatcccctaacaccatccaaaaatgcgaaggaatcctattttgctaaatttttgaaaatcttcaagaaactagagattaaaattccatttggagatgcccttcaacaaattcctctttatgccaaattcatgaaggagttgttgactaagaagagaaaaaataatgaagatcctggaagcttcacaatcccatgtaccattcatgatctctctattgggaaggccctcattgatgagggagcaatcatcaaattaatgccacttttaatgctcaagaagattggaactttggagatgaaacccataagaatgtctttgcaccttgtgaaccagtcgatcacatatcctcttggagtaatggaagacgttcttgtgaaggtaggagaattaaccttccccgttgattttgtcattatggatattgaagaggatagagaagttcccatcattttgggaaaacctatcataatgatctctaaagtcattgttgatataggggaaattccactgaagtatgaagttattgatgatttgcggaagcatgaggtagtttccaaacccaagcttgaattgaagactttacctcctcatcttaagtatgtgttccttgaagataattggtgtaaatcgatgccctttgggttatgtaatgcctccaccaccttccaaagatgtatgcttgccatctttttcaacatggtggagaagtatataaaggtcttcatggatgactttttcatgcattgtgttagtcataagatctcttcaagaggcattgaagttgataaaggcaaggtggatatggttgaaagattgccaccaaccattaatgccaaggggattaaaagctttcttggtcatgccattttttatcgaagattcataaaatatttttccaagattacaagacctttctctaaccttcttaacaaggatgcaccttttgttttcaatgaaaagtgtggcattgctttcaatttgcttaaagaaaaacttatgaccactctggtgattgtagcccctaattggagccaagactttgagttaatgtgcgatgctagtgattatatggtgggggctgttatgggacaaaagagggacaagggcattttttacaccgatcatcccgccatcaagtacctcttcactaagcccgattcaaagcctagacttatttgttggatcctattgttgcaagaatttgatatggaaatcaaggataagaaggtgtgtgagaacttattggttgatcatctctctagacttgtcaatgaagaggtcacatctaaagaaagagaaattagggatgagtttcctgatgagttccttctcatgggtatagactttgttggtctctttccttcctcatatggccatgaatacatcttggtgacaattgattatgtctctaagtgggttgaagtggtggccactccaaaaaatgatgccaaaatcatgataaattttctcaagaagaacatcttctcaaggtttagggtgcctagagttctcataagtgatgaggccagatttgagaccattgagagatggtgtttgtggctcaagaaaaagctctctttgaatgcaaaggagtttccaaagttggaaagaaacatcaaaaataggaagtgcaagctgggtgaaagtgtcgaggtcaaatttgatgtaaccagtatcaatatgatgttgggaaccactctagatggtccttttgagtatggggagtcgaaaagtaagggaatcaccaagatgatattgaggatatggagcggcttctgtgtgttcttggataaaccacttaccaccaataagtacataaaaagtgagtgttggaacaatgattcaactattactcttagtgctcattctgtgcctagcaagattccttttcctcaacaattaaaggaagtcagaagagagctcaacgaaatcaaggagaagaatcttgccctcttgagggccatttcttttgatgttgctgaaaggaagaggcacatggttgttcaacatcctgataaccagtttccatcccgagaggattttgcagctcatgttgcatggcctcaatcaactgtagaccagtcatttgaggaccaatggggtagttcatcaagaactacagttgaggaaaatgaagaggaagctaagggaagtgaagaagatgaatatgaaattgatgaagaagaagctgatgatgacatggaatag

SEQ ID NO: 50746 - DNA, 561 bp, Glycine max
  Peptide Sequence Number=SeqID_167524
atgaagttggtcacaacattctctacattgacatcactcttgatgccaatgcaagctaccaaagtagcctctcctcaatgtctttctcttgttcctttcttcatgcaaggatcggtcttagcgtggttcaaatggctccatgctaaccatttgttaaccacatggaaggaatatactcaagcattggagttgcgctttgggctctcttcatatcaacttggctccgttactgaatattggaaggagtttgaaaccctatcaaatagagagatgggtttgtatcctgaagcattcttgaattacttcatgtctgggttgcatgttggtattcatgataagcttaaggatgttcatcctttttcccactgcttctctcatacttcgtcaaccacaacaacacccttcattttgggaccatcaccgtccgtgtccccgtccatgacattactaattcaactgatatcctctgttaagatgtcggagcagaaggctaaggggctttgttacaattgtgaggatcgatggagccccaatcatcattgtcagaagaaacaatgttag

SEQ ID NO: 50747 - DNA, 351 bp, Glycine max
  Peptide Sequence Number=SeqID_167525
atggccgaggcagataatgctacacagacactaatggattatctcacccaaaagacatgtgcttatctctacaacatttatggggataagagaatcatgaaaagggaagtccaccaagtggagaatgaagttgctacttctggccttggacaacaaattcaggcattgtccaagcaaattgagagtctgatgaaggatcaatctcaaaaattccatggagaaatgaagaattcaaaagaagaagccatgagagagctttacaggtcactatcacagttattacagagcaaaagtattttcagaatagtgcagattaagaagatacagagcaaatgcatgaaaatcccttaa

SEQ ID NO: 50748 - DNA, 579 bp, Glycine max
  Peptide Sequence Number=SeqID_167526
atgagcgtcatcgacattctaacccgagtcgattccatttgcaagaagtacgacaaatacgacgtcgataagcaccgcgatgctaatgtctctggcgacgatgcctttgccagactctacgcctccgtcgacgccgacatcgaggccctacttcagaaagcagaaagtgcttccaaggagaaaggtaaggcatcagctgtagcgatcaatgcagagattcgtcgtactaaggctcggttgctggaggaggttcccaagttgcagagattagctgtgaaaaaggtaaaggggctttcatcacaagaatttgctgcccgtaatgatttggttcttgcattgccggatagaatccaagcaataccagatggggctcctcctgtgccaaaacaaactggaggctgggcagcttctgcttcacgtcctgaaattaagtttgattcagatgggcgatttgatgatgaatacttccaacaaagtgaacaatcaaatcaatttaggcaggaatatgaaatgcgtagaatgaaacaggcaagtaacttaaagcagttgcgagtggtttgccgttatcttttagcttag

SEQ ID NO: 50749 - DNA, 1230 bp, Glycine max
  Peptide Sequence Number=SeqID_167527
atgataacaaaagatgatgacaaaggtgatgacaaaaagctcaaaggtcaatcaaagaatgagttcaagatattcaagatacaatcaagaacacttcaagattcaagaggaaagttgatttcaagagatcaagatttcaagaatcaagattcaagagatcaagattcaagactcaagattcaagaatcaagagaaggcttaatcaagataaggtacatcctttgtggtacaagtaaaaggtacatctacttgggtttgactgagaacaagagagggtacatctcttgtggatcagttctagtggagggtacatccactaggttcaaagagaacaagggagggtacatcccttgtggatctttgcttttggtggtgtataccaagagtgatcactttcacttatcacccgcttactttaaggggactcactcacctcgtactctacgtgttgctggccgcatcaaggaattagatgtcacaattttggttgattctggcagctctcataatattattcaacctcgcattgctaagtttttgggtgtaccggttgttgctatttctcccttttctgtgatggtgggaagcggtaacacaattcaatgtttagggcttgtcataacatatatgtttgaattggctgaacaagaattctcaatttccatctttgtgttacccatacatgctgacttagttttgggggttcaatggcttcaaacccttggcactttccgcttagacttttctatatctttaattcaattcacctataacaaaaaacctatctccttgattggtaccactcaagctactcccatgtactatagtggtagaagaggtttgaaaccctattttgtaaggggggtaaacgagtttgttgacaaagctcaacaaaacatttattataaagatgatggggggatcagatgtatatgccttaaatgcaattattgtgccattttgaaggatgaaatggtgaaggttcacctttacaaagttggcttcaaactagattattggatttggattgaacacagtgaagagaggccacatgtttatttacatgttcaagatatttgtattggaatttcaagcaatggtgcagatgtggctcaagtggaacaatttatgtcaatgcaaaagatggtgtttgatgctctcaggcaacatgagttagttaaagcacctaagtcaaacaacatggaagagcctccaaatgaagaaacttag

SEQ ID NO: 50750 - DNA, 1071 bp, Glycine max
  Peptide Sequence Number=SeqID_167528
atgacctaccttgggcattttatctcgcaacaaggtgttgaagctgatccagaaaaactgcaagccatttgggcatggccacaaccattttcagctaccattctacgcatctttttgggacagaaaagctattctagggtctacactgaccagcagagccttcgaggcatggtcaaccaagtcattcagaccccaactcaacaaaaatggcttgccaaactagtggggtttaattttgagatattgtacacgcctggtaaggacaacctggtgacagacgcattatctaggatatccgaacctccggaattgttgtttttggctgcaacaacttgccatcctctgttcctggatcaattgcgacagttttatcaagatcattcattgggacaacaaataattagaaaaggaatgggagaaatagactcaaatttcactgctgctactctagctcccatcttcctatctgacatcaatcgactccacgacatgctgcgaaccatcgtgagcgaccatgagcgagtctttggagcacattctggcgcgaattctttggcctcaaaggaacgactttatccttcgacggatgtccaaaccaaggttaccaatcgcaccctcgagacctttctccattgctttgtttgtgattcccctggcaatggggttcaatattttcccttagctgagtattggtacaatacaacttaccattcagttataaaaatgtccccttttgttgctctgtattatcattctccgccctctctctggtcgtacattgccagttccaaagtggttacagcattggactccaccttgtcccaacgccattcccaactccaagttatcaaggataacttagctgcagcacagatcagcatgtgcaatcaggctaacactcatcgccaggatcgctctttcaaggggggtaatgttacttatgactttcatgaggctcatccaaacaccaagacattagacccaatagcctcaatctatctgaagtttcagatgttgaaactgggccaactgagacacaagagcccaagaggggcaggccccaacgagtga

SEQ ID NO: 50751 - DNA, 339 bp, Glycine max
  Peptide Sequence Number=SeqID_167529
atggggaagaagaacacgataggacaccacctagagaaaaaaaattttgacaacatattcaacattctgatgaatgtgagtgacaagacaaaacacaatgagaaagcaaggaaggatttagctttgttagcgaatcaaagactagcccctcttgaccttgctttagaggagagtattaggtctaggtgttgggccaaagctattggtggaaagaccaagggacgactctacagggctggagaccttgctcgtgattatcaaggtggagacagtagcctcacgcaaaaaagcaaagcatcaagtagttttcacttgattcaaaagagattatccagttga

SEQ ID NO: 50752 - DNA, 363 bp, Glycine max
  Peptide Sequence Number=SeqID_167530
atgaaggttaatgggccaaagcccagtgatctgaacgtggccattattaagcttgagggttccagatcttgcaatgaagaactccaacggcgatggcagagtagcgaggacattgctcgaagtgactttggtgtgggctatcaacccgcaaaaaaaacctctgacatcacgctcagagccagtcaatgttggcttgagaactacgttgatggaaacgagatcaagttcgatgggggagactcatctctaggacaagatacagcgtgggtcgtttcgagatatttcaaacgtaaatcctcatatgcaccattttgctatgacagtgaggagtcgggattggaaaatccaacttctaaagggtga

SEQ ID NO: 50753 - DNA, 237 bp, Glycine max
  Peptide Sequence Number=SeqID_167531
atgggaagtagctggagctacatttttcggaccacccagagggtggtgggtcggatggtgaggggtgcttgtggatacattgacagtgtgaggaaccctccactctctataatggcatcggctgggggtccttctcttttccttggcggcagaggatgcggggcttgttatcaggtgcatgcagcacgttggttaaaagaggctattcttcttgttttaaataatatattaaaatga

SEQ ID NO: 50754 - DNA, 225 bp, Glycine max
  Peptide Sequence Number=SeqID_167532
atggcacttgcccaacagagacagtggctgacagtggtagacaacgagattcaactggaactgcgacgacgcagattcgggccacgcgacttccagggatggttcgcactcttcaaggcgcacctaaccttgggttcgctagaagaaaagacggcggcggtggcgggcggtggtgatgccggagacagtcagaacaggatcgtacccgctctgatctcatgttga

SEQ ID NO: 50755 - DNA, 1266 bp, Glycine max
  Peptide Sequence Number=SeqID_167533
atgaacacgctgccaacactgctgacacagcttgccaaaaccggcaaagcgcaaccttcagcggcagtggacaatctgtccgctgctgacaccctgccgcagggatttattactgagctgggcaaccgcctgctgacgctggttaagcagcagggaaatggcgcgcaatccgctgatctggcggcagaaattgacgcgaaaaacgtcacaaaagcgtcattaagcgccctgctgctggcactggacaaaccagaggcgttaaacgcacttttacagccggaaaacactaaagccggactgaaatcagccgatgataatgacaagcgcgcagcaagttcgttaactgccagcgacttacagaatgtgcaggcgctgtttgctatgttgccagcggtggtcgaaaaccgcagcagcccgccagcggataacagcaccgcgctggaaacccggggtgaggcgcgcaccagcttaaacgctgcgttacttaacagttcgctgcaaagtgcgctgaaagaggaacaggcgaagccggatggccagccatcgaaaggcagcgatgcgctgaccagcctgaccggcgtcagccatagcccggtgcagagcgcggccgccagcggcacgccggccagcaacagtggtatgacgctggatgagagttttcagcaggtgctgagcacgctgagcaaaccggaagagcggcgcgagatgctcagcagccatgacagcagcgcgccggccatcagcagcccgctgagcagtaccagtccgctggtcagcaccacggccagcaccagcagcgcgccttccacgccgatgctgaatgcgcagctgggcagcaacgagtggcaacaggcgctgagccagcagattgtgatgttcagccgtaacggccagcagaacgccgaattacgtctgcatccggaagatctcggcgcgatacagatcagcctgacgctggataaagatcaggcacagctaacaatggtttccagccacagccatgtgagggccgcgctggaagcggcgctcccacagctgcgtacggcgctggcggagagcggtattaacctgggacagagtaacgtcaacagcgacgccttcgcacagggccagagttatcagggccagcaggaaggacgtcgcgacggccagtacggcagctttaccctctcccaggacagtgacaacgagataacgcctattgccgtcccggcagccctccaggcgcgcgcgaccggcaacggcgctgtcgatatctttgcctga

SEQ ID NO: 50756 - DNA, 858 bp, Glycine max
  Peptide Sequence Number=SeqID_167534
atgtctgataacgcgaaagctaaaggccgcaaacgttcattactaattccggtgttactgattgtaacgctggccgcttgcagcgtggcaggctatgcagtctggcgaatgatgaataaacacgagggtgacaagccggaggctgccaaagtggagccgccgcccgccccggtattttttgcaatggatacgtttacggttaacctggtcaatcccgacaacgatcccgatcgcgtgctgtacgtaggctttaccctgcgtctgccggatgaggatacccgtcgtcggctgaatgactacctgcctgaggtgcgcagtcgtttgctgctgctgctttcacgtcagagcgccagcgcgctggcaaccgagcaaggcaaacaggccctggttgaacagatcaaacaggtgctggcgccaccgctggctgagattgacgcgctgctcaatggcgacagtgacagtgcggaagtagagaacagttccaaaggggccgatggcgatatccgcccctatgatcccaatacccagcgtcgcgtggtgcgcgagcgtctgcaggcgctggagatcatcaatgagcgttttgcccgtcattttcgtatggcgctgttcaacctgctgcgccgcagcccggatatcagcgtaggggcaatcaagattcagccgtaccatgagtttgcccgcaacctgccggtgccaaccaacctgaacctgattcacctgcagccgctgcgggggactgcgctggtggtgttctcgccgagcctggtgtttatcgccgtggataacctgtttggcggcgacggtcgttttccgaccaaagtggaaggccgtgagttcaccacaccgagcagcgcgtga

SEQ ID NO: 50757 - DNA, 153 bp, Glycine max
  Peptide Sequence Number=SeqID_167535
atgtctgtgttagtgatgagttgcaaattggcaggagatgaagaagggagtccatccacagaagcaatggatatcctacgttactcaaacggatacaccctgttgggaaagtttaccacttccgggctaagcgtcaaatggccgagagtttag

SEQ ID NO: 50758 - DNA, 351 bp, Glycine max
  Peptide Sequence Number=SeqID_167536
atgaagtacggacactccagtcccttaccgtgtccagtgttcgagtgttcgatatgcgtctgtgtccgtgtcaatgtccgactccgacacaacacccgtattacgttctatattttgaacattacaggtgtccacatgttcgtatctgtgtcgatatccgtattggtatcagtgcttcatagccatgttcacaggaaggaaagtcgatactgcaatggaaaattccaccgaatggtctcctactcttgcatcaacttgaagagacggcatctccttctccttcgtcttcaacgattacatgtcattaattggagcgcaaacgatgcggcacccgaagttggtttccaataa

SEQ ID NO: 50759 - DNA, 267 bp, Glycine max
  Peptide Sequence Number=SeqID_167537
atggagatactgaccagtctccggcacacgaacattctgcgtctttatggttggtttcatgatgctgatcgtgttctcttgattcttgagtatgctcataaggcagagctttacaaggagctgagaaagaaggattgtctcactgagaagcaagctgccacgtatattttgagcctcacaaaggcattggcttattgtcatgagaagcatgttattcatagggatatcaagccagaaaatttgttgctagaccatgagataagctaa

SEQ ID NO: 50760 - DNA, 1597 bp, Glycine max
  Peptide Sequence Number=SeqID_167538
atgcctctgttcagcatgatctttggtggcattctgctgctttttgccctgtgcattggactcgccagctactttctgattcagagcaataattccctcaatgacgccaccgatgagattcaggtgcgcatgggcatttctaacagctcaaaccatctgcgaaccgcacgccttaatgtactgcagtcgggcgcggcggcgcgcatcggtgaaatggatggctatcgtgccgatctggcgcgcaccgaaacgcgcattaagcaggcgcgcgagggcttcaaaatttatatggatcgcaaaatgaagacgccggctgacctggcgctcgacggtccgctcaccaccagcttcaacgcctatattgataaaggcctgaagccgatgatcgaatcggcgaaacagggcagctttgaggggattgtcgcgcaggagaccgatgtcacccgcaagctggatgatgcctataatgccgtgctgctgaaggcgattaagatccgcaccgagcgcgccgaagcgattaacgccgaagcggcgcatcagtcgcgcgtcggttttatcgcgatggctgcggcttttgccgccgcgctgctgctggtgctgctcaccttcgtattcctgcgccgcgtggtgatcaatccgctgcgcctgtcggtgggtcgcattgagcgcatcgcgcagggcgatctcaccgcccccgaacaggcctatggtcgcaacgaaattggcagcctgctgcacaacctgcagctgatgcaggcgtcgctggtgcgcaccgttggcactgtccgtgaaggcgcggtggcgatttatcagggctccagtgagatctccgcaggtaacaccgatctgtcatcacgcaccgagcagcaggcttccgcgctggagcagactgccgccagcatggagcagctcaccgccacggtgaagcagaacgccgaaaacgcccatcacgccagccagctggccgccgatgcgtctggcaaagcgcgcagcggtggtgaactggtgagcggcgtggtgaaaaccatgaataacatctccggcagctcgaagaaaattgccgagattaccaatgttattaacagtatcgccttccagaccaatatcctggcgctgaacgctgcggtagaagccgcgcgcgccggggaacagggccgtggcttcgccgtggtcgccagtgaagtgcgcaatctggcgcagcgcagtgcgcaggcagcgaaagagattgagtcgctgattgccgagtcggtggatttgatcagtaacggctcgcatcaggtcggcgaagccggcagcaccatgggcgagattgtcgaagcggtgcgccgcgttaccgacattatggccgagattgcggcagcgtctgatgagcagagccgtggcattcagcaggtcagcctggcggtgaccgagatggataacgtgacgcagcagaacgcctcgctggtggaggaagcctcttcagccgcggcttcgctggaagatcaggccggtaaactgacgcaggcggtggcggtgttccgcctgaatgatacgccggcttcgctggtggctgctgcgccgcagtcggcgctgaaagcgccagcgctcgctccac

SEQ ID NO: 50761 - DNA, 2279 bp, Glycine max
  Peptide Sequence Number=SeqID_167539
gccgccagcgagtggctggcgcgtcttaagcagcaacagattccgctggtggtttgttcgagtaaaaccgcagccgaaattattccgctgcagaagcggctgggcatcgccggtgcgccctttatcgcggaaaacggtgcccgcgtcgcctttgccggggaagcgcagatcgccgaagagcccggtgccgattatcttgcgctctgtgccacgctcagcaccctgcaggcggattttcgcttcaccggctttcatgactttagcgacgcagaagtggcccgtttcaccgggctgacgttgacggaagccagccagagccgactgcgcgacgcgtctgaagtcatcgtatggcgcgatgatgaaacgcggctcgacgccttccgcgcggcgctggcgcagcatcagctggccctgacgcagggcggacgtttctggcacgtgatgccggcgggcagcggtaaaggcgtggcgctggaacagttattgcagcagttgcagcagcaggaaggcacgaagcgcaccacgattggtctgggcgatggccctaacgatgcgccgatgctggagcgcgtcgattatgccgtggtgattaaaggtttcagtaaaaacccggtggtgctgcaacgcagcgatcatcataacgtttaccacaccgcacacgttggccctgagggctggcgcgaaggcccggcgctggataatatcgtcaatgaactggcgaaagtgccctatctggaggagattgtgattggcctcgatcgtgccgatcgcgatcagtttctcttcgcgcgcgaatttttctcgcgcctgccgcagcgccaccgcattttgtggaacgatggcccgcggctgaaagcgctggacgccgagctggataaagagggcctgtcgcccagccagcccggcaaggggcgcaacgtgtggttctgcaccggctacacgctggcctccgaccgctcgcagtgcgtggcgctgcatgactgcgatatcgtgacctatgagcgcggcatgctggcacgtctgctctatccgctggccaacccggcgtttcagtatgaattcgcaaagaaagtctacggccattcggagtatctcgactatctcaccagtttccgctatccgctgtccggcgagtttgccatgcgcacccacgtgctgaacggcatcaaaatccctggcgactgggggctggagattggcgtgctgtcagagatttatcgcaattacaccacgcggcagacctgccaggtggaaatcgcggacaactacgaccataagcatcagccgctggcagaagaggacggcaccggtggcctgaaacgcatgagtaacgatatcgtgcagtcgctgctgcgtaagctggcgacaatgggcgtgccgctcaccagcgactcattccgcgtgctgaaggccacctattatcgcaacgcgctggacatgatggagatctacaaccacgaagccaccatgaacggactgaagtttgatcagcacattgaagaagcggcggtcgagatgttcacccaggcgattctcgacgccggccagtcgttcatcgagcggccaaacgagaaaccgtttatccccagctggagccgcgtgcagtcggcgttccctgatatcctgcagcgcatctatcaggcggcggcggtccgctaccgcctgcagactttctgcatggtaactgccctgctcagtactgcagctgacacctgccgacaacgtaacgctaaaggtggtgctggcgttgaccagaatggttttggccgccagccggctgcggatacgctccgccacgccctgcgcctcagccagcgtggtgtgcggcagcacgatacaaaactcctcgccgccgatgcgtccggccacgtcgtaagggcgcagcgtatgtttgatgacgccggccacgcgcatcagcgcctgatcgcccgcgtgatggccccagctatcattgacctttttaaaatgatcgatatcgagctggatcaccgccagcggctgttgctgctgttcgcagcgccgcgccagcgcgataaactggtcgaaaaaggcgctgcgattaagcaggcgcgtcttccagtcgcctcaccaggcggaaaatcacctgatgcgctagcgccagtaacagcacgaacagcagccacatgcccaacagaaacagcgctacccgccccagctcctgcgacaatccctggcgcaggctctgcacgtgaatcgcctgcatcagctggccgcgctgcgcgggggtcaatgccacatcgtgcggtgccggcagccgg

SEQ ID NO: 50762 - DNA, 219 bp, Glycine max
  Peptide Sequence Number=SeqID_167540
atgttggacttcttcgtgatccaagctatgcgcgtattcaaaatcttgaaaataggattcttcaaaattttgcgcatggggtgctctactgtgaactcaggctcgtttggtcaggttgatgaggaagactctattggaaggggtttggggtgggagctgtatttcgctcgatgtttgcatacaattcgcaacattgaagaatctcagtttgacaaataa

SEQ ID NO: 50763 - DNA, 279 bp, Glycine max
  Peptide Sequence Number=SeqID_167541
atgttgttgttaatgaatttcaggaattcatactttgcaagagttggtggcttgagaacaaatgaattgaacgagttggagcttgaatttcttttcttgatgggtttcaaattgcatgttaatgtgagtgtgtttgagagctattgctgccatttggagagggaagtcagcattggaggagggtaccacattgagagaacactaaggtgtgctgaagagatcaaagcaaagaacatagaagaaaggggttacacacaaatcacgcgtgtaatgttgtag

SEQ ID NO: 50764 - DNA, 207 bp, Glycine max
  Peptide Sequence Number=SeqID_167542
atgaccagaatcacatttttggcaagattctgtattcgtaagttcaaagaaggaggcagatgtatggagggcggtgtgggcatcagaaattttggtgtgtatggaatgctaggaatgagtctgctcttcgagtgggatcatcccaaatgcaaccgatgtttatgtgcacgatggtgggggctgagtcaaaatacattagcgttatga

SEQ ID NO: 50765 - DNA, 393 bp, Glycine max
  Peptide Sequence Number=SeqID_167543
atggttaagtttgtctacccctacacgaccagcatcattcttccagtacagtggcggatccaccctaagtcaattgggggtgcaagtgcacgccctcagatggctgtaggtccgccattgcttcgagatatggtgcacctgcttgcaatccttgaggttcctttgctacgctatcacttgtggggccgtttttggcttttccagtcttcccaagttcccactgattcaaattccaaaagttctgcaaataaaattgaagaagaagctagaggtgggaaatactcaagtcattctcttgaaaaagttgcagcaatgatatgcaacaaaatatcactatacggagtcaagtttgtttctgatttgacatcatgcgaatttggagatttgggttag

SEQ ID NO: 50766 - DNA, 471 bp, Glycine max
  Peptide Sequence Number=SeqID_167544
atgaccattcgaattctcaagagcttccgttgctcaatttcgagcgtctcgatatattatgtcccaaattcggacatccgtgtgaaaagttatgaccattcgaattctcgagagcttccgttgttcaatttcgagcatcccgatatattatctcccccccctttgacattcgttgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 50767 - DNA, 351 bp, Glycine max
  Peptide Sequence Number=SeqID_167545
ggagctggtcccggagcaagaaaaaagccatgcctcaactacgtggttgcctgccatttccctagtttgagctgcccgccctatcggataagaacaaccagggtcgaagactttgattacaaggtccgatatcgcatccgccttggggaagtccccttttcaccgacagaacaagacaaaaacaggcttgcaggccttacttcttactcttacccaggccggggaaaagatgctctatctttcccgatcgacattgttttcagccggatcgagctgcattctattctggttgggaaagcggcgaaagttccattcatccgggattacaatctccatcagccaatgcagaag

SEQ ID NO: 50768 - DNA, 360 bp, Glycine max
  misc_feature (86)..(86): n is a, c, g, or t
  Peptide Sequence Number=SeqID_167546
atgggggagacacatgaaattccccaccacaatctagctgacttcgagccttggctcggatatgccactgaagggcaagcagttgntggtataccctttgaaaacactttggagggccctcagtttcgcccacaaccacaaccatggcattttgcggtgggaagagcccctcctgctatggccgaagagggaaaggcggatcatctaaaggaaaggctcagggccattgaaagaggtgaagattatgcctttgctaaacctagaaaagttgttcctaatacccaaacatggtcattcccaagttcaaggtgctggactttgacaagtacaaggggactacttgtctcaagaaccatctaa

SEQ ID NO: 50769 - DNA, 466 bp, Glycine max
  Peptide Sequence Number=SeqID_167547
atggcgagggcgtgcaaccctctaaaggcgagggcatgtagccctctaaaggcaagggcgtgcagccctctgaaggcgaggacgtgtagtcctctgaaggtgagggcatgtagccttctgaaggtgaggacgtgtagtcctctgaaggcaaggacttgtagtcctctgaaggcgagggcgtgcaaccctttgaaggcgagggtgtgcagccctctgaaggcaaggatgtgtagtcctctgaaggtgagggcgtgtagccctctgaaggcgaggacgtgtagtcctctaaaggtgaaggcatgtagccctttgaaggcaaggacgtgtagtcctctgaaggcaaggacgtgtagtcctctaaaggaaataggttctagtacccaagggtccacccctatgagaaagcaagagattgactcatcaatagtgctgatcatcccaaattcaaaagatttggacattaaag

SEQ ID NO: 50770 - DNA, 333 bp, Glycine max
  Peptide Sequence Number=SeqID_167548
atggtgacatggtgtaatgggccaatctcatcacaagaggctctatgtactagaatcccccgccagtatgcaagaaaagagaacgaagattacgaggatattgcacgtggaattgctaccgggagtcgcaaacagcacaaatctccaagcaaaggtcaatggtcaacactcaatttatatacgaaagtgacactttcctcctgtcttcatgtcccaaacacccgctcaataatctgccaactatataacattgcttttggaggattctgcgatgctacatttgctacattaaagttcgacaataagaaggttaatctccaaggaaaactttag

SEQ ID NO: 50771 - DNA, 645 bp, Glycine max
  Peptide Sequence Number=SeqID_167549
atggaaggtgccaaaccaatgaaaacacctacacatgcttccaatcctttgagcagagacgaatcaagtaaactagtagatcatacaatcaatacaggtcttatctatacctttaatgttgctcttccttgggatcgcactaagattggaaagacatttcataaaaaggatatcatcttgaaggcacttgaagaaaccactcccaagactcaatttcaaatagccattaataagcatgttctatatcaaaaggctaattgctacaaaggcaaggagttgctgattgaagacaatggcgatgctccaccaactaaatatgctaaagttcatcttgaatctctcaagcatgagactgagctctttaatatggattggtacgccataaagaggttttacagactgaaggaatgctactctggtttggaacctgatgagaagccacctgtcgatgcagttcaccatgaaattggattcttcttcacacaccatgtggatcctatcattgaaaaatttgaatgtgatgttgaagatgcttctgattccgtggttgttcaagtgtatgatcctcaaccctcacgcgcttatgttcgtctgcttgaagatgaactagccagaactagagaagcccttactcaagctttatag

SEQ ID NO: 50772 - DNA, 297 bp, Glycine max
  Peptide Sequence Number=SeqID_167550
atggagcttaggtctaccttcaccacctgcttctttctcttgattctcatcctggctctccctcgtttctcaagaggggaatctgaagcattgcatacagagatatatgagattgattatagaggtccagagacacactcttcaggtgttcctcctcctcatcacttccatattggtaagcagcattcaacttctcatcctcaaaaaggctcagtcagaggaaccaaagctttgggcttaagggatagcacttacgatgaaaataaggcaaagtactcaactattcattcatcttga
